United States Patent 7,469,185 (PRIMARY RAT HEPATOCYTE TOXICITY MODELING) - sequence listing, part 2

SEQ ID NO: 2026 - DNA, 392 bp, Rattus norvegicus
  Genbank Accession No. AI137356
tttttttttttttttttccctttaagatttattttatgtatgtgaatacactctccctctcttcagacacacagaagaccccattacagatggttgtgagtcaccaggtggttgctggaaaccaaacccaaatctttcacagaacagcaaatactcttaatctctgagcctcttcatgtttcttaaatgaacaataacccttttgtctactggcccagagaggctggggccactgatctaacgtggacccaccatattgtgctgcacgaggtagcgaatggtctcccggatgccagaactgatgaggttggacgtatagcccaagaaaatggtgcagcctgtgagtgggcggcggctctgagtcaggtcttcgtgatgatcttcatctactg

SEQ ID NO: 2027 - DNA, 480 bp, Rattus norvegicus
  Genbank Accession No. AI137413
  misc_feature (1)..(480): n = a or c or g or t
tttttttttttttttttaaagcttaaataaagaatttatttcaaaatagattcagccgaacttatttcctgttgtctttctggaaaagccagctgggttacaaaactccaagtccaggtttgtggtggagcagcagttacaaatgctgccagtcgatgcccaccagggtctggttggcctcctgcgcgtgtccgatctcctcggtgatgctgtgctgctgccagagcttctggatctttcgaaaccgctcttggcataaatgtaaaggatttcctcgtctgagtccctggtcagtctcnccgtagtcatcaaggtaaggaggagaatnaaaacagcctttggttttgccagctaaaaatagcacctgacattcccgtactctcaggaagatgccggcccagagccgcaggagtaggtgtgtgctgtgcanggcccgacatccctcgcctccagctcggcttggcagcagtaactctgaga

SEQ ID NO: 2028 - DNA, 415 bp, Rattus norvegicus
  Genbank Accession No. AI137480
  misc_feature (1)..(415): n = a or c or g or t
cggccgagcttgggcttggcctccaacagctccagcggggacgagggcggcgtgaggagaccgcgcgtggcagggggagcaagacccagagccgccgccgcgtcgtcgaagagaccgaaagcgccgggagcgggcggcccgtantgcaacgcggggccggggccgccgaagctggggcgcatccagatccgggcgcagcagctccgttcccaggccagccgccggggtgccatanggcggaggggcacccggctccgggtagtanaacgcaggaggcgggggctgcggtgggggctcgggagggttctcggcgcccaggccgtccagtcncatggacaggatgaagtccagcacgctgtttaggtcctcatccgtgctgcncgcctcgggctcatttcgcggccagcgctcctgg

SEQ ID NO: 2029 - DNA, 432 bp, Rattus norvegicus
  Genbank Accession No. AI137488
tttttttttttttttttgagatgctcgaagtttattgcaaagaggaaggcggggttggtgtagggaggtcaaggagaaaaggaagaggaggaaggaagggaggaacatcgagaggagaggagggtaaaataacccggagactttcttgctgttgagaaggtcctgtctccttttcagggtgatgaagcccaccagacatcacaaacaactgcaacaggttcaccggcaggcagcacaggcaatgcctcatattcagatcttcacagttgggcatagtatcttgtacactctggtgaaatggttctcacagcaggagcatcacagccagactggacattctctcaaaggggtacgagttgcagttctgaaggcccctggctttggttgttcacaaagttcagtcctgtttactgtgatccttgcctcgtgccg

SEQ ID NO: 2030 - DNA, 535 bp, Rattus norvegicus
  Genbank Accession No. AI137495
tttttttttttttttttactcgcttttcaccgactttattggctgcggactgtagcgggctcagcaccggtagagttcacttgctcttcaccttctggctctccgtcttcttgggcagcagcacggcctggatgttgggcaggacaccgccctgcgcgatggtcacacggcccagaagcttgttgagctcttcgtcgttgcggatagccagctgcaggtggcgagggatgatgcgcgtcttcttgttgtccctcgccgcgttgcccgccagttccaggatctcggccgtcaggtactccagcaccgccgccaggtacacgggcgctcccgcgcccacgcgctccgcgtagttgcccttgcgcagcagccggtgaacacggcccacggggaactggaggcccgcgcgcgacgagcgcgacttggccttggcccgcaccttacccccctgcttgcctcgcccggacatgctggacccggctcctgaagttccaacaccggctcgctcagttccgggaccctcgtgccgaattcttgg

SEQ ID NO: 2031 - DNA, 496 bp, Rattus norvegicus
  Genbank Accession No. AI137583
ttttttttttttttgatgtcagacacattttattataatcttaatacagtctacataaatttgaactggtatttatttgggttcagttataacatagcataaaaaaaaatcaaagcactggttgtctgaaataaagcgagcaatcgacaaacacacttgatttattttgtataaaagggttaagtttacaaccaaacttttataaaaagtttagcataagtacgtcattacatttcaatgcagaaagttatctctgccactgtacaagaaaactctaattaaagagtccacaaggtttcactcaatatatatatatatatatttatatataaatatatacacagcattcagtaggctcgtgtcaaaaaggccatttctgaccaaagacttcatttaagtaaccgaatactgggtccttctggtattcacgctccacctttgaaaaaaggcaaagtctgcttagattgggcaattccttgtgatttttttttttttt

SEQ ID NO: 2032 - DNA, 415 bp, Rattus norvegicus
  Genbank Accession No. AI137586
  misc_feature (1)..(415): n = a or c or g or t
tttttttttttttttttaaaagggtaaacgtttatttggagttagtcttctggcaggtggtattaaggcccttcaggcagagttcaggagctcctgtatggctgcctgctgctccggactgagttgagctatgcattcagtccacaatcctccagaagtctgtacttggcgaactacattggccaggcgtttggcacaggggtcttcatgtttgatggcctcatgcatttctccttctgcaattatactgaatattttcggtagattggtattatttgggccaagaacaattggatgattactttcaatcaggtcacacaggtaactgaaggtctggacagcttcttctttatcttcatgtanggggagccacgacagccagtgtggtaagacctcctccacattcacgcagtca

SEQ ID NO: 2033 - DNA, 457 bp, Rattus norvegicus
  Genbank Accession No. AI137689
tttttttttttttttttccaagcaatcaaaagatgtttattttttataaagatctgtaaaaaaataatttttcaaatagctttactttcatagagaaaacttcctacagaggttgactaagatttaatatgttcaattgtaccatcattaaataaggtgggacaccatatgaatttcattgcactgggagaaatgcagagcattttatataaagtttacggagcattctaggcaactgcagctgtcttacagctatgtgttcttttggatttggtccaaagaaacctgagtctgtttccagagagaatgaaaaatgtggtagacacctgatcagctactccttcctgaaggatgcacagaagggcattctctgtagatcccactgaatccagttcccaacactgatcttctcttcccttccccgccttagttcactttgggtcccagcctcgtgccg

SEQ ID NO: 2034 - DNA, 590 bp, Rattus norvegicus
  Genbank Accession No. AI137790
  misc_feature (1)..(590): n = a or c or g or t
tttttttttttttttttctctgtgcacacagctttattggatatcgctggagcgtccccaagtggctctgattactggtgtgacaggaggaggtggtgcctcactggagatacagacaatgatggctgacattanatgactggggtgggggcccagcacctanggagagagtattaccatctagtcacgaacactctctgcactgccctgatggagagacaacagccagaccccgtcacagcagcagagggagcggagcgctcttcagcactggggagctagcctggagctttgccattgcctgctgttccaaggtccaacaggactggagcaggatcttccctcaagtccagccagcctgtggggtcacctgcaaagtcccagtgccttcaggatggtgtcttgccaggggtggcccctgtcttctttgatgctcccttcagcagcgcaagcttcttaggcaggctggagctggccttcatcaccacatcatgctcaatcttcttccggattcctacttccaggctcttcttcaacttttgctgctgcacaacgcgcgccttcttgggagcgatgactcgaccgccttt

SEQ ID NO: 2035 - DNA, 495 bp, Rattus norvegicus
  Genbank Accession No. AI137897
  misc_feature (1)..(495): n = a or c or g or t
cggccgcaaaggtttttttttatgaagacagggttttttttttgtttggggttttgttgtttttttgtttttaagaaaaaaaaaacccagctttttaaaaagcttattcaagtgaacctttgttttgttggttttgtttttcttagttggaaagagaggagtccattacacggaaaaaggaagggtggttcattattatgagtaaggctacttcccacataatgggacccttcctctcgtccttttaaactgagaatgtcagtcgtgagcttagtgtttaagcggttgtcacttgcagctgtttgcatgattagtcttgtgtgtcncaatagtttgcttttctgtgccagttcaaaataacatttttgctaagaacacttaaaattaactgataatcagttttgttttgatttacctggttgtgtgtagtatttctgggaccaaaaatttccttaaactactgagcttttanaaaccctcgtgccgaattcttgg

SEQ ID NO: 2036 - DNA, 408 bp, Rattus norvegicus
  Genbank Accession No. AI137930
  misc_feature (1)..(408): n = a or c or g or t
tttttttttttttttttaaggcattgttttttagtatattttccctatagacagataggcaggtaggccaagatagcaaagtatgccaaactctaaaagtagcaacacgtgacaagagcaggttgaatccccaagttcctcatcctcgatcccatgggctccttcctcctccccacttctgtttctttgaggaagcaatgtttctactcctttggggttggtcttccacctanggacctggctttggcatggcagttattccctctggactggactctccctcttcatcagtaccttctggtcctacaaaccagatgacctcccctaaaagaatgtgtttgctttgtgagtaaattaatacatttattcctgctcagtgatgttgtgtcttgctccccttctggagca

SEQ ID NO: 2037 - DNA, 448 bp, Rattus norvegicus
  Genbank Accession No. AI137931
tttttttttttttttttgcagtaaatagttaaggtcagaacaaaaaaacgacctcccaggttctcttctcattgcttaatcaacctgaagcatctttggcctactagtcaacagcaagatggcttgaagaaaaaataaatatcatatacaaacaagtgtaactagcattcaagtctgtcgaacctgtgccttagtgacaagggagacaggaacctgtgtgcatttggcatcagcaagggtcctcacttctaggaaatggagagagaaggccaaagggtaacaacaccttctactgcatatttaatttaagacagaactttcaatagaggcaaagctatccattggcagagtcttgagccaagaaacatcatcttgcaggttctccagtcttatgagaaggatgctgtgggagcaggctggaatggccactctgttagcacagatgatg

SEQ ID NO: 2038 - DNA, 558 bp, Rattus norvegicus
  Genbank Accession No. AI137935
tttttttttttttttttcctgcggagactttccgtttattactgcagtagacaatcctctcaaagtgcaacactaggacatgctgccacagcccctgctccttcccttcccacaaatccctggaaattcattcttgggagcactgacaagtttttctctggatgaaaaagtaccccactgccagtgccacagggaaaatacacagacatgaacaaaagaacaaagagaaaggctcttgagaggagtgggccataagggagaacagcacaaacatcattcccccggtctagcagcaacctattgtgctggtcgccttggctccaagggcctctacctcctgtttggaaaacagatacagcataactaggtggtatctcggcctaccagaggcctgtggattcaaaataaatggagagacttctccagttagcttgaaaaaagtgggtggtttgggtaaactgagtgttcaatttccccttacgctgttaggcagagcacctggaagaacatggggttaagctgctgcctgacagtgagaacccctctattgagcacact

SEQ ID NO: 2039 - DNA, 475 bp, Rattus norvegicus
  Genbank Accession No. AI137941
  misc_feature (1)..(475): n = a or c or g or t
tttttttttttttttttaaatgacttttattaaatccttacaaaacaatacaaaatcctggcgttgacagttggtgggaaaggagtccggaggtcagttcacctggtacgatggagttgaaagtgcttgcatgtcccccactctacaacaggtctcttagatttcagcatggtttgtggccaagccaccccaggatcatgtctcattcacagttaaggggtctgaccacccgtcctccaggtcaggcttggagggacccgggaaatcacagccctgcttggggagtgggggtggggtcaatgctgctcactgcccagtcacgttgcttcaggaacctgcggaggggctgagtcctcacgtgcccaacaggacagctgagtcatactgatggctgagaactcagatgcctaggagtcatactgatggctgagaactcagatgcctaggagtcccccaccctctangggttctttgg

SEQ ID NO: 2040 - DNA, 514 bp, Rattus norvegicus
  Genbank Accession No. AI137991
  misc_feature (1)..(514): n = a or c or g or t
tttttttttttttttttagcggattgacacagggctttatttaagctgtctgtacgaaggaagtcatgtgtgtccctgtcagagtgtgagataccgaggtgtacagtgtacaaaaccaggttcttggtagttacttcacaccctgtggtcataaatgtaaggacacgaacatctgtagtgtagccagccgtgacagtgatgacagcatccgggttcgtagctgtgtctgcttcaaacccttaaccagatgaccagaccttgtatggatctagcagaagaactagaaagtcaaaatatgccacagactacgaatctatagggaggtgactcggtgaccaatccagaggtttcctttttatttaaataaatactttacacttcatgcctgcctgtaatgcagtaccaggagcaagctcagggaattgtgatgtagacagtacagacagtagcagcaaagtgtgtacactgaggtgtgctggagacnctgcagttagtgagggaaagagaagcatgt

SEQ ID NO: 2041 - DNA, 498 bp, Rattus norvegicus
  Genbank Accession No. AI138061
tttttttttttttttttggggtggggaacgggttattttaaggcacattctacagatacccccagcctccacaatgaacaaagatcatctctattaaaagcgtgatttcatcccataagtcccatctgacctaagatctttggtccctttatttacaaagtcatctttttctcacaaccatttcatccatggtcacaaggaccagcggaagcaggagctctgtttggtatcaagttggcactgaggtgccaggggtcaggtttgcacaaggcggtattttgtgtcttgctctggaggatacttgtagaaaagcacgaggcggataaagccggtaaggattcctggaaggttgggcaccgtgatgtatgggtctttgaggcgaaacccatagatagaccaggaggtagaggaaagaagggtggcaatggtcagtgagaacgagagacgctgggttgatttagtctgaatgatcttggccaagtcggccagtggggagag

SEQ ID NO: 2042 - DNA, 393 bp, Rattus norvegicus
  Genbank Accession No. AI144623
tttttttttttttttttaagaaactgagttatttaatgttaccaaggacaatgaacaatacagggtcaagagaaccacaccttaaatttcttaacactatcagttttcgattcaaatggatacacttggtatttatgatgtaactctgaactgtacaagaaataaaatttagacccaccatctaaatataaatagccaactctctaagtactttatgtatgtagtttccctgtatatatgatgtgtaccacatgcatacagtacctgcagaggtcagaagagggtgtccaatcctctggagctaattacagttgttaagtagtcaagtgggtgctggggtcctctggaaaagcatcagcgctctttagctgctgagccatctctccgggctgc

SEQ ID NO: 2043 - DNA, 510 bp, Rattus norvegicus
  Genbank Accession No. AI144741
tttttttttttttttttaaaaggatttaaaaattatttatttttttattacaataaatatttatcaataaagaattaaaccattgaaaactaaaacctactgccttaaagttggggtccatagcagcagacacaaacataaaatccagttgaaaggtcaagggtcaaggtttctagactccggtgacaacagtcaggtcctgattatatggactaatgacggggaacggtaacacagagaatgcagaacccacactcaaacgacccagagtatgctactatacatccaaccacaagacttggaacattccggtgaagtgaagcaggctcagagctctgcttcagcaagatcaagtatctcccagatggcgtccgcaagcacaccgctcccaaagctcctcccagccgaaagagggcctgggagacccagaaacctcaaccccaaagataatagccagcattctcgaaaccagtctttctggctccaaagttcctggtgaaagggacgtgg

SEQ ID NO: 2044 - DNA, 517 bp, Rattus norvegicus
  Genbank Accession No. AI144770
tttttttttttttttttgaatatgacaaatttttaattttaaaatgtttcgaccagcattagcacccgacgggcgcctctacactcgatgccatctccagaagattgtacatgattattccgggttatcgttaaggctaaacatcaaaagtcaggcccccagtcccagtcagaatcccagtgaaactccaggtcccagcagccctgggctagtttcccagggaccctggggcagctttgagtgctgcagcatgttggaggacactggcctcaagcttgcttctcacatgaagagactgactacgaggtagatgagattccaggtccacccagcagcagaggcaggcaggcaccatcgagtgccggcactggccccagagcaaagtccgcttgtatcgaagctgaggtgagtagactcgaagcaccacatctttaagacaggagggacaactgctactttatgcctgtgacattggctcctcaccagtcctccatgctgactgcctgactcctactgg

SEQ ID NO: 2045 - DNA, 588 bp, Rattus norvegicus
  Genbank Accession No. AI144797
  misc_feature (1)..(588): n = a or c or g or t
tttttttttttttttttangaccataaatatttttattaaatgtgaaaatacacgggcataaaaatactgcccatattcattgacatgtgtaagccccagttgaaataattttagttccttttgtattaaaacactaaattgagatggattaagtcaggtttgtaccatttaaaacaaatataaaggtaagagtaataatttatcaaacgtctctaatgtttacctcccctgtgcccacatctctttgcacaggtatctcaaccacagacagtgcaatgaaacctgtcgttactgtacacagagccacgcagtggctaattttactcttaaatcattcagcaaatgagatcatctattaaaaaaaaaaatacctcgcccccctttaacatcatttgaaattacagaataaatgctgccactactagaaaaggaatgatacgacctggaagaagatcagattagaggttaccatttcctctcctccctccatcactacggcaaggtcaagtacattcacgaaagccgtcctcactcccgttacccagacgcatctgtaagacagggcggcacacgagggcctgcacagc

SEQ ID NO: 2046 - DNA, 488 bp, Rattus norvegicus
  Genbank Accession No. AI144832
  misc_feature (1)..(488): n = a or c or g or t
tttttttttttttttttagttaggaaaattcctttactatttgtgtccacatgattgttgaaaaagcgaacagtagtaacgtctactttggtaaaaacagtccccgatcttggggggctacatcctctggacgggctttattcccagtatatcgaagcctttggccatgacagcagctacggcttcacacaggagcatccgccacatgttcaccttcagcactttcccagtctgccgatctttctccacacagtagcagctgtcatagaactctgtgaaagtggttgctagctcataaatgtaatcacacagagtgtggagaaacaggtcatctaagatcttctgtaggatttcggggaaccgtaaaatgcaccgtcccagtttccactccttctcgtggtccaaaatgatcttggtttcncgagctgctctctgcagcatttcctcatcgatattggccaggcgtgcaatggacctgattctggtga

SEQ ID NO: 2047 - DNA, 471 bp, Rattus norvegicus
  Genbank Accession No. AI144858
tttttttttttttttttaaaaagaaatttactttattacactaaaaggtaataagactcataacatttccacacagtcacacaactggaaatgcaactgcacaactaccatacagagagaataatggttcatgttattaatcaacaaagaatcagacgtcaaaacagaatacaactttcacttattattatgggactacagagtttcttttttggtattatagttttttaatataggtcttttgagtttcttttctaagtttaatatgctatcatagcaagcaaagagaaaacagagctgtttttgatgacttggtactgagaaattagcgtatgggaatactttaaaatatataaaaacactgtattcacaaaattgatcacagcactattcgtaatactgaaaacttggaaataacctaaatttctaacaactgaaagaacgttgagaaaattacaataaatcaatgca

SEQ ID NO: 2048 - DNA, 549 bp, Rattus norvegicus
  Genbank Accession No. AI144919
  misc_feature (1)..(549): n = a or c or g or t
tttttttttttttttttcaaaatatattagatttggtttttattgtagagcacacacatattagggcaaagtgctgcacacacaactacaaatcatttttgggaaaagaacagtaaaaaacaaaagaccaaaacaaaacaaaacaacaaaaacaaaaccaaaaaacaaacaaacaaaaaaaaaatccccaaaaaaacaaaaaaaaaacaaaaccaaaaaaaaccaaaccacagaagacctgtaattgctttagttatgtagtctcaatctgagggctccacactggcaaaggatttgaccccaaagagagacttcctgatggttggctgttcccatatctctgcagccactgaggcctgagggacagacctctgcatttccagaatggtggtagcagcatggctgctcagaaggcctctgctttctgcaggctctgttctggcctggctgccaaagccattcctaatgaacctggatcagcanaaccccacagccctccaggatctaagcagacacaaactgttaaagacttcacccttttttttccct

SEQ ID NO: 2049 - DNA, 512 bp, Rattus norvegicus
  Genbank Accession No. AI144936
  misc_feature (1)..(512): n = a or c or g or t
ttttttttttttttattgtatcataccaaagtttattgattacatcaaagaaaaatttctgtaatgaaaaaggcaagttgcattcataaaagatggcattcatgttcattttagaaagcaacaaagtagatgtaaaaaactgcttaagtgaaaaatgtaatatcgcagttccattttataagctgaaaaatgattttatcaacatttgcataaaatctgcactttatatactgcatgttattaaaaaattccaccactaaattatgacttttgcaaatttaggcttacatttatactgttgctggtgtatatgtagtagatatggaatggatatttttttgtttaataggcaacatccttaaacaatagacaacaatttggaaaattacagacattttgacagctcaaaaattattattcacatcatagcaatacggtcctactgttagatttcttgccatcttctgacataagagtagttaanatatagtgctaggaatgctggatggctc

SEQ ID NO: 2050 - DNA, 525 bp, Rattus norvegicus
  Genbank Accession No. AI144958
  misc_feature (1)..(525): n = a or c or g or t
tttttttttttttttgtccgtcaccaacgttttaataagagatgagcgcacaacgcacatttggctcccttgcgaggtgtccatcaagcaaagcggccagtttcctctggcctttgattggggcctggccatctccttcctccccctgcgtgcttctttcctgaatctcagaggggcggctcgtgcgttccggaatccgggagtacacgtggactgccttcagacctaccttcctcctgaggccaagacaacagcctcctgtctccctctgagatgggctttcctgatcctcgagccgggacatcctcccgggacccgcctctgtaggaccagccctgcccttgacagaggagcaggagagaaagcagaggcagagccggaaggggcaacaggttctccgtcccaagacttaatgggccggcacttggtgctttgccatggagatccctaagctcatgccgccacctacacacagacgagtctggaagcctgaggaaaccgggactcgctatgtantggggctga

SEQ ID NO: 2051 - DNA, 453 bp, Rattus norvegicus
  Genbank Accession No. AI144965
tttttttttttttttttccccttggctacctgggcagctttgtgctgccgcaccagctctgtgaggttggccacatactcatctgtctgctgcaggaggtaggccaggcgcttgtccttcttctggtcaatgagcttgcggtagccctcctcgtcttcagcctacaaaaccaaggcagggtgaaacacagtcttgtgggtgtgtgtgtgaggactgcagaagctcactcatgactactactgtaccactgcctgacaccatgctgaatctcaagggcactgccagacaatgcaggtcttttcatgagccattcacacagggcagcagtggcacaggcctttactcctagcactcaagaggcagatgaatctcggtgagttcgagagcagcctcagtctggtctacagagtgagttccaggacagccagagctacacagagaaatcctgtctca

SEQ ID NO: 2052 - DNA, 499 bp, Rattus norvegicus
  Genbank Accession No. AI144981
tttttttttttttttttacttgttacattattttattgcatttgaatgatcctgctctgcagtgaaggcatctaagacgccattaaattaatttcaaatttaccaccaatacacatatacatggtataagaaaagacacagacccttttcagatcccaagtctgtaaacataatttccatatagtggctaattcacaaattaaactctcttacaaataaaatcttttttcactgtgaatcctgaagccagtttcctctgttaccagtggactgtggagctttgagaaaagagctttctttgtaaatagtccaccaactcaagtcttgatgtaagcagctccagctcatgatagggaacctgaacaacctggtaaccaagtaaccgcaggtgtctttgtttaatggcctcctttccaagtaagtgtttactgcccaagcaaaatcgctgtgggccatcaatacacagggccacccttgtatggacatcctcatccactgt

SEQ ID NO: 2053 - DNA, 563 bp, Rattus norvegicus
  Genbank Accession No. AI145081
  misc_feature (1)..(563): n = a or c or g or t
tttttttttttttttttacttttctatcatttatttaggaacatgttttacatattaggaaaaaacagaaggcaacttgatctaataatttttcaagcatatttttgttctaataatagggggaaaactctctataaagaaagttaagtccaggtgctataaaaatccttagcccttcacatcacaataaaggatgtatctcggccaatttgttacctccacgcacataattagacatacagcatgcatggtactcttagctctatccccagccctgcagcacaacanaggaaaagcccccagattaaaaaaaaaaaaaaaaaaaaatccaaaactgggcttaggctctttgcatttaaacaggtaagatgcaagctgcttaaaaactatggcatattgaaaatataacctctcctgtatatgctgatataatttaaaatttaaaggtgaaaacatacatttactaacaaaacacatccctatagaaaatgtttatatagtggaatactgcctttcagactccatttgcatcagtaacaatagtgactgactctagtccaagg

SEQ ID NO: 2054 - DNA, 443 bp, Rattus norvegicus
  Genbank Accession No. AI145095
tttttttttttttttttatttgcagctgaatgtttattgcagcactcccaagtgatcactgttggatgaataaggaaacaattcataaccaataaaaatgttgaactgccttttttacagtaattgtacactcattgtgcttagtctgtaaagttgtatcctcagctcacccataaccttcccagaatagaacactctgtcatacattaacatagagccttcaaaaggtatacacaaggctcaactctgcaggccataccagatgctgtcccatccactagacagtttaagagggacacagcaagggccatgcagaccccatctcaaacatcccagtactaatactctgtatttgcttcttgtgtctgctttttctgaacatcaccacatccagttttccttcgcaagaagtctcctctcactggccatgcatttctgctcca

SEQ ID NO: 2055 - DNA, 436 bp, Rattus norvegicus
  Genbank Accession No. AI145238
tttttttttttttttttcagtattacaaaatgcatatttgtcttaagatatatctcttttacatacatgtgtgcctgtgtgaatgtatgtgcaccacatgcttgtagatatctagggaggccagaaggtgttacgattccctggaattagagctgcagaaattagtgagccacctgataggggctgggagcagtgagtgttcactaacactctgtccagcccatttggtttctttcgatgtaccttccagaccctggacacgggtgtgcactgccatgcctgggaaacaccctggacacagacacccgcctgcccgtaagcaggacgttagctcctagattagtttagagggaagaactcctttagtggactcacagatgattcattaaataccctgagaaccaaagtggatcacattttttttttcaatagttac

SEQ ID NO: 2056 - DNA, 514 bp, Rattus norvegicus
  Genbank Accession No. AI145332
  misc_feature (1)..(514): n = a or c or g or t
tttttttttttttttgtcaacataaattttatttatttaaacagaatttgacacggcaccacatcagtcatccagggctacactgaggaactgggtttgtagtgttcttttggaaaaagaccacaacacaggcagtgttttttcctgcaaacagaaggctccttggttcttgaagattatccaaacttgccatgtccccaattcatcattcacagcaagaagagccaccaggtggaaaaactgttaatttattgattcaaagtttgttttttcttctaaaaagtccccaatacatgcagttcagggtcaagtgtcacatttgtagcacattgttggtcgacacaaaagtatgcgtctgttgtataatccgaccttgctaggttctacaaccgagaacgcccacatggcggcaaaagcaagcactcttggccactcccttgcccactgtccgccggtggggcttgtttttanaggcagaacacagtttcattgattgaactccctgacaaactca

SEQ ID NO: 2057 - DNA, 465 bp, Rattus norvegicus
  Genbank Accession No. AI145343
tttttttttttttttttaaaagatataaagtttattttggtctgtatgcctgagggtcacatggatggcatggtgaccacattcaagtggtagaaaaagcacgttctcctctcaattgctactgaagcaggtgtttaagggcacaatgaaaaggagacaattttgctaaaagtgaaagatttttaaaaattgtttaggcacagtctggaaggagaagtgcttaagttcaaggaaactaagcgttcagggacctacaagtaattacctaccaaggttaagataatttttcagccaggtcttggcacacagccaggacagcactgaacaagattttacggcatcaaccctgagtgctgggattactgatgcgcactagcacacaaagattaaaactgcaagcccagtatctcacatgctgctcctctgactcagctcagcgcaggcccttatgtattaactgcaact

SEQ ID NO: 2058 - DNA, 465 bp, Rattus norvegicus
  Genbank Accession No. AI145368
tttttttttttttttttaactgacatttggttttattgtgccaaggacattacagatggtggatcttgtcaacacctgcagtgcacgggtgccccatctgctgaggctgctcccactccctaaattcaaatcttgagtagtggccatgatttctgaagacaccccacttcaagcttccaaacagattagcggtggtggaaggcaaagcgatgcagcaaggtcagactgtcactgtccaaagccagtctgccacccgcatctcctgccacttccctctggctcatatccttagcccttccaaggaattgggggccgaaagacagcagaaatccatctccttcttgccctctatgccccatggccaacctgcccagttccaaagcagaatgtcatcttcacagggccagcgttgctgtgtacattggttttcatttgttgattttgtgagataaacctcgtgccgaa

SEQ ID NO: 2059 - DNA, 451 bp, Rattus norvegicus
  Genbank Accession No. AI145384
tttttttttttttttttcaaggggaacacaaccggctttaatgaactgtcagtcagtgtgggggtcagaagtgatgtcagtggggaacagcttctggaaccggccataggcggcctgggtgatgacgactgtcacgtgggccgcaccgccctccggaagctcctgcacctgctgcaccacggcctcattgtagagccacctgcacgacacaggagaaccatcgccagacatgctggaaagcggtgcgggcgcgggtcggccccccacgcatgactcacccaagctggggtcccccgaggcgcacgcgtatcgtgagcagctgcctgccggtggcgcgcagcactgacgcctccagggccgccttcagctcgtccagcccacgccctgagactgcagataccgccagggctccagagcatggcatggtgtgcctgccgcctcgtgccgaatt

SEQ ID NO: 2060 - DNA, 556 bp, Rattus norvegicus
  Genbank Accession No. AI145385
tttttttttttttttttaactcttcaaaaagaacacaaaactttattaagatcttacactgtcatcagatacagccaaagaaaagggtttataaaagacggagaatccccttctcatgtgctcctgccatctgagactcgatggcaacgaatgctgtgtataaacaactccattgagtaacccagtgttccctttctgtacagagaagaactgaattcacactgttaaaagccttttctggcacaactgagaagcagggctcatctttaggagtaactcctaacagctagtaaagcaatgtgggactttacgttacttcacatcctgtccatttcagagtgggaattcaggaaggccctcctaccttcccagtcactgtcctctccagacttctcagaccgtacgtgagccacacaccatgaagctactcatgacagtggcagcagacaacattctctgaactgacaatcatgatggctggatcatcctagactttgttgatgctaaaggatttcttagagaaaaccctgattcagaatgctgtgagcagctgtca

SEQ ID NO: 2061 - DNA, 455 bp, Rattus norvegicus
  Genbank Accession No. AI145451
tttttttttttttttttcaggaaaggaacaggcctttattctggatatggggggttggcctcagtcccccagtaaaataaaggcctcctgcacatgctgccggacaacacaatccaacaaagtgtgcacatcccgggctgcctgggcagcagcctcgagcacctgctccaagtggtcttcatgcaacctcgaatccatctcaagcagtgcaatctggccaaaggctggcaccagggccagggctatctggggcccgccagctgcttcctccacgtgactgaggtccgctagtgctgtgccatccacaaaaccagccgaacatgcacacacaaagtcccgcatgggtatcccagcatccatcactgctagcgtggctgcattcacacatgctgcataggtcccaccgtctgcttgtagcacctgcacataaatgtctatctgagaacgtgggtgca

SEQ ID NO: 2062 - DNA, 480 bp, Rattus norvegicus
  Genbank Accession No. AI145455
tttttttttttttttttggctccaaactttgcattttttatggtgggcagtcatcatttgctccaacagccatctgaagccaatagtcctgattactgaaaacaacaaaattgtacaagtgctctcctcctttgtggaagccgtgttccttctccctccatgcaacggggctgtctgcaaagccttgaactgtcaaggtgacccatggagccaacttcggttcatcaaagtagtgacacagctgttccagaaggacaagtatcttctctggcaacacgaaacctgtgattgtacacagacaagcttgggctgccactgtgtttggctgtggacagcagtaggttgatatgaaattatgaggttcattatttaggtccgcgttgcagaagacggcaccaagccagtcgaagaactccagggcattgcaggcctcctccggctctcctgcaaggctgctgctctgaagcactgggcactgca

SEQ ID NO: 2063 - DNA, 567 bp, Rattus norvegicus
  Genbank Accession No. AI145556
  misc_feature (1)..(567): n = a or c or g or t
tttttttttttttttttcatcaaacacagattctttactttgtaaacctcttattagggttatagagttctgcttcttacatgcaaaactggtaaccaagtcaggtaaagaaatacttatagagagagagttctggatgatatctttcccctctagttcaatgtgctaagactgagacagaagcagaatttgtttctgtcaagggcagggagggcagggagggcagggagggcaaagataggacctcactaggtaaccctggctaacttcaaactcagagatccagcctgccactggcctaccaggttctaggagtagaggagagcgccaccacacccagtctgttttttgagacaaagtctactatgtaagttcagattggcctttaactcaaaaatcttcctatagccacctccaaagtaccaggattaaaggcatgggccaccatgttttggatgaccttgagctcctgatcttcctgcctgnggtctgaactcagagctttgtagtgctaagccataactccaagtctataagccttcatccttgantcactgtgtatattaa

SEQ ID NO: 2064 - DNA, 563 bp, Rattus norvegicus
  Genbank Accession No. AI145586
  misc_feature (1)..(563): n = a or c or g or t
tttttttttttttttgtcgtcatgggactttatttgatgccagctccaagatgagtggagggctactcatgcacagccttggtctcttccagcagacgatactggctgggcgtcagggagggtgcacagagggtttgagtgcctgcaaattcccctcatgaagtgtggagagccgccatcactgacaaccttctagatggctgctggatcacacagcattatggggacagcctgggctcccccatggccatgctcacagtanggccgggagatcctgtcctgagccaggaatcttactggggcattgtgggacaagcctctggccttgggggacctcagctgcttggatcacacaaagctgggggacttcacgcgtgctcagtgcacatgaagtgtgcaagtcactggggttagtcctgtaaacacagcaacacaggcacagaatgggaaagacacgcctccagaattacacagcatagctggggtccactcggtcctctagcactcaagggagatcacattatggtnccaggctcaccatgctgggcgtcaccctcgtgccg

SEQ ID NO: 2065 - DNA, 558 bp, Rattus norvegicus
  Genbank Accession No. AI145768
  misc_feature (1)..(558): n = a or c or g or t
tttttttttttttttttccttctcactgtcatagccttgctcctcttcatcataatcccgagtcacctgtttgacatccttgtcactctcagacttcctttctcgttccttctccttgtctttgctcctcttcttcttacttgctgatcgctccctttcatctctgcttctttctttgtccttatctttcttcttctcttttttatgtctccttggggatggtgagcgggacagctttcttttangagatctgggctttttangggaccttgtaccactcctacttcgccgtcgtcttctctctctagaatcacaaatgtgcaaactgcttgcactccgagagcgtctggctgtgctgtagctttttggtggagttttggaacgttttttttctttatcttctttctttttgtctctggctttggatgtgctccttgaccttctacccctctctctcgaatgagatcgtctccgtcttggacttttggatctccttctactcctggacttggagtgtgaccgcctccttgtacggcttcgtgaccgcctgtgcctgga

SEQ ID NO: 2066 - DNA, 387 bp, Rattus norvegicus
  Genbank Accession No. AI145801
tttttttttttttttttaaaaaatattgctgtttaattttctagtcatgtactttaaaaagccaatacaattaagactttcagttatctttcagctctgcccctgaagtcacccacaagcagctgcagaagcacacaggacttgttcccatggtgggcacatgtgaagggcattgggtatctagaaatgggaatgcaagcctgtgtagctgacaggcagcctctgccctgacagtcttaacctgagggtcacacggcaccgaagtaataagcactcgaggtctgccttctgcccttcctctgcccttcctgcctttgcctgtctgcactggtgggtctgttttctcccgaggttgcccatcatgaaaacttgatttcttggcatctg

SEQ ID NO: 2067 - DNA, 482 bp, Rattus norvegicus
  Genbank Accession No. AI145853
  misc_feature (1)..(482): n = a or c or g or t
tttttttttttttttttgctcttcaatctgtgagattgctttattgtacaaaagtttccagtaacagtaaattaatttatacaaaaaaaaagtcgttttggatggaagcatttcactaattgctttatttaagcatacaagggaaaagtcttatctgaccaattaggttgaagggttttattacctttaagaagccattagctgggatgaaacgctgcaagcacttgtgtcaaaacaaataaataatgctctctcaattagcagagaaagtggtacatctgttaaattagacacacattgcttcacacagtggcccagccagcaccccaatgtccccccacccccaacaaacaaaatgacagacagcaactttaagctagtcttaggaaagatcggggccccgaaggaccaacagctctttccctctctccttccaccccaactctacaagagccagcagggcagcanagggaggtggtgtc

SEQ ID NO: 2068 - DNA, 480 bp, Rattus norvegicus
  Genbank Accession No. AI145870
tttttttttttttttttaagtgacacaagaaatggtctttatttggaaaacgattacaaaattatcatccaaactcagaaggcacagccaacacatacacacaaagtaaacaaggcaggactgcagcaatagctcacttaacaaaattttatctgactttgggtggaggaactttcccaagtaaaaatcaactggagtgctctgtacaaagctttcctaatgtctaatctcattaatgaattacttgcctttgcagcttttaagtcttgagctaagccttcagaatgatttattgaaaagtcttattcagttcagttttagagaagaaaactacaacttctcaaagtttagtttaacacggtctcctcttggcaagcattagatatctttagcttgactgttcctatttccccctctgtcccagctcttttagatcacgttagttatttttaaggatccatcttttttgacatgtctagc

SEQ ID NO: 2069 - DNA, 530 bp, Rattus norvegicus
  Genbank Accession No. AI145892
tttttttttttttttttcctaacaaaaccatctttattgcaatagtacacagcagatacaaatgctttagcaaatccacactcagcagcctacagcgtaaatactagcttaacttaagtttctccaggaagaagatacctactgtgaataacttaaaactaggaaccatcattggtcactatctactgtaataatttacaacatgaggaaggacattagcgctcgcgcaggctgacacatctacagcctgggctcacagcggcgactgagcagccttgcacactttcctcttggccacctctcttctcgctggggcccacagccctgcacagtgctctagggttacagccactgacctcttttgtgttcatctcagctcgaaagccaggtctgctgtgtggggctgctgtggtgtggcggtccagcactgcatagtctcgagtcctcaggatgcacagtgagacctgatctcatagctgacggaggcacatctggaatctctgccagctcaccccagcgaagaaaacacg

SEQ ID NO: 2070 - DNA, 380 bp, Rattus norvegicus
  Genbank Accession No. AI146008
ttttttttttcttttttaaagatttacttatttatttcatttcatatatatatatatatatatatatataagcacactgtagctgtcttcagactcaccagaagagggcatcagatctcattacagatggctgtgagccaccatgtgattgctgggacttgaactcaagacctctggaagagcagtcagtgctcttaaccactgagctatctctccagccccaagatttgtctttaatgtactctttacagttttaccgtctgagctatgacatttgttgagccagattagcaaactgaaatgagaagttcattacagttctgcagaagggtggtgtaccaactcctgcacagtcctgttcagtccaggcttctgtcata

SEQ ID NO: 2071 - DNA, 483 bp, Rattus norvegicus
  Genbank Accession No. AI146033
ttttttttttttattttcacttattttacttttagtaataaattttttctatctcatacatgattggacacatattttgcttttaaaattaacagtcacaaagaaaagaacagtggtttatttttgcaatcatggtgaccacgcagacgaatcttaaggcctcaacaacactgcatcttaccatttctactgcacagaaaggccttctgttttgactctttctggtgaacagtgattttttctccggtggtttccgttggccaggtagtcatgacagatgatgtaccacggcgcttgctgtgtcaggggattctccaccagacgaatccttgttctgactgtgacagctgctggcaatctctcagtgcaagtccgtgcctccggcctctaccgtggttggcctaagaggcctgctttggctgccagggcttcattctcttcaggtttcacctctcttgttgtgaagtctttaacacagtccaa

SEQ ID NO: 2072 - DNA, 511 bp, Rattus norvegicus
  Genbank Accession No. AI146154
tttttttttttttttttagggttcttattttttatgtcaatttctcatgtttacacaggaaaatacttcatgtaccaacatagtaagatgggtgaacaaatagggaatgtatccagtgtgaaaaagactcacacctgtgcatccaagttccatgtgcctgtcacctccacacccaggcttatggtgacagtacaagctgctctgtgacactcaaggcttcaggtacagtctcctcagtaggggatatcattctggtagtacttgtgcagctgggaacctcggttggttttcttagacatgcctgattttttggagatagttgacatgccactggagagggggtatgtgttgatccatccctgtgtagcctgttgtcgagagcccacagttatatccaagttgcttcgggtgtcctggttatctgggggaacgagttggctggcagtcacgtacttcttatctgagaacatggcagtccaaaacttaatcatgatgcttatatcttcacgca

SEQ ID NO: 2073 - DNA, 520 bp, Rattus norvegicus
  Genbank Accession No. AI146215
tttttttttttttttttcatgtgaagcaatttattcaacatttattaaatgctcatataccaaacattatgctatagagatgccaaatgaatgaagtttctttgcctgcccctgaggagctcacattctagtaaaggacactttaaaaaataaaatatacagtacaataagtgattcaatagaggtaggttgcaactataatggtgaccaaaggaagggccagggtaattaatgtcacagagtctcaagaacgcatggagtttcccagaagaagcctagggctctccatgcaaatatggtgtctacgaaggtctggagggctacaactctggacttctggaaaactctttaacactcttatcagagcagagtggcaaacacaagaggagggtcttagataccaagcagagactctcaccaaaaagctcctaaaactgcctgtagcagggatgaggctgaatgcttctagaaagcccaattcggtaatctgggccaacagagatgggaaaatatacacagg

SEQ ID NO: 2074 - DNA, 392 bp, Rattus norvegicus
  Genbank Accession No. AI146259
  misc_feature (1)..(392): n = a or c or g or t
cggccgccccagcgcccgaggcgccgggccgaggagggcccggggaggggaggcggggccgggcggctcctcctcgccgggaactcgggatgaccttggccgagtcgcccgggtgggccgttttgtggttttgcggttccgtggcgggaacctcacggaggagcgggccgtttgccgggcgcctcgctgagggagggcgaanaagaggcctcctgaggcctcctaaggccccggtcgggctganggcgggctctggtttttcttctctcanaactccggtgtaccttgaggtgactagcatgcagatattcgcaccctgacttggtttggctgcctgactactgacatggcccaccggggtggggagagggacttccanacttcagctcgtc

SEQ ID NO: 2075 - DNA, 488 bp, Rattus norvegicus
  Genbank Accession No. AI168947
ggatttggtttattgtcgggatacacaggcacaggcacctgcgggcgcttcagtcactcgggggactggcgccccccacggaaccaaggatgggcttttataggattttggggagcaaaagcaagcattcaaaagcaaatgcatggttacagggatataattgggggattctaatatggcaagggtttaacccgggggcaagtttcctagctaccttcctgaaacataacggctgactcggccccccaagggttcaacccgggggcaagtttcttaactaccttcttggaacataactgactcggccccccaccagggtgtgggacctttcccggggcttttctcattgtcaggtgctcaactgcagtcgtcctgttgccaggccttcaaccaaacacatcctgcttggcagccgctgtgtactcagtgttctaacctttccctgaaccagtcattttaagtacagccttgcaaaatggcctcgtgcc

SEQ ID NO: 2076 - DNA, 639 bp, Rattus norvegicus
  Genbank Accession No. AI168950
atccattatgatttattctctacaatacttcattcaggactctgatgacttgtactcggcagttagagagagccaagaggcaagcaactgtaatacaataattgatctgaaatctttgcagtgaaggccatgtaatctcttcagggaaacaaaaataaaaataagaataaaaggttttctagacttctgaaatctcaatgaaaagcaacaccattagtgaaactgtagatgttaacagagcatggaaaacacattttgctcaaaatattaaaattaacacccaagacttttgtatagatgatttttttttattataaacagtaaaatatatatgtctcaactacaaacccttcatgtggaaagggtttctaacatgagttattttaacattatgaagcgaaaacgttttttaagaacctcacagtggaaacaacccaacactgacaaactctagtgatcaaagacattcgcttttagctcaggaaaacaaggacaattcataattacagagtatatgtcctagctgtgggtatgatgagacaagccaactttccagaccaaaaggcactcacagctagggatgaaacaaattctaaaccaagccagcagagttcaactggctctttgagaacagtggtg

SEQ ID NO: 2077 - DNA, 637 bp, Rattus norvegicus
  Genbank Accession No. AI168953
aactgaaactcttttattgaattttgtgtatatagagacgtgctagtaaaataatcataagtcaatgctaataaaactaaaatgtttataaacgttctaacagttacttaactactcttctgatgtaatgtttcatttacttgattaattcttttctctaaaagtaatagttaaaaattgccaatgggtaaattatgaatacaatcgtgtacaaagccaacatagtatgttttaccatttatctctttcaagttctgctattttaatttctgaatacaaaggaaactcccagaaaaataaagccaaaagaggcttaagttcgacactattatgtttccaaagtttaccttaaatctacagttaaccagtagatggttggagaccagagtcattccttttataggccagagtgactctgggctcttatgaacttaaccctgaaaggaggcagatgtagggacttcagtttagtttggattgtaagaggggactctctacctagagaaactttgaataatttcaagacttagaagcaaacaataaaaatttacaatacaattaggatataattttttaatataatagacattgttaattaactatacacatatggttagatttcggcagtaaccaagcg

SEQ ID NO: 2078 - DNA, 642 bp, Rattus norvegicus
  Genbank Accession No. AI168965
aggaaactgtttattttaaaattaccttcccaacaaaccatgaaacaccacattacggtttctcactgaggacacactttcaaagttagatagagacttgaacaaaactcaagggcagcatcacaaagggacaatactaagaatgggtaggagagtgtcacttggtaaaagtaacctcaaggatgcataacatgtcatattggacggatgacaaccttgtgcttttctcccgctgtgggatttaccgaagccttaggtttacccaggtgccatgccagctttcccgggaaagggatagtcttactatctcacgcctacctttactataaataaacgaagtccaaagcaacagatgtttaaaagaacaaaactacataatttagtacataattaaaataaaaacaggacagtgacagttgaatgtttcaaatatacaaccgggagagagaaccatttcatacagttcggaggctgttaaaggggccactcaagaaggttcaacagtgcaagacgcttttccagttacaagctcaaaaccggagtgcaaacgagactaaagcttccactcagagttgtaattgggagcttgaaagtggaattaaaagcttcacttgggtcatgttcccgaaataaaaagttttt

SEQ ID NO: 2079 - DNA, 513 bp, Rattus norvegicus
  Genbank Accession No. AI168986
gagaaaaccatttttattatcactgcccagcttgtgtgcaggattatgtaccaaatggccagatcttctaaagaacatctacataacatttctttcatgtttcaagagatgaaaataactgtacaaggttaagtacaaaagtacacaagacagcggacacgagaaaatctatgtatgagattttatcccacccgaagctttaatatatttgaaaagtagaattcatgaactaaaaaatattgtccttctatagtcctgtcaagtttaatggaagtgggtttaacctgattacaacactaacaccagtatcactgatctgatatttacaaaaaaaatcgtatttttcaataaattaaagtcaatgcaacacccatgcaagctagaacactagctgtttggtgaacaaggacccgacatcagaacaagtctataaagtcccaaattgatatttttcaaactgtatccattccacgcattgaagatgtgaaacccaaacccatccctcgctgtgtg

SEQ ID NO: 2080 - DNA, 582 bp, Rattus norvegicus
  Genbank Accession No. AI168989
aaagatgctttaacagtttattttgaaggtctttttaaaaacaaagtaaaagacaatctgagaaaaaaattgcacagatgacactcattaaataagtatggtgattaaatcagacagggatatgctgtcttctgcaactccagaagtgagttccgtggtcctgaaggttcttagacttccagagtgaggaggggaatcatggcaacaaaagctgcctcgtaatcatgtaaatctacagtagcaaccaaatgtttcttttcttcccaagaatcaatttcgatcttcaaactgtgccttattttttaaaagataagatgctagaaactcgatgggatttggcggtctttcctttgcgagcacagcaagtccctgtaataagataggcacaactgtctggtccaggtaggcacgggtgggcaaggactgtagatccaccttctgttttgatgacttttctgcattaatcttctcattttcaactattctctcaacgctgtctgtgagcccgtactcagagtgagggttttctgcaacctgtgtctgtccctccagcatctgctctgactccatggcggacccttg

SEQ ID NO: 2081 - DNA, 255 bp, Rattus norvegicus
  Genbank Accession No. AI169007
ataaatattcaatttattcaaatcacataagattaatccaaagccacaggcgtgatgatttcctggtagaatcaagaagattttcagtgtggagatgatctcatggagattggaaatgttcaacttgccacgagcaactggaacggactgtctgtaggaaactacagaagagcgggggtggggggtggggagtactatgtctaccagcgctttccgcttctagctggactattattatacagggagagaatgcct

SEQ ID NO: 2082 - DNA, 447 bp, Rattus norvegicus
  Genbank Accession No. AI169030
agtaccaatttaaatgatttctgtaaacattttgataaaggccacatggcactcgtcacattgttcaaatgcctagtggcaggactcctgataagaccaaacaggtcacataagcccataagacactgcagagacacagccaatgtgactaaatccgaggtggagcacacgaaggacctcatgtataatacaaaccagcttaataaataaaggagacaggtgcctgactctaggacagggtttggttccagtcacctgttcagagccttctttgagactctactgccacttccacttgtgcaagtctaatggtgcggccatgaagtttgtagccatcctgccgaactaatgccacggtgccaggctgcaccccaacacctgctggcatgtggcagatgagttcatgctcatgagggtcgtttttgtcaccgatgggtgccattttct

SEQ ID NO: 2083 - DNA, 428 bp, Rattus norvegicus
  Genbank Accession No. AI169034
aagtaaggagtggcatatgtcacctatttaaaggtttcttttgggaccagcctacatgaagtggcaccttgggggggtctttagagccaagttctaaaaataatctgaaaaataattgtgtcccagtagaaagcctcaagtcctctcaagttcctccaaaatgccaccgaatcctacttgctctaggtgaagaatgtgtatctaatgatctgttgacagtcaacagtctcaggcacatgctaacctcactggttaccacgcatcatttcttgtagataaactgtattcatatgataggcagccatccagctcggatgtctctgagcattccaatagtatgaatgggaagcatcagcataatattcttgccatgccctgtaatacgctctccagtactcctcataatcctggtagggatctgaataact

SEQ ID NO: 2084 - DNA, 522 bp, Rattus norvegicus
  Genbank Accession No. AI169075
aaaggagaggaggtttattttggctcatagtctcaggttacagtcggtaatggcaggggagtcaaggcatctgcgtgagaaccgatcagaatgcacacatggcagttgctccactctttctctactcttctagtcccaggatcctctacccagggaatggtgccatccgtgatgggtgagtcttcccacttcaacagacattcataaaggcccttttccctagtgactctaattttatttcaagttgacaattatcattagcagagcaggccatgtctctgcctcccccctcctaacacatgacaggtaagaggatgaaggcagaatgtaggggctacagtgcaagcaggaggaagatatatcctactggcttcatttcgctagagaaaactcttaatatggggaccttgaagaaatatcatggactccacgaatctgctgcttcttgaggaaagagctaaagttcaaatcctctactacaattcattcatttctgggcctgcttggatttgaacaaaaatg

SEQ ID NO: 2085 - DNA, 641 bp, Rattus norvegicus
  Genbank Accession No. AI169105
agaagtcggttgttttattttatttttccaataaagagtccctttacatacagcttttatgagaaattaacatggtcatttattcttgtccaacagaatccccccgcccccggcctccttctgaggatctcccttgggaatcaaacacaaacaaccccctggattttggttagcctttaatacaattctaatttgtaaaacagtaaacaaagctggaggtataaaacatggaatgctatctgtcagtagtcttgaacacattcagtagtcacagcatggggaccgaggccactgacatttttataacactccctgtttcagtggactcctagaggttggtggcacggaggtgaaacccctctgtgcaaaatgcactcacttcgtagaaaagcagctttcttctttctcgctggatcggcataacacaaacaaacaaacaaacaaaaccaaaaataaagttcgttttcttctaacgctaaaagtgcatcagaattgtggggaatcggaattattgaaataaaaggaactacgtatgtggtgtcttactaggtcagtactgatggttaaataccctcagaattagtcattaatcaaaaggttattttgttaaaacttattgcacttacatgccaacaaattag

SEQ ID NO: 2086 - DNA, 659 bp, Rattus norvegicus
  Genbank Accession No. AI169116
aattataaaattctgtttaagactggtaacatggcaaaaaaaagtttatatgttaagtacaaaaaggacaaaattgtatgtacagtagaataacaactatgtaaacaccaaagtttatgcacagagatatctaaagtaacatttaacatcaagattaacagtggtaccattgggtagcaaactggttcttaaagatctcccaattttccttcataagcagtaattgtcaattacaacagggaataatttattaaaaaataccccagtggctggtggttgaacagtgcagtgtcagctgtcacatacagagcagcggctctggctgatctttcagaggacagtgaatacgtcccaggaacataccccaaactgccatctctgctttccctctttcttaccctgtgaccatgtaaattccagttgcaccttttcctaccaattcagaactcagctctgtggccacagggcccagcagaggctgtgggcaggaagtatgccttccaaaagcatgatgcctcaactctggacactcagacgacttcctgcggtcaggcaagccacttttactttcaggccatgcagccatattcacctacagttagacatttgccctcaatgggtcttttggacatgggcttttaaacccctgaaggtaggca

SEQ ID NO: 2087 - DNA, 671 bp, Rattus norvegicus
  Genbank Accession No. AI169154
agaggcgtgcatcatttattattacacagtattagataatgaagcagtattgttgacaatgacactgccgtcacacatacctcaggtcctcacatttctactgtgggatctgttttatcactaaaatatttacagtaagaatatggtagagttggtagcaagtttcatcacagtctaaaatgaatggcacctttcgccatgtactaagcagcgctctatttcacaggagatgggttccatgcagtcactgctcatcacagccccctggaagactactccactgcctttgtaagactgcttgtgttggcgtctgcgatggtggccaaataaatgagatttctgtgtaacacatgctgatactggacgcactcgttcgctcgacccttgttctgatactccacgatacagcggatcagctggtcattctcctccaggagctgaaagatgggcgagggggaagcgcagggagctctcaggtgaaggtccggggcaggcgccaagttgaccctgctcccattccttcctcggcccacagactgtccccaccacggtccggcccctgcaggaagctcctgcaccaggtctccggctcgcggtcgctcacccgctggatagtctcctggttgaccttggccttgccgcgtaaccagtcaggagcgaagcctcgtgcc

SEQ ID NO: 2088 - DNA, 703 bp, Rattus norvegicus
  Genbank Accession No. AI169156
ctcttttgcagctggctgccatttattctctcttttcaatcaccttcactctttgctcaccatccaattacatcccccggcccacccgacatcatcttgtgtttgagtccagcttcacataggtacacatatccactggttccaggcacagggcatggggagatgctgcagtgagtaactcattttttgcataacagtattgcttttgtcagtgtgagaataaacaggaaagccacgtttcttcataatctggtcttgtgaatagataacaaaggagacaagaccttgggcccggtactgaggcacggtgcctcccattcgcatctctccagtttggtccattagagtccaagatgcaggggttccctcaggccccaagacacaggaacttgggaagttctttatgcagcgttcgatgaatctctgactcctctcgttgccaccaaaaagccagaatttattcaccaatgcagcatgggtaacatccaaagatgaaagtttaaacatctcttgattgatagccttgggcttgccacttcctggtgataaattctttgtatccagcagggaaaggaacagtttcctaactgtctctgataccacatagaggatgttttctgagtgtttgacttggaaagaatggatgcttgcaagattttgtattgctttattcaagtgggactgggaactttgaatctgcaaa

SEQ ID NO: 2089 - DNA, 668 bp, Rattus norvegicus
  Genbank Accession No. AI169159
ttttccacataaaccttttgttttaataaataatatttgtggcttagattttgaatcacatttacagataaggaagactagacctaaatagtaacagtgcagctagtgttcctggaggaatgtgcgccccacatgcaccttacgcccaaagagcaggggacagcatgcacgactcactctagacgagagcaggagcagggaaagaatgggtctttgagggctgcacacaactgaccccacccatcccactgtaaaccagtgcacagctgtggcgtcagatgggctgggttcttgcccacaccagtggcccttctgttgacactgagccaagggcagtagctgtagagggtgtccactgattaccagtattagaacagaaagaggaagccacacagttaatctgtttctccaagagtacagccgtgggtgaactgcacctccttaggctcagtccagaaacttcctattggcatttgcaccaaacaaggctccgcggacttctggcatcatctgctgggctattaggtccagtcggctttccagagtgttggaaacctttatcttgcggtccccattatagatttcaactccaccagctatgtcctcaggcaggtaggcctcctggtcaatctggacgtcaacatcttttttggtggcaattttataca

SEQ ID NO: 2090 - DNA, 702 bp, Rattus norvegicus
  Genbank Accession No. AI169170
aaagtgaatatacaatttttatttaacattcaaacttcattaagacatgtgcaatatggcaattttactggggggttgttaaccctacctaggatgattgcttgctgaggcttagcaacagggtccagttcacacttagcactaattaaatactttattgaataaatacaataaacaaaatgcattcaaattttctctaaaaaaagatcactttaaagtcctttctagtcaggctaatgacaaacacaataaaggcagatatgctagtttaacataattggctgattttatacagcacttatatcttttagtccacaagtatattattaaatgatagagaacatctaatacaaccatttctacataactagtaaatgaatttctaagaaaaaaagattttacagaccccatcttttatacccacccccaacagtctaactctaaagaggataaagccaatgcctttcctcacaagagctcaggactaaagtcgctttgctatcagaatctgtatttgtgatccgttatgagcattgagacaagattcaaatattctcaaagaagcacaatgcacgttgtgatcgcctattcagcaacagcgagcactgcattccaaactatctcatcccaggaattaaattaggtcagccacattcatgggcatttcctccactgtagtattgtagaaagtctcaatgtcac

SEQ ID NO: 2091 - DNA, 702 bp, Rattus norvegicus
  Genbank Accession No. AI169176
ggtccaaatattcatttattataaacgagggtgcggagtttgaatgctcagaaacaccaattaacacaaaactaaaacagccagtgaaacaggaaccaacagggaatatggaggcattcacatctggtccagagctaccatccaggctctccacccccacccttggtccagataacccctggccctggtgtccctgctactggaacaaactggactgtagtacaggagtcaggtattctatgaagctggtgtcaagggaaacggactgtcagaggtcaggtttcctgttctccaggaaccaaggatttcaacctcaccaattatcacacatctggatacaaaaaacaggcaatatgtttggctaatcgtaaaaagacactgtagggagaaaccagagtgtgtagtagacagaggcccctggcctggaagccactggagcctgaatagtgaatacatgtggccctctacatagtcccaggaaagacagtgggaccgtccagacagacagctgatggagacggacggggctctctgcctagtgtgctctgacatcagtcactgacccactgccactgaggccccttgttctctgtccagctaaatgcagccaagccctgggaataaacccatagcagcagctagctggctactccccaaagcaggacatggacccacaaaaagcttgctctcctatgtgtggca

SEQ ID NO: 2092 - DNA, 637 bp, Rattus norvegicus
  Genbank Accession No. AI169177
aataatgacaggcaatcaagtttattcgtgttcacagaacatactaggcgaccccagacagccgccctctgacaatccatggacccaagacttccagtcaggaagacatcaaaggccacagaccgtattcccaagggtctgccaaagtcttacaacagagtcgaagtgctggaaaatggagtgttacccctaaacctatgccccccgaccaagactaaactaatcctcccacaactctgtctcacggaccctataaatcgtaataaatatctgtgtcacagcaagggggcatatctcgcacccctgcataagttagaataaatattacatacacccctccttcacctaggaggatatacataaatacataaatattaattagacaccgagaagacctccgtccgtcaccagtgagcctagccaggacccacggtgcctcgggctcgccccaagaaccggcatcttggcggtagtgttctgagttagcgttgccttataagtcccagtttgggatacgttcttgcgcaccaggtacccctggtgcctctttgggttttttttccggactgtgacccatcgcgtttagaatgccgccgggtgttgctggagaaaagctttgagatccagagcatagtcc

SEQ ID NO: 2093 - DNA, 351 bp, Rattus norvegicus
  Genbank Accession No. AI169211
gacaaaggcaaaagaatctttatgagttttaggtagtctggtttacatagtgagttctaggccagtagagatacacagtgagacccccagctccccaaaaaagaaagaaaaataaacagatgttactcacacttgatcttggctgagccagtagagatagctgtggaacgggcaaagagcttgacaggtattgtagttttgacacggcgaaccaaagggactgtaacacggggtcgcttcacgggaactgcccggggcacaggcactggagaaagtcggcctcgataatcaaacagcctgtatatggcagttgctgctctctttagccccttgggtctattaggcttgggc

SEQ ID NO: 2094 - DNA, 615 bp, Rattus norvegicus
  Genbank Accession No. AI169225
acataattattcaaataaattttaatgatttcaattcaatacaactgaaaatgtagtgtcattaaataacattttctgctataattcagagtacagtttggaggccatttccgggcagaagcatcacatcctaagttttcagcttaagtgaggtgactgacggggtcatggcaggggctgggcaacaatgatcagctcatagaatttggctaagagaggaaaaaaccaaaaccaaggcaactaacaaagtagctacaggtattagtaaaatgaaatacaacccaatgtccatctcaaacgactagaaaaatacaggtaaagtcacagcaaataaagtcttcccagggtcgggtcactttatttgcatctcatagtgatttcttaaggcctatgtccaatgaaacaattttaaaaagctctatgaggaatggaagtttatgtgttgacaacactttttaaaaaagcttagatttctgagtgagcaagattcaccttggtgggcaggggccccgcctgctcgtgctcttcagtctgagacctgacaaccacgagggaaggagctggatatctgctcagcttttgttcattcataaactccaaatcaccatagatact

SEQ ID NO: 2095 - DNA, 716 bp, Rattus norvegicus
  Genbank Accession No. AI169231
  misc_feature (1)..(716): n = a or c or g or t
ttttttgtgttgtactttaaagtctcaaaaacaaaacaacatcccatacaccccacgataactctcaatcatggctaatcactgggctggtctataaaacttatacccaacactgacggccagcaccactcaactgcactcttgaaagcctcttcagtggacgggaaaagcaggaatagcatggaaaagtcaccaattctgtccatttccaagagagacatacacaggtgatagataacatggtccagaaacggctgtcctctcctctcaagacaaacgcccagagcggcaagtattaggccatagaacgatttcaacaagacgttacaggcctggcgaagagcacgccctgtcgtgtatggagaagactgctggcagggaaggggaagaaaacaaactagatagcaggcctgaatgccaggaatctctacatttataactgatcaacagtactgctctctcccgtttgctcaattttcacactgtctggaggactttgggaggcctatcttcatcactgtatgtgttagaggtcacttctgctgaccaccttctgtagtctggcttggctggcctgggaggtataggaacccggggcgggatctcaggcttgtcttcatccgagctaggagaggctctgtgtgtgcagctagatatccggatggctggcttgttaaacgacccggctggtcctgaatgagacctncttaatctgc

SEQ ID NO: 2096 - DNA, 561 bp, Rattus norvegicus
  Genbank Accession No. AI169265
aaatcctgatactttatttcttatatcctagctatcaaatcccatatgaattttcagcattaaatagtgacacatatcaagtttcagagatttattcatcagtgtaataaactcaaaaaaaaatcaacatgatttcatgcattcggagacatagttcctgcttaagtggaaaattgtgcggatggcttctgaaagaccttcattgtaagcagctttgcagtgaacttcacagtttagaagtctgggccttcttttttcagtttgctgtagtccacgttcacagaatagaacttatattgttcattgggacccagtttgttccaaggctctgggttattcttcctgtcccagctgacatctggattgaacaatgccaagcgcatcacatacagtgctgctccagtaccccctgctccaataaacacgaagagagggatcaagctgggatgtttcttggcttgcccgaggatctggcggagcatgtttgcggcacaggcctacctacaccgagagagaagattaggacacacactaaaccgcttctgcaacctgcctcgtgcc

SEQ ID NO: 2097 - DNA, 637 bp, Rattus norvegicus
  Genbank Accession No. AI169269
caggtagttaaggcccctgtaactcatctcaaggctcctccagccctaaggccatgttctgctgcaggccctttcccgaggctatgagagcagagtctgtctagccagaagaggctcccagtgtcctgtgcacagcctgagtcagtgctcagtatctgtactttgtggaatagtccttgggcgacaccaccaggcctcggcctttgcgggcgccacggtacacggtctctatgatgtcaaccatttcctgcttgtcttccatggcccagttgatcttgttattgttaccagtgcccaaatcaatcatgatgtgtttgttctgaagaagaacatgaccgtgcatgggtcatagagctcatacatcttgttgaagtcaggtacttctgtaatatccacaagataaataactgcaaaatttttaaccttttcggcaatgctgtacagaacctcgtccatcttcatgcaagtggggtcccagtcgtgtccgaagcgaatgacgaccacgcggtcctcctccgaaagaatggcctggtctacctgccagccattgtgcagatgcggaagcatgtacgacatcttgaacgcgcttgcgcggccggacgccgcgaactacctcgtgtgagcccacgcggcccga

SEQ ID NO: 2098 - DNA, 581 bp, Rattus norvegicus
  Genbank Accession No. AI169272
tgctaaaaagtcatcggggaaaacattaacaaaatgaaactgacagatttaaatatccatggaatccattttcattcctacactgtgatgtgcctaaaatgactattggagtgcgccgccgccggcacccctggttgtatgggaaacatcactcacagcaccagctttgccagggcacggtgggtgcacgctgacgggagccctggttggtaggagggggcagagcgagcagagtggagccagaggttggctttcattcccaaggatgggggcagcaagaggccacctgcagacgacagcagagctgtctctgaggccaggcttcctcaccctggactccttcagatcctccccgctgtcgtctgtgctggtgagaccacagataatgcaaacagagtgcatcacccatgccagagtcaccatgaggacaaggacagacagatggacagactgaaggggaagggagaaagcaaagcagaaggaacttaagacaaatgaagggagggtccccttgctccaccgcagcaacttcctgtctttccaagttgagcctcctgcaatgctgccctgccctgccctgc

SEQ ID NO: 2099 - DNA, 634 bp, Rattus norvegicus
  Genbank Accession No. AI169284
tttttttttttttttttttttttttccaactgttttttttttttaatttttccccttttaccacaaaacaaagtagaagaaatgattaaaactgccaaagtagttaactagtagaacatgtattagtctcacacacacatatacatgtacacaggaaggaaggcaggcttatttacaagaaaacatgtaaaatcaaagtgggtgtcaggaaacattgaaaaacaaacacatacatgctacaagaggcaccactgagtacagtgctagggaggggagtgaacagaggcagacagacaggttcagtcttcacagcatcagtgcaatggatccacaaaccatgttacagctagttcatgggttaaggagctgttcccaaatgtgtcctatttggccctcagaggttgagttctgcagattccgactgctctaaaagcctacctactgagagggcacatgatcacagtaagcttaaggagttgcaaaagctatgcagaccaaagtcaccgatcagcagtctgctctcagctgcagccctgcatttttctgagaaatatcaaggggaaagtcaaacaccagtaaacactgtctctgaagtgcaaagctggagtgactgaaattcagccaatacttcgaa

SEQ ID NO: 2100 - DNA, 657 bp, Rattus norvegicus
  Genbank Accession No. AI169287
aacattacacaattttttattattaaatgagaaaatctcatttgttacatcgtcacattgctagtcaagagaaatgctgcagtgatgaagaaagtcaatgttggatcaaccaaagtcctcatttctacaacattcatttacaaagaaataatgttcaacacagcccaacacaacattcttggttttcttcatattgaagtcccccaaaaaaatcatcttctaatggggtaggttcactacataaattatagttcttcatttttacaattcaccccaaactgcatgagagatgtatcacactaaaatttctaaagctgtgaggaaatccttcacacatcgtcatcatctgatgtgtcactgctacttgtctctgtgtcatcattctcaattgtgggtttgaaagtgctgtttttccagggtccaaacttgaagtcacagatcaggccgtttttcaaaataccattttttctcagaccattcttctgtaactgttcactaataacttggaattctctcatttcatcctcagttaagggagcacatgtttcatcattttcactgtcttcctgccagcccatctcttttaataatctgtgttctgcctcaagtgaactggaaagaacatcagtttgtggaaaagtccaagaacgaatgatc

SEQ ID NO: 2101 - DNA, 662 bp, Rattus norvegicus
  Genbank Accession No. AI169289
  misc_feature (1)..(662): n = a or c or g or t
atagtttaatgtattttaatagcaaacttacaggaacagcacagaagacagacaacattaaaaacatgtacttgcatgtaggacaactccgttagaaaagtatagtgaatggatggaatctactgtatgataaaatgctacaaacaccatttagttgctgtcaataagaaatttacttattttaaaaaaatccaaatgctggcattgtccagaaaattttaacaggtttatttataattgttataaagttgaactgttgaaatgtgttcactgaaacattttgcttgcattaatgctttacatcttgcatttatattaaaaattcacacacaaatgaacgtggagaaactgccaatacctgattctgtcccctatgtttccactcgcaatcatatacttaggtacctttgacccccatggaaaaaatatctaacattcagaactactgataacaggaagaagaggaaaaaaaaattttttttttgagaatgaaatgtttcccctcatagtggactcttaagcacgttctccgcgtatgcggcgtgctagctggatgtcttttggcataattgttacacgtttggcatggatagcacacaggttggtatcttcaaaaaggccaaccagataggccttacttgcctnctgcaaagcaccaatcg

SEQ ID NO: 2102 - DNA, 567 bp, Rattus norvegicus
  Genbank Accession No. AI169302
gaagtatgagtctctttattttaacagcctggcaggatcaggtaacagtacagagttcagaggtgcatagcacaggctggggcaatagctcctgtctacaatccagagcactaagacctcggctttgtggccttaaagacatcagccccaggggtaatccagatactgggcataaataggacagccaaaacctccctcagtctagccaaacaagctttcatgaggaggcttgttccctggcctggctggctccttccccgaaagcttttgcctcaggtagatcagcgatactaaggattccttcctttggctaatatgggaacttttcccacactagcacagcaggggccgtgaccacaagctatgggcatctgggaggctcccattgggcatcaagtggcgacacagagcagggctgtctgcacgtgctgagagctgggcacacagagtggccaggcggcagggtgtgccgcagggctctgaaggtgggtggcccttatggtagagaaaccagaaggtctggaagagctgctcatcagccctcatgcggtagaccaggttgtgcca

SEQ ID NO: 2103 - DNA, 665 bp, Rattus norvegicus
  Genbank Accession No. AI169345
cctcaagttctaatcatattttattctgcttataaatgtgacttctaaattctgacacatttttatattctcaatgtttaaatgatatactgaaactttattaacccagaagttttcaaaatgaaccaaatgatatgttatacaaataaggccagttttgcatagtatattaatatagtaacaaatcaacactcttttccaagttcagagaaatgggaagctggtatggtttgtagggtcaggtctaactttgacaaagccaacaatattcttagatcagagtcaaataaatttccaaactcagttccagagaaaaggaaaacctttagttaaaatctttacaataaaataattatgattataaatctcttcagttaaatatgcatacattacatgggatttttaaaagggatgaaaatggatagtttccagacaaatctaatgcacaaacactccatttatagagtatatgtcagtttaacattctctaatgttgtgttatacagtggctgttttgtgcaaacatgatgagcaaaattaagaaaagttctgcaaaattagttagttctgagatttctaaactagaaaacagttaaacaaaaagagggggtgcaatcaagctggattttacacagaggctggactggaatgaccagtgctgatgc

SEQ ID NO: 2104 - DNA, 571 bp, Rattus norvegicus
  Genbank Accession No. AI169374
accttttagatttttattagtagttctctgaagaatcaaaatagttagcaaattactttagattcaagactgtagtatatcctttgttgtttaaatctttaatgttgaagaacataatacaaacaaaccagagagactggtttctatgcctaggtgttattcatttgtcatcctaaagcagggctggagaaggctgttcaacaactgggggttagtgctgagtgacaagtcgtggcctgtttcctcaccaatgtgctgggaaggagccgatgattactcaaactgcttacagcttcctagcacaggggctccaatgccctgggcagcagaggattatggtctaagccaaaagaaacagtctgaagaggggcacatgggaactgcctggcagaagaggcagactttgccccatgaggaaaagtgcatctttgtaccgcagagacattccagaaccagtgtaacactaagggctgtgtgtgggggaaggcgggccccggaagaacctctcagttgcattccacttgggttagagcccagtctgccagtgaagcagcagagaggacagcgtcta

SEQ ID NO: 2105 - DNA, 558 bp, Rattus norvegicus
  Genbank Accession No. AI169417
aaattaaccctcactaaagggaataagcttgcggccgctaaacttttttttttttttttttttttttttgcacatcactcctttattatactgatctggaaagagacttagttgttatgcccaaacgagttctgaacccacacagtagggtcaagcagctggaacatgattcagacagtgaaagacaaaaccttggacatgatcaaggggcttcacctctacaaaacaaggcaaagggatccaaacacagcatgaggtacaaggagtttatcccatttgatatgaggaatggctttttttctggtgaccacttaggactctcaactgccactagcaaccttgttgcttttgtgctgatatatgtatatatactttatttttgtaaaaataaatgtaacacatagacttgacaagactgttcccaaccttctagggccagcagctcctttagggtcagagagaaagtagggtcttttaatcggcatgaggttacttttactctccactggaatgactaggcccccagttacctaattgtgggaagagtgcaggacaggt

SEQ ID NO: 2106 - DNA, 530 bp, Rattus norvegicus
  Genbank Accession No. AI169430
ttgattacaaatataatcctgagctgaaaaactgggatttgggggagagccatctttgcatacaaaatatccaaaggacatttactctattttctttttctctagtgacactcaactgccagagaccgttctgaaggcagacggcagagatcataattatagtttagtgtgacgcccagttctgcctccagctgcagcacttgccatggcagtggatgcggctgcgtcctctgcttcttccagttcatcctggagttcttggctgacactagactgcagtgccgcaggagtgagccactcctttgggaggcaactctgtagaaagggtatacaggagctgaagtaggccagccggttgatccagcgaggaatctctttcccacagagaatctctgacagggcggaggagaagtggttgcagttcttgtgcatcagatggtaggcgttgcctttgtactctttccccagctctttcacaatcttttctatgtcatctttccagaagtccgtctcgtgccgaattcttggcc

SEQ ID NO: 2107 - DNA, 569 bp, Rattus norvegicus
  Genbank Accession No. AI169591
gacacttaattagtcatgtttaattcactgaacgcaagattagattgatgcatatccaaacacgctattgcaatgcttttttaaaggacagtaaaaatgttgtcatagtaacattatctttagatattgctgaacacaagactttccctgaggtgtaaacatcaaataacttgaacagctttacacatcagccccattaaacagtttattacaacactacatctattgtaatcaaattggtgctgtttacagacattatcatatgaacattttaacaagaacaaactactataaaaacaagcatttacttgactttttccaattgcttgcacattataatggccaaatatataaccagtaataaagttgcaaaagctattaactttttaaatcacacagtttccttcaaataaaacagttaagcaacataaaaaataaaagtagagctactggttaccatttatgcagatttgctttattcagatctattcctgttcagtttatccatgaatccttacaggttcagttcaatcaagaagcaaactgttggacaagcgtcactttccccg

SEQ ID NO: 2108 - DNA, 634 bp, Rattus norvegicus
  Genbank Accession No. AI169596
atattgaagaaaatatgcaaccagaaaccatggaatttctttgtgtatgtgagaagttaatgaatttagaaggatcagattcaaatccttagtctcattagcatcacactccaaccaaaccgcattaacctgcccaaacggttcaatatgacagtgaaaactaaaggactaagaagaaagaaaggctgtagttctcatcttaaggtttcaggatgatggagatttatgaaattcctgcatcctgaaaactgacttcttacatacctcacctcacaatcataaaaccgcagtcatctggagtgactcttatctgatgatataataattaattactacaacggatgttcatctgtggtatacatagatatctggagtaatagctatacaaaacagaattcagtgaaaagtaacactttcaacatctctacagcaagaaaagatgctggggaggcttctcagtagtcactgtttgagttctaaaatgtacattggatatgaagaggaagtcttatcttttctggaagtttgcaagccttattaaagacgatgaatggccaacaggagtagtagttaactgcaattccgtctaagacaggtacgattgttaagacattccagaagtgagtacactggg

SEQ ID NO: 2109 - DNA, 609 bp, Rattus norvegicus
  Genbank Accession No. AI169599
atacagaatatgaaggtttatttccaaaaagattacattttttttaaccaggatacacagatgcacttaatgtaacagtaccttctgcaaaaataggttacataatactccgaaatgcaaggaacaatcttattctctaaaaattggacagcaggcgtttgaagctcaaatagccttcaaagtggaggcagcaaacactggtgacaccatagagctgtgctgcagacgagcccactgctatttatgacaccacagagctgtgctgcagacgtaaccactgccattcagctgcaaaccactcatgttcacacagcgccaaacagaatagccttggtgccaagcctttcaaatgggtctcagtgctgcaagaaaaagttgaatgatacacaaaactatgaaaagtttcaacagaactatttaaacatcttctctaaaattgagaaaagaaatcgtgttaaattttttttaaaaagaaaaacaacagtcagctagaactctcaagcagtcagaagtcgtcctcgtaagcagtcagggaaagtttacaggagatctcaataaattatcttgaagccacagcaggaagcttgcgttaaaatcgccgtggaggtc

SEQ ID NO: 2110 - DNA, 549 bp, Rattus norvegicus
  Genbank Accession No. AI169611
cctacccacttcccaccattgagaagtttattgaaatgtacacatgagtaacaagtgatcttgcagtagcctaggtaggatctttggtcaggcccatcaagaccagcagtctccctggtggtaaaagggagccaagtgagaagaggccgtccacactaaggcatagaagtcatgtgaggtgagtctggggagccaccggcattatgaagatggttggaagcctggtattgtctggttctcaggtgccactgtagatgtctcttctttgttctcctctgaagatagactcctcttttctgcaattaatcttttaactcccaccatccactgactgacctcagtcacatggtcaaccatgagtgatcgatgaatgtcatctgctgtatcccactggtggtgtaaaagttcttgtaccagcagtgccatcctcttctttacaggtactgacaacttccctccatcccactgttcgtgaagcagtgccaagcgtcggctgatatcatcacatacctgcttcttcgtgtgaccacggcaatcctccaatgcctg

SEQ ID NO: 2111 - DNA, 581 bp, Rattus norvegicus
  Genbank Accession No. AI169643
  misc_feature (1)..(581): n = a or c or g or t
cannnnctctaccactgagctaaatccccaaccccgtggctcacactcttaatcccagtacttgggtgacgaggccagaagatcacgagctcaaggtcagcctcattcatatattgagagtttgagaccagtctgggctacaggagaatgcctcaatcttagcataaaaacaaaaaaattcagtcagtcgcagtgatgtgcacctttagaagcaacacatggaagtcagaagcagcagatctctgtgagtttgaggccagcctggtctacaaagcaagtaccagaacagccaggggtatgcacagggaaaccctgtctcaaagaataaattaataaattaaaacataacatttcaatcagtcaattaattaaaaataaggctgagggcagtgatggtgaggtcacagctggacaggtaaggcagaagcaagggactgtcacaaataccaggtcagccaggttgacaaagtgagttctaggccacccaggaggacgcagtaagattctgtctccacctttaaccccatccagagacaggatggtctcttgtgaggccaccctactttacataatgagtccca

SEQ ID NO: 2112 - DNA, 554 bp, Rattus norvegicus
  Genbank Accession No. AI169690
gtagataaattatcgccagcataaaactgctaatggagtttgcatcatggatcccattaactctgtaaaggaagtgaggttccatggtctcataggaaaaatatatctctctgcttggataaagtccgttaaaagagcaaatcaccttggaaatgttctttacatgtctccaacctatgaatacacaataaaacaaaaggtatattaaaaaatataacttttcatttaaaaagaagaattaaatactaatgatgtagaggtaaaatacatggaaaatatacaggtgaagttctaaaaatttctcctattttattagtgcatactaaaaatactcaggaaacaacaacaacaaaaacaataattacagctgatcataaaataaagtacagtagttttacttttaatatttaggggaaaggtcaaacaaaatgttgtccattcaaacaaacaaattttaataactttgattcaagtaacttagaaacatggttcacgtggggtttaatgtccatttatggctaaatatcattttaagagagaccaaaattaataac

SEQ ID NO: 2113 - DNA, 629 bp, Rattus norvegicus
  Genbank Accession No. AI169735
agaaatacccaatttaataaagatggagaaaaaaataaagccagatcccaaggtccattccctcattcatcctcagagtcattcctggctggagaatgagcttatgagggaaaaggtcctatacaacaggtcgagcaagcgcaggaactggcggtctctgtagtcaaagcgctctccaaagacaatggagcagattatgttgcctgtgacgcactggaagaggaacgttgggtccagggagactccctgatgattcttcagttcctccactaaacatttggcctcctcctttatctgatcctccacactctgctttcctatcccaaagtctctcatggtggctacaaataatcgccgaaggatcttccacctttcttcattaacaaaggacacaccgtattcctgcataattggctgaagcacagcaattattccccggccagagaaagcctcagcatggtccaccagagcctcccttatggtctgtgtcccacacagcatgaccacaggcctaggtccaaagtatactgtgaacacatctccgtgtttttcttgaagctgaatgaaagacttacgaaagcctcctctgtccatctgcaagaggtttcccaagaggggtaagggacggg

SEQ ID NO: 2114 - DNA, 492 bp, Rattus norvegicus
  Genbank Accession No. AI169751
aggagggatgcagctgcagatggtggagcacgtcaggatcagaaaccagaatcctctatcaagtctggagacgaggagcattaagagcaatgatgacgacagtaacaatagtgataatgaccatgaggatgctgaggaccagggagctgatgttcaggcatttggcagtggatgcgtaagcctgggctccagtcatatcacccaccatcttccgatccctagacttcacagagtaggcatatgcaatgaagcccaggcagcagaagttcatgaagagcgtattgaacagggaccataccacatggtcaggcacagagacctctctgggcatgttgatcacggtagttctgacagaagccgatccgtggggtgcccccagttcagacacctcatattcttccttgattctttcgtagtttgggggttgtcccccagtggcagcgttcacgaaggcttgagaagtgtggttcatggtaccgagcaaaagcagca

SEQ ID NO: 2115 - DNA, 623 bp, Rattus norvegicus
  Genbank Accession No. AI169756
aacggtgtcataaataagtaatataactttattaaaatgaaaagacaatattcaaaataatgcaacaaaatgaacaaatcctttgtccaatactgtacacacagtgcggagatcagtgcattttctaaagcatgttttaaccttcatttagttcatactaaaaataagctttaaatagctcaaataatgtcattcagcagtttaaactgaacagcttgttgggacatggcagcggtgtccctctgttagcaagcaccttctctttgtgcttatctatacaagataaacaatcagaggatgtaaaaattgaacacaagctacacgtctcactgactctcagggcagtgaggcagccagctgtgagttttctaagcaggaagatgctgaagtgacctctggcattaagacgttctgtgctattggtcagaagtgtttcacttaaaaagcaaacaatccccaggaaatactgaataggaaccaacaacacaagaccagcttgtgttgtaatttaaagtctcaaaaacaaaacaacatcccatacaccccacgataactctcaatcatggctaatcactgggctggtctataaaacttatacccaacactgacggccagcaccactc

SEQ ID NO: 2116 - DNA, 581 bp, Rattus norvegicus
  Genbank Accession No. AI169903
ataacgcaaaacaatctttaatgttagatctgtatttttacatttcccaatacctgcttaaaatagacaccaagatctttgaaatacaagcaacaattgtgatttgtaatctcagcacccaagaggctaaggcattagtgtaagaaatacaagaccatcttgagctacacagtgaaaacctgactcaaagagaaggaaaaagaggaagaggagcaggaagaggagcaagaggagggaggaagagaggctgccactgggaatcctggtacacacttttaattccatcacttggaaggcaaaggcaggtaatccaagttacaggccaaccagggctctcacacatactaaaatgaatgataaatgggaaaaattttaaacaaaaaacagaacactgcttttgattgatatatatatatatatatacatatatatatatatatatatatatatatgagagagagagagagactcaatgcatctaattaacattatggtggtgaatgatggtgaaattcaaacaaaacagcttttcctctgtatccccagcaatggcttctgcaacacatctgtgatggccctta

SEQ ID NO: 2117 - DNA, 519 bp, Rattus norvegicus
  Genbank Accession No. AI169921
aatcctgcatgtattaggaatttactgctacatgtgtaggtcagacctcaaagaaataccactttgcctcagagagacttgttcattaatattaaaattgtaaagcaaagagcggtgggcttgtttttaattagtcttttctgaagaaaggagatttttaaaacgagtagtgtcctctgaaaggttttagccagataaatagtggacactctgacatttgcttaaaggtaatttgtacaataattgaactaagagagcactttcggtaaacccggcgattgactgaagaaatgcacctacaggagagacggctcattttctatgttctttttatgcaaatgttatttttatcctaataggatgagttttacatggtgctttttctttctcctttccatctaatctcagaacaggggcagtctggcgccggctgtctacattgaggcacccagtgtgtgtctgtcagagtgggtgctttcaggatgaactcaggagcacaattagagatttctgaggaat

SEQ ID NO: 2118 - DNA, 449 bp, Rattus norvegicus
  Genbank Accession No. AI169984
catggacgcactttattagtggcttactggaggggaggggtggtgggaagatcagctgggtcctcacaggcatattaatgggctaaggcagaatggatttcatcctagttgaatgtatccaggttgtcataagtgactatcagaactagacatgtcccaaagccctaagggccactctcacagtttatccacttataatctgctgggaaactaagtagaagaacttgacttattctgaggcaattgggatggttacagctcgagatggtcatgtcaaactgaatttataaaaaatactgtaggagttggggatttagctcagtggtagagcgcttgcctatgaagcacaaggccctgggttcggtccccagctccgaaaaaacgaaccaataataaatactgtaaatactactagttaaaggacagaataggacatcggttctccctgg

SEQ ID NO: 2119 - DNA, 520 bp, Rattus norvegicus
  Genbank Accession No. AI170038
acatgaggacaaattggttttattgtgggataccacgatgctacaacatatacaattgataaatgttaacacagcacacatatgagttatggcagaaattacatggtcatcttaatatagttagaaaaagcccatgtttcccctcaggataaaatgttggaagaattaggagaagaaaaatgtctttacatattaaaggctagatatgatgaacctggaaatgacatcatacttaatgaagaaagacagagattttcctctaaagtcagaaatgaggtgtgtgatcactcttgccattcttagtgtagtgctaagaaccttaaacatcaggatagagatgagacaagacattgaggaaagcaggtaaggataaccatgtattaagatgatgttaccacagtgaaagcccctcctttgcatgctaactgaagttaaggatttctagaaaaataaagtttacacagtttcaaatgtctacaacatgaaatatgaaggtactaccagaatctcagcaaactgg

SEQ ID NO: 2120 - DNA, 326 bp, Rattus norvegicus
  Genbank Accession No. AI170046
gagatcgaatattgtttttattttcagcaaaactaaaaaaagacaagtttgagttttgtagtaacaagggctggtacaccccatatatcgctgaacaagaaatgaaaccaaccacttagttattggcaaagtcataaaccgggggcatccactatggggaaacgaagtccaactccttaaggggtaaacatttgccctgtgcactcttcgttctgtagcacctctgtgagctcaccgcttcagtggtgttgttcttggaagtcagactatctgaattcttcaaacgtttttaggtaatgatgttgatgacattcacagactttcat

SEQ ID NO: 2121 - DNA, 525 bp, Rattus norvegicus
  Genbank Accession No. AI170059
cttttgttcaataaatgtttattgctttttcaattatcctatttacaaacaacatgggattcttggcctcatgatacaaagcaatactgtagtctagcagtgtaggcaacatcatgggaaccagaaaaaggccaggccttttttgcaccagccaacattttccagttgaaaatactaatttacacataaagaacacttataaaatgcacttgcatgtaaacactgtaaaatcctgcatttaaaactctatacctcaaagaactctacgtacataaaaaatagaagaaatttctaactgataccaagaaggcatttttaaaactacaaacagctttctttattcaatttcaaagctaatactctgcaaatacaataaaatctgacatttcatatacattcctgctttatatttttatattttaaaagaagccacctgtaaatactattttcttttgcaaagtaacaaaaaagaacaaaaaaaaactttaaaaaattacagtaaaacataaagtagttctcaagtgg

SEQ ID NO: 2122 - DNA, 559 bp, Rattus norvegicus
  Genbank Accession No. AI170064
acagttaattttaaattttttattaccctcaaaacatcccaggccagaataaagtacaaaacagcagtggctgcccctggacaggcaggtcatggctacatctgtggggtcatgtgtaaatgttgctctgaatctcatttgtagtcatcagcttcttcagtatttctgtgctttcagggatgttcttcaccaagcatttcaagctcctggacgaaaagatgggcttaaaagcttcgactgtgacaaggtccaacttcatcacatccgtgtagcacacatacagaaccgcagggactttccacacttgacagtagctcagaactgctgcagacaggccgtgcacaatgttcggctgttccagcagtgggcagtagacggtatctttgaatttctgagtttttagggctctcaggaaaggagaagaaaggttgtaggtagactcgcaggtcttatactctgtgatgtgtcgacacgtgagaactgttacctgcatgttctttctgggttggaagccgaaaaccttcttcaaccactggaactgctgatcctcagcaatgta

SEQ ID NO: 2123 - DNA, 501 bp, Rattus norvegicus
  Genbank Accession No. AI170117
ttttttttttatgtgaagacatattttttatttttttattttttttaggcataaaggggtatgttaatccattgccacatacaattcctataattacatatagggggtgaactgtgaaccagttagaaacctgtatctagttgccaacgagtgccactggagaaaagaaactccacaagttgaagactgagaattagcttccttccagtgtgacgcggtacacggaggtgctctcgagcgagtgagcttcctcctttcgcagacgctaatgcagtagtagcaatcaatcttgtcctctcttgtaaacatctgctggtggtccagagctctgagccagtcatgctgctgtctaggttctaacagctgtttgtggactcagttaccattgcaagtggacaccttacccgactagaaataaacattttccctgctctcctgatgccccgttccttctttctgcaaacacatcttaggattaagactttaaacctttgatctccc

SEQ ID NO: 2124 - DNA, 594 bp, Rattus norvegicus
  Genbank Accession No. AI170260
aatatcaaaatatattttattctggacctctttcagatctgattcaaattacagttgtcaaagcaatacaatgcaaagggaaaactgcaacaacaacaacacacacacacacacaaaatgtgcctggaaagggtcaaagggtcatcggggacaaatcactgtgatgtggaaccaaaatacatcgtaagtgtcattgacatggtccaggagagatagacatctgtatcagtcttccttacacaatcatcatgaaaattgaacaataaagttcttaagcgtgtacaaaaaaactgtcatgggctggtttacacttctacaacagctttaaagttaactgtggaactaaagaaaggctgcagacatcgtcacccagtactaaggtaggctcacagaattagacccaaatgatttgcaaaaactcaaatgaaaacattatatatagcaacaatgtcaaagtcaggaaagaaaatcacttctgtatttaaggatggcagagatacacaatgaactctgcctgtttgtaatgagatgaaaaaaagcacaccagatagaacatgcagaatgtttccccaaacttaatgagaaatcccaaag

SEQ ID NO: 2125 - DNA, 603 bp, Rattus norvegicus
  Genbank Accession No. AI170265
agccacattcgaaactatttatttagtaatcctataattcaggcttcttttggcccttaacctaggccctcactgctccaggcatggggccatacatcctaatagagccaaccagcacccagcagcctacagccacagtagagacgctataaccttttcatctggcgccgttcctgtcggcgttgtcgtttttcattgagctctggtgctggggctccactgtctgctgcgaaccaggggcccagcacgtttacccacaagaggtaaagggcccggcctggagccagaagccagaaggaccagatgtagagggagagacagctgagcacctgaacaatggctgtcagtaggatcacatccttaaggtgctctgccatgccctgctccatgttgaggtccatgccaccgtccaccaaggacccgtcctcagagaaggatgcccgagccattgagctcatagagtggtagctggccccgtacacggccaagctgaaggccagggccatccaggcccagaatgaggcagatgaatagaagaaagccaaggtcacaaggcagtagatggcattggctcccagaatgatccgaaggtaaaacttgaga

SEQ ID NO: 2126 - DNA, 602 bp, Rattus norvegicus
  Genbank Accession No. AI170279
cacaagacaaaaatttaatatatttaagtctatattggaaatacacaaagacaattatgtatgttattagcaagtcttattttgtacaaattacagaatatcctttttaaaaaaaacatacatatgacctttgttggtacatttctatgctggcaaatatatttctgatacaaaggcactttgaaaacccaatatggtttggtttgtaagtttgcaaggtacaaacaatttttacaaacgtatgattacactgaagaacgtcagcaactgtgacatcacatagaaaacacttctttttgtaaaaacaacactggttttatggggataaaagcagtggtttccagcagctgtagtgaagacattcagaagggtgaaggcctccggtctgaatttctcactggctgggtggggagataaggatggggtgaagtgatcagcgagaacccccagggggagagataacccagtaccctagaacgaacccagaaacctcagcagtcagaatggcttgaagggaaaagcacacaggcaggtctgggcggattggctgtgacccccgagctcacactggctctacctgcgtgcttggtgcttccgggctg

SEQ ID NO: 2127 - DNA, 612 bp, Rattus norvegicus
  Genbank Accession No. AI170289
gaaaatcgcaaataaaaagtttaatttcagaatccaagttcatcatttataaatacactaaagcgtagtccacgcaaattcagactaagcctacatacagtatttcaacaaaacattttttttaaaaggtcagaagcaaatgaatgatttatccataatatttgatttgaaatgagaaaatgaaaaactttttttagacattataagcaaaacctttggagtctggtaaagaatctgacagctgaaacttcattttgatagccttgggatttctataatgtcccaaggacggttgagtcttccctatcacaggaaaaaaatctagatgcctaaggcttttctcatgactgcaataaacaagtgctctccctgttaacaagctacctcctcaaagtagaatctgagctatagtctggtcaaactgggagggggtcagtgcatacttcttatgagatagctttattgtagagagacgcaaaaactaaatcagaggcctggagatttgatcagcgggccatctgttgtaaacgtgtcatatcatgctctggtgaagtccgaagcatgactttaaaacgtggatccaatttcaaggagctcatgataagtgggata

SEQ ID NO: 2128 - DNA, 530 bp, Rattus norvegicus
  Genbank Accession No. AI170308
attaagaaccttatgttttattacagaggacatgcttagcattttatgacattacttctagacaaccccacacccttcaaatgaatattctgctctacaagcggttgaaagttggtagcaaagttagtgcacttgatcattcctaccacagagctgggacatctagtagacaagaaactaacatgaatcagttaaatgaggagaagactgactcccccacttgtttccaggatctgttaaaacggggagtaatgaagttccttatattttgataaaattttgttttaattataagcccagcttacatatttaatgttgaaactgggtgaacattcatacactattcaagttgtctagagagtgaataaatcatgattggattagtttatcatagtattacaaaacaccactggaaatggaacctaaagctatttagtaaatgcagaggaaggaaagaaacttggaggcttcttatgaaaggacctcatctgtccatatcaactgtgctcaacatgatggcagtccctaat

SEQ ID NO: 2129 - DNA, 542 bp, Rattus norvegicus
  Genbank Accession No. AI170327
aaacatgtttattacaacagatacaattcacatctgactagctttgtttctcctttcccctcccacaaccatgttcattgggccacttccttgtatttgagcagtcaatgtacttccagcacacttgcccagcagtactttaagtccattcttacagggtgaaaatggatttcaataatttatacaaacgtgggttatgctcaatcactgcaactccagctactgtacacaggaatgagaaggttatagaaaagtgccacagcaacagtgccccaagaaaggaaagagggcacctttaaaaaaatggataaaatcaggccaagggacttcagagggaatggaacatacaggaaatgacaacatttctttgcaaaacaaatggagcagcactgctcttgatcaggtgcaagtgctgatcagttgtctcatgatatttgtacactgctcataaggttcaaaatcgtatcctcacacacagatcacctggcgcttgcactggatttttgaaaatgcaagatttctgaatgataaatcctcgtgcc

SEQ ID NO: 2130 - DNA, 712 bp, Rattus norvegicus
  Genbank Accession No. AI170357
  misc_feature (1)..(712): n = a or c or g or t
aaataacatctttaattaaagtttttgcaaggtaaaatattaaacttaaaatagtcttagtacatcaaaatactaagctctttagttgtattccaagatggtctttaaaacgtaacacccgatatatcacagaagagcaaccttgatctgcaagtgtacagaatgaattttacaaacataataaatatatttacgcccttacacataacagtatgtacaacagcagtcgacaacagtaactctgaccagctagggacgagcccccatcggtgtaaccgaggcattctgaactgacttaaggaagtttgactgaacgaccaattctttattcaatgttgttttgttctcccctcaaatggtaggaagcttttcttcttcaaaataaaaatattaaatttgatgcaatcttccttaaatcatgcacgaaagtaagataacagatggacaaaggcaggcttccagggggaagagtataaaccagaataatttccataagggtaacaaattaaaagataaacctaactttaataaagatgagaaaacacataaccattaaccgaaaccccaacatcagctatagcagcttcagacaggtagggaggaaacatgaaatgaaaacgtacaaagatccaatanaatagcacattgcacaaaagctcaaaagttcaagatgaagtaatatgaaaatataagagccttctcaagtggaaga

SEQ ID NO: 2131 - DNA, 606 bp, Rattus norvegicus
  Genbank Accession No. AI170362
gccgtaccgtaaactgggaaggggtctttccctttatttggcccactgaggtgtgggcttgaagtttaaataagatttcaattaggcagggatgctgtacagagggatccaggtggaagttgaccgggtagcattcagtgcacctgaggctgggggtgcccgtggcagagccctcctggaggctcagggggtggacacagcttctctgcctcctgttccactgactggctcccgtaggcactgtcttctttcacctctgtgctgggcagcttgtctcgggtctcaggcgccttcagcagcctaactccctcatgaagacccatgtcggacaaggcttccaatagacccaccaagtctccaccagccagcttgtaactacgaaggagactgccactgggggagggggtcttcctgtatgtgtccaccaggctcctcagccccagtctctctgccagctctgcccagctgccctgggcttctggcccatctagcagttgctccaggttctgcagggctgcatcccctagtgacagccctggccctgcagggctgggtggggccaggggtggctccgtggtgttctgagcagcgttcaacagcagggtc

SEQ ID NO: 2132 - DNA, 604 bp, Rattus norvegicus
  Genbank Accession No. AI170363
cttagtgattctttatttataaggtaggcagaagcaactgttacaatgtagaagggagacacattacacgctgttatctatacaagtttcaaacaaaaactgcacagggagaggtcaactctcaatacaaactagcaactaaaccacaataatttacctttagaaagggtttgttttcagctgtgacactgcttttacaatgtgcaaaaacacaaacagaactacccaaggtgtttgtcacattctttctacattgaatttggcaacagtttatattaactttattcagattatactaacgtttaaaaactaaacaagtgagaagctgtaccaaggtacagttacatccattcctttcaaaggtttaaaataccacttgtctctattagaatgacctcgcagcgatttctgcatctgcaaaaaccatctcaagcatcatatgcacaatgcatcagctactttgagtcatcaaggttggtgggctaaaccacaggcactactgtttgcttatagtctgtaaaaggagcttgtttttcaaagaaaagagcttaagtcatttctaataatcatgcctttgctttaaagccataacacctcgtgccga

SEQ ID NO: 2133 - DNA, 688 bp, Rattus norvegicus
  Genbank Accession No. AI170379
ggttgcatcgagtgcctcacagacactataaaaccaaaacggaatagaaacatctcggtggttaacagaacacaggaaagccaggtacagagtataatttgtcaaacacaatattgctgctccccgccccacccccacttcctccaatttataaaaagaagaaagaagaaaagaaaaagccatttggataaagagcaacacaaaatcaaaattggcagctcactgaatgcttaaaattcaggaaatcgtttttgtaactgaaactggatacattcaccatttctaacacttaggctatttttttttcaatacatagtttaagtccattcttcaggtgaaaaaaaaacatgtctttaaacacaacaatcaacactgttttggtgttccttgtttgtgtgtgtgtgtgtgtgtgtgtgtgtgtgtgtgtgtgtgtggacactgatctatatactgcttctatgccattgcctagggtgggcagcatgcatgggtaagaggaagggacatgcactatgtcatccaagtgccgcccagcctctgccacagatgacagaccctgcatccctcatttctagatgagaaagccaaggctgtcaagtcataggctctggagggaagtgcgagtataaacactgcagtgtggaaatccttcaagaaggtttttaacatctacagaagctaaacattt

SEQ ID NO: 2134 - DNA, 507 bp, Rattus norvegicus
  Genbank Accession No. AI170442
catgaaaataggcatttggccaataagaatttaattccacaccaatgaaactttagaggctagatttatgtagggtagtatttgcagacactataaaatttttagtttactctaaaagatgacaagacaaattcccctcagtgagatcctggcctaatatatttgctttacttatatagtgaaaggatagtgttaaatatggaagctttcaattcgtggcactgactgataatctacacaggggatccttcgaacgctacaattaaggagccacctagcttttcagcaatactagtccgattgaggtcttctggcccatttgcttgatactcgtgctttatacctggaaatttcttcttgatggcgtccttcgagcttgcatagatcattttacttttcagaggtgcttgttctggtgcccacaagaagaacatgagctcttcttttctggactccttggtttcaaagctggcatcatacaaagcgtagcgacaatctttttcagga

SEQ ID NO: 2135 - DNA, 492 bp, Rattus norvegicus
  Genbank Accession No. AI170530
ataataaaatacataaatctaatttaaaaatcagagtgagactggaatcttgtatggggaaattgtctatttcatgtcccctagggcagccaacagtcactctcatgtaggccttcaagtttcatccacaggaaatgggaatgtgggggaccagtaatcgtagccttcccgtgggttcggaaggacaacttactgggagccccccagtaggttgaggctggcttctgaggttctgcagagaagcagatcacagcactggcactccagcttctgacagtttgaggcacagcaaggcagaggatgtggttctgcccgtccctctggagagtaggcttcaatttatggactggtactcagaatactgcttgtggcgcagcagcagaaataggcctcccccgagaaacatgagtcctggagctcccaaggctaccgccatgattccgaggactaatggagagaaggaatctactggagggaaacctatgcccagaa

SEQ ID NO: 2136 - DNA, 634 bp, Rattus norvegicus
  Genbank Accession No. AI170570
aatcaaaggtttttattactacacagaggagtcaccgagatgctgtccctcatttcactcggtaacaatccattctaaataaagtactttaatgctggtcatacatttatataattatcttgacagagtaagaattagaaatacccaatacatttttgttagactgttgttttaaaattaacactggctttgacaaaagcagttggggcttaagggggacacgaaggtaaatagcagccggctcgtattaatactgctatttccctcccttatcacactccacagttcaatttatttatgctcctctctgggataccacgctctgtccagtaataaagcagtaaccttattgcacacacagttggggaaaggtgaaaggtggaaggtgaaaggtggcgagcagctagcatggagtgactcagtgcttggggttttgaagtgtgtactgcaaagagccagagaggccccagaagaaacttgggctgtgccaggtaagaaccctacagaatatcatgcccagcagttttattttgaaaataagctaaactgtttttggaaaagctttgaaggaatgagacagatgttgctcacagaacagctttctaagcaacaaagtaatgatgtcagtaaaccc

SEQ ID NO: 2137 - DNA, 446 bp, Rattus norvegicus
  Genbank Accession No. AI170593
cttataaaagtagtttttaataaatcgatgtattccaatgttgtgacatgataacccaatgctatatcaaggtagcaaaagggagggagagctcttggtgttttagagacactgtgagtgacagtacacttgcagtcatcctcacagaaattctcttcaggtccatgaagatttgttgacagccgtcccacttgttgacagcggagatgtgtgtgaacagaccaagcagacaacgaaagtctaacaaccaagcaacactttcaaaccatactggcccaaatgggatggccactgctgaaaaaactaacttttaaaattagtcatttaaggaaaacagcatacaccaaagctgcagtaaagacataatggagccacaggacgacacaatggttagagctgagaagcagtgaacgtgtttcagattctagttttcaatgtccagtata

SEQ ID NO: 2138 - DNA, 431 bp, Rattus norvegicus
  Genbank Accession No. AI170628
gagaaaaaaataatttattatatatgcaataggccagtacaatacatttccaagcactaatttgaagatatgtaatattttaatgtttccaaagttgttacgcacagttccattgtccagacggccaatttcttctctcaatgctccacagtacttgaaagatacagaattcagaaggaacctttattgtctgtatcacttccgttttccttctttagaatcatgttttggtctggcagatcgagcaaactgaaccaccatgggcttcccgaatagaacatagccattagcttctttcaaggctttggctgctgctttttcttttggaagtcctacaaaagcttgtcccttcatgcgtccttctttcattaagcgaatatcaaacatgatccgctgtgtttctgaagagaagtcgacatatctcccaaaga

SEQ ID NO: 2139 - DNA, 602 bp, Rattus norvegicus
  Genbank Accession No. AI170653
attcttttcctttttcaaaacaaaactaaaaatctttgagaagtgcattcatcacagttaaaagcttcctgaagtttgtcggcagaacatgacatcgtggtgaggcagaaatgagagccgtggcgtggatcgccagcctgagtcctctttcccatctccacttcactgctctgtcactgttctcatgctgctaaacaactcggccagcagtatagcccccgccccaagcctgaactcagccacacagcgtcaagacattgcagtcccagccagcttcgccgtgatgcccaacagagccagcgcctgacgggctcccctcaggagaggttctcaagtgttcacaaagtagacagtggtgcagggaccaagacgtaggcttcgcttggctctaaggtgactccattgccattcctggggacttccttcttgctccagtccttttccatgtacaattcagcaagcacagggcaatgttcggaagcgactccaccccaggaccagttatctggaatccaagggtttgtgaagccttctctcacaacagcccagtgacccgtgaaacactttctttaagcttttgctgatccaaatgttgtccacgg

SEQ ID NO: 2140 - DNA, 710 bp, Rattus norvegicus
  Genbank Accession No. AI170664
tttttttgaaagttcttcaaagtattttacttcagattgaaaaatgaacagcgttgctcgctgctcagtccagatacacagtactcacgaatacaatgctgtcatctggggaaatgtatacacacctcaattctccttcatgcttttttcttttagaaagatactgtttaccaaaaagaaacgtcagcagtacaggaaaaactattttcccaataaatttacgaaaacctaagattcccaatggaatcaagattatcttcccgctaccaccgtaatataatcacatgcgtactggacactaaaaccccacctaagagtacatttgcttccgacaatgagggtgattctttaaaaaaaaccagtgtggtaaatgtaacaccgatctctgcaggtgttaagtgtctgaaataggcagctaatactggatttaatattattttataaataattgttcccttagcagtaaacataagtctacacattcacaagccctacaaaataaatactgtgattacgcacaataggttatgacaaactagtttcaaaacaacaaaacttcaacatcttgataaaaactctgatcagaataaaatgtgactctaaaattgaaaacagtcaaagtaacatcacattaaaatcgtccaccgtttacacagtactgtaagtttccagttgtggaacacattttcccccattgtaaattaaaatat

SEQ ID NO: 2141 - DNA, 645 bp, Rattus norvegicus
  Genbank Accession No. AI170665
ccggcaaaggtaattaaagatagtttatggatgacagtgtgggtcaacggagaacagacaaggacctgtagtgacatttcccaggaacagatcaatgggtctataggaagtgatccagacaaacaagcagacagacagagggataaggaaatgaaaacatggggatgctgtgtctgtgcataggatccagctctgccctggactcggtcaatgacgagggatgctggaccttggtccttgaagagctacttcgcctccttctctgctctccctcatccaaaaggccaggaacatgggcaggtgatgttaccagggttggggtactctgggtggacagaggatcaaggctcttggaggctccctggggctgtgggggcctgggtagtgtgggattagcagggcccacatccagggcaggtcccccacctgccctgcccaccacaccaacatggtgcaataaataaagtttcaagtaataagtcagggtcaatgaaggaagagttggaggctagtaagcaggcaggggtataagacacaaagtcccctggccacccgccatgccttctcagctttctctaggtccatcaagtctatctcaagtactgcatgctgatgtccaccagtatccaccggacactccttgca

SEQ ID NO: 2142 - DNA, 508 bp, Rattus norvegicus
  Genbank Accession No. AI170666
ccaaagacaatttttttctttaataaaaaaatcccagacaaactttgaagtcctagagtaaaccagcaaaagaaggaagtaaattcctccccacttggggatgggggggtgaggggggcacggcagagccaacatcatcatcaggagagctccaggcttcacatctcattgtcaggagcccacttaaaaaataaattacaaaatggttgtttggggaagagacagatgaacggctgtttccctccggtgcagcaggaactgggcagactacagatcagtccgtgcgctggccgccttgggggcatatttaggcatgagttcatttatcttccggatatagtcagacttctctgcacagcctttgcacatctccccccaatcgtccaggattttcttcagctctttcacccggagcttcttcaggtccaccgtgctcaggtcaatctgcttgtctcagagccaaccaggataccaaatcaaatgcacacaagcacaagggttccagaca

SEQ ID NO: 2143 - DNA, 671 bp, Rattus norvegicus
  Genbank Accession No. AI170679
  misc_feature (1)..(671): n = a or c or g or t
gaacacatggatctttttatttttgaaatcaaaggcaattcaaagggacagtcactgaagcttctgttgaagatctacagagctggcccgattctgagattaaataatattgcactttaagaggacctaatttctaggcttttcatccaagaaggaaagtattgctttgtttaggctttccttagactaaaagctcattgcagaaaactactttaaaaatcaatagtgcagagtacaacatagtaaataaagtacctgcttgctttataatctgaggacattttattgtaaaactctttagcccataattagtagaaagtgtagctgacagtgctcatttcagtggtccaggatccgaaggttcccagatacaatcttgttctctaacactgctcctggggggatgtcaattctgtcaccatgatttgcaatgatgataactgttccctttaatgaaacattttttccaaatgttacatctcctgaaaccgtgaggtggtccagttccaacatatcgggtatactttcaaaccttcttagataatcttgaaccttggtaaaagaactgcctaatttaaccaaaggtactgtangaaattcacgcttttcactcatggtcaaagatcctgcgttaaggctgtanaggtttgacatcacaagtaagagatctg

SEQ ID NO: 2144 - DNA, 483 bp, Rattus norvegicus
  Genbank Accession No. AI170693
gtaataaagacactgcttttatttagtttgatatgtttctatacagaatgcagaaaacacatcttaaaatcatatagaaggaaataaagacacgtcagtggttggtgaacacttgaatgtgagattggctctctgtctcagagtctgatggccatcggcagctcagggcttagggaggaggctgcctgcaaaggcattgttgctcttgttattctgttcactgccccactgcctccagttgctatgacaacaagccactctgggccagcctcctctctacatggcaatgcccaatggtggtgttgctaagagcaacaacagttatctggaaggctttccaaagccctcacctggaatactgggattgattgattgatttttgatgaggtcaccagaaataatttcatcaggtcagatccctgctcttgggttaagggggtacatatggagggggtgatcggtatggggtcatgttcttgggac

SEQ ID NO: 2145 - DNA, 489 bp, Rattus norvegicus
  Genbank Accession No. AI170714
gcattcaaactaaggcattttattagctggcttttcaacttaaatagtatctttgtgacctaagaacaggtgtccgtcacttcccatcacactccagaaggcagactagatggacggtttcattttcagcacaaaatagctttactctgttaccttcactaaatcttttcttagtgttaaccaaaaaaagcaccaggtcacagatggactctcccagccccagtaagataggcttccttagaacacacacagcaggagagtgaaaacagaggcttctggtttctttgggtccacaaaatatgcagccaacattgattttgatgatatccatcccaaccaaagtaagactaacgtgatctcctgctgctgcccaatcgacaggttcgtcgtgcagagtgattcctttggcagtacaggtttcattgggcggcatggctaacagtcggtcaccagtctggacatagccggcttcaatcttaccagtcacac

SEQ ID NO: 2146 - DNA, 652 bp, Rattus norvegicus
  Genbank Accession No. AI170754
ccaactaccactttatttatattactatgcttaagttacatgggaaaagacaaccaagcagttctgccccatttcagaaagtttccaatcaacaccaagtacgtggtgacaaggaactagggatggtgacatctgtgggtcaagactgacaaggaagaatgggttctggtgctacagttcctctccaacaagaatatggcacactggccagcacaagccacgctaacactgagcctccagcgctgggcacagattcggatctcttcttgaagctagcaaattaagtgaaataactgggttaaaaagaaaattttaaatgaagcccaaataaatttaaaaaccatgctcttgacatattctccactcaaaatgtacacaaaacactccttttcactctaaggaccccaattttttcccttacatagcccaccatgtagttgcaaatctgcctcaagatgtaaacacagggaaaaaattaatggcatatgcataaaattctctctacaaactgctgttggatggaaaatacaaaattaaaaaaaacaaaacaaaagaagaaagaagaaagtttccatcttagatgctcacaacctcttgttccgcagttcatgaatccgactctgatgctaaggtgacagtgtatgtaaggaga

SEQ ID NO: 2147 - DNA, 587 bp, Rattus norvegicus
  Genbank Accession No. AI170762
tttcctgttgttctactagggtgagagtgtgggactacttacacgcggcacatgctgacaacaagacgcttactgtacagaactgcaatgcaggactacccgaaacagggtcttctgtggactggaccagtgtttcaatgcaaatgccagccctaaaaacaacatggttctgatttcacagtatgaattccctggaatctgggaaaaggtaattgttagctgaggctgtccctcagcagcttggtccctcaacattctgagacatcaggaaggactgcaccacttcctcagtggactgggggctgctgttgacgtcttcaagggcatcggtcactgaatactgtcggtctcgcaaccggttccagttagacaggacgttgtggtactcaaacaccttctcatagttcccagtggagttgtagagcttaatgaggccacggtagtcatactccagcccgctgtagccttcgccaaacagcttcttcccaatcgctatcgaccgaaggtacagtttctcagcattttcatactgattcatgtcataattgtacagagatgccaggtgtcccaccgaaagggccacttca

SEQ ID NO: 2148 - DNA, 637 bp, Rattus norvegicus
  Genbank Accession No. AI170768
gttattcaacagccatttattgtttctgtgtgcaaggcactgttttaggcgccagaagggaaaggtagacaacacaagtgatcagagtagactctgctctcgaggagcgcacaatctagtttgcacacaagagatgccacatggaaaatggtgaatacttcccagaggaaacagcacagaggtttaaagtcagaccaggtcagaaggaagccgctgggctcttgctacactgtcttcttgggcagcaggcacaaaaggggacctgctagatgtgaggagtgggactgcgtcttgggctttacttccagctctagacacacagcatctgctatgcttaaaaagcctgggaaaggggtgacatgacaggtgtggctgcactggccaggctctccgtgttagagctttacagagggctgggaagagggtgtgagaggacactgagctgaacccccatggtcatacctttgagaccactggcaacctctaggcctctgctctctctttctgagatgaaaatgccggagcacatgatctcaaaggtcttcactacactactcaaaggtgatcactacacagtggcaccacaggtatcagagccacagccacttagggccagcactcatgttccctcgtgccc

SEQ ID NO: 2149 - DNA, 684 bp, Rattus norvegicus
  Genbank Accession No. AI170769
aacaacataatttattaattttgcacttggatacttgaaaaaaacacacatacacacgagaaatcttaatgttacttaggatactgccatggtttggttgagtgttagaaattttattttaaaatagttcaacaaactcacttcggattttaatattctaaaataaaaatgcattgtatcaaaatcttgatcatttaaaaaaactgtaaacaccatgattcaagccaacgattttgtgcttttgagacgcagtatgtgcttcgaggataagtgggacttcatttgtctgagaagaatttactctgctcccttctggctttttcaaggctttcaaaggtgatgagtccttttggcagctccaactttgtcttttctgtttccaatatgtcttcagcttcacttttcattctttgtagaagagttccgtagcccaggtcatactggtaggtgaagatgaaacttaggggaactataggaataagaaaagctggcttctttcgctttattgctccagctgctaaagagatcgttgcgatgccaaaaaacgttccaaaatatttgaggaattcccgagaccaggcgatctgcatagccatttgccgttctctcatctcattctgcatgatcagctgtctttccagctgaagtcgagcgtgcataaccatgaactcctgttgatttttc

SEQ ID NO: 2150 - DNA, 645 bp, Rattus norvegicus
  Genbank Accession No. AI170780
agttgtatttgataacatcccagtttaattcacaatcttttctgacatatatccacataaatttgaggtcccttttctgaaaatacactaaaattactcatgcttgcctgtaactttgtaaaatgttgatgagagaacacttacaaacgcacaccactatttaagcacacttactttctctttaaagaagcaaagtggctcaaataggaaccaagctcaagaaactacacaaaaaccaagtgagattaaaggtgttaacttcaccaacctgttgctcccatctgttagcatttttatctttcagacagggagtcactgtacagcccaggatggcctgctggagttccaggcccatcatcacatccaggttctcctctctcaaatatctgaaccctcggtgtgtctgggtttaaactctcccagtgttaaatggaaggctgccatggatggagatattgtcacaataagagacaatatagaatagagagtgtaaggcaagcaaacagcacactgggtgctggccatgctcacactccagttagaccagactacccaggctcgctgggctcaaaggctgatctggaccttgtgggtcattcttactttattgggttttcttttgttccacagttgctcgttccacta

SEQ ID NO: 2151 - DNA, 629 bp, Rattus norvegicus
  Genbank Accession No. AI170795
aggtactttttattttcattccgcatgtgtcttacaaatttaaaaatttcataaaatgaaagatcacagagaagtcatcaaggtcaatttaagtatggtcacatttcttggattatgtcattgctatcagagacacattgaattcaaaatattttagatgcaatttgacaaacaaaacaagcaacgccaaaaaccttatggtgagattttaaaacagaacattctttaatttcctcccaagttactaagcagtctgatgacttcattttaggaccacaacgtgatcactgcctctagtctgcaggggagatggatttcctcattgaaacaagaaaaacagctcctttccatgtgtgaaaaactgttttctgtttgtttgttttgtccattttgtttacttactttttaagattctttctactggaaaataactatgcttacttgctgatgtgtccgttcaggtctgagaaagaagaaaatctacaaatggtccaaagatgaaaactttactcaagtcttagatctgcttgagtttcttctaacttgcaaatatcaaaatgaaaaatttagttaaagcacctgattcatgtggagaaagtaatgaactgtattttgatgctaacatatta

SEQ ID NO: 2152 - DNA, 662 bp, Rattus norvegicus
  Genbank Accession No. AI170820
agtataaatactgtatttattaaatatccttacagtttatttaaatgtatttacagaactattcctgcataagttatatttcagacatcgatcaggtcattgcctctggtaggacaaacaatgatagtctcgacagaacacgcagctcattagcacagactcagatttgctcgtcgttactatctttgccaccaacttcctgctaacagtcacgttttgacatggtcactgctctattgagaagttcaattttgtgataatttacttttttcaaagaaatagaatccaaattcttgtttcatattttgttttataagcagatttttgcaaatttttttaaatgtaaaactgtgacagtctccagagaaactgagtgttacaacttggccagagagagctgctgtacagtgacaagaagccatgaacctactctaaagtacaaacacgcacagcctcagccagcctgccagtgcctccaagacactcctggggagggcagtgctgggacgcttccgtctgctggctactctacccagagcaagggcactctcctgcctcggaacgctggtgccagtctctgccgcagacacacacctggaatggactctgtgagcgagtagcctatcgaccaagctacttcatctccacttgataatttaata

SEQ ID NO: 2153 - DNA, 605 bp, Rattus norvegicus
  Genbank Accession No. AI170825
caagtttgacaaaatttattgtagttttagtaaagacacttagcttagtcgtctctccatcttgacctcaggttaactgttcttccagtcaagtaaagaacatgtaggagaggtgttatttcaacaaacagtaaaatggccacaggacagtttgcagacgtaaaaggtaaatgtatgtatcttgatatacttaaatcatgtatgaactaatagtgctaatgtacattcccatcgtgtactcgggcttactaagtggactcaatgtagtgaacgtgtcaggtacacccgcaggctgcttctcggaagtcattacagtaaaaattgcctagtgaatcatcaccacccatgaaactcacccaagccgcctccaaacttaacattgtcattttcaaggacattttatcatttctttagtctgtgactattaaagatgcattaactgtcacgtttaaaaagcccatatacgatacaaaaaatacaaaacaaacaccctagatacagaaatctaagagcatatgcgatgagagactcacaatgaaagtgtgtctgaagaagcatttctgtcccatttcagtcactaaatgtgcttttgaaaccactgctca

SEQ ID NO: 2154 - DNA, 498 bp, Rattus norvegicus
  Genbank Accession No. AI170894
aaacattaaagaattgtataaaatgatacatgacgcagaacaagttctcttacaaatgttcacgtcatttacaactaagatcaagcagccaaaaaggagtagattaataaagccacaggaataaaacagatgcaaatatttaaaaaaaaagatacgtattatgtgttgaataaaataaagtctttccttgtgttggttgggtagtcttttgccttaagaggacaaagctgtgtgtgatcattgggttcagtcttcttccaaaggaataatatcaggaacttcatcagtgtcagatgtcgagtcaaaagcagagaaatcaagcatcagccagttgagaggcgtgttgttaacaaggtaatccataacttcatctaaggactccttcattttctgcagctgccccttgctagaagtgaggacgccatcagacacttccttgaaggaggtaacattgcggaacgccgagttgatgtcacctgccatcacccccaagtgttt

SEQ ID NO: 2155 - DNA, 502 bp, Rattus norvegicus
  Genbank Accession No. AI170979
agttaatttcaaaaaaagttctttattggcataaaaatgaaagtgttgtaaataaattggcaccaaatatcccaaacacgagggtcaaagcctatttacccctctttgctgtttttcccccttctgcccactttcctgggtgttgggggagctcgctgacaacagtcacaaatccagcgacctgatggaatagcaccaaggcccacacaaaaagtatgataacctctgtcacacacatcacagaacatcatttcttcttcatggtggggctgtccacatataatgcatgtcttacattccatacactgccatgggtaggtcttaatcatagaaacaagctccatggtcatatccaagcaagaagggtggccactgttatcacactgggagcagtatataagtgattcagcctttcctttcttgttggactccttacccttcagacaaattccacatagagcatttggaatgacctttggcttgtacccaggaactgatttgg

SEQ ID NO: 2156 - DNA, 566 bp, Rattus norvegicus
  Genbank Accession No. AI171064
aatcttaaacagtcacaagtctaagccacatttatttgcacatatatagtaatgggcaacagatactccaggtccatacaaatttataaacaacaaagttaataatcacttggtacacttgtgtgttatcttgtttacatattcaagtctagatgaacttccttcattgtgtaaacttccatacaatacttccttaaacaaaaattcttgaaaacacaaattggcatgtttcagttatagccaacagaaaagacaagaccacaaattcaaaaaccaaatttagcagatatttttacccaccccctaaccacccaggaggtgataactattaacagatgacatactacattgttaccacacaagtaactgtgaggacaagagaatcttgttctataatcatgaaatgacaaccgaatagtattgtttaaattatctaccaactgaatggtttaaatcaaaaacagaaaaatgcttagattaaaaattgtaaatgggaaataagtaaatgttttaaaagaactattccccatcaaagctgtaaaaacctggcaactcaaaataacttt

SEQ ID NO: 2157 - DNA, 544 bp, Rattus norvegicus
  Genbank Accession No. AI171091
gaacagcatgttttccgtttatttctgtgctcgcccttgcagtacatcaaagctcagtgaactaccgctaactgagaagtctcccgacagtcacagtgtgtgagagaagcaggctgtgtgaccctctgtggcagaagacacaccgggcgggcagtctgtctgctctgctcctggacgtgaagtaactagcagctgggctggggtaggcatggccgtgtcctgcttcagtctgagtccatggcaaacagttggatgtcctgtgggttccagtacaggccgactgccgagttgtagaccagagaccagacgtatgggatgaagaactcctcaggctgctcttcctgcacgtatttgaatttcagttctggaaatttctttagtctgtctttgggtagtgccacaaccccttgtttaatgatttccaagacccgttccactgacagctcagctccagattgtagcagtcttgagctaaagaaggaaattaccaggtcaatgttctgcattatgtcttggaatgaggggtgagtccggaattgctcaa

SEQ ID NO: 2158 - DNA, 463 bp, Rattus norvegicus
  Genbank Accession No. AI171147
gttcgctgttttctttattggagcttttcaaatcttggggtaccagagcaaacagagttggacacacctatctatgtacatggctagtggcttttaagcagcagcagagatgactcaggggttaagggctcttgctaagggcctgagtttgattcccagcacccacatagagactcacagctctcattagctagttctagaagatctgacacactccacagccacgcatgtggttcacacatacataaataagcacacatctgtacacaaaaattaaaaacaaggaattcttaaggaccaatattttacgccactttagaatttctgtctccagtcctatttgggacagtgagctaggccctgtgagcccagctgcttcagtctctgttctgttcctcaactttgcttctggctgtgtggcactgccagtgctgatgaacattaaagctgtgatcgaacagag

SEQ ID NO: 2159 - DNA, 398 bp, Rattus norvegicus
  Genbank Accession No. AI171196
ccagtatctgccaattgcttctttattgctcacataaatttgaactcattacagctggtgccagaactttcacacaaaaccatacttgggtatttttatataaaatctataaaagatattttaaacatgtatgtaataatacttccaggtatttggctgcttgatcatctatgactgtacagccattatgtatatatttgtgtggatatgtacatatgtacataaacacacatttacgcacatatatatatatatatacagatagattatgcataaaatagaaagcttattttactgctaatgcagacattctcacaaaacaagacttttagctaccatcggcatttatacatatatacaaaagccaatttaagtacatgtacatccacttacatatg

SEQ ID NO: 2160 - DNA, 626 bp, Rattus norvegicus
  Genbank Accession No. AI171206
cacaatctccatttattccattgtaaacatgtacagagtatgcgtatgagcattgttagaatttaaaacaaggtttacctttcccaaactaagttgttttgggcatgattacattgatcagattgattccaagtacagctagaactgaacagaacaggcaaagtttcagacatgaaaaatgggctgtacaaactaaaacaagacaacacacaatgttaattcctaaataacaatgaattaccagaactgtgaactggtatagaaacagtaataaaataatcctattttttatgaaggaatttattgtatttttgaaggaaattaattttatgaagaaaattattataaggttcctagtatgaaagacaataaacaatgagttgagggtcattaaaaaatatcgcagtagtaaagtctcccacatctgtctttccacatctatatgctgttcaatctaatgtcacagagaaaccaaaatcagatttctaccaacccaaaactaagacatgccatggtggtttttagggaaactgtacttcctgaactaaaataagaaagcccacgtggacagtgcaggccgtcgtttctcctttccactggaattgctctctgatgatcaagacatg

SEQ ID NO: 2161 - DNA, 542 bp, Rattus norvegicus
  Genbank Accession No. AI171230
caggctgggtggtagatgttttattatttttctttgcacatcatctgaccctttaaagaaattaagcacttaaaaagtaattactgaacaaaagtgaaacaaagtgcagaaaaaaggcaaactgaggcattaacttccatgataaagacagtcctattcatggctggaggggtgggaactcggggttaaacagtggtgtctacagtcactcttgtgggtcactaaggttaaactccgctcattaaatatatgaagggtgatctccaatgcatgtagcagaaaatactcttctttacagtacaaacttgcattaatcttccctcctttcttcatgtattatgaaatatatccctagtgctctcctcactgcttcaaacaataaactattcttcactcttagaattcagctaagggaggacccactgtgctcagtcacaccgtgagaaggctggatggcagttatccctgggtatttatgtcaggtcacaaagatgcaatttgctaatttttttccttaaaatgttggctcatcaggaaaaatt

SEQ ID NO: 2162 - DNA, 575 bp, Rattus norvegicus
  Genbank Accession No. AI171231
caggattaagtgtttattttagttcagttaaaacaaacatacattgtttcattgaaactggcatagcactccctgccaacaagccacagtggcctgtcagcctctacagtacagcgggggcatttacactatatacatacaaggagtccacgtgacttccattgaaatcacatgacaagttaccagatagccgcgttgtacctactgcattttgaaaatttagacacctcatttaaagcttttagtttgatatctgaacttgcgttgatgaccaaccagtctattgcacatacaattaaaacaagttattttcaattttagtattatacacaatgtcaatattgaatcctatgtacaagtaatccggggacctatatataatgtgaatccatcaaaatgcagttaagaaaatttagggggaatatatacgcttgaacccaagacccaattccaacatgttatacagcttatttacaaatacatatggacaatgtatgtacagtttaccataaatattgaaaaataggttacctttaatggatcaatgctgctctataaataacagtacagttatt

SEQ ID NO: 2163 - DNA, 616 bp, Rattus norvegicus
  Genbank Accession No. AI171242
ctccttctcctagaaggtaaatttagaggtattttatttaataaaatcccagcactcaggaggctgaggcaggaggacagctaggacttcaaggccagctacataaagagcttcagaaaggtgaggtacagaatgaagctttgtctcaggaaggaaaagacaagactccattccagctggcacaaaggagggaacatgtaaggaaatgcagggactgtctttaagccagtttagtcaggcagggcatgagacagcagtcagctcgcacttacacacgtcctagggcaacagaaggctaaagccaaatcagagaggccaggaaaagaaagctgctcttcttccagaaccaggccttcctaagtaactgtgtgtcttggtggtcatcagagggggcagggcttcactcttaccatccacaagagtgcccgggctgccctgacagagctgcccagacccggaggaatttcctagtcacccttttagaatactagcccagagttgcatgtcagtgtcactaagagatgcggcttcataacgtggccaggccaggcatcttgattaaattattttactgactgggggaggggtgttgcatttggaagcccacagcaagact

SEQ ID NO: 2164 - DNA, 593 bp, Rattus norvegicus
  Genbank Accession No. AI171243
atattttaattttctttttattcagaccatatattgaagtatcgattttaaaaaatttataaaaagacttagatgtaaactgtcatagtagatttacaaaaaatatatataaaaaagcaaattaaatattagaaattataggagtctctcccttaaactgaaggagtcttctttaataactttcaatgtagcttactggcaatcttaagaaattcaagaagctcattcatgttgtgtaagccctaaaggaaaaaactgaggaaactcattgataattttcacagcttcattgtaaagttcaagatcaaagcgattacaatcttccttaaacaggatataagatgcacatagtatggttgccttggctgtcaccttcccgactacttctacgattccagagatttcttcatccagtggctccatcaattcaatggttccattctttccttctccatctgaaagaataaacatttttccagtgggatgaatcttttccagcttccccacgaagcacacgggtcggtcgatatactgtgataacatgctggcgttgacgcgcgctttggggagttccattatgtccaccatgattc

SEQ ID NO: 2165 - DNA, 588 bp, Rattus norvegicus
  Genbank Accession No. AI171262
gagaattcattaaaatttttattttgaattatgacctattctgaattcaaaaaaatctactttggaaaacacctcattgggtgttgacttactaataaaaagtaagtcatcactgtttgaacataatatagaatacacaataaattatatttacatgcactgaccagattatcacacacaaggtaaaaaaatacagtattttatgtacattcttaaagatttacattttcacataggtttataaagttaaaaattctctgtacaaaatcttccgtgtacagagtgtacacatcttcgtccttatggctgtatcgccacacagaactgctttaaactagcactacaacactggagggctcacttcatattcacatcttggcacccatgtacaacacatcatgaaatgtgaattataaaacaattagaaagtaatcatgcagctatcttaatacaagaaagtgagatgagctgatcagcacttatcacctccatttctgttcgtatctgtgccacttcctgctgtgtatgcctattccacttcctgttccgctttcacacaggtgcatgcaaaactagcagattatgaac

SEQ ID NO: 2166 - DNA, 727 bp, Rattus norvegicus
  Genbank Accession No. AI171272
acacaagcaagggacactttctttaataaagttgggatttaaaagtcacttagtaaaatgtttaaagagtattatttttatcacatcaaaaagtttgacacatggtaggttctgttttccccatagaaagtaaaaggccatgcgataaaccccagacttggtacgctctggcccgttctgtttccgtaaagaggttgtggcatgagaacgagtttaaattaatcaaaagcaaaatacgttatgtatcaaaggaagtgtcaaaatagtctcaaacaattaaaatataatatatatttataattccaggccctcaaaagcaatcatggtagttaagaacagagttttgagtcattatggtaagaggccaatttgagaaacatctctagtgagatgagattcagacactggcatgagaaccccacagagctctgtgaaatcaccctcaaagcggcacattccttctcacagcaggaagcaggctggcgtgtccctctggcacagaggagtggcctcagcggggtcaggaaggcagctctgcagggccgcactcccatcctcccttccgctcttgggctgccacccacctggcctcccaagcccatggctcactaccatcatccattccaaacactgaacaagcccatggctcactaccatctgcccattccaaacactgagcatcactgaagaagaagtcaatgcaatgtggtttaaatgccaatttctt

SEQ ID NO: 2167 - DNA, 623 bp, Rattus norvegicus
  Genbank Accession No. AI171273
gtgtcccagtttctttttatttatttttttttgttctttttttccttttttttttttaagtatggaggctcaagtagaagatgtagattttttttgtctgtttaagctttacaaaaaacaaaataaaacaaaaaactccttttgcattccataaaaatttgacagaaaagcacctggccagagagcagcggtcgccagccccgcccccacccccaccgcggtctccttgggacaagggcacacctgctctgcgcaggacagtgctgaggacatgtctccttcctccatagctgcgtggtcgatgcaaactgttatgtgaccgtcagggagggaaaggaagagggaaaaggagcagaaaacgagttttctaaagaaaggaacctaacgagtgcatggcgtgtccggttagcgtgaagcaggtctttaacactgctgctttctcttcaaggcttccaccacgtcattcttaagggcttcctgctttgatttgtctgcaaacgtctgcacagacctgggtcggctcaattatcaggctggatgtagatggcatggccccatctttcaaaggagggtcatacttgttactccatggtgacctattggagtccccgtctctgttgtag

SEQ ID NO: 2168 - DNA, 397 bp, Rattus norvegicus
  Genbank Accession No. AI171319
gaacatgttaccttttatttaaaagtgttactagccctgcctggggctcctatacaaaaacaacacacaacccaaatgaggctgcttcccgtctctagactcggggacagtgttggggtttagcgagtggaatgtgtgctgaaggagggcacccaggaggctcctaccccagtcctcaggatggcaccagctgtcccgttgcctttctatttaccacagaggaaggaaaggcagtcttttgagatgctcagtagaagtcgagcatggatggcccttgagggtcccacgaagggtcatttgctcggtcatggctgcagatgttgcgagtgtcgccgcagcgacaaggatggcaccggatagcttagggagccaagcaccgcagcggctgccaccgcga

SEQ ID NO: 2169 - DNA, 483 bp, Rattus norvegicus
  Genbank Accession No. AI171338
tggttaaaaacaaaaccaaaatttttgacagaaagctcggaaagaggcagcaatcaatcaatcatcaaacgtaattttcttcccctgaaacacagcgattttggactgctgctccttccgcctcctgcttgcttcccaggaaggatgcagaggtgcatacgacggctgcttcgcactctcgaatcctctgcgtgcactctttgtaaacttattctggattggaggttcattttctggaatatctggggctttattctttggggcctgttctctgggatcccttctggagcttttaggtccagataaagagtggaaaaacacggattctaacttcctggcttctggaatcagcttatgtttatcgtttcttatatcccagtgggtttcaagtgtatttgttttggatgacacttttgggaggggcttctgttccttagctgaggaagggacagcacattccttctttcgggtccgcctgacttt

SEQ ID NO: 2170 - DNA, 571 bp, Rattus norvegicus
  Genbank Accession No. AI171365
gacaggttctttgagcatttactgaagtcaggggccacctgcagtaggtttacagctcagttctgagcctcagccctggctggctcttggggacgaggtctgggaggacgcgaccgccggcctgtgctccctgctttctgctgccgaagcgtctgctccactttctccttgaagcgccggttctgttgcttaatcttggccagctcagctttgcgcttggcctccaggtccgggtccttcccctccaggatcatctgtttccgcttgttgatctccttcttttcatcaaaatgcgaagcctccagtttgatttcacactccctgcgcaccacgttgacctgtgtgaggatctgcaggacctgggcctcctccactgccaattcagccagctgctgtttgatctcctcctcgatggcatgcaacaggtggatgtcgtactgcgtcaccagtgtgatggcctgtccctgcctccctgcacgggctgtgcgaccgaccctatggatgtagatcttggggagcccaggggtgttgtggttgatgaccacctgcacagtggggatgtccaggcctt

SEQ ID NO: 2171 - DNA, 515 bp, Rattus norvegicus
  Genbank Accession No. AI171460
agaaggctgaagtctttaacatccggcttgatacaggtatatcacaattagacaacagaattttctacttccaaggcaaaaatgtagaaattaatactgatgtgtagcccttacagaatgtccatgcactaaaactgctgctgcctgtaaagacagagacttcacaccttttagattacaactagtcacactttgttttgagacatgttcatacaaagatggaaggaatcatttgtagtatccattagctaatttgtttccattagcaaatgtcacccatatagatatgattgtctaattaataggaagatgtgtgcttgatccagatcaccattacagtaatatcatctctaattaggcagtgagctgtaatcctccatccacgataagaacatgtcctgtgatgtatggtgactctaaaggaaacacaacggcatgtgccacctcaagagcttctccaaacctcccaagagggatgtttttcttgaaatgttcttctttcaagtgttttgtca

SEQ ID NO: 2172 - DNA, 465 bp, Rattus norvegicus
  Genbank Accession No. AI171487
cagagttctgaggttgctgactgagcacagcacagctgtgtaccacaggtcgaaactcgaccttaaatattacaatctagcagtgtctgctggccggagccggccagcccctgccagcatgtgggcacttcttcatgtaagtctattctttggcagctgacacttgcgctgacagagagaatccagtgacgtgttagggatttcacgactaatgttggcttgcaggcctgtgtgtttacagttctggactctgacttggcctcagaggtttccctggaatgcggttcctttcctcctttactattctgaaatctgggctaaacaagctaacttgaatgtaacagatgaaaaaattatgtcagatatatttaaaaaatccagcaatttgagtgttcatgtctatgtaaatacatttaaaaggggattaagcaatgtctaacttatactatatgaaattcagaatgg

SEQ ID NO: 2173 - DNA, 544 bp, Rattus norvegicus
  Genbank Accession No. AI171512
gtttctcgttttgaacccaataatctggagttcaaaacgagaaacaaaaatgtcacaaaaaacactacaaccaaccatggcaatggtgacaaacagtcacatgatttttcctgaaaggcttgaaaaaggcaaagccacccacaaagtctaaaaccgtcagtgtggacgctacacaaagacacgtagaaagagaaaagtacacaggacagaagggaggaaacgaggctgttgggctggctggccaggcctaggcgccaccaccgactcctgggtgagccacaggagagacaatcagcacttgctcttctgatttagcagaacccgaggatgacagaagaaaagcctgtgcagtcagccctgccctgacaacttccaaccctcggctagaggaaactgtctcagagagaccatgagagatcagactagttcccaaaggcttccatccacccttcaaccttccttctccccttctcacagaaggcagactaggcaactggtaatatttgatttcaaacaagccatcgcataagtcggccgctgttac

SEQ ID NO: 2174 - DNA, 536 bp, Rattus norvegicus
  Genbank Accession No. AI171530
cattgatgctttaatatgtcatgtatagtattttaatgtattgctatttaaaactgagttagctaacatttatataaatatctgctgtttcaaaatacttgagtgctgatgttgagttagctaactgactactctgctaacttagaccacattaagattagtgatacagctatttaataaatatgggttaacttgtatttgaaaataggtattttttctgaatagcctgttgagaaaagtgtactgactctgggttacagtcatgtctctctcttagactctcttagcttgtgatgtttgaacccctcataagggattaagaagccctcaaaccacaactttggtcatactgacttctatctcccacttcagcatgtctgatgccaaccatcatttctctcagtctctcaaaaataaaaactatcagagttttctaaaaggttcggcagttttttggagtctctgaatgattacagcattctgcaagtctgcttcttccaatgtgagcgtctcatccagaaatctgaggaaaggaa

SEQ ID NO: 2175 - DNA, 442 bp, Rattus norvegicus
  Genbank Accession No. AI171535
ggagattttatttcctttattgagaaacttaagtcttgggtacatcaaaaccaatttctgggagaggggaaaaaaaaacagaactcataatagaaaaaaaagttaccatcatctgggccacaacagaacccagagaatatattcttataattgaaaaattctaggtgcttcataattgaccttttgatacaaaatgacctgttgaatttgtaacttggttcttgaaagaggtccacagacaaactaggaagtcttcagacctcagctgaatgccgtgaggggttatttggcttttgactccttctgggcagcttctttcttggcatgatgagcctgcaggactgccacagcttcatccaccttggaacggagggactcgggggactccagcatgtggagcagctcagagttgtcgatttctagcagcatccctgtaaatttt

SEQ ID NO: 2176 - DNA, 518 bp, Rattus norvegicus
  Genbank Accession No. AI171574
  misc_feature (1)..(518): n = a or c or g or t
cggcggcgcagtgcaggccgccgcgcgggtgaatcgaggcggcgggcctatgaggaaccggcccgccatcgcccgcggcgccgcaggcggcggcggcaggaaccgaccggcaccatacagcagctttctgcagaggagttggacgcacagctggatgcttacaatgcaaggatggacaccagctaaacaaccaagcaaatccgcacaagtaacaggacccagaagcctcgtcttgacgcctagagggagggttggcaactggactgtgcagacaatggtggatttgtttttgtttgtttctttttttttttcctgttttaaataggatctaaaaaactcatgtaaaggttttttttccccccccccccttttttttttttaaattctgaaacagacctgttttgtactgagttattttgggataaattttactgtttgccgntgtggataatgcggcattttcacctttgccataataaaatagaaatgtgtgtagaaaaaaaaaccttgtgccgaat

SEQ ID NO: 2177 - DNA, 589 bp, Rattus norvegicus
  Genbank Accession No. AI171601
catttctaaacttgaactgtttttaattttaaaaataggcatttatacagagaaatttataaaacaatttcatacatgttgagttgtttcaacatttcttttgagctttctagttttgctgaaactgcattcaaagaatcattcagaataaaacatatccattagaaggaaaactatcttttaaaattttgttctataacccaccttttaaagattttaaacaagtctatataatagactttatattgtctaggaagaaattacctttctaccattagctttgacattaaaaggacagtccaattctttaattcctttttatctggggtgggtggagtgggtgttgctagcagatcaagccaaggtctcacccatgctaagcatttactcttccacttagctatgtctgcaacatgaaatataaaccttaagtatcattgacacttttaagatctttgagaatcttacccaggagttagagatgcaaagtaaatacttcagagcattttctctgtattcacatattttttaccttttgagaaacatacactttttcaaatcttttcttgcttggaatacttaaaatatg

SEQ ID NO: 2178 - DNA, 687 bp, Rattus norvegicus
  Genbank Accession No. AI171615
agatacacattttgggtttttattgctgattacagactatgaaatgtgcattgcaagtcaacaagagattcttttcatatttccaataaaagcttaaagaaacagacaacaaacacaaagacaagagaaatacaagcttcaaaacaaaacaacagaaataagtctccacagtcacggtctgacaaaaatttgaaataacccaaaccgtgcaaatgctccacagagaccatggccatacatggggttgtaaatacttgtcccattaaggacaaaccagacaagttatcagttatattggtgatcaagacaaacctcattggcttacagcagtatttactgtcctctgtgagagtctgacaagtttaagaggttggaaacctgtgatgcttcagcagggccgtgctcagaagtccacatggttcctaagaaaccatcctcagccccccatgggtcaggaagatgcagttcacaacagggtcacactggctgcctgcaggtaaccttggaggtactgcaaggcttctgcattgaggctggtgctcaccatcgagggaacccttcccggacaggcagtagacagtctgtgaagtgcctgtgccagatggaccctggggttgttcaccgtctgacccacagggtcatactcctttttaccagcaaacgccagctgtgagaaggcagtctggt

SEQ ID NO: 2179 - DNA, 600 bp, Rattus norvegicus
  Genbank Accession No. AI171632
cagatgagtttatttaaatgtttccctttcaataaatagactataaaactcccggaagtgtatacaaaagcagtcactactggctcctgtgcactccggactgtgcagctcagtctgcaaagcaggggcagtgtaccacagccaccaggggagcccttttgagggcaaaaccagacaagtctcagaatagaagggtgtgttcaagtgtcacttctgagttctacttctgggccccttatgtgctgaatacaaacgttgaatactcctttaggattagcccccaccagactgtctcatatctgggatcaagctgttatcttctaatttctctttgtagccacacccagcagctctgagcagtcttacatgtattagaccaagtcctgagatgctggtgagcttgaagctggctctacctaaccttacccagtatcacttcacggactgtgtggtgtgcttggcaggcagaccagactgctcacagcagcatggacaagccttgactacttctggaaaagtctatggcattacaggaacctagaatctgaggtgctggtgacacatgggacttagtgctttggtgagagctttgggcactaa

SEQ ID NO: 2180 - DNA, 617 bp, Rattus norvegicus
  Genbank Accession No. AI171646
gttaaaatttttatattaaaaagtggcatgaacttttcatgtagaacaaaaatttagggaaggcaaaactggataaaaccattaaaactgaaatacagtgcttcaagtgaatcccatcacctggtgatgctataagcagtctctaagccaacaccagatactagaaccaccaatcttaaaaaaaaaacaaaacaaaaaaacaaagaaagcagcagtctagggcctccaaagcacttcatgcaagaataactgcttgtaaagcaacgggacctgctccttctctaagctcccccttctgaagcaggataaccccttttgcagggtaagtaatcacagcactgaaacagagtgcctctcggcatctagtgtaatcccaaagaatggcatgaaggcaaaccaagcattgcctgcgactgcaatgctgcccttggaggctgactaaaatggagttaaaagttttaaagtgtgcaccacattgccagcaatgggatgtgtcataatatcagatgtcagaagagttaagctaatatttctctttaaagcacatctgaaatagaaaaatctttaatatacaccatttgtaaacaaaattgcacttgattttgaatcctcgtgcc

SEQ ID NO: 2181 - DNA, 502 bp, Rattus norvegicus
  Genbank Accession No. AI171674
aagctgcttggtttaatttttttttagcacttgaaaaaaaatgtacagtagtttgaattcagtctttgcaaacctctacagaggtcaaaggtttcattcatccgtacaaaattagttacaaatttatttttggcaatttcatcttagtaacccgttttatcctattgccattgtcccaaccattgaaaaagtttacaataatttacatagaaatatcttcaaagtgcttaagaatagtgattgttctctgggatatgtacaggtggcctatacagtatatgtacaggtgggagtcactatagcacaaggttcattgctggaatatggctttctagggaaagtgcatatttggccagagatggcaatactgtctagggattcaagggttacagatacttggtaaccacatccaaagctgaagtagaacgtggccaagaatatttacaaaagtaatataaaaatgatcaagtacacaagcttgatccacgaaaagatatcttga

SEQ ID NO: 2182 - DNA, 538 bp, Rattus norvegicus
  Genbank Accession No. AI171676
ttttttttttccctcacactgctttattgcattctctggaaacagggtgagcaaccttcctgctgcctatctctgggcaacatggagctgaaatgacatggtactcataggctgaacagcaccctgtaccttacaaccctctaaccagggagcccctaatctgctatacatacggatgcagcccagaaataggggtgggatgggggtgaggtcaaaccgggggtacaatctacttttgaagacttcttaggcatctgcaggaaaactaaaaatctaccctagaagtctagatttaaagaggcctaggcctctcaggagtccatatttggagggatgggggtgccagagccttgatgtgggaaggactcatttctagagtccagacttggagaatggcttaaatcatgggcgtttcacaagagcccagatttcggctcagggagtaccagtgggatatgttaggattgggtgactgaatcttgaagtctccatgagtggggaactggggaggcccattctagggaggggctgggcccca

SEQ ID NO: 2183 - DNA, 471 bp, Rattus norvegicus
  Genbank Accession No. AI171726
acttgagctccatagtatattttttttctcattaaaggttcaaaaccaaaagcggtttctctttgcagcaaatatacattaaaatagagtctctgtacagccaagggctctgggccctggcttgccccatggccctgcgcctccctggccaaacccaaaaataaatatagtgttattgctctgcagggcgtagaggcagtgctgtcccccatcccttgaggtgggagctgatagggggccctggccaccccaggggtccaggggctggagcctgcttggagttattgcttcaagggggggcactaatgcccaatgcaatgaggagaggagcgaaggggcagggcctttgctttccaagcccccctctgctctggagaggaggtcggagtaagcagcagcaaaagcatcacccactgggagactgtggtctccatccccttccctccctgagatcagtttttgcctcctaca

SEQ ID NO: 2184 - DNA, 703 bp, Rattus norvegicus
  Genbank Accession No. AI171782
aaaagtctaaaaaactacatactttaataagaaaaaaattcaatagagtgataatactgagaaccaaggcattcagagattccaaaagtcatgcttttttcagttgactcaaaacactgtcaactaagttttcagaagtttgttcagagccagcattactcataaacgtcacacgtctattggtttacacatttactttcttccccataaaagacctttgataaacatctaaaatgtccaggtataacacagctgagatgagactggatcaaatactggtactgttctttttcttttaaactatcacctcaagtgttctgagtgtcgcatatttattcaaccaaccaaccaaaataaaaatcaaaatggcacagcatatattgtaaataaatcaaaaccaccacatgtgtaacagaaagacaaagcagtggtacattaaaccaaagctgagtacaaacaaggactgtctattgcatagtaaataaactgaaaatggttccaagtgagacagaataatggagaggtcaccgtgaaggtggccaatgagcttcctgctgaccttgactgtgaagccatgagggtatggaagagggcatgagttgacgagccaagagttcacaatcacttgagatttgccacatctggtactgggcagttcaatgacttactaactcaagtgtttatatgcaagcttatatgcaca

SEQ ID NO: 2185 - DNA, 662 bp, Rattus norvegicus
  Genbank Accession No. AI171798
aatgatttttaagggcatacacatttgtatccacagaaaccagaggcacagggtcccctgcagatcaagatacaggcagctgtgagcaggcactgggaatcgaacctgccttttgctgtggactttcatcttcttgacgggacttgaccgagatagtcacgcagcacactacagtcactacatgacaggaagcaggggcctcactgcttcgtccaaaacccagtgaagcacaaagggcactgcaggagccccaactggtgttcaagatgatactgagggctacaccaccagttccaaagtgtctagctgggggctggacgcacagctttatcccagcacgaggaggcggagacagggggatccctatcagtttatctgcatgggctacatctcaagctccagaacagcaagtactacatagaccctgtctcaaaaataaacaactaggggctggggatttagctcagtggtagagtgcttgcctagcaagcacaaggccctgggttcggtccccagctccagaaaacaaaacaaaacaaaacagaaaaaacaactaaagtgtctaagtgggaaatcaaaagccaacactgtagcgacggtatgctgagcattggccctgctgaccaggcaggggaatggaaaccttatgtccaacccaagct

SEQ ID NO: 2186 - DNA, 666 bp, Rattus norvegicus
  Genbank Accession No. AI171800
aagagtttaaatacagtataattatgtaaagttaaatggcacatgattaggatttgactaaattcaattaatttgaatttttagtccagagaattacattcatgcagtggtatgaagcattgattgaattttatttttaatgtttagtagttgttatctactgtttgaatatgatgttctaacagtttaaacattgtggtatataaaacatatacatatgtttcttgccgatttttgagatgttgtaatattctgaaccgtgcagatctcgctgccaataaaaaggaggtggcagcttcatgagtctgtggatgagtccgaaccctctggagagtctgagaagtcaatcacaatatcgtcagatggctttggtgaagaaagtaaataccgtgaagtgactgtttgtatgtggtcttgatagtggtttttataaggaagctcctgtctataaggaaggtgaacgacatcctggcctgtatcatgccgcggctgctcttctgggatgtccatagtgatatcctggcctgagtagagcctttgttgctcttctgggatttcattcaagatctcttcatataggttggctattgaaatggggctctgtgaagtgatggtctgtccaaatccctggtacaggcccaccggtgaggacggcttggaagagtc

SEQ ID NO: 2187 - DNA, 734 bp, Rattus norvegicus
  Genbank Accession No. AI171803
cacgtttttcaaaactgtattttttcctaaggcttttttatttgtattttattattcatgatcagtatagaagctcacaaaaacttgatgaggccatataaaaacaaaaaggaaaaatgctggttttctgttttagtgatattaaccttaatatagccaaatataaatttcatctaagaaacaagaaattcttttgagcactagtagctgctcgtatctgttgattataattagaagcaatacaattctgattagtcataattttttaaaagaaacttccttcatatctaaggaaaatattaggagtctagattaaattctatttggaatttagataataaccacttttcaacccagcccaaaattgttggattaaattaagtatgaactgtattttatgcagtcacgaagtataaatgtctactttgctttagggtggaaaacaaaagaaatcagagttgtggtttgttaaagtgaccgaagctctgaattctaccgaagccggttgctctaaaatctatatccaaagagtaggaaatgtcaaggttttcaccacctttatctcaactcaccaaagcccacatggactggagcagcactgtccacacatggctgtacagaacagagggaaataaatggccagcgccacatctcactaagcactaaagactaagcagaacccatagcctagttcagaaagccaaggcttcaggtcagatggacaaactgttctg

SEQ ID NO: 2188 - DNA, 488 bp, Rattus norvegicus
  Genbank Accession No. AI171866
gataaatataagttcatttattggtttttgcactgctgacaatggaatccatggctttatggagtcaagtgttctacaactgtgccacacccgagcccttagttaagtgtgatcagaacatttgtatttttgtcactggctgatttcacttggcttaatgctagagcatttgtcagaacgtcctgggcacggtgatacatgcatggaatcacaatcctggagaagctgagggatagcagggtccctagggtttgttggctacccagtcaagttgagtcagtgagctccaggttcagtgacacactgtgtctcaataagtaaggtggagactcattgagaaacactcctccaaccttccagactggttttggagaagccagcacccaagaaagagcaggcacagacagaaaaacgaaaaacgaaataaacaaacaaaaaaccaccctgcaagaaaaatctgctttttctatctagacagaaaacatttg

SEQ ID NO: 2189 - DNA, 505 bp, Rattus norvegicus
  Genbank Accession No. AI171876
agaggtcaagctccatttatttgcagccaccacacacagcagtcctcagccagtcaacacccaaagaagcaaatcaagagtcaaacccaacaggtccgggtacacgcagtagggccagattcacatccagtgcacacggaccaatcttccagtcaaatgacctgggtcacccaagctgaagtcacttgaaactctcctcggaagaaaggagttactgcgtgctttcgtccagtcgctggggattgtgtatttcattttctgggtggaaaaaaatataactcaatttaagcggatgacctcgtgcaccgccggtgatgaggccggggcagagacctcctacaacccccgcccatcccgcggccgtttgcgggccccgggtcagcttcctcccgtgggagccccgggagtggcttccaaatcccacgagcgccttctgaagtatccacggccctctcacagtctacattccactctgtacgaagcacgcgagttcttccctcgtgcc

SEQ ID NO: 2190 - DNA, 551 bp, Rattus norvegicus
  Genbank Accession No. AI171980
gaatgtagtatttattttgtgaatttacatgtgaagccatttacaaaagtaaagattcagacagatgcagctttcagtgcagtttcaaatatgttcacaacaagcaaaaacgtttttgagtattcggaatgacagtattgaatggcacatgcttcagtgtttcctacccaaccccaagaaggagggaacaggagaagatgtccctactaatgtaaatacaaccatgcaaataaagactcttaagcgaagggtcacattcagaggtgtaggacatttctgcatttagggctatcatcaccggagaattatttcacaacacaatggagagctctccaactgtccattataccagtcgtctcaaactatgttaagtgctcctattggcttaccagcattgtccaaaaactgactttagaaggagtcatttctagtatttcctaaaaagacagcatctgtagacaaaatcatttggtttcagtgggataaagcacccttttaaataagagtgtaaaatgctcctatactctcaacaatgtaaactataattagac

SEQ ID NO: 2191 - DNA, 619 bp, Rattus norvegicus
  Genbank Accession No. AI171982
cagggcagactcagattttatttcagacgagggcgggatctgaggcttgaccactcatgatgaccactgctcgtgatgacctttgaacctcgagaagaacacaggggatcacaacgcagatggtggacgcggttatcaatcaacatgcgatgcacacagggggaggggttaacacacggcacgtgctcggtgttaaaggtctgttattggttctgtaataaggacgatatatatatatatataaaataaaatacctcaatgtacaataatgtatatagtaaaataccataaatattatatatatataataaaatacattagtgtataatagatataataaaataccataagttattatatatatataataaaataccttagtgtaataatgtatataataaaataccataaaatattatatatatatatatatatcgctgtaagattcactataaggtttgctataggatttgctataggatctactataaggtttgctatgagattggctataaggtttgctataggatctgctatagcatctgctttaagatctgctatagggcctgctataggattcgctttaggggccacgtgacacccttaagacgccaggccg

SEQ ID NO: 2192 - DNA, 589 bp, Rattus norvegicus
  Genbank Accession No. AI171990
accattctccatgtttattgtgattccaatgccacgcaggacacacaccaccactggctaggatgagagacagcagacagtgtttataggtgcatatatataacttatccctatgtacacacacagagtagacattacacatgaagaatcaggagggtacactgctggaattaggctgcggtcagttttctctgccactgacattgagaaggcggagatgaagctctgagaagatgcagcctcagaaccgttacggcatgcgagtcacttcggagtcctcggtccacactcctctgtgtttggcactctcaggccctggcacctggcctgaactcttcagggctcccagtcactggcctgtctctgaaaagagtggggaggttggaggccaggcctctctccctaccgtgcctccctttttcacagtcagcactccaaacagtgggttctgcctcccctggggcacccagaccctcagctccattgtccccacaggagctcgctgggacacccagaccggagtcattgctgaagcaaagctgaaggatctgaccccagtcatgcccgtcatcttcatcaaggccattcc

SEQ ID NO: 2193 - DNA, 531 bp, Rattus norvegicus
  Genbank Accession No. AI172015
catttatttaaatttattttaagtgatccataaaaagaaaatttgtacatattaattagatatatttcagtacatgtatacactgtataatatttaaatcatgtgcatttctttcctcatcacttcttcataataaaaacgtcaaatattttcttctaattttcatgtatcgtacattaatgatgatctacagacacgtaactatgtaatagtacaacagaactttcttctaagtaactacaacttagtgacccttgtttgacctttccccattcgagtatctctcccaagattttgataacaacttgtatgagatcatttttcactggattccacacgaacagaaatcatgcagtgttaatgtgtgactggcttgtttcactcgcttaacaaatcttttgttccatctgactgtgtcacagatgacaggatttcattcctttgtatggctgaatagtaatctatcatataaatgcaccatactctttatacatttatcatgtgatgtacactttggctgtttctagtttt

SEQ ID NO: 2194 - DNA, 647 bp, Rattus norvegicus
  Genbank Accession No. AI172041
atctttaattttccatttttattttaagcgatcacctacattttagtgattaaatttaagagatatgtacccattaatcagatttattatcaattcaatttgaaggcaattttcaacctttaataagttatattcatatctgagattgtttaagctttctcatggagaaaaagaaaccaggcagcagctagagctgcaacccaagttttcttctgctcatccttaggcatttgtactgtgtggaccgagtgactggggccaggtcttctttctatgaaacagagtcttactgtgcagccctcgctggcctagaactcactgtgtagaccggctgctgcctcctaagatctgagactgaaggtgtggactgcggtggcctggctgcccagctgcccagcctctaagttaagggttgtggtctttcacccactgctcgatccactttgagatttggttgatattgtcctctagctgctctggctcgttactgggcagctgatgcacaatttcttctttgtaagatgccatggcttcttcatagagaacttgaaaaatctcacactgaatattatcttgtagtttcttctcgtgataaccccttgtttcaagtcgtttgtacaatataccattgtctgtccttaacacga

SEQ ID NO: 2195 - DNA, 669 bp, Rattus norvegicus
  Genbank Accession No. AI172051
ttttctttatgaaatttattttcttatataaattatgtatttctctgggcagacagccttcaccttattgcactagtagcacatctgtaataccaaactacaggacaagtcttaacaagaggtttgtgttcttgaacgtagcacttgtctaccaggcactgtagaagagaatgaggaaaagccaggacctgctcaggagcttaagggttgggttgggtgggatatggacagtaacacttctaacaactggttttctcccaggaaggcaaacatgcaaagcttccatctggattttgggagcagggacaggttggaaggcaactctgctccctttgtttctgagagaagtgggcacttacctcgcatttgtaacaaggcctaactgatgctttggggcaacaatcaggtgtggagttttcatcaccagatttataattagcagcaattaagaatgggccaccatcactgccacagtgaggtgacccatcctggcaccagggacccagaagctgtattctagataggtgccactaagatccagagctgggacctcaaactgctccttatctcaccatggctctgcaacactagttagcaacactccaggtacagggttcctcaaccactggtcaaagctatgatatggatggagtctgtaggcagaatgaa

SEQ ID NO: 2196 - DNA, 391 bp, Rattus norvegicus
  Genbank Accession No. AI172086
gattgggcatttaattgtctctaggatgccccgaggagaggacgaggggcctttggcagagctctggctgatgaagtaacagaaacgatgccccgaggagaggacgaggggcctttggcagagctctggctgatgaagtaacagaaacgctggacagggagtgccaggcagagaggtagccccaaggtctggctagggaaagccatcaccagggcttaagacagtcttcgagaccagttggtgaataaggaatgttgcctctgaaggaggaagaggctacagaaagggcctgggtttgcagggagggaccccaaggtctgaagattaggaacaacaaggagttagttccgagccctggtgaaaactgggtagggtctgtggccatcctgac

SEQ ID NO: 2197 - DNA, 570 bp, Rattus norvegicus
  Genbank Accession No. AI172097
atgtatatatatatttatttgtgaagggttaaaggggactctcatgtaaaaatccaaaatacaattttatgaacaacctgcagggtcagtccaagtgtggctgtgaagctctgacccagagagcagacttggggctggggtgaaggcagcaggtatgcagccttcaggatcttcctcttgatccaaggtactgcccaagcccaagtcccatctgtgctccactggggttgtgctggcttgacctaggattccctggactacccaactgtcttgtctccccagaccagccgtgtcctaggaataggctgggggccaggcccaagccagcctgacaactgaaacctctaggagacagtggggtccttggctttgtggggttcagtgcccgtcagaagagagatggtgggatcatccgtgtagtcatctccctcagagaagtaggagctctcccccagctcaaagagcacaggcagttcactgctccctgtgtccacagcatcagggtccaacaggaacagaagctgagccgtgtagtgcaccagctgctttcctgagtcggcggttctattc

SEQ ID NO: 2198 - DNA, 580 bp, Rattus norvegicus
  Genbank Accession No. AI172099
gaacacaataaatatttattgaataaataacatctttcaagtgccttaaacagattctctaacttacctaagttctgaaaagtataacaaaatgaagacaacgggacaaggtagacatctttggctccatttggaggagggccatagctcatcatctgatttctctcaggctgtttgacttctggaaaatggtctgacaccatttccttttctataaagagttagctgcctcgcttctagttccatcatcctgtatcaactggtttttcttctactgattgatgcctgtcttctgattattgggccagttcaaggcagtatagtccatctgggggaaaggcctggattctacttacttctaatgagaaaagccagactcagtagaccccagaatggaccagcaaaggcagatgggcactggattcaaaagttactgagatcagttcttttaaagaaacactgtttgaatctgctctatccctccccaaggaaattcacagcagacagggctccccaaagaacctgacctggtcctctgactaattggagatgaatacagagagcacggtgggatgactga

SEQ ID NO: 2199 - DNA, 560 bp, Rattus norvegicus
  Genbank Accession No. AI172102
ggctgtaattgcgtttattagcttgacaaggcagatgtgaatattttctgtgacaaaatggtgacaaaatatatcagccacatatcggccacatatcagccggcacacattagatgccacaaggaaataagaactaacgattttagaaacagtaggcatgttcttccctgaagctactggtgtgggaaaggcaggagatggggacaggaggcgtgctgtatccttgcgttgctcaacctccaccatgcatgtggcctgtcctgacagtgcagctcctgactacctttatcttgcaccctgaagagcatacagggcactggcagtccatgtatttccaggtcctgaggtgcacagattggtttgggggccatgctttcccagcccttgggccttacgcaacttcacagcagatgaggcacacgctggcacgtggtctgtccagggcagtggtgcaggccaggccctggtgggctagctgtcataccagtcgaggaagagcaaggaaaaggaacacatcaccaggaagaagaggatccacactcggaagcctgcgttggttt

SEQ ID NO: 2200 - DNA, 498 bp, Rattus norvegicus
  Genbank Accession No. AI172105
aggtaaaccatccaagcagtttttattcattaatattcataaatacacacagcagcttcattagagatttcaatttcctcttcagtttgaatgtggagtattaggagagccttttgcatgtcaagggacaggaagcagagatcaccctgcactgctacctacatttacctgctagaagtaaaaattagttaagtggaaatgattatcatatatatccctctcttccttttgaatgtacccaatgtaacaagagtgacagacctgaaattacaatcaccgcacaaacccaggatagctgttgtccactttcattggcaaatacagcacagaggacattgtctgccagtggggaggtcatcaaagaggacgtggtggaggctcatttcctttattactctcttttaaatttaggttttctaaagcgacatttaaaggcataatatctacacagcccatagcaccaaaatctgccattttcccccgttcatcctcgtctga

SEQ ID NO: 2201 - DNA, 602 bp, Rattus norvegicus
  Genbank Accession No. AI172106
tttatttaaggcgtaattgagtttgttttatttttggagattcttaggcgtccacttggcttatacgattccatgttctccaactgggaactgcgttggatccagccccatcttcttcatggagacagcaatgtcaaacaggtaatcataacactcacacatggtttttgctttctcccatgtttctccccacacgtacaccccgtgacgcctgactagaactgcacaggagtctgggtattcattcatggcacgagccatccgttctttgaggtccttctcttcaggagtgttctcaataatgggtaccactaatatatcatcgtatctgtaataccctccagaggtacatttccttattcctttgatcatctcttgatgtgtaattttaaactcctgtcctggaaacagaagggtagccatcacagcagctttagagtgggtatgaatcactgcgcctgctcctctcatggtgtaagcgttcatgaaaagaggcgtacactggcttttcttaagattcttagatgctggaggcccacttatgtcctgctcattgatgtcacaaacaaacatgtcttctggctgaatgcgctccttttgca

SEQ ID NO: 2202 - DNA, 585 bp, Rattus norvegicus
  Genbank Accession No. AI172107
ggggataaaggtctttattcgacaagattatcttactcagtaacaaaacagcaggaggtaacaattcccccaaagatctggaacagtatctgcccctggcaggggcagtacagcctgctaaaaaaagtcagctgcagccagggtctctagtgtcagccatttttcaaagattgtagttggggttctttcgaagaatgacaaagccttccagaattggggtgacagggagaaactcctcagtggccagctccgcccgttccccatgggccaacagcactggagttgtgtgagtctggaaccccgtgatcgttttgggcttcccagcctggcccaccacatccactgcctgacccacgcggacagaaactggcaatggtcgcaactcctcatcaaatgtaaccagcatccgaggctgcatggcggccaccagcccatacagtacatagtgagatttccctagaatgatgtttcgcacatccaggaaagaaacaagcacggtgagcagccccgccacagccacttgactcatgagctgccggtcactgtggtaggggcagagggtaagtgtgcccttccctaaatgtg

SEQ ID NO: 2203 - DNA, 513 bp, Rattus norvegicus
  Genbank Accession No. AI172157
gaggttgcaatcttgctctttaattgtggtgaaatgtaggagacagaccctgatactctgtagcagtggggaccccagagaaagggccaaaacctggctggaaagctgagggaggggagggtttggaaaggggagcctggagccctggacaaccatacaggtaaaagatgaggcctctgctgctcctacactaaagggtagggggtagggtacaaaaaggatagagcaacgccccttttaaccacatccttttcctaggtcacaggatagcaaaggtgagggagccctaagagggggactcggaagaagttagataaaataggtgcaagtacatgttctctcccagcccattttttttcacatttgtaacgggaataacctgacgaactgtctgtcccttagtgaggtggatatagaaagtaagatccagggcccataagtcaacacctaaattccagaggcaggaggcaagccgcgaagggtcggggaggtaagcactccccacaaaacact

SEQ ID NO: 2204 - DNA, 719 bp, Rattus norvegicus
  Genbank Accession No. AI172184
attttaacttttttattgtttgcttattaaacatacattctcaaactgacactttgccatgaataaagcaacaaaaataaggcaataccataagatgtgctttacatacaaacatcatcctggaagagtaggaagtctgaatccatgtacaacaaaaaaagccaggaacaaaaagcactgtattctgaacacacacaaatgtgtatgtatgtaaagacagcacacacacaatacagtttacttgggttctttatgagcataattccttaatcatcctttggaagaatgaatcttaagaaataagaaatctgaactgcatttattttcacaatatcaatgttaaacttaggagaagcaacttcattgactaaatgttaaatatttcaagagtaaaaggcaaccttaatttttagtaaccctctaaacagggtctggaaaacagtaggttttcctctcttggtatgaacaaaggatggtaagcaagcatcattgagagtgtggacacatagaaaaccatcttgggaaccgtgctcttcacaagcctaagaaaccaccagaaataatgagtagaccccatgcaacccaaatgcaaagctaactctatacatgttacaattttcaaactcttgcttctaagacaattttagtacacctaataagtacagcaggtcatttagaaaaacagaaacaaaatatatacccagtctttgcaattcaaa

SEQ ID NO: 2205 - DNA, 646 bp, Rattus norvegicus
  Genbank Accession No. AI172185
cactggccattagctttttattgacaggtgatgcttccacagaatgcacaagagattgtctgtacagcagtcatgtctgccttgttagcctgatggttgctgtggcctcctgtgttggacagctttcaagtggatacctatacataccggtctactcccccttgacgaaagcaaggccttatctcaaagccctttcatcctaagaataaattctgttctttgtgtcccattccagagattccaagtccacttcctctctggatgccagtctgtggagagcactgccacatgggctgaccatcaggcctcagaagcctttctcaagaagccaggctttaagttgctcatcaaagtagcccttgattcgaagagtacctgtcacctcattaacctgggtgacaggcgtctttcccagcaatgggctcaaaaattcttccacatccttctgtagagcccagatgtcaccttctaccttgcgaattaaggtcatctgtcggttgccatgtgtgatctccttatagacagggatgttgtgcatccgagagcgacgaacaaagtagggcaagctgggaaggggatctctgggaggctgccaaccactaggagtgggataatgtttatgttttggtggctctgggattttggt

SEQ ID NO: 2206 - DNA, 668 bp, Rattus norvegicus
  Genbank Accession No. AI172206
aactttaaagactggatttatttggagaaaaacaaaaaaccctcaacccaaaggatgggattttacatctcaagacatctcccaagtaatgtctacagattacaaatcattttcatagaagatatttttgtacaaattttacatgtattcaggagcgggacataagtcaacccctgttcttattttaacagaggaaagtaggagagtgggacaaaacagctgtcttttggatgcaactatctggaagggaaatagacatgaagagggcaaactaccttctcactgtctacaacaatggtttaaaaacccattcaacctgggtatctctgcaaaagccctcctagctactagccaatcaaatccaccgaagaaatttgctgtgcctactgctgcagcacgtgacgtcaatgctcctgcacagcaggcctaggaacttgtgctaaaaccaaggtctcatctgtctgcaggtacctgactacccacaacagggaagcttgccatcctcggagctgagctacaaaggtgcacatcaagacaggctacagcgctgcacgaggaactcggaccctggccaacagttctttgcatcctcctttactctggaagggagtaaagacgccagccctcctaggcagaaaagcagtgacaactcaggcaccggtgtgggg

SEQ ID NO: 2207 - DNA, 530 bp, Rattus norvegicus
  Genbank Accession No. AI172236
acttcaagtttttattccaactccaaaaaataggactatcccaaacaatagcaaacattcggcttttttatggcagttactcagatatacttgccagcctatttagtgttaaattaccacctacagcatttcaactgaaaacagtctctatctttagttatccctcttaagactgtctgagagaacaaaaactaatacatgatgctatcactaaaaggaaaaaaggaatactcttcatggcctttcattcatttcatcaattaacacacataaggcagcatctttttctataatctggtcccttctgtgacctgaactttctctttgctgttcattctgcccagtacaattgctgttatcatcagtatccatcggctccgttttaactctcatccctgcttctgagtgaggtaaatcatcaggcaaagaagccaagcagttttgaatcatttcaattactcgttccagatgtttctgaaacctttcagctgtttcaaggcgctgggcgtttctggaccctcatcatgact

SEQ ID NO: 2208 - DNA, 625 bp, Rattus norvegicus
  Genbank Accession No. AI172263
gggtggtgggctttaaagaaaacaagttttattttttataatcagaacattctaataaaaatattattataacattactccctctgtcctccaggccttgactaacaggcatgctgtggagtgcctacacactggctccctgaggtaggtgtggagggacccactgcccagcctgtgggcagcccatgctgccagagatgcccactcctcccctcccagacgtgtgtgggctggaccttctccctgtgcagctaggtcatgctccagactggtacaggtgacaatggggggctgggtgggcacagagcctgcctgaggggcacagggccagaagaaggcccccatggcacagcaacagacacctgagaactcgccctggcaggcacctctgcaggtgaggtgggcagcatcagcagacaggagcccagccccctgcagggctgcagtttgtgagggcaaccctgcgggggaggggcagctccatcagtgacaccggcacagagaaatactgtcaactgtctccacagggagctactgaccaaagccagtctctaagtaaaaataggtttggggctctcggtgctgatggtcttgcctgcaccacagaaaattcccagcaggacat

SEQ ID NO: 2209 - DNA, 717 bp, Rattus norvegicus
  Genbank Accession No. AI172266
aacatttcatattcttttattctttcttgtttacattcagaataaaaatcagtgtcagcacccggcaatgcttttgcagttttttgaataaagtcacatttgtaagaagtttcctctacaaactgcaccatgtaacacaccagcggctggaggaggacgcacacgtgggcccggctgtttgacttcaatcgttctgctgctttggcatctagctttgcatcttcagaactagaagcctcagtgagcaaacttatttctgggtcagaaggccagtaagaaattcggttaactccagcattcactatcattttcaaacaagcagaacacggttttcttgaaaaataaagatcacagtttttcagcctggacccatgcttaataagagcaatttgcccagtatgcaagtcttcactggaacagtgcagaccaatgatcttcatgttttttaccaccacaagaccagttttcttaacctgttttttgtcagtagatactctggccaggtcttcattatctcctaagggaccacgggtttcctcttcagttttctgagatttttgcccttgggcttctactcccgggaagagctccatccagagactgagcagagtaaaaaggttcactttaaaaagccttggtatttgacccgtcatgctgcccgtctgcgtgccgactgacctctcggccccggagccctccagactctgcatcggatcc

SEQ ID NO: 2210 - DNA, 625 bp, Rattus norvegicus
  Genbank Accession No. AI172272
ttttccgtctagatttattttatttctctcagtgttttgcctttgtgagcgtacacataccagaggtgtgcctggtgttcttggagatcagaaagagggccctggatcccctgaactggatagttgtgaggcactagatgggtgctggcaactgaagccaggtcttctataagagcgatgggtgttcttcaccgccaagccatctctccagtcccaacattttctgttttgtttaaaggaaagagctttgagctgggggtgtagctgggttcgtagagggctttcccggtactacatcagctggccacggtgacacaggcctctaatcccaagtattggagagtggaagcaagaagatcagaagttcaggtcatggggtctgtgcttcctgctccgtcttcctctcctggcaggtggttcagtcagcagaacttccagcgattcccacattcattgcataagacaaaggtggtcatgggctcatcagcactgcgtgtctgcacctggttataggtacaattcttcttcttgcacttgctacaccgcaagaggtcagtggtggtaccgcctgtcttggccatctggtgctcgcggatggcctcttgagtcatggcgttcctcaact

SEQ ID NO: 2211 - DNA, 607 bp, Rattus norvegicus
  Genbank Accession No. AI172274
aacagttgcagcctgtttatttaacacagggattatcatcacaaatgataatttccagatataaaagctgagaggttaaatggtttgtccagaattccctgagtcatctacagagagctggaatccggctccggacactaagtcagataaacctggctggatttattctgtgagaggaaatgaaggcgaccttcactgttccatccacagtgatcagagccaatgacacagacccaaaatttgcttgagtgtagagaaccaggcagccctggatcccagtgactagccaaggtgagcaatatggaaagtggcagtggttatcatggtcagcaccttggttctaggtaccatgccaatcacactgttcttgtgaagaaactgaagagcctgctgcaaacttctcctctggatcctttatggtgtgtgcttaaaggtagctgggttacttgcccacaaatttgggaggtcgtttctccctgaaggctgccatcccttccagccggtcctgggttgggatgttctgggcatagcacatatgttcaatggccatccctgatgcgatgtccacctccattcctctgtcgatggcaactttgcccctcgtgcc

SEQ ID NO: 2212 - DNA, 634 bp, Rattus norvegicus
  Genbank Accession No. AI172285
aggtgtcacacttcatttaatctgaagaacattacaggctctctgtcttcagatataaattataacagtacagaacacagcgaactcgaacaatttaaaaactaagtaagtctacacggtgttaattccggcaagagtcttgccaatctgtttgaaagtcacccctgacctcatttcagtagacgtgcaccatgccatagaggaatgtccaaaagaggacgtaggtgaagaggcctccaatgaggcctcctgtaaagagaggtcttcgtgacttgaagtatttgttccacctccttcccgctttgagaattaggagcagggagagcaggacggaggcaagcaggtagaagatgaagccgtagagaccggtgaggccgaggatgccggctgtggcccccgacagcgctgacactgaggtccggcagtaatccaggaccgcggcgttgcctcgcacggctgcctcgctgatgaacggcggcccttcccgtttggccaccaccgcggccatcgcatccgccggggctccgcttctgccttctcgcggactcacgcggaactggaatgtagcggcacgcagtccctcgtgttccgtcagacaggaaaaagcggagagtccagcgccgcccctcgtgcc

SEQ ID NO: 2213 - DNA, 405 bp, Rattus norvegicus
  Genbank Accession No. AI172286
acacagacacacagacacacagacacacacagacacacacagctgcttctttcatgaggggttttctctcgcttcctttagttgctttatgtaaaatccaaagctttcagggggctcagtgaaggggaccggctcgcccacatccttgagcaaagatgcgtagcgcttcagaaagaggtcgtccagcttcatgttctttgctgtcaaatgctcatacagcgctttagcggaggccacgtctttgtctgcgacatagcttttcatgctgcaggagtacactctgtcattctcacgtaactcgggaatcagctctaacaaggtcttcagaaccggggccttttttggtttctgagacgtcctgagacagaacaccgacagaattgaggtctgctcggccctcgtgcc

SEQ ID NO: 2214 - DNA, 730 bp, Rattus norvegicus
  Genbank Accession No. AI172302
gggttttaattaaataaacttttattttagaatgactttagattcacagaaaagttgcagagaccaaagggttcccatatatcttcatccagcccaccccagagatatgattacaaactggaaggtaactaagacccagacagtatgagtcctggttgacctgctaaagtgctttctctccctggtctctgtttggtcctaagaatcaatccagcaccacaatacactttattcctttcaatctcattctctgggacactcagtgggtggggaagctggtgacctcactattgagctgggaagacagaggcttgaaaatgacaagcgtagcaagtgccacctcaccctgctgcttccgttgccttgtggactctgggtttgcggaagcccctctgaatgccccgttatccacctcattctgcttatgaatcatccttggagtggggtacccagctctagaaggcaccgtgccacgacttcttctaggttttaagaaccttacttaaaggctgacttggcccctctgtgtgcttatcaataaacttgtgaacgggagtgcttatgtgtgggagtgagaaattctgtctcttgtccaccaagattcatctgtgatgaaagatggccccacgttctttatagttcctcccattgagagctgggtccacttgcacccctggaatctaaggaatgaactgaccagtggagacacagtcctagcaccggggcttga

SEQ ID NO: 2215 - DNA, 574 bp, Rattus norvegicus
  Genbank Accession No. AI172313
caaattgacatgagtgtttattgcacaaatttcccctagaactgggaggttattataatacaggtgtacatttgagaaatgtattcagaacaacaaacaagtatgtacattttatatagtcatcatctaaataacttaagagaaagcagaacattctcataagacagctactggatgtaggcattatgcaaattatttttagtgatcatctgcactgtgtgccaactgcaacaaaatgaaatctgtagtaatgtttattgcacttaatagtttcaaattcaatattaagacatattaataaatgcaagatatttaaaatcaaatcaattagttaacatatacagaaaattagttttaatcctataatataaaagatccctttttaatttcctgtaacaatgaacaggtatttttaacatgtagcacatatttatctgtaccattaagtagttgaaaaattattaaacaggccaaaactctcttcacatttatcacagccacactgtaaagaagtagcagctcattccttgggctctgagttagtaaagaatatgatgatcaaagcattataaaa

SEQ ID NO: 2216 - DNA, 567 bp, Rattus norvegicus
  Genbank Accession No. AI172405
aaatctttatgttcctttattggagcaagattcctgacgtatacagtgatgtatttactaaacagagtcctgtgcagaaattacacactatccatctagacagattttggttacactttgcctattgatggagtagttccatttataaagttttatacatcagaaagctttgaatttgaccaggctgtccattaatcatctctgaaaaagtggcatttcattttagctctattttacagcattaaaaagcttatgcatcaggtcgcttcccgaaacattgttctctgcacaatggcgctgggcagacagctcttcatccacccaggtcagagtcacgtctgagagtttctgctacatacccgtgacagcccacctcaccgactgctcaccctgacagacagcccaccttctcggtcagttcacactgccagttcacaccagcagttgtcctttgtagatggcattagagtatcaggtcagtgacagtgggagcaggtgctgccatgagatccaggtaactaaaggcccttattttttttttttaaaaaaatgccaaatgtgagataa

SEQ ID NO: 2217 - DNA, 651 bp, Rattus norvegicus
  Genbank Accession No. AI172417
acatgtgtatatattttaatctttctgcaattaaagttttaaagtagtagaaatagtagcctaatacatctgataatattgttaagggttacttgggttgattaattaagtttatcacaattataaatcatgcttgctccagttctacaaggaccccaccacagtctttgggatggaggaaaatcacgggtttcccatgtgcccctattttggcctcatcactcagactgcggatcttctgtttcttcagatccatcacagctgcatttatgttgtccacctcgatgcagacgtgatgcattcctccagccttgttcttctgcaggaagcctgcgatcggactatcactccccagtggatgaagcagttccatcttcgtatttcccaggttgacaaaaaccacagatactccatgttccggaagagggaccgcctcactcacctgggcccctagaacatccctgtaaaatgacgaggccttttccaaatctggtactgctatggccacatgattgagtcgacccagcttccacacaggactggatgcttgatgctgggacggtgatgtggaaaaacttctccctgctgcaactggagtctggactctggagaaaagccctgtagcgcctgcagccaacgcagcggccttta

SEQ ID NO: 2218 - DNA, 557 bp, Rattus norvegicus
  Genbank Accession No. AI172452
ctttgtttgcaaaatgttaaggagactatccaaggggggaaaaaatgaattcaaagggtttgtgtcacaaagtaaaccagtcctccacaggcaaattcatttgtttttgggcttcgaggccatgtagagggcgatcaggcagtagatggtccctcccactgtgagagccatggtggtccggtaaagcatttggtccggaaggcctcgtttcaggtggatgggcacaccgtcagccttctggaagaatctctgtagctctggaactttattcttcccagcatagtcatatgctgtcacactggaggtcagtttggtcggtgtggcaaatatgataggcggtgcttctctggaaaccggcttaaaacccttttttggtttctgccatggtggctcacaacaggtccatgtatcctgagctggcctttaactcacttgcagcccaggctggtcttgaactcctgatcctgttacatctgcttcctgcggagtataggcttccgaagcccaagcactaaccaacttctgcgtgaaactgttaaactggagtacatgttggc

SEQ ID NO: 2219 - DNA, 579 bp, Rattus norvegicus
  Genbank Accession No. AI172453
atcaaaattaattttgttatacatgtttttaataagtttgacaattcttttcaatacaaggtgagttaatttattttttttaaaatgatatgtcttattttagagggaaatggctagttacaatggtacatgggcacgtaggctctcgttcttcattattttaagaacatacaatttgacttaaaatttgctcctctaaaatatagaacttcctcctgtaacaaaaataaattaaccttgtagttgaaaaaaatggaaatatttggcataggtctctgagtgaacttgaaaaacaggtcagtatttgttttgactgcagagatcacagaagctcccagaaccacctggcccaactggcaggccatttctgaacatgttctgttgcacagcgggtcagtaagtgcatggaggatgctcaagacaggacagccacaaccacttactccaaagtaatcaagatttaatgaatgacatcagtagaacaagctcaccagtttttcaatgcctggaaagtgggtagtaagtgtagaacaagttcttcgataggagcaatacaacacgttttcaaattttgaagac

SEQ ID NO: 2220 - DNA, 572 bp, Rattus norvegicus
  Genbank Accession No. AI172519
tttttttttttttgtttcgttacttttgttttattgaattcacgaagacatcccaaaggaatattacagccaaatgaaaagttgtttccccgctgaaaaactggcttatttccctcagaaatgtgctatgcaagaacatgcctttgccccgccctcagggctacacagagcctgtctttctgctgctgcttttcctgtttctaatttggtggcgtatctacggcagcatgctaacaaccaagcattcaaccgtggagacacagacttccagtctccctagcaggcaggaaaccccgttgtgtgcctgatgggtgtttgcgatgtgctggttggtgttttacactgtgctaataatccttctcggcttacatctccttcttttttgaaagcccatttttccaggcttgaggagaagggcttagcgaacagaccacctgtcacgcaagcatgaggaccttagttcgaatcccaggcattcacacacaagccaagtatggacctagctaaccggccacacttaacccctaataccctctcacactcacctcttttccagcctagcgtgcgcctct

SEQ ID NO: 2221 - DNA, 397 bp, Rattus norvegicus
  Genbank Accession No. AI172540
tttttttttttttttttaacagcccaaactatttgggactggtaagaggaatcagtgggtaaaattctctatgtataatcctgactgtgcctgagtttgatccagtgagccctcaaggaagggagagaacttactcctgaaattgccctctgacctttacatgcactctgtgacacatattcctgcactgccatacatgcatcatgcatacatacatatatgcatacatataattttaaataaaattatctttatgctttacattttaacttagctgtgttttgtaatgactttaggtgatctaagacatgtttgtataaataatacaacacttggctcatatttataatgcatttagtcagatctgtctcttttcctatggaagcgtgtgatgcta

SEQ ID NO: 2222 - DNA, 157 bp, Rattus norvegicus
  Genbank Accession No. AI172542
tttttttttttttttttcacacagctagcccatttttattaggacagaagcacacagcctgtgtgcccctcaaattcacatcccattcaccttccctcatcgtggggagaggccactgtgaaggcagggtaacccccatcaaactgtgggcaaccac

SEQ ID NO: 2223 - DNA, 261 bp, Rattus norvegicus
  Genbank Accession No. AI172572
tttttttttttttttttgccagtagttatttatttcagttactcctgcctgaaagtccgtatttctcaagaacagcaatgcatctgagtatccactctctccagtccttgacggcttccataggcttcggaaaatacacatgctcagagctgcttttcggagtcgctcgtgagtcgccgtaagactcatcgtcaatctatgtcaccatggctttgtatctctccacaatattgaggccgatagcactctgcaccttacata

SEQ ID NO: 2224 - DNA, 511 bp, Rattus norvegicus
  Genbank Accession No. AI172600
tttttttttttttttttagggttcctaactcaaaatttaataaagttatatggtaacaaacaataacttgtttcaaggaaagtgtccaactctcccaattaggtctcactgtacatggacagagctctgtctgacatacggaaccttcctttcagcgcatataacatctaacgattactagggagatcaggcatgaatacaactctgaccctttgaccaagccatctacagtttatcttctggttctttctctggtgaaatggattcttttccatcttagatggcaaaccctctctttcgccgcctgggaacggccatggcaagagcagactcattttgagcagggaacaagcaagcagcagggagcacaagtcctttgggaaggttaaacacagacagaccccagaacacatcggccagcagagatttgcccaagtaagaggctgggatagagtaactgtagtgggaaaatacactttacagtggtcaatttacaaagagaaagcgcccc

SEQ ID NO: 2225 - DNA, 358 bp, Rattus norvegicus
  Genbank Accession No. AI172610
tttttttttttttttttcaataaaccaatttaattttaaatgaggcattgccagaaaattttgtacattgacttggcccagcgatgttctgtacccttggtgctgtgaagcaggacacgagcggaaggcaaagacgggttctcacaaggactgctgcaagtcaggccagacagtgtatttaaacagtcttcttagacattttcttgcctttcttaaaaactagcttatttttaacgtagccacgcttccttttagtagtcttctttgacaaatacttctgtttggggaagatgttggtgactcgaggcttgtgacctaatgtctccctgttgtcgggtgctttcacttcctcgtgccg

SEQ ID NO: 2226 - DNA, 535 bp, Rattus norvegicus
  Genbank Accession No. AI172618
  misc_feature (1)..(535): n = a or c or g or t
tttttttttttttttttaattttancaagtttatttgtgcttcaaaatacaaagcccaatccttactcaggaaatctatcagatggttttctaagctcagcagggcctccccagctgtcaaaggcttccagggtgaccacagtcactccattttgctagctcctcttgcagaacaaagtccaaggtcttttgatggctctttgggaaattaaaggcaggagcagcagcaggctgtgtggttctctctggcaccacagggcaataaccaggacgcagccatcctgaaggccctgatgtgccacgcctttcgatgatgcccctggagccgtcctggaatctgccacttagcgcagaagcacggatgctctgacgagctgtgtgtggaagctcctctgctcgcaggcagaagtccaggcgcaggagggctgcccccgtggctgcagcaacaccccttgaaggcccagaaactatggttcagcctcccccatgcagactggtcacgaaggcccttcctcaccgcgcaacacctcaatca

SEQ ID NO: 2227 - DNA, 542 bp, Rattus norvegicus
  Genbank Accession No. AI175001
  misc_feature (1)..(542): n = a or c or g or t
ttttttttgtggtcagaacacttaaaacctatttttcttacaatttttcaaaatatgatacattactctataaacaaaaaagatacacaacaggtctgaaaggcttaactgaaactttgtatcctttgaccaacatctcttaatcgtctagctcctatttatactataaacaattaccatttttcagtattcctatctgttcaatttaccttttaagactcancatgtgaaaacattgacatttgtcttgctgtgcttgcctggcttccttgaacataatgcactgcaggctcacccgtgttttaaacatgattttcctattccttaggaccaagcagtattctgtcaatatgctggactaggtttaaatgctgccttttctagaatagtagcagcgcactttgatgtggctcagtctaagacgctgacccggaacgctgcaaactaagcagctgcttgttatgaaatgcatcattttccttgtcatcctgctcatccagtgattcccttatacagttcttcaactcttcaatcctcgtgcc

SEQ ID NO: 2228 - DNA, 587 bp, Rattus norvegicus
  Genbank Accession No. AI175005
atcttggacacctctttattgttgtagtaacaaaaatgtgtcatataaacagaactcaagttctatttttatttatttttaacaagaataacagaagttacagagttgtaaccacccccaccccccaaccctaccccaggaggttgacatttagtttgcaagaaacacctgctggtgaaagcatatgactactcttttaaaaatgttacaaaatttaacaaaacattgtcctaagcagctaccttcatattcgtaaacagaacataaacgggctgatccagtttctgctgcacatcaaacagccgctgaagccacctctggttttaaaacaacaaagataatcctgctaaactaccagagcagacacatcggagtctgggggaggggaggattttggaggatacatcattagaaacagaccaacacacacagcatcctagacttcaaatgacttaatgtcctccacattgcctccagttctacagtgacttcttccctacactacaatggcactgtggctgtccagtccacattctctttcgaaaacacaccggacacttcggacacaacgggagagggggtctgtg

SEQ ID NO: 2229 - DNA, 580 bp, Rattus norvegicus
  Genbank Accession No. AI175011
  misc_feature (1)..(580): n = a or c or g or t
cacaatttttattgcaacgtggccacttttatgagggcagggagtttgatctcaaaacaatgttccatttaaggctcttttatacagaaattgccatcatgactgatattcaaaatatctgtagtgtttcaagactcatatggtaaacataaaactcctataattatacagtagtgtacactcattgggaatccaaagacatcaacacatctattcctttgaagaaaatatgcaggtaagaaaaatgaacactgagatactaggataaattgaggacaggtaatgaaacttaattggcattctttataanggactaaacgcattacaaaataaaagtgcttttaaccaataatgttaaacctgtgctgccatgtcacaataagcgagccaaggcgggtgaggtgtgtgactgctccagtgccgcaaagaactgtgatcaagtgcagctcgactataaataatactgaaacaagtttcccatatgaccagtggagaatactttcaaggcattcaattagctcaaccctctgtagtactctaagctattcacgctgacaatccgttgtagtgctcacgcaag

SEQ ID NO: 2230 - DNA, 649 bp, Rattus norvegicus
  Genbank Accession No. AI175033
cattggcattaaaagtgtttattgggaatatcatccaatctatacaagttatatacaaggcatgaaaatggcaaacagcacaaaatacgattgaggtataagctaagagcacagtatgtcatgtttcaataaatataatccaaaatttgtaaactaagtaaccagatagatgagtcattttttctagtaaaaccatataaaatatttatttcatgtgaggtagaggacagttttgtgtgtcgtgtaatgcaaccaaccacagcaattttaatcataaaactatatgcactggcaaaattatcaatcgagttatgctcaatgtacctaatgtgtttccgtagttgcagaagggaccattcacatactgccttcccaggttagaaactgcggggtaattgaactattacactgccttaaaattactacgggaagtccttccagcagaaaagctaatggtgactacatgtatcacaaactcacaactcaaaaggtgtcctagatttagcaattattctaatggggtgttctcatgagaattactttaatgtgctgtgctttctttattttcaagtgaggtatcttatattgaagaaaaaatcttataaatttcttttatactaaactaactttaaacactatttcggtttct

SEQ ID NO: 2231 - DNA, 529 bp, Rattus norvegicus
  Genbank Accession No. AI175034
acaacaaacatttaatatttaactgttttacaggaaacaaatttaaataacatatacttattttcattactgatcgttgcacaaagctgacaaaatacggagagcattctgtgattaaacaagtttgacattaggaaatttcttcaggcttccacttccacagcagctgagaccacgcagacttgtgcaatgtcatcatattcatatgttctttttaaaaatgtgtccgtgagtcttaagccagacacgctttggagcccctgtactgaggacaggagagtcagggccaggcagagcgaggagctggggtgcagcttccccagctgtcttcctgaaatcccacaccagtggatagaggtggtgttgcacatctccagcactaggtccatcgtcctctcactgctgcagtttgtgattttacaggtaatgtggaaaggttcttctaggtttacggtatctgggatggcctctaaagacagcctaacatctccataacctggagccatcctttgaagctggctggtctgta

SEQ ID NO: 2232 - DNA, 649 bp, Rattus norvegicus
  Genbank Accession No. AI175045
tttttttttattattataataaaaatatttattataaaataatcacatttctttgcatataaactaaaaacataaatgtaattcacacattaataagttaagtgggcctaggcatttagcatccatctactagagtttaaagtctcctgtgggttcataaataatagggaaggtattttgatttaatttacacagttgatgctattgagatcttaaagcttttctctattactttacacatagctcgtggtatttgggctaattaaccaaatgccttagatctttggtaaacacaagtattcatgtgcacaaacgtgtagctgaaatttcagtgaaaacatcaataacaaaacaatgatacgagagataacccaaatgccgagagtttgtgtgatcaatcaaagttattgtccacaacttttatggatcacatctgaaatgcaaaacaaatagttgtggctcctgttgtcacaaccagaagcacctcagctctaagtcaccaggaaactaaatacacatttcaaactcaactgatacacaggactgataacattacaatgcagaaaagactttcaacgttaatttgacacaaattaattaattatttcaccttatcttgtaagagtgagacccactgaagaagccacac

SEQ ID NO: 2233 - DNA, 587 bp, Rattus norvegicus
  Genbank Accession No. AI175063
catttctaggcacaaagccatcgtgtttattcagtaatgattatccgcataggttgctataaacaagagaactgtgctaaggtaaatgcttggctgagatgttttgtcttaatcatctttatccagagtgtttcactcaatgttatgatttaccagtttacatttcaaatcaatacactcagagagagggaaagaaggaatttttctataattaaaaaggaactataattacaaacatatttaaacactttaaactgctaatttacaacagaataccctgtaataagtcacaagatgggaaattaggaatacatactggcaaaggctgctacttggtgatgtatttggcaagtaggaagaataggagcaagatggcagtagggaaacggtggtctagaaacaagaaatcacacaggtttttaaatacctggcttttagagcaaaacgagttttaaaaaacaaccatccacgcaaactgagatctgtcgacatagaggggaaagacagaacatttctcttacggtatagaaaagatgcaaatccctgtaaaggaaaagtcaatgcatattttgagcctgttcacgttc

SEQ ID NO: 2234 - DNA, 440 bp, Rattus norvegicus
  Genbank Accession No. AI175288
cggtccacagcggccttaggaccggggtaggccgcggcgcacagcgtgcgacgcggggtaacgggaacctcgagtcccgcactaattggagccgactcggggctggagggatcggcgggaaatggcggacgaggcgttgtttttgcttctccataacgagatggtgtccggagtatataagtccgccgagcagggggaagtggaaaatggacggtgtattactaagctggaaaacatggggtttcgagtgggacaaggattgatagaaaggtttacaaaagatactgcaaggttcaaggatgaattagacatcatgaagttcatatgtaaagatttttggactacggtattcaagaaacaaattgacaatctaaggacaaatcatcagggcatatatgtgcttcaggacaacaaatttcgactactcattcagctgtctg

SEQ ID NO: 2235 - DNA, 437 bp, Rattus norvegicus
  Genbank Accession No. AI175294
actttgaaacacctatttatatccattttaatgagaattaaaagatacaatgggtcaacaacattaaaaaaaaacctattggggtaagacaggagaatcagatcttgtttatagcgtacgctttacaagagactttgacattgtagtgttagttcatcgctgcccactgaacgatccccgtgtgcatcgtctttgtctttggtgtcactggtaccaataaacacagttcacggctttaaaacctaatcacactaactaggaaaaagtaaatcaacgtcacctttttcaaaattaaatacaaggactaatttttgtctcatggtccacaatacctggaacatcatgccaaaatattaagggttaaagggaacattattcttctctaattgcaccaaaatgtggctactgtatgctggtgtgatgacaaccagtgggca

SEQ ID NO: 2236 - DNA, 527 bp, Rattus norvegicus
  Genbank Accession No. AI175342
  misc_feature (1)..(527): n = a or c or g or t
ctgccaaaacaaactttattgcaccaaaaaggaaaaaaaaagaaaacttcatttatgtacagtcagatataaagacatctctttgactcctgtgcatatatttcctcaacttaaaattagggcataaaagtcaggctgctgtgccagacatgctctgccccatggcagggccaaggagaagattgtcacttgaaagtgggaacacttaatggatgacagacaacactggacccacagaccaaaggcattctcagccctggactagctctgggaatggaagagggaaattggaagcagggtcccttctgaaatctccacatatgacccagcctccatgtaggcaaaacaaaactgctccccaagtgacctgtccctgtccagttctctgctttctgcccttccaagaggtccctctttgtgccctattttctccctctctctccaagggagtcccatgatccacaaggcagagacctttatagcancgggcagggcaggtagttctccattcctcagggttggacact

SEQ ID NO: 2237 - DNA, 538 bp, Rattus norvegicus
  Genbank Accession No. AI175366
aaagtttttaaaaagtttaatggagccaataattcggcatataaattgtgttctggcagacattagacctgctttctcttaccaaagaaaatggcacgttttatcaaaatttgacaactgagagtaaagggcactgagattcagcttcagagcaccaacttaaaccaaacaaccaagaatatcattattcaacttggacagaggaaacagaacaaggcaggaagggagatgaagcatgttcctcggtctcaagtccctcaggaatgggagttctggcttcttgtcagagcaatcacaccgtcaaacccaattccagaatttatattcacaaccacagaaaagcaaaattgaactccatgtcttggtgtatcctaagggaagcctggaagtccttgtgatgcacagggtcgtccatttaaggtaaaatgacagattgctataattcttcctgcttttcaaataaaacaaagctccacttttgcaaaaactgagaaataccttactttccttcctagtctgaacacggagttcactgttt

SEQ ID NO: 2238 - DNA, 531 bp, Rattus norvegicus
  Genbank Accession No. AI175459
acttcagctttgaaaaactgtcaacaatgagagaacagaacagagaacaggataaaatctgatagatgattggtccaaagtatgtaagaggaccttagagttgaatcagaagacaaacatccagtttataaaatgagcaaacaccaacaacggagaaatacaggtggcaagcttggcgtggtggtagagcagacaggtcatgagttcaaggccactatttcaacattttcaaacaaggtacagagaaggcaagtatcaaaacaggtgccccgtgcactgcaacggaaacccctcatgacaaattctgccaaggacacagaatggcagagcccttccttttgggaggtgcacagtacacgctcacacggatgggttacctcttacagcacaggtctgtgctgaccacacgatcccacgcttgagctccctggtgtccagtggaattaaaaacacacagggaaaactgctgcagacattggttcaaactctcaaactcagaagcatccaggtggccttcaggacaagctgtgg

SEQ ID NO: 2239 - DNA, 658 bp, Rattus norvegicus
  Genbank Accession No. AI175477
  misc_feature (1)..(658): n = a or c or g or t
aaatctgcattggcaatttttaatgtctcacttgtgcagaactgaaatgtgtttttaaaggcacagaaggaaggaaaggcagttgtctgagcatgaagtcacgggaaagggtgctggagagaaaccgtgggctgctctgcgtagctgtaggaaatgaacaatgcggtgccgaatgagagctggcgctactgtggtccaagtgcaggcatcgctcacacgtcagtcggcagagcgcagataccacagtgcacagtcgatcactgtggagtgaatgcccaggaggtgctcgatgccagtgaccaggagctgcaggcgcagtgtggtcctcattcaggacgtggacagacattcgaagcagtcaagcacataccttttcctaccagaaatcactttctctgcaagtaaacaactgtctgcctaccgagaattataattttaaaaaatggagttgggtctaattataatttgtgaataaaaaaattacaaaaataaaagcagagacttctgtccttgaaaaaagagatagaaaactagatnttcctgtaataagaaaatcatgaatatttcacctttatgtcttttcaaacgtcatctcttcttttttttatattctgccataattcacattgggagatgtatacactatggcaacttctgt

SEQ ID NO: 2240 - DNA, 403 bp, Rattus norvegicus
  Genbank Accession No. AI175501
acagggagggaagtttatttatctcccaactctcaacccttttctctaaaagcagagcccggtagccaaggcctaagggtctggaagcccaagtgtccaagtcagaggcccacacccagccagtgacagacgagggccagtctgtgtcagtcaaaactcgaggttcatgtatagtcttaaatctcgctcccaggcccggtccttcttttctcgccttctgttctccctctgactcagcgtgccgactcgaggaactctttctttcccaaacacagcccgggtatcccgagctgcaaagtgtgtgacccggggttgggttggggatctatagcccagtccttcctggtccctcttgaggacagtgggaatagggttggcacggccttaaccccggggtcctagc

SEQ ID NO: 2241 - DNA, 597 bp, Rattus norvegicus
  Genbank Accession No. AI175508
agaaacaaagcatcaggctttattttgttattacttgtaatacaggtattgtactgtagacatctgttagtcttgcaattcattcggccaatacacagaaatgaaaaggagcaggaactcatcacaagccctggctggcaccctccaacccaacacaccttgtccctttcaccctcacagcctctccccgagacaagcaaacctaagtcctttcccaagcacaacacccaagtgttcctttcccagtggacagtgggatagaaaagccagcccaatccacagcaaggaggcagtgtgggctggcaaggagccaaatcctggtcaggaaaaaacaaatgatgtaaaaatatgtgaatattttctatcatagaatgaaaaactgatctgcatctaaaagtgcaagaggcgaggtgactgagcccttcaccagacgccgcggaagtgcacaggccgtggtttaacttgttgaaggaggctagggtgtgtttacgctgacatagaaaattataaattacactgaattagtatccataatcactatatacacacaaaccagttctaaaatccactggtttacaagtgaaaaccttacaaggt

SEQ ID NO: 2242 - DNA, 628 bp, Rattus norvegicus
  Genbank Accession No. AI175515
gaagctatacccgatttaattccataatcagtcaaccatcaattacaatccatccaaccctctccttgggcttctctagagctctgttggggtcctgggatggggcattttttatgcagaccagggaaggccatcctatcaaagccagaacaaagtgttcatttggtcccagactgtctgtgaagccccaaggcccaggctgggatgcacagggctgtaggaagcctgggcatttttaaagcaggacttgccccacgggagcactttgcataaaggaggagtcctccacatcgagagaggctttgagggtctgatcaggtgctgaggacttccatgggtcctcgaagctatcagtaaggctccatgttctctcgattcctgaacatggtaaaagcagctcgaggcttgtccgtggggaccatgtgtccggcacccttgatggtgaggaaggtgatgtgtgagcattccttcacgaagccagctaccttgtccccagaccgaagcagtagagcctcaggaaatctcctcttgagtggcaagcgagtgaagatattgccaaaatcctggactacaagtgtgtcctcagacctatcacggccgggttccccaccagcacacggggcgtaaa

SEQ ID NO: 2243 - DNA, 641 bp, Rattus norvegicus
  Genbank Accession No. AI175551
atctttcaagcttttatttaagtgcacagacttaaggatgatttagattttgttaaaagcagccacatccatggactgtacatagtcctcaaaagcagtaatctgctcttccagcatatctgttccaaccttatcatcttcaactacacactgtatttgaagctttttaattccgtatcccactggaaccaatttagaggagccccacaccaagccgtccgcttgaatgcttcggacacactcctcaagtttcgtcatgtctgtctcatcgtcccaaggcttcacatctaacaagatggaagacttcgcaacaactgcaggctttttagctttctttgactcatactgagcaaggcgttcttctcgtagcctctttgcgtcttcactttcctcctcatcatcagatccgaagagatcaatgtcatcatcgtctttagcatctgctgctccacttcctgtggtatctgccacactgacagggccatacttgcccaaagatttcttcactcccggcaagctggccttttctttttcgtaagatttgatatgattataccaacgcagagcatgacacaggtcagcgggtggtggaccagagattgcttcaaatactgccacatcggcttgtgatggcacgtacc

SEQ ID NO: 2244 - DNA, 581 bp, Rattus norvegicus
  Genbank Accession No. AI175575
ttttttttttttttttttggcttttacatttttttttattttttcactcatcatttatctacaaatacacattataacttttatatacattgcacatttacatggtagaaaagtacaaaactatatatttaaatgaatttatatttaacttgccatgtttgaaaatataaaattgcatcagaaaaaagtattatgaaaagcaagaaacttgaactgataaagctttgatggaacttttagtgacatgttggttgaaaaaaaaaaaagagaactaattgaaaaggtacagccgactagctcaaaggaaaccctgaatgacaggttgaaagcgcgactttcacctctcttcagtctctgacacccacatcactctatgtctttggatcataaaagcacagctctagaattttaatgcttctctcatgctctctcccaacgttcaccagaacaaggggacggaagcagacgtttcctccgagacgcatcttctctgtaccttgtatctgaggcagagttacagtgccttttggtcagtcaagattccttgtaaacaaaacccgagggatcaagtatgtacaggt

SEQ ID NO: 2245 - DNA, 556 bp, Rattus norvegicus
  Genbank Accession No. AI175578
aaatgaaacaaaaacctaacttttaattcaatgagcacagcaatgatacactgtaaatgaagtgacatggagatacaatgtcaacagaatgaagtgacacagagatacaatatcaacagaatgaagtgacagagatacaatgtcaacagaattctgcctatctcctgctaatatggtttgatttgttcttctggaatcccagcacttggaaggtagagagaagtagatcaggagttcaaggtcattctcagatacacagtgagttcaaggtcagcctgcaccacatgaattcctatcttctgaacaaaaaccaaatcaaaccaaatcaatcttctttccccattttgaataaaagaaatgaaggctcctatgtgaaaacatagtttattctctcatccagacatctgtagtttacttttacaaaataacagacaaaatttggttctttacattagtacagaatatgtgatattgaaatatatattatatcacttgagttataaacacacagcaaatgcattatcacttcacaatcaccatgttctccatacattta

SEQ ID NO: 2246 - DNA, 605 bp, Rattus norvegicus
  Genbank Accession No. AI175590
tttttttttttttttttcattttttctttgaatttaatgagtttacatcaaaaaaaattaagtagtcattttacatctaaggaataaaaaccattttaaaaaaatacaaagagtgaaaggatttttaagcaagtttacatttcttttggctatggttctgaacaattcatctcatgatatcttatcacaatgtgcaaatgcatttcacagcacctgtgacaatcatcaagttaactcttaagcgtatccactgtcagtatctcctcagaggaaaccgatctgccttctatgaaaagctccatggtacatctcagcatcgcacaaggccaccagtcacccgccctcacaggaatcgaaaaagttagttggaaataagtccacataagaatttaatatctaaaaggtgaaatgctccttgtattaatgttagcaagatctttactttttcatcactaagaaacactttaatagttttagagcaaaagctgttaaagagtctagggagctaaaaccgtacccctgaggtcaagcttacagataaatcttttgtaagtacttctcaaaatatcctccctcccatccccaaattctgtattgtttcttac

SEQ ID NO: 2247 - DNA, 488 bp, Rattus norvegicus
  Genbank Accession No. AI175760
gcattcaaactaaggcattttattagctggcttttcaacttaaatagtatctttgtgacctaagaacaggtgtccgtcacttcccatcacactccagaaggcagactagatggacggtttcattttcagcacaaaatagctttactctgttaccttcactaaatcttttcttagtgttaaccaaaaaaagcaccaggtcacagatggactctcccagccccagtaagataggcttccttagaacacacacagcaggagagtgaaaacagaggcttctggttttggcttggctggacgttgagtccactgagttaagtgtcttctgatcttcacagtctcagcatcaacaaatgcatttactgccaccgcaaaaggaaggaacgagagtccaatgctggcagcctggaagccgtgcgggagtgatcgttaatactggtgggcagctacctgaactttagtttccctcgtgccgaattcttggcctcgag

SEQ ID NO: 2248 - DNA, 496 bp, Rattus norvegicus
  Genbank Accession No. AI175777
gaaacaaaatgtactggactgagagaaaaggggaatgctgctggagtgccagaggggcacagtggtgaactatttacatatcacttataagagcacacggctatttaaaaaagagtgtaataccaaagtgtaatacaaaatatagtggcaccgacatcagctacagagcagtaccttgtgagcatggtgtcagcgcatggtagtgtctggcagtgtggaccatgggagaacagtccataggaaatcatctatcaaccccgagtctaggtgagcagtgtgggcttggggcagcacagcgctgcaggagtgtggaggtgtcttccagccccgtacaaggcctaggtaggtgccccattcttcgctggctgctctgggtcagtcaaggagttgcccacacctgtccctgcctgtgctcagctctggtcctagctgcctgggaaggaagaccagccctggctaaatctacaaagttcacccagtcccaactgtgctgtgt

SEQ ID NO: 2249 - DNA, 487 bp, Rattus norvegicus
  Genbank Accession No. AI175778
caacctgcaataaggagtctacacattagcaactttacgacttttgaattttcaagttaaaagattcatcagatgattatctttaaggaaatctttgagaacattatttacacaaacattttcacagttttaaaaaaatgcaagttattgctgatgacagtccttcctactggaacatctccctggcatgtgctctacatacaagaaacccccactgtaccttctggttaattagagatggaggctttatttgtacattctcaagagacattcttgtgagaggctcctcataagaatacagataaccatttatcagttataactatgtaaataggaaggtttcaggataggcctattatgaaacatttccttagagattcctgaacatgttaacaatcaaaagtttctgcttatatctgaaaaataaaaccattgattttactatcccctttttgttatgaaattatttatattgctaaaaagggct

SEQ ID NO: 2250 - DNA, 512 bp, Rattus norvegicus
  Genbank Accession No. AI175791
cacaaaattattaaaagctttatttacgattggaatcattcaacaaaaagcaaaagcaaatgagcctgaaaaaggacctaagctgctgtctcgaatgtcctcggacactcaacagctcagtagctaggctgccttgcacctgactggcatgacaacagtggctcaacatacacagcagttgcactaacagcagcacaatttccccctttaacccttgcctgaaacaaagcaaggaaagaaggggagggcatagactctgccaagtaagtgtatttaaatactgcatgggactgttaacagcctgaaccttttccctcatttttgatagctgcagattgatgtagtaactgtcatttagcaaatgcagaatgcatgatgaagaaatcaggtgatcataaaaatccaaacacgaatgatactgatgaacgttcttggtttgtctttccaggacttctttcctgtctgttctctgtctaaggagagctccagcatttccaagcacctgaagcaaa

SEQ ID NO: 2251 - DNA, 586 bp, Rattus norvegicus
  Genbank Accession No. AI175794
ttgccttttaagtagtgttcttaaagcactacagcttggtaaacaatgtgaattagtataagtcatctcaaaagccagagttttgttttcgttgttgttgttttttaatgagttgttaaaaagatgcagcctattctaacaggataaatatttttaaccatttcactttgagttaatgaaggctcacaaatgagcaacactcctcattgaggaaaacaaaaagctgttgtcgacaagcgacagcgcacacacacaaacaaaagaactgtgtaaaaataactaactgttcccatactttcggagttactttacaatgggatgatatgcacatgatcttgctgcaactcgacacacagaccgtaatacatgtagtccagagacaacgattcagctcaggaggcgccaacttcagacagcgcagcgctataatccgttagcgcaactgcttttactcagtatttccttctagactgagatacagactagaaaaaatgctccctaattaaaatttgtattgtttacaagaaaaattttataattaatttgtattagaatttacaagtgtattctcaaatcatacttgctg

SEQ ID NO: 2252 - DNA, 395 bp, Rattus norvegicus
  Genbank Accession No. AI175875
atacacagcaaagcttacaggtttattagcggtctgtgtggcaacttctctttcaacgtttcagtggcagttctggcaacaaattcataaaaagcttaatttttatacaaatagttttattacaaatttgaattcttaagaaataacacatttaaagaaattacacagaaggccttagtagtcttaaaaactttttttttaaaaagggggtggggtaagggggacttttagtgtaacgccacttcaagcatagtgatcttcccctcctgcgcctgacctgtcggctccctgcaagatgaaaggccttggctgtcatactggaagtcagtcattcagtctgcggatagtgtggcaaaccctgaaaatactccgcgcaaagcggtaagcaggaagcg

SEQ ID NO: 2253 - DNA, 435 bp, Rattus norvegicus
  Genbank Accession No. AI175991
aatgattcaagaagtttatttgcataattaatagtcacatttccaacagcatttacaacacaattgaatacagacaagccattatgaagaaaactctctctcatcagacagctcatatgtccaccatgtccagcagtgcagagagatgtagctcagaggccgcttcttctgcccttgaactttggattagcctttccaggtgcttcagcttttcagtcagagatgtgtctgatgcctctgagaaccgcacgtggtctcctgtccctgcattctgaggacttgtggatgtcttcaccttggtctgagttttgatggcatcaggataagacactaatgtctgagggaggtagagaggaaggcgggctgactcggtgaaggcctgtgagtctcgtgatagccattgctgaagttgatcttcaaacctctcctcgtgcc

SEQ ID NO: 2254 - DNA, 519 bp, Rattus norvegicus
  Genbank Accession No. AI175992
caagtcaactataacaatcaatatcccaaaccctgttttctgcattcagaacagaggaagttgatgatgtgagcagaacacccgcagccaatcaaagaaaagaccatgtcccactagccagccaatcacaacctttttccagtttaagcagccaattgggcctcttcacattcctaaaaatgacctaaataaagcaccagagctcggacagcttccagggaagccagataccgaggcgcaaacttttaaaaaaataaagagtcagaaataaaaataaaaggtttccgttggtcaaggtttaaaaataaaaaggtttctttctgcagccaatcacaagtccatcccttcaagccaatcacaaaccaccttgatgccagccctgctgagtggctggctggggagggttggatggggtgaggggagcaaggggtaagaagacgggggtttgctgccacttcgcaggcagaggagccatacagatcttttggccatcggtagcttccaggggttgccaggggc

SEQ ID NO: 2255 - DNA, 475 bp, Rattus norvegicus
  Genbank Accession No. AI176004
ctaggttattttttttattttagtcaagaagagaagtgtgacataaattcaagattttattgaaatcatttggatgttaaatgaacataatagcttggcggtgagggaagatttttaataaggcacaataatgagttatacgaataaacagaaagaatgaaaagtgttaactgtgacatttaagtggttacatgattttaattattcttttgataataagcagtcttgtgacgtttattcaaggaactgaaaccagtgcctcccatggaatttgcaggagaatgagagctttgttttctgcctttggtaatttaaaaaaaaaaaagaagaaacaaatgagcaggaatgtaagactttataaaaagtgcacccctccacaagaaaggtgcaaaagggaggctgcgttcaagcaccaggaggagaaagggaaaagaattttctttcaaaaaaaaaaaaaaaaaggaaagaaagaaag

SEQ ID NO: 2256 - DNA, 653 bp, Rattus norvegicus
  Genbank Accession No. AI176007
attgttacaaccaatgtttatttacagaatataaatctcttcaaaaagatacattccttcatttaatcaatggtagaaagccttattaaacagaaataaagcctaagccgcactttatctcagaagaagattgcggcttcattgcaagttcatgaacacagaacacaaatgtacttcactcagcagctacgtcaatgaggctgttgattctcactggcaatgccattttatacatggaacaaatcttacttaaattaacagtagtaaaaattaaacttcaaacataaaaatatgtaacaacgaaggaaagagcaggaagtacgtctgctagcaaacaggatacgcaagttctccgcactcagacactcggtgaggcgtagggaaacctagctctgagtctctggccaggaagcctgtagttccaatcggatgggctttcctgctccactttcacaaacggctcaagagacaatgtggtgttttcagttctataactacctagtgttttattaaaacttactgaagggatctaaaggacctccatgggtaagacaaccaaaagatgaaattataactattttaaagggtatttttgcaagtacatacgccatataatgcacaacggacaaagatgtgttggtggtaccatcatg

SEQ ID NO: 2257 - DNA, 420 bp, Rattus norvegicus
  Genbank Accession No. AI176063
gtggcaacagtaactttcattcaagtttccagagcttccctgttggcactgttcacagagctagctattcttatgcagtgtccacaccaacagtaacatgcacagaagcactctgcagcctgccctggagggctctaccggaacagccggtatgttctgggcaggcgcccatctctgctggacagcgctgcctggatgtgttcatacgtgggcaggtcagtcaaatcacccagagcggccacagcaggcttgcctcggagcatcttggaagcaaccctcttgatatcttccggcttcacattgcctacaacagagagtaagaggcagtgagagcaagagcagagtttccatctccatctcaaactgtgtgtgcactcaggcagaagagccctggtctacgtcactcccaccactggggtg

SEQ ID NO: 2258 - DNA, 525 bp, Rattus norvegicus
  Genbank Accession No. AI176101
gacaatggtaaaatttaagagctttattaaagcattttatcacaaagatgaaaacatacaaatgagaagcatgcaaccgtcatcttccaggtcaagtcaaaatgctctttctctctcctgtttcacagagctggagactgcggatcttcgaccaactcactctctggaaactattcagggcatcagacatccaaaacataaaccattatacaaagaaagtgcaaagttaaaaaagaaaacatagagacccttcccctccctaccctcagttaaaggctaacaatggcactttgctcttgcttaacctagattgtcttcaaaagtttctacaatgtgattcttaacaaaatttttaataatgtccaaaagctccttagtgtttgaaaataaatgctcagacaagacagtgcactttacatcaaacgagtctgagagccctgcattgcagctttctgtaaaataaacaagacaagaagctggtataggctttattgcacaggtagaacgtcctcaggcaggcaggta

SEQ ID NO: 2259 - DNA, 348 bp, Rattus norvegicus
  Genbank Accession No. AI176117
catgtactttaaaaagccaatacaattaagactttcagttatctttcagctctgcccctgaagtcacccacaagcagctgcagaagcacacaggacttgttcccatggtgggcacatgtgaagggcattgggtatctagaaatgggaatgcaagcctgtgtaactgatcagcagcctatgccctgaaaagcttaacctgtagggtacggagtacaaaaattctactcattagcacatttaaacttgttatcactacagagacacttgctgccacatcagcattaactgctgactagtaagtctcccagtacacgtcaggggaagtcccaacacgtattttaaataaat

SEQ ID NO: 2260 - DNA, 386 bp, Rattus norvegicus
  Genbank Accession No. AI176121
gtgttctagtgctctttattaatttaaacaaggacatggggctggcgttcccagaggcatcagtacccagttggttcaggcagttcccctattggctgactaggtcttgatacctagtgatagtcacacgtgtctaccatcaggtgatcctgtccccggagactccagacacatcacagacatggagcatatatgacccgacggcctcactggacatcatcatcatcaaagagatcttcaaaatcgttaaaaaagtccgcatgaactgccttttcattggctgccaagtccatcaggagcccggtgctacctccagcctcatccaagtctacatagggccccgcgccctcgggaaacatctcatccacagctggtttcctcgtgcc

SEQ ID NO: 2261 - DNA, 427 bp, Rattus norvegicus
  Genbank Accession No. AI176125
gtttaattaaaaaactcaaaagatacaaaacaagcattttacataatgcatacattttcaacatctgcagataagataaataaaacaaggctaaagcagacatattgtgtattgcttctctttggtaagtcaccaatatcatccttgtagaaacaaaatgttaaaaataaaacccatggtcttaaaataattgtcccttagtattgacaaaatattcagcaataatacagtagatgtagatttcaaattgacaagaatgcataatacttttttattctccgaggggtaggtaagtagctgctttccaaaattaaggcctacaagagccaacctttttctagctatctttttccttggctcttttttaaacgtcacattcaaactcccacaaaccattcctttggaaaatttcaaatagtaaaccttt

SEQ ID NO: 2262 - DNA, 555 bp, Rattus norvegicus
  Genbank Accession No. AI176172
gagaaggaagtatatttattaggatgacataacgttctaagattggaaaataatgacagagtctcggtaaactccagcttggtattctgaacgttattccaaagaaagatacagtgtagctttttgaaatgtggcataagaaaaatcagccgggtctaagacaactgagcctagaccaagtagcatgatacttttattcaaataaatgcttgctcaatcaactgttcatatattcatcaaggaagtggcaatcattgatcaaagattagaaacacaaggaggaacaatagtaaaaggtcttggtgctgatcctttggaatattaaaggacaataaacaagtgaggtaagcacgaatgtcagataagtaaatgatatttcaggcaagagcttcattctctattatatagattcgcccattatcaaaggtggaaaatcaaataagaaatggtgaaagacgtgaacacacagtttgacacaaaaataggtaattttttttaagcaccctctatcgatacaaggaaaataagttgttcaaggctggtatgtgtctgtaa

SEQ ID NO: 2263 - DNA, 512 bp, Rattus norvegicus
  Genbank Accession No. AI176182
  misc_feature (1)..(512): n = a or c or g or t
aaacgtttgctaattttattatattacataggtctttatttcttgtgatccaaaaaaacatcaaaaatctaaattttctttttaaaagtacaatattacactttaatttttggcaatttaattaagggatattagagtaaaaaaatcatgtatgtacaatttttgttttgattcataaccaaccaaaaactccgttattaaagtagaaatgacagaagtagcctggatcgagttatgtacagtgtaggcgtaacatctcacccgtgagggagatccagtgtactgcatgcacacaaagactacctgtcacactgaagcaccgcctgtccccatcctgctgaacgtattttagccaaagggtactgacgagaaatatttctcacttgccaaggtaacacatccaaggaaagtttgttcttagcgcagctaagctcatgccgctgtccccttaaggacctgngaagctgtcctccaggagctggagtcccaagaagcaccctctgaacctaaca

SEQ ID NO: 2264 - DNA, 477 bp, Rattus norvegicus
  Genbank Accession No. AI176185
ttgctacatctccggaagaggtgaggactggagtccagatgtggatgctttcaagtccttgaggtccacagcctggtgtgtttcacgcacagataaggtcctccctaggtctacgggaacccctcgagggaagacttgtttcttctctctgtaatgcaccagctcagtcagtgccggctgccctgccttctctgactgctcacagggctagcagtgtgggcgagctcagtgagtcataggagggctcgttgctgctgctgccctttcggtgggcagctgcgcagctagggaaggagtcagcctcggggtaggtgaagacaaaggaagacgtataggtagtgcagctgggagtgcacgtgacaacgggagtgcacaggggctccagctctgtgaccatgggccccatccccagggaactgctgtgcagaggctcccagtctgctgcatagaaggaaccagacaggtccacatctggca

SEQ ID NO: 2265 - DNA, 579 bp, Rattus norvegicus
  Genbank Accession No. AI176212
gttatgaagacattttcctttaatttatccaaacatttgactttcatgaagtcatttatttcagaagaaatataagcgtataatattaaacttacaacattatagtatttacaagatgatagctgacaagagaaccttgcctgtatgaaaatacaaatactctatttatctcagctatttgcatagaaaaacagcagggagaagctcacccctctttagatcctgttaattctggagcataacgaagactgctgacacggaaataaaacttatgaatgtcccacatctacagttttagaccttcaacgtttttcttcaagttcagcagctccttttcttgccttcttttctccagtttgaatgctagcttgttagctttcttttcaactcttcgttccttccgctcctcctttatggcctgctttctggcttttttatcctctttggctctcagttttgagacggggctgggtggacaccttgggcagatcactgctgttgatcatctgcatccgttcgacctgctttgctgtgaggcctttcttaggtaggacatggagaagttttccccgtccttgg

SEQ ID NO: 2266 - DNA, 528 bp, Rattus norvegicus
  Genbank Accession No. AI176265
ctaagacaacatgagtttattaatgttcatttaaaactatgcatgagtttgtcagtatgtggattgggttcattccacctcagagatgacaaatgactgtccaaaaaatacactaacttaaacaacatgatcaacataaacaacataatcaatccaatccaaagggcatcttttaaaaaagaacatgagtacttagttctaaaaggtaagttagtccattaaaaggcatcatttttaatgggtcatatttgtcacaaagaatcattgtataatccaagctaaatatatccttgccaggcatatcaaatttaagcaaaatgtcaaaagaactaacattgcactaaaaagtaaaacatcttcatgaattgtataaacatcacagcacattattactatttgacaacagaaaacgacgcttcaatgttgaacttttataatttctagtaaggagaaacagaaacttcaacaacttatgtaaatcatataaatctaacaggtgattcattaaaaaaaagcctccctcgtgcc

SEQ ID NO: 2267 - DNA, 598 bp, Rattus norvegicus
  Genbank Accession No. AI176273
agatttagagatttattgatcagattgttttagaaaaccaatagcgaacactgacaaggtaaataagtacagatggaacatttcagggtagatttacttgctcataggaaaccaggggaggtggaaaagctgtcctgatcacatggcatgcacaccagactgcaaaaggacatccacactgtgtaacaggactgtggcaagtagctttaaagtaaggcgagcttttatatcaagtcattaggccctgaaagatgacttctgccagtggaaagaaagggttgtgtttgccctgaaaagcaggtgaagtttcaacctattacatactggtttgcacttttctgtaaagtggaaaataccttagagtaaagaaggcatcatttaataaggtattacattcccagataaattagcgtatgtggggggaaactgtattaatattaggttttaactctccacctgggcaacactgtcaggtggacttccttactcctgggcaacacatgcaaacaggagatagtacagggatggggaagccctcacctttaacaaactgaggaacagtaagttgttttataactagagtaagaaaacatggacc

SEQ ID NO: 2268 - DNA, 497 bp, Rattus norvegicus
  Genbank Accession No. AI176276
actgtccagttattttcttaaaaaactttaatgcttgataaaataaaacaaaattttagtaccatagaaaccttctgacatgtatgatgacttatcaatatgtacaacttcaaaaccaaatgcttccagcacaagcgaagtcatgctgaacgtcccaactagaggcaagctgatgaagcttcctgtttgccgtgtgagccttggcttggaagaacttagacagttagaaatataaataaaaccttcaatgagaatcaccaaaaaaaaaaaaaaatgcttgtaaaaatgaaatccagtcgtctggatctgggaagtctgtcctgcttatcagataccagcaagcaaatgaaactccatgaacgtccaaatgtcagcggtccaggagaggtcctgcaggtgcacagttgatctatcagaaaccatggcttcctaggtggcccttaaggaatcatatgccatttttcaccagctcatgaactccgttctcacctcgtgcc

SEQ ID NO: 2269 - DNA, 572 bp, Rattus norvegicus
  Genbank Accession No. AI176284
cagaatagtataaatgtttatttctgtatgatttactcttctgccctgttttcacaacatagaaaagtgtattttttgaatagctctagtaaatataatctttctactttgggatgtaaatagggcttaaaaattctagaccgaaccctccccaaataatcgttagaagttggtgatttcgtgtggctgttagcgctgttcagcgatttgatgcaaatgcctgacacaaacgtccttcagttagaaccgcacagaaggaaagggacggatacggtaaaagcttcttaaaaatcaaaactagtagctttgattgcaccttcaaatttttacaagcaaaacaatcttatgcaatgccatcatacataatctacaaatataataaaaattcacaaacattttgtgcacactgtatatacacatcacaatggtgcgattagaattaacacataacatatacaaaatgaacaaagtttaggtttagaccaaaaacttattgcagtcttttgaaaaataacttgattagatattcctttgtcctcttagactaatttacatttatacagagttgactt

SEQ ID NO: 2270 - DNA, 672 bp, Rattus norvegicus
  Genbank Accession No. AI176298
aaacaggtaccagttttgattttatttcatcgtattaacatacatgacacttcaaaatgagaaatgcacaagtgaaccattcaacagcttgccttactccaagaacactatattcatattaaacatttatacagtctttcctctctaactttataactggtctaaacagtttccagcatttctcacagagtctagttttgctcattaaaatcaccattttgcattgtcccaggagacttcaggcttccctgtgcttacatgaggaaacctaaccaccacactacccacaatgtgcctaggggcagccctttcaacatggtagttgtgattccaagaactgataggacattagtgatggtggactgacagctgtagtgtatgactacgctacacggaaggaaccacagcccagagagcacctccctacatgacgtatggcattaggcaatgtactgcccaaagacactgaagccaaatccccagtcttcccagaacagacgtactgttggagctgctgcttcattctggaactgtctcactggtgtgaccagattttaagaaggtgggttcttacgtactgagtgtgtgtacacaatggatcaaatttactgtgaggctctgagaatctaatcacaggctgctgaccagtgtccttggaatggcccgtgctct

SEQ ID NO: 2271 - DNA, 574 bp, Rattus norvegicus
  Genbank Accession No. AI176308
gaagggttttgtttgtttaatacatctgaaaagaattcatatacaaagagttgagacacaagaaagcattggttcggcactaacgaatctacaagatcaggactggggaaggagattacctaaacatttttaaaaactggaacttgcaaacaaaataatctgataaagtctctattaacacttataaagagtcatgaatctctcgccatttttgagagagcttcagccagttgttcaaggattcctcataggcatggaagaaaaaaaggggtacagccctgactggtccccatgttggttaaaagtatgctccccaccccacatgctcatagcttcttaatgaagcaggcctgtaacctcatcacctgaaggagatggcaatcaccagtgcggctgtgtttcccaacaccagcccttaaggaaccctgtgtatctcgtcttcagctgaatctaggaacactacacagtgagttgtaaatctatgctaagcatataagaaaatgactgacaggggcaaaagaactcttttaattaggaactcaatccatttggtgtatttcaaaaggtgcaatac

SEQ ID NO: 2272 - DNA, 596 bp, Rattus norvegicus
  Genbank Accession No. AI176320
ggcatttaatgagttagatggtcttatctttaaaaacacaagaaaatgtcagaaagctaatactagctacagatgttgccaaggaactaaactgacctaaaattacaaaagtataaaacacacaaaatataacatgctaggagggcaaattagtacataagtacatttaaaaaatttacaataaataaagattgcactgtaattggcatttaaagtactgtatgcagaatatagtataaataaacccaaaacacaataatgttggtttccccatgactttggtatgggaatattataagctagtacagggtacttactgcatcatagacaacacagaccaagcacaaaacagctatgatcaagaaaaaccaaggagcaaaaatatacagaacaccaggaagaggggctcggctgtgtctgctgcacccttttggaatacagttgcacctccaactctttaagtgtccctgaggtacttgaacactgtggacttggttgggggatccaatgactttgggttagaactgattacctcatgactctaagtgaatacatgagagtggttctccgcactcacacagcaccggtgggtccaa

SEQ ID NO: 2273 - DNA, 590 bp, Rattus norvegicus
  Genbank Accession No. AI176323
ctgatggtttagaactttatttcaatgtaactatatgcataggaaacacactcatatcggttaatagaatgcaatcacgttcaacttatcctatacagtcttgaccagaaacttggtacatggtttacaatttaaaaaaaaataataacaaaaaacaaactgcaatctgcttcatctgttacaaatgtataaaaaaaaaaatcttccatcaaatgctgctgaaggcagcagaaccttgagaaatatacctttggtttgcctcaggaaagtaacacatattgcactgtaaaggtttataaaattggcgcaaagcattgttgtgatgtcacaagaccagttctgagagtccagtaactgacgggagcctgcgggacatacacacagctgtagaagccctcgcttgccctcagccagcaggacacacactgaatctacagtcagattgttctgaactaagacgtcagctcacctcatgtgctcaggcagtcaggaaaccttagatagaccttgatttctgcaaagaaaacggagtttcttcagtgtttcagtttacgagtaacaggatgctaacaggtaggtcgttccttccg

SEQ ID NO: 2274 - DNA, 556 bp, Rattus norvegicus
  Genbank Accession No. AI176362
tttttttttttgttgtaggaaaaacatttattgcaattcagtgtcaaaaatgtttacaaaaatatgccaccgtcttatacaaacaactataaaaatgtcagttcctcatgcaagaaaggtgtgcaaataagttatacaggattcagattactctttattaaacaatcatctttgcatgtaatctgtccaaccttttgcatttagttaaaatgttcaacccactccaatagatttctttaaaacatacacttaaagctcctaagcttagacacagactataatatactctctttagccaatgtgattggcatttggtagtgtaaggaaggttccgaaagctcccaagtctgaagcagggcttggagccatgtgttaaacagccttgtgcatagctaataaacatcgtctatactaaaagacagagtcagactctgtaatgctgaagcaaatgacacatccagaaatttggagtttggatgtggccatccattatttttcagccaaatggagagagactaagttcagagagctttctcaagaaggtttgcttgatgga

SEQ ID NO: 2275 - DNA, 646 bp, Rattus norvegicus
  Genbank Accession No. AI176363
gttggaatctggactttaattatatacataaatagtgatataagaatgaggagttctaaggcttgtacattatttccacgtgaaagattgcagattagttggcctgtaatatggcatcacccaaaccagcaaaaaggcttaatgtttttcctgatgaaagccagtttactatatccaatactgattctgccatttgtctgtagaaatactgagttactgtctggagtttccaatgtttacctataactgattataatgggtagagcgtagagttttctatttatttccaggtgaactcttcacatttcctggcttctgaaaatgttgcttccacaaatcttctacaactatgtaccctcgtaatccccagtcatataacttctccccagtgatctgggcaatagtgatggcttgttgtgggtaatagacagaggcacctaaccccatgaagaaaggaggatacaccagcttctttatttttgaacctctagcaaaaaggagtccaacaaaaccagcaaaaccaataactccgagtcttgggtaaaatccaggaggtgcattttgaagatagttatagttgtctacttcccactggacaaagtgttccaccttgggtttagtatgggagtatatttcctgacacaaa

SEQ ID NO: 2276 - DNA, 516 bp, Rattus norvegicus
  Genbank Accession No. AI176393
atacaaatagttttattacaaatttgaattcttaagaaataacacatttaaagaaattacacagaaggccttagtagtcttaaaaacttttttttaaaaagggggtggggtaagggggacttttagtgtaacgccacttcaagcatagtgatcttcccctcctgcgcctgacctgtcggctccctgcaggggctgtgacacagctcgagaggggctgggaagtggcctgtgtgtgctcaggtgtgaactgcctgccccaggattgcaggatgaaaggccttggctgtcatactggaagtcagtcattcagtctgcggatagtgtggcaaaccctgaaaatactccgcgcagagcggaaagcaggaagcgccaggcacagggcgcactatcatagacaccatgtttcggaatggttttggctttggttatgcaccttctctgatgtgggagtgagtgagaaaggctggtgttttcacattcggtggcctggtgttggaaaccctgttaaaggacagt

SEQ ID NO: 2277 - DNA, 430 bp, Rattus norvegicus
  Genbank Accession No. AI176422
ataaagttttattaatgacaaatatttcatgattttatgggacgttagatacaaagttttttacttcagtgtttgaaggacacttgttcagaagttatccaaacatatgggaggttagtttggcatacatttacagtattctagaaactggctgtcaagtgtgccagtaagtggaggcacttgggctttacatgccattgtaagcaggtcctcctccaccttctgggaccacccagttaatattttgacttgggtctttgatatcacatgttttacaatgcacacagttctgagcatttatctgtaaccgtaagtctgggcatcacagctggccctcaaatcaaactttttataaagctgcttggctaggtgtccatggcagccttctgcaaagattgtgactttggcatgcaactccaggcctcgtgcc

SEQ ID NO: 2278 - DNA, 370 bp, Rattus norvegicus
  Genbank Accession No. AI176456
caagtcaagtttttttattttattgtcagttacatgctttatagaaaaaagtgtggagaaccggtcagggttgtacaaaaaaaggctaggttcctacgttgttttatttacaccattgtgaggacgcccccacttcaggcgcagcagctgcacttgtccgaagcctctttgcagatgcagccctgggagcacttcgcacagcccacggggcagcaggaacagcagcttttcttgcaggaggtgcatttgcattgtttgcatttgcaggagccagcgcaggagcaggatccatctgtggcacaggagcagttggggtccatggcgaatggaggcggcagttggagatcaacgagagatcgctcctcgtgcc

SEQ ID NO: 2279 - DNA, 675 bp, Rattus norvegicus
  Genbank Accession No. AI176465
agtgttaagacatttattacatacagagcagatatgtgagttcacttgcaaggccaaagcctgaggagagctgcactggccccttccctccagtcgcacccacccagctaaccccggtcacttcacacgcctgtgggaacagacaagggacatacatcacagtggagaggtggcagggtggtggggggaagcttgcagctgcacattgctgcagcttgttgtggccagataggctcaggggcagtgcccctggatctgtgcttctctggtgggaagagtgcagtagaggccactgactctaatcagtgcccctgaagagtaaggccagggccagggcagcacctgcttccacacacttgcttagaattgtgcccatcctggctggtcctcagctcttctggcctctgcctgaaagcctcttgtcagttgctctccaagggagcaggccacagccggcaaccctaggcacttagtacgtgtccgggagctgggctccttggagccctgtacaggaggcaggcccttggagcacaccatcctccattaacctgaggctaagcctgcatcctaggactgactctggggagaccagggccaccctttttcctgaggcctgtgcctgccctggcagcctgagaaattctacccttggggcttctgggaggggcagggcac

SEQ ID NO: 2280 - DNA, 630 bp, Rattus norvegicus
  Genbank Accession No. AI176473
gtagaagaaatatttaataaagaaatacagttcaaatacttaaaaataattatgtaaataccaggtagacatatgaacaaagatgacttctgagttaaataaattaaacagagaactataccaataaataagaaagtcactggctgaaaacagtcaagattttatttttcaatattatttcatttggaactcctagaataattttctccaaatgaccactctcctgtacccagaaagctctggccagggctcctagactttgctgcattggtcctgagacttctagactgcattagtgcttctggctggtttgaaaccaaatttcactgttcaccagaaagcagctcttaatgcattctaattctgcagtcaagttacttaacttataggcagggctggggtgagaggggcacttaaaataataaggtcactctaagaatgttcttccctccattctcggttgacacatgaatctacagagtaaatataaccttcccctgggtgcaaggctcaacccgaagcttctggctggcctacaggattcagagccaaggacactgcctaaaaagctaggctacagatgtagctccaggaacctcagccaatgaggctttgccaacctgtagtaga

SEQ ID NO: 2281 - DNA, 416 bp, Rattus norvegicus
  Genbank Accession No. AI176479
aggagggatgcagctgcagatggtggagcacgtcaggatcagaaaccagaatcctctatcaagtctggagacgaggagcattaagagcaatgatgacgacagtaacaatagtgataatgaccatgaggatgctgaggaccagggagctgatgttcaggcataggcaatgaagcccaggcagcagaagttcatgaagagcgtattgaacagggaccagaccacatggtcaggcacagagacctctctgggcatgttgatcacggtagttctgacagaagccgatccgtggggtgcccccagttcagacacctcatattcttccttgattctttcgtagtttgggggttgtcccccagtggcagcgttcacgaaggcttgagaagtgtggttcatggtaccgagcaaaagcagcagcg

SEQ ID NO: 2282 - DNA, 525 bp, Rattus norvegicus
  Genbank Accession No. AI176490
ggttctttaaaatgtcgttagagcacaaaattaagaaaaatacaaaaccattaaaaatgcttgtcacttgagaggggggagatacaaagctaaatttttcccagtgacctaattgcaagctcggaaaatgatgttacccccagaaaagcgaaaagtcctcgactatgtaggctgcagcgtggagcgggtggcgctgctcccggactcagggaactgtgctcaggtcccaagaatttaaagtgagccagctcgctactccgggactaccgcgcctccacctcgggcggattgcacgccggcgagtagtctcgtgcctcgccaggccccagcgccaggggcgtcgtcctgggacgggcgggaggcgtgggaaccccgcccgccgtcaccagtggaggaggcgcaccgagcgcggcggcggccggcggggtgcgggccaggagcgcaccgtgcagcgccccaggagccaggcgcgggtagtgcattgcaggcagcagcgcggcgtctgagtcgggggcgcgcgcgcgc

SEQ ID NO: 2283 - DNA, 655 bp, Rattus norvegicus
  Genbank Accession No. AI176492
aacaaactattttattcttcagagtctaaaaccttctgtgagcagcttccctattgtggagagagatccagcccctcaggcctcaaactcgaactcgaagtactgagggtcgaagtagtggatgcggacatagccgtcttcgccaccgctgctgtagctcttgccatcgggatggaaggcaacactgttgataggtccaaagtggcccttgactcttccaaactcttcctcaaaagccaaatggaagaacctggcctcaaacttgccaatcctggtggaggttgtggtcacatccatggcttcctgaccaccttccagcaccacatggtcatagttgggagagagagcagccgagttgacgggacgttctgttcggaaagtcttctgatgttcaagacttgtggagtcgaagagcttagctgtgttgtccttggatgcggtgacaaacatggtcatgtctctagacaactggatgtcattgatctgccgggagtgttccttaacgttcaccaatacctctccagacttggcgctgtactggttgagctctccgctctcgtggcctgcgatgatgcactcccccaggggaccccaaacagcactggtgatccttggaatcattacaggggatcttcatgtaagggctcgttgctgt

SEQ ID NO: 2284 - DNA, 723 bp, Rattus norvegicus
  Genbank Accession No. AI176502
agtagtaacaattttattttaactcaacgtgctgaaacacacaatctatttccaacaataacacaaatagtgtgtatctcatcataaaacatcaaatggattaaataaaggccagaaagattaaatgttaaaggtctgagttttaaaagtcaacttccttctgaacttaaataattttagcagaactttattttcaaaaaagtgggctcaattcatttgtaagcaatgctaaattactagttagattacagtatataataagctttactaacaaaatatttaaaaataagtattacttctcagatataaacttacatacaacaacagaagatacagtatgatttcattcctagtaaagaagtcttacattggaggcactcagtattatttcagattgacatagccaacacttacatcattccatgaacacttaagttggagctcacattctctacataaaaagctttgtaaaatactctcatacgtgctgaaagtgctgtatttattttctgggaacactgaaacccactcactcatccactcacctctctaaagaacacaacaaatatttccattgtaaccatcaaagaccagacatgaccaaaagagattacttcacctcttcatgaacatgtgacttgtagtaaaactgctgcgttagattttcataaaacttacccaagtctttgcttctgttttctaaatgaatcatatctacgatcc

SEQ ID NO: 2285 - DNA, 498 bp, Rattus norvegicus
  Genbank Accession No. AI176540
cctttgagcttgttttattgatattcgttagtgaatgaaatcttgtcaccggtctgatgcattacaacaggcttttaggtagtgtggctcaatgttgatcaccggtttgctaactacactatcacgacctttgaagtgccggttctcacactggtgtttccagtgcggacaggaggcccctttgaacatgtgacacggtccatccacgccaaggtggtcaccctcctttgccgtcctacctactgctttaaaaatacattcaaataaaagggtacgttacttggagtgactgcacacgtacacggcagccaggagagctgagaacatgatgaaccagctccgtctggagaataaatagtttgaaatagtgggactgaagtttgctgcttggggaccttctcgagcatccttggtggacataaggtgaccctcgctcgattcaaggacacatcttttgctgggggaggggttgttcgtgtgataatttctagtacacag

SEQ ID NO: 2286 - DNA, 575 bp, Rattus norvegicus
  Genbank Accession No. AI176554
tttgggtttcagaggaagaacaggtattgcattataaagacttgtttgaaatagtctgtcgccatcatttattgtaaacagacatgattattcagggagagaacaatacatttttttctgcatttcttccacacggtaagacagggtcccacatagcccaggttgaccctgaactcctgatcttcccacctccacctcccaaatggtaggattctaaacacactccaccatcctggtttatgtggtgacggaagccatggcttcaggcattctaagcaagcattcatccatctgagctgcatacccagtctatctcccacccactcttagaagagcatgaatttatgcccatttaagacactggcttcgctgaacctcattaccatgatgaggaaaaaaaaacctagaatctcaaagactagcagtgctttgtagctgtcatcatctcctggccacggcccaggaagtaagcatgataatgaactagggtagttcaactgacatactcgtgctgtgcattcaatctgctgagtcagtctgggattagcatcctggggaatatgacacacttcctg

SEQ ID NO: 2287 - DNA, 586 bp, Rattus norvegicus
  Genbank Accession No. AI176569
aacatttagaaaagtttatttaatatcagtgtttaatcattgatttatctaaatcaaaatacacaacccaaccaactggtctgctcaatacagcacagtttttcccgttacagttgacatttctaaagaaacagactccatgaagtgagtctgtaaagcacctttgtccaagggcactgcattttcactctacagcccacagagtaatgattcttcccattgtaaccacggagctgcactaaaaccagtggcaagtgctctacctacagaagggtttaaccacaagccgaagacaggggtgccacaggagggacacactgagaggaaacctgtcacgtgggggttacaatacccagaattctaaggtggctccaatgaccaccaccttttcatgaccatctcaagtaggagctgtgaatacaatgggatattctcataaacatgttaaatatcttggccaacagagatttttacagcttacaagtcagacattcagagcgtcagaggacgactctgtgctttgcctgcagagggaccgtacaaggaaggaggtggacatagggttgtctttagaggatgagaatgg

SEQ ID NO: 2288 - DNA, 776 bp, Rattus norvegicus
  Genbank Accession No. AI176581
aaatccaggaagacttttattatacaatttgactttacatcaataaaatgttaggtaaaacattatagatgaaagaacaatttaatttgtattgaaataaatattagacatatgtagcacatacagtgaaaaaaggtcacaataagttccaggtgaagacatgactttgtgcagtcaccaaagaaagcccttgacacttccaatttcacaccatcaaatttatcattcttgctgatttaagcagaacacaaaacaaatatggaacctagggcttactttcaccagtaccagcatggataatttactacagtgatccaatttgaagatcagcagggaccagcaaattgctgcataaaagaaagagcgaataggggcctttttccttggtgtcagcaggctacgatgattatgtttattacattttcttgaaaggactccacatttcctcaaatatgcaggagaactgtatttcccctctgagccctacattagcattatgtgctttggtcttgagtacagaggaatgatgaatttttcaatttattttataaatttatagccagggtaacagcgccttgaagagtctatataactccccagcctgcgaaatatattaaaaacggattcaagagaagttcctaagaagtgctgaccactgtatatatacacattttttagctcaatagatcccattgtatcaagtaccagaagtgatgcatttataaatcaaacagttcttatgagtatggctaatctctgcaatccttggatatttg

SEQ ID NO: 2289 - DNA, 717 bp, Rattus norvegicus
  Genbank Accession No. AI176583
cagacaaaacaaactttattccgaaaaagcatactggggtaaccttgaatacactactggataaggcacatggcccctctctctaaccaccctccctacaccaaaacccacccctgcgtggccttcgtacacaatgtagaaattgtctcccgggcccacaagaagccccagatttatggttgggagctgtctgggtggtcttggcttggccccagtcctggttgtcagagaggtaagccagggagagtactgccagtttccaagtgctctgggccacatcagggtgatcatactatgccatttgaggaaaggtgggtgtcataatagtcttatctgtgcttctcacatcaccaagctgttagaagcaaagctggaaggcacaccgagaagagctagagagctccagaatgctacaggcacaacggggtatatgaggcatcagaaaggccaagatgtgtgctcctgagtaaggttggctggcctcagacccagagcactgggcctgaggagatcctgagggggctggacctgagcttagacagtgatctaaaagaggcaaccaggtaaagaatgggagctagaactgaggcccatcgtttagggaatgggaggcgggcagaattctgtcccaagtgaccagatcttgtgcctaaattataacacaggagcttgggaatcctctaccatcaagaaggaaaccagtcttctctaccatgg

SEQ ID NO: 2290 - DNA, 605 bp, Rattus norvegicus
  Genbank Accession No. AI176588
gtcttcattttttttgagtgtacagttttattgtcttttgaatacacatttgttttactgccagtccagataaacaagtttataaagaaaatactaaactttgcttttggcagaagtcaagataacctgtgcagattaaaatgacttacttcagtctaagaaatggttttgaatcatacaaatcttttatgaaaaataactgttcaaaagcattctcccagcttaacacattttcagaataactcccccccccccaaaaaaaattcaaaaatactaccataaaaatatgtcaataccgtatggctttatgaaataacttctaaattttttgatttttatttaaaaaggttcccaagttttaaataaacagctagcaacattttcttcacttaaaagtgcatatatctgggaatgggacatacataactttttgaacaaataattttacaaattaacacacacgaacacttaaaatattctaagaggcaaagtttttccagaaaaagtcatctagactgcaatagatgacctttcacctctttctctctatagcctttggattatcaaggagatgctttggcagttttaggacatgtgacagtctc

SEQ ID NO: 2291 - DNA, 758 bp, Rattus norvegicus
  Genbank Accession No. AI176592
  misc_feature (1)..(758): n = a or c or g or t
attagaaaacaggttcggtttattgatccgtcataggcactgtacataaattatgtggtttgtgattacataatatttggcatctgttgcagaactataaaatcaagttcttcaataataaaaaaaacacccttcattattgaccagtataaatatatattatttttaaaaagtcactaaaaatggctcaatactttctctatcataaagtaaaattcaaaaggcaggagagagaaaaatataaattctgctaaaccagttttaaacactggcaattaatacacggttgcatgtgcaaacttctgcaacacttggcctttttaaaaaaaacaccaccagaaagtacggtgaaatctaagtattgggcaaagcgtgatcctcagctgacaccagacacttctggggtggacggggagaagtctcagaaagtttcctctgcccttacgtgatgtctcatcctcttagatggcccctgggaaccagcaatgaccctactttcttgttgaggggctttctcgggacagattctatttccccctcagtgtcacaagatctgtggctctctgttcttcctctcccccttatactttctggccaagtttccattaacactcattcacacataatagacatgcacgccaatacattttctgggtgacagacaaaaacattatcagcaagcttaaacctttaaaacatcatgagtcaagatatcacctcggtccatcagacttctggctgcantgtggggcaacctt

SEQ ID NO: 2292 - DNA, 511 bp, Rattus norvegicus
  Genbank Accession No. AI176598
cctgctctccaaatgcagacaggcctttgcctatcatgtggtattatttatatcacaaaacactgtcatatgaaaatcagcacatagctctgaagcacacagaccggaaggaaggagtatctttctactcacacagaccccaggtgggaagacctaggctgtcccttactttctacccttggaagttgaatacgaacacatggtcaaagatgaagcagaaatatggaagctacatgacttcctttagacacatatacacccagagaccccagcaaggccccgcccagaaagtcagtgtagtgtttctcaaagggagaagagaggtgacatcggaataaaaatgcaaagctgaagaaaagaccagatgatcaaaccattatgtctgcttcatggagcaatcaggaatcctcagaggatgcggatctacagcccagtgtatgacatgacaccagcacctgtcagtagaagccatgacctccctacagtcatgtctacacaggcacctcgtgcc

SEQ ID NO: 2293 - DNA, 729 bp, Rattus norvegicus
  Genbank Accession No. AI176607
ttttttttccacaaaaatatatttaataacttgttatataaaatcaaacacaaaattttatcaataattcaaagtcatttctatcagggagtgcttatatttaggaaaagaactaaaatatatacatattcacaacatttgtaagcacaactgaagagctatgatgaaactcaagaattctagatttacagctggaagttccataagtttatctgtaataaagtgttcagcactaattatgaacaactattaagcccaaagcaagaaaaataggaaggaatgacctgtttctaaacctttatgacaaatacttctcaaagataaaaaaggcaatatgaaatttacttaagtgaccaagattcctcattggatccctgactgtcacttttggcacgtagcccagcctgatggaagacagtattccctgtggtcaggaagcccgtgctgtgtctcaccagagccttgctgactgtactcatgtgctctggctcaaaggaaggaaggaagcagtattagcaacagtttcgcaccaactgaggcccgtatttattatattcccgtattcctgactctattcctgaaaggctttatctccctccttcaaaggtgtccctcacatagggaggaggtgggagtagatgaccacacacaccatatacacgtttgtccccataaaggctccatgccctgtttttattctgaactatacccatggcaatggtcacacca

SEQ ID NO: 2294 - DNA, 513 bp, Rattus norvegicus
  Genbank Accession No. AI176613
atattaccgcccgtgtaatctaacctcccatattttatgtaatgttacagtacagagataacattttaatagtcattacaagatatatcataacaattattctttaggatcccagaaaacatggcttatgtaccaggattacaatatgatacaatatctttatcagacgcctcaaaactgatctcgatgtaagtctgagaattctgaaatctcagtacatataaaggcctagctctatcctttcagtagttaacggtttgttgctaagtagcccatcagtcagtgtctgttctgaccacagcagcgtggcttaaccgggaactgcgagacagacagggttgtagatctttacggtttcatcccaggagcagtcagctacctcagtggggctctggagacttaggtctaagccacaggtgaactctgtgtgatgctccactgtttccagaagtggatccctcgtgccgaattcttggcctcgagggccaaattccctatagtgagtcgtattaa

SEQ ID NO: 2295 - DNA, 667 bp, Rattus norvegicus
  Genbank Accession No. AI176616
ttttttttgactaactccagagttctttatttaattggaacatccgacggcaaccacattcacacacacaactgttacaaacagggagcacctctcagtgactgcggaatatgcttgcctctcctggtctcctagccagagtagcaaatctgaacttctattcaggtcaggactgctatggcctgtgtgtccctgcccaggacactcatgctcagcctcaagattggccacttctgccctagatcctagggaaaggtgaacatgagggagtcctggtagcactacaggagtctcccttctttctgtagtgtcctcccccacccccaccctggcccccatccagagctctagggtccatgaaattgattccctcacaaaatagtgctagggacctgcaggggctggtcatcagggttaccatacaagccatccattcattggacagtggggaaggcatatctgggggttatcctgggctatctccacctcatctgatagccaagaaggaagcaaacttaaggatggcagcccacccaccattcacaggtccctggtaagtgttggtcaccaaggtctccacacactctgggcccggcgagctgtggtcaggatgcctaaggatgtgggcaccaaatctggcccctcggcaggcacccggtttagttca

SEQ ID NO: 2296 - DNA, 688 bp, Rattus norvegicus
  Genbank Accession No. AI176646
aaatggtcaatagttttatttcagcatttactaaagtcttaaatataatcacatataaaacaaaacatttcaaaagtgcaaaatatcaggaaggtaatcagtgctgttcatcccttgcaaacagtctctcacgaattgtgtagccagaattacgtacaaaatgctgttacactggagtttaaaaacagccttggtcaagaaactgtacatggtaacaaatgacgcaatgcacacccgtacccaggccccttgccctactcacttgtgtaatactgagcgtgataacgccacgagtggatggtgaggtgcaagctctttgagttactgtactggactgccgggaagcagcatttcttagtgcagtggtttatctagctctccagggccaagctgcccatctttggtcacaagaacacactcagttgtgctttggtttactcttaacgtagtaatgactgctaacaagagtaaacaaatctcaagacaacaattgacaaaattactctagtatttaatgaatactacttcattctcagatattcttactcaagacatactgtagaaaaaataaaatattccatatacctggaactcctcagtagcttgcttatccagtattacccataagcagaaaggaaggccaggcctgactgtcctgtgcctctgacctccagggcacagtgctcgc

SEQ ID NO: 2297 - DNA, 567 bp, Rattus norvegicus
  Genbank Accession No. AI176675
cactggagcctagaacactttattagaaacgaaatatatcacaggcaaataaaaatagttcttagctccattgatacaacataaggggttttacattcggcctagatacagggagaggcagattccctcgcctacagacctctggcttgcaagcatctcccaccacaagattactctgtatagtacatagcccttgtttagtagagggatccaaatattcgttttcaggcttacaaagtccgatacattcactctctctttccttcacaagtctaatagcaaaaactactttttccatgccccaaagccattatcagtagaagaaaactcaggcaaaacagagatggcagttaaggaatggacagagtattattggcacatgcccagctagtgacaaacaaatgcagtgcaccatgacttgaaaataagtcacattacaaggagaatgaaaacaactgtaccaactaagctagggagtgcgaagtggaaaggggattgattgagagttactggttttactggtacaacttaaaagcagtggagggcaagcacttaaatcctcgtgcc

SEQ ID NO: 2298 - DNA, 529 bp, Rattus norvegicus
  Genbank Accession No. AI176698
tattgaagtttttttaaaaaattttaaccagacaaaaggatgcacaacattttaatctattatatgatagtcttattctgtggtgattatgcttagtcagctgttcataatatacaatactgaattttaatcacgttatttacagagggcaaagcactcatctacaggtaaaggcgctctggtttaatgtgcacgtcacagccctgtgcaaacacccattatgtacactgtaaacaccacagggcatacccgtctccatcaccattctcacaggaacaagcacacaggggctaggctaaggtgcctgctttttcttttttgaggcataaattctcaaaggtttgcttgccttctcactcactccagatacagagccagtgttggagcccttcagggtccccttgtggagactgcctggtgacctctgaatgtcctggatggaggaaagcaggcaggagtccttcacagctggataggttaaagtgagcctcgtgccgaattcttggcctcgagggccaaattccctata

SEQ ID NO: 2299 - DNA, 559 bp, Rattus norvegicus
  Genbank Accession No. AI176701
actgtatccaaagggtgctccaaggtcaataaagcagagccaaggccacccagttgcctctgcctttggtcttctttcctgtgtgtcagtgctgaagtgaaggcctgcaggtcacctgggaagcagggctgataaggagctgagtggacagtctcgggctcagtgcggagacagcagcacctatgcgagcctttgcactgacccgcccctgctcagaggagctggctgtcactgagtggctacttcacatccatcctgcacacaacagtcctggattagctacgtggtatgctgtggtcaccctctctttggagtacaagttcaggacatcaaggtccacgcgtggaccactatggtgggaggtgactgctaagagccacacactcatcatgcccagcaagtcctcaggttacaaacactggtttcctagtcagcccaggggaaagaggtcttcactgtggaagagaggatttataagtaatctcaagaaagctgtgacctgctagtggccttggctttgtgcctctgcttggcctctttccaaggtcttggataacat

SEQ ID NO: 2300 - DNA, 566 bp, Rattus norvegicus
  Genbank Accession No. AI176714
aataagaaggcctgagttggtagggaaaggaacagtcagaagaagcctgagaagggtaaggaaggaaagctcatttatacatttacaataatttacagccatcttcttctgtaaaaaggcataataataatcacaaacaggaagttcccggctatcttacagacttcagtacaggatttaaatattcaagcttgtgacgggaagcggcaaggtggtcgcagtgtacaatgtaaacaagtagctttggaaagtgaacaaagtccttgagcgatttttctttattaagaaaagacctctctttcattccttcctgaaacatgatcacaggtcagagtaaagttcatatacaaacataatttaaatggagtcagtctaaaatcactgacgtataaacagttttatacagcctacacgggagggcagtgctgaggtccctggtatagtaaacattttccatttctttaaaaaaagaaaaaaaggtactacagtattgcagtacagtgcagcataatccttaaatataaaaatatcttctcttctgttgggataatagaccttgcgtcctg

SEQ ID NO: 2301 - DNA, 461 bp, Rattus norvegicus
  Genbank Accession No. AI176758
  misc_feature (1)..(461): n = a or c or g or t
aataattcttccttccagaaagcttcctggtggcagacgggctggaagcaatggtgaaatgcaaggtgcagtgacaacttgttttctttggcaaggtaccactgctaagataaagctgatcattcttccatgtattcatttcctatggtggctcagcatgggatcctggggccattatcattgtctcatttgcccctttaaaaatctacttgtcagggctggagagatgggtcagcagttaagaactctgactccaggtcctgagttcaattcccagcaaccacatggtggctcacaaccatctgtaatgggatctgatactgtcttctggtgtgttctgaagacagctatagtgcactcatatacataaaataaaattaaaaatatcttttaaaaatctacttgtcaaagctctttgcacaatacaacagtcatgttggaaatactntttccctcgtgcc

SEQ ID NO: 2302 - DNA, 566 bp, Rattus norvegicus
  Genbank Accession No. AI176775
acaacagaaatcagaactgtacagttacagtaagtttaatatatataaaaattacagcagacaaatgcatttacataaaacccaccatttcattctgattcactgagttatcacctgaatcttataaaacatccccactgaaggataaatggctacggacactctggggagagaggctacacaatacccacccaaactgcaaagtcatctgaaggagaaatgtcgaggacacccaactaactactcaggaattgccactgcctcgttaaagctgctgggcaactttggaaagaatcatgtccatcatcttggaagtttccacacacaagaactcaaaaactcacattttaaagtacattaaatcacatattttgggaggccaaggtgcccgtttccttgcgttcctcccttgacaacagtggaaaaacacccctgaattaatattaattaaaaaagaaaaggaaaataacaagtggggaagttaagatatttaaagacagaaacaaacccttatgccgaattcttggcctttagggccaaattccctatagtgagtcgtattaaat

SEQ ID NO: 2303 - DNA, 528 bp, Rattus norvegicus
  Genbank Accession No. AI176804
cccaggggaaaaagaaatctctttatttaaaactgccatttctttttttgtgaatctacaagtttacaagtgaggagagaaactgcccctggcaccctcccaccgccctctccacacactcccaccggcccgcctgggccactgatgggaggggttcccactgtgacaggtctggaagatcctgaggatgtctgaagggtcagatagaagggttccgggctgagatgagacacttttaatcttccctcatacctggctttgcatgacctccctcctctccccacccccttgattttggcatgagattaagaactgaatagaaagacttatttctgggaaactggcggagacacgtagagaagcacccagcccgtatttagcgtatttggcaagaactccccttcctgatcgatcttctccactctgcaaacagtttaaaaaacaaaaccgaaagctttttgactttttcaaaaatcactgagttcagtccaaccttgcccaaaggttactgggcaggtgtggggggag

SEQ ID NO: 2304 - DNA, 506 bp, Rattus norvegicus
  Genbank Accession No. AI176806
gggtaccatgcttttatttaccatcatgcatacaaacagcaacaaatacactccgagtacagtgctaatctgacaaagaacttttataactatgtgcagtttaagaagagactatcaagtcaatcaagtcacatatttacttttccataagtcaataacttgacacatttgataaagaccaaattatccaagctgtttctaagaatttggattaatattgaaaactgttatgaatattcacttaagtctattgctcttccaagtggtttcaaatgaatgcaaatgaaagtgtttaaatttctccagtaagtagaaacaagtagcattttactaaatgttggtaaaatatgaacacagtattaccctttcacttacattagatcacatataaggagagaaaaatgacccaaacgtgaactgcttctttaaagaagcgttgtctaggcaacattcaacactcagagaaagtatttttgctgagaaattctatttccatcaccaatgac

SEQ ID NO: 2305 - DNA, 599 bp, Rattus norvegicus
  Genbank Accession No. AI176810
tttttttttttccaattacagaacatagctttatttatagaatcttacaaataaacatttacagttcacatgacataagttattttgttttctaattcttctaatgacacctgagttatttaaaaatatactgtgatggaactgtaaagggaactctgactaaaatcctttctttttgcaaaactcaccctgcttatctgcatgtctttggaagaagggttgctaaaactggatcctaggtggtccaggcagagagaagtcctttaaaacccagatgaaaggtactggagaatgctcccccagctgacactaaatactggagggcagccatggaggactgaaggtgaggtcagagatgaggtgcttagtgacagaacccaaggcctggctaagggctcctccatgtgacaagcgctttccttgctagtgttaacaggggacagaagctaagggcactaaggccagaggagaaatgtctgctaagcaactcactgcccctgagacctctaatatgtacagatgcttaaaacagcaagtccgacatttaaaagtcaaaaaaaggtcaatggctgcatttccgactcatgggcgaatctgtc

SEQ ID NO: 2306 - DNA, 450 bp, Rattus norvegicus
  Genbank Accession No. AI176815
gaaaacaagctctggcaaagttttattaaaggagaactttcttgtgtcctttatcatttaagaagcacagcatgaaacagtgtttatatggcagagctaggactggagaaagtaaacactagggtctccttcagctccacatcctggctgaaaaagagggctagcctgggcaacaagagcctgcgtagaggaattccttggttaggaggcagaaaagttgactggatgaagaagtgtctatggaagtgcggtctaggatgtggtcaagagaggaagaagaaagaagagtagctattaaatgccccaatggggtagatttttcaatttctgttttcctaaaaaaatatagattatatatcatgaagaagaggtgtgtatacatgcctcattctttctggcttggcaccagagatccacagttggaaatgggtgatgtcaaaacctcgtgcc

SEQ ID NO: 2307 - DNA, 445 bp, Rattus norvegicus
  Genbank Accession No. AI176828
aaagcgaacaaatccatttatcttcctttccatcccctggccagcagaggtgggggttaaacagttcattttaaaaaagacaacgactcataaaatgaaaacagaagaaagaatccagagctggagagctgaaatgtggccctggggagaatgtgtatgtttccagtcttgatgttgggggtcatcccagagtaaggaactgacaggcttgagactgaggtgctccaagcttcctgaggctctgaaagggggactgactacgctcacaccataagctggccactggacctagagttcccacctctgtgaccttgttgttgctactgctgggcacaatggaaaacagtcaagccccctgggtgaatcgccagcccaagcttgtcttaccagctccttccgaaacaactccttagcctcgtgccgaattcttggcctcgagggccaa

SEQ ID NO: 2308 - DNA, 574 bp, Rattus norvegicus
  Genbank Accession No. AI176836
ccagtctcctcggggcaacccgggtgtgggcccgctggcatccccgggcgctcccggtccccgggagacctggagaattatttatccgggaatatgccaagaaggcagtcagcaagggtggcaagggtggcgtggccgctgaggccctgaaggaccccgaggtgtgcacagacccctctcagctcaccacacacgccatgggggtcaacatctacaaggaaggccaggaggtggccctgaagccagactctgagtacccgacatggctgttccaggtggacctgggtccccccaaaaagctagaggacctagaaccggagtcccgagagtactggcgactgcttcgcaaacagaacatctggcgtcacaacaggctgagcaagaacaagaagctgtaatgtgagtgtgggcacttcctcccaggagccagcctggtgccagccagaacggggagaaccgagtccttcattcgctcaccgtgatgtgcaggccttacacacactaaataaacaaagatgaaaatgaagggcaaaataaagggacctgcggcagtcaaaaaaaaaaacctcgtgcc

SEQ ID NO: 2309 - DNA, 478 bp, Rattus norvegicus
  Genbank Accession No. AI176839
aaaaacatcaccaagtcagatttttatttctacagacagaaggccaaaagtttctatttcagtagcagtgtacaccaaaccactcctccccagccaaagctgactcttctttgcatcctgcatgcctttgaaccatgcccagccttgtgggggtggcagcaggactagactgctattctgtgttccaaggggtacctgaaagcaagaatagaccaacactggcatccgtgggttcctcaggccaacgcgctcccctctgagttcaccattcattcaaagcctggtcttggccgtcagcaaaccttgagacttaaggtgctcggcgatttctcatctccctggaggaccttctctccctccgacctccattctgtactgcttgatcagtccagccatctgcaaatgaatatcacagggaagagacctatcgtaaccacgagaacacctcacggagactcacctcgtgccgactggtgcc

SEQ ID NO: 2310 - DNA, 662 bp, Rattus norvegicus
  Genbank Accession No. AI176841
ggagttattaaatttttattaaatatactctgttggcacaaatcttcaaaatatataaacatatataaacaaagtatcttcatggcatcaaaatagaactccagactggacagtgaccatggagaagggcagccacagaggcagagagcccctaagccagagctactgggggtatatggggaagcaagaagatcagggacccatgacaccctagcgtctcctgcccagccggttgcctgatgcagggcttgagccatctacatggtgcaacctgttggggtggcccaggagcttccgtcacctccagcctcctggcatggggtgcccagcctctccatcccaatatggggccaggcagggaacagagtgggcagtacactcacaagagcacagtccctctagccaccagaggttgccaggatactgggggacatggtggggacgcccatcaccatacgaggaggcagagagatggccgagcatcacaagcacaaggtaagaaatacagaacgagctaggaccacagcaagaactgcacatgcctggaggtcaagccaccctgctcaggtcctgcatgtgagacggctgccgtctgtccatctggctgtgggaatcaacacccaggtcaccgcactgcacaggatagggggtttgtatgtgca

SEQ ID NO: 2311 - DNA, 495 bp, Rattus norvegicus
  Genbank Accession No. AI176850
atgggggaaccacagtatttattgcctttgcttgaaacttctttgacatataacccaggctagcctcaaacttatatgcaatctccacaggggtatcacaatttttttgcccttggcctaacttttcccacctatctttaaactttcctgagcttcagctctaactggacaaatctttcctttggtctcccaatgcacttttgtgacaccatgagtgaaaccttggatggaagggaagtcctcagaagataggagtcaggtttgctctctgggccacctgaggcatcaccaggaaagaggaaagcaatggtggacaacaagaccttaggagactctgaggactgcacacagcaggtatgacctgaagctgaagggcctatggttggtaggggaattgaactttttcacaaagtaggaatgacagtcagtagaaagggggtctagagtcatcacttccctttgctgagatctacccttaagcacccgccttgtgcc

SEQ ID NO: 2312 - DNA, 535 bp, Rattus norvegicus
  Genbank Accession No. AI176916
gtcttgtgaactttaatgtctatgacgaagtcctttgagtaatgccccttccttgccaatccaccccttatcagtctgtggctagcaggctccagagtataagtcccatgccaccctgtggtaaaacctattctgtccccaaaaccagcagcgtcagaggccagggccatcagggtagagtgcagggatgcgtctcgtcaggagccacctggctggggacggttcccacagacctggtcctgtgtaggtgacctgcagtgcccctcaggatgctaggcgttgggccagtgggaggggaaccgtggcatcccatggttctgtcttcaggcctggtcagagctctttgaaggtccaatgctcagctgtgggcaccgtcatgcctcatgcgctgtctctgggaagaaaagctctcggcatcgttgtacagtgtcctgaggggagaccacgctgtggccgactgtccgggggtccgcatagatctcaaagtcattcccaccaggactggtctcatttccaaagaagtggacctcgtgcc

SEQ ID NO: 2313 - DNA, 469 bp, Rattus norvegicus
  Genbank Accession No. AI176933
agtgtcaagagaagtgatagcataggaagacacccaggacgtgacggcagggtgcaagtgtaccacaaagtgccacaaagttgataaatgtaggttgctaatagctctgaaggactcttgatgaacaggcagaaaccactgaacgctcagtgtaacgagaagagcagaacgtttaggcagctataaaaacactccatagtgggtggaactcttggcaacctggtcatccaaggaacctaactttcagccagcaagggtcctggctttaagtcctccggcttaaggtgaattcaagtttcagccaagtggctagaaccaagtcaacctattttcttctctccagcttccccaaagccttgagttgtggggtggtaagcagatcagatccagtgcaggatccctttaagaaatgggtctcaaaagataggctactgctagggaactaagtgtaagtcacctgaaaaaaaga

SEQ ID NO: 2314 - DNA, 594 bp, Rattus norvegicus
  Genbank Accession No. AI177016
aaaaagaaacgtgtcttttattactgttagttgcatgtctaagttacaataacagtctaagttctctttacagccaatttcctataaatattacattaccaaaaagagtggtactttgtaactttccaaaatgtcccttacatttttgtttcatttgatagaaaaataaaccaagcaaccacattaatttaggcaatgtttcccgataaaaaggtagaaatatttaaattacatattacagtgtaccaacatgaagtcaaatatccacaattacacactcataaaaaaatctagacatcactctgagcataagaagtctctgtacaggatttacagacgtctcctgcacactaagctctcagtgtgctacggagttcagaggttctgctcggatgttccccaagtcgagtgcagaatctgtctcttcatctatttccccaatgactgctacattatctcctctcacaatgtataaccccaataccacttgttctactccctgagaagagctgaacacccgctcgtggctttcatccagaatcaagttaatggtctggtcaaaacctttcagggttcccacgatcattctgccat

SEQ ID NO: 2315 - DNA, 643 bp, Rattus norvegicus
  Genbank Accession No. AI177022
cattgtaatgggtttatttggtacaaaaggatagagagataattacgtttactgttaaggactaagacacaaagtctgcaaaagctctatacaaatgtgggtgagatggcgaggagacacggtaacatatggcatcattctgagggacctccagctcttcattctaacacaggaactgaggatgcacagccatttcttcataggacagttctgacagaaagcaaatgtgactcagtttatcggctcctacaaggcaggcagagcaaggggcgatttcacccagtactggttccgccatatagaatgggtgctgatggtggtcagttctgcagaggctgttttctagcgctgggttcctatgtccttggattctcctgattctcaatgataagcttgtcagttgagtacagttggccaataaggacctgtctgcggattatttcaaggtctcttttggctttattcaccagggcttgaatttctacggggtcttttacattcttattttctcggaaggcatctcttattctcctgacagcatacattctgtaattgtaggcgctgaaatgcttgctctctctcatcatcgcccggtacagatctaaaacttgtgcgcggctggaggctgccatgttggaaaacg

SEQ ID NO: 2316 - DNA, 557 bp, Rattus norvegicus
  Genbank Accession No. AI177031
cagtcatgttatgagcttttattttaaaaagcacatttaatacatgtttagtttctcagatccacatttttcactttgtatgccacagaagtgtttgaatattattctttttacaaaacggaaccttacaaaaatactgacaatttaatgtttttatacagttctttttccctctagtcgcagttatttcattgtaaaacaatggctaccacagaactatgatatctttagttgagattaaaaaaaaaaaaaaccaaaccaaaaaaactcaaggctcctttaagcagctaaagtaaataacacaggtcaagacacagtttataatcatagggggtgtgactaacattgtttcaaaaataatatcttacatagttaacttttactgtttaatacattattaatataattttatatataaaatcatagctggctatatgttgaaatgaaaggacggagtctgggaggatatgcatgtggttgatccatatggttacatgtagccctttgaaagatttgaaaagcactttttcttctccttcttcttttccttggaggtt

SEQ ID NO: 2317 - DNA, 625 bp, Rattus norvegicus
  Genbank Accession No. AI177052
  misc_feature (1)..(625): n = a or c or g or t
tcttgttctctgaggtcactgtggtgtcaatagcagcactagaggggttagcaacacctgcaccaaaactgaagcctgcagatgaagactgaggcagctcctctttcttttcctgctgcccgagagtagataccccaaactgaaatggagctgaagacgctggattgcttaagccagaagaaggtccaaactgaaaattatcattcttgctgtcgttttttatttcttcaggtttggaatcaggtaatactccaaatttaaaatctccagttggtttaggaaatttaaagtttgtattcatggtgtttgtagacccagagtcagatgaagtgcctaatttgaatcctccctgatctccaaatttaaaatttccagtgcttgtaaaagtttgagaaagcccagaagatgatgatggaataccaaatttgaaggctgagggtgctggatttaaagatgaagatgtcccaaagcctttaaactcagactttgtgcctggctttgcactttcacaagctatgcacttggtagagtccgctttattttgcactaggcatacttcacagtcccagcttccctctggttttttaaacttgtccaatcctaaacagcctncagaaggcagaga

SEQ ID NO: 2318 - DNA, 629 bp, Rattus norvegicus
  Genbank Accession No. AI177055
ttttttttttgcactgtggtatcctttatttaaaaattgtgagttaactacagccatagagttcttgttcaccatttagatggcataataaactgagagaacaataacacaatcccaagaaggcattaccctataaacacacgtatgaccacccatgcacacatacacacaacatacacacaaagattataatataaacaccaagtgatgaaaaaaacactttgaatgctctaaatcaaattaaaacccctttattataataaaccgtggcaatattgtgactataatgaaagatattgtaactgcttaagaagaaaaacaggggaatactggcaatttagcagcagcaaacagccaaggaagggtggaagctaagcagacgaagcagcatctctctctaatgttggcactgtgtaggactgcacggaagtagtttaagttcagtttttaaggaactattaaaacatcctttgaaatactaatttgctgcactttacaaacagtggaaaagaaaaaaaaagtatttggaatgttagacacgcacgcacacgcacacacagaggaaacatactaagatattggtttatggtctttgtttatgacctccaaaaagttttataaggaaaaat

SEQ ID NO: 2319 - DNA, 404 bp, Rattus norvegicus
  Genbank Accession No. AI177091
acaatttacatatatatttatatacagtatataaatctctttcttcttggtcccacccctcccctgataacctacaagttgtcagtagcagatccaaaaacttaacaataaaagagagaataaacagcttttcttccctttcctgatcccactgcggtattagataactggtgtttacaaatggaaccagaaacagaacacacacataagagttattaaaagtgcaaacatggagggcaccacttatgttacatgggctgtggctgggccacgggcagcgctgaaggttaggtgtctgatggtcagtcctgtcttctcagactctccattggcctttcgatttttctgctctttagacgagacgtccaatgaatggatttgtgcctgctcgttttccctgaggg

SEQ ID NO: 2320 - DNA, 597 bp, Rattus norvegicus
  Genbank Accession No. AI177096
gcgtgtatatcaaagcagtttattgacctccagtagcacagctctgctttactcgagggtgtggcaagcgtacaaaatgcaaggttccaggtgatccataggcatggctatctgctgaccaatggaatgccctcattcacgaaagggcagccggtagcttacaaaggtcacttaggtgccctgggcccagccactgtgtacttaattatcaaggggtgtgtccaccttgccagctcctcactcatactgcaggagagagaagaatggcacaggtcccagcttctccctgcccttcagggaggtcagctccaccaggctcacacactccaccacctcagcccgcagctggctcagcagctcacaggctgcacacatggttcctccagtggccaggagatcatccacaatgaccactttctgccccggttctaaggcatctttctggatttccagctcagccttcccatactctagagaataggaggctgatacagtggggcctggtagcttcccgcgcttacggatgagcacacagcccacccccagctcctgagcaagggaagggccaaacaggaagcccctggagtccagacctgc

SEQ ID NO: 2321 - DNA, 473 bp, Rattus norvegicus
  Genbank Accession No. AI177115
ctgtatctttttttttattattatttttttcatttttccttcctttttttttaagcactagtctgtgctttgcaaacagaatcaagacattaacaaagatcagcttctctgaagaaaagcatttctatagaacagagacagctacatgtccgctgccattacacagctcaaagcaggaaaaagaaaatatttacaaaatacaagtttttttaaatttttatcttttttggttttttttgttttgtttttgttttttacaatgctaaaagggttattcagaattttcaaccttataaatagaagaagcactttatgcatagggatatggtgcattattgttgtttaaagaaacaatgacaaaccttttaacttgcaaacagaaagaaaaaaaaatcactaatgttgaaaattgtgaaaaaaccctaaccattaagcagtctgcctactatttttgtacgattataaaatggcag

SEQ ID NO: 2322 - DNA, 568 bp, Rattus norvegicus
  Genbank Accession No. AI177119
agtgatctatttatttttctctcttcccacctgaaaaaaaaatagtctcataaaggtctcgataaactgccactggaatggaaccagtcagtgattcccagagaaactttgaggagacagagggctgatgggtcaggaaccagggtggacttcctgaaggaagaggtctgagtgaggatggggaaagcagagggagcgaggcgggcgtccgggtgctggacccagcctgccattctagtcaggaaacagtaggaaaccagagaagacgctgtcagagccctcagtgcccaccatgccgttgtagtcgttgacggccagccacaccttgtcgcccctctgcagccgcaggagtactcctcctgagctgacctgcttgctgttggacatgtggtcgcaaaagctggtcaccttggcattgttgaggagcaactgcacgcacaggttggccgtctgggatgtgtggtggaccaagtagtagaggccgggcactttgcaggtgaacttccccgtgtttgtgttgtaatccccctgaggattggtgatggcggaattgaacttgacaaggcca

SEQ ID NO: 2323 - DNA, 590 bp, Rattus norvegicus
  Genbank Accession No. AI177128
ttttttttgtgatgttgacctagtccctttttaactcaatgtttattacccatttttaaacaaatacaatttgggggtaaaacacactgatgtcccctacttggtgttacatacactgcatacatgggaacataacacacattacgcatgtggaagtgctgacatccatgttatacacacacaggaacactaacagtcgcttgttccttcaaatcggctgaaatgatgagttctgtgaaaggcatctggtctgggcaccctttcagtggtgaaagccaaatactgaccctggctacctaaatgacatgggcaaaaagcaccaccttaaactgcagttcactaccacacacccttcccacaccaagggctgggtccctggagggaacccagatgctgcagccaacctcctcaggtcctgaactaatcttgtgtagaccaagtgcttccttggggtgagcatgctggagctagtgggcaggttctcctggcattgctagctgtgcctactgctgtatcccattcgtgcccattacaagtacagccaagtaaccttggtaccacctggatctatctgcagcatctggtgagtt

SEQ ID NO: 2324 - DNA, 583 bp, Rattus norvegicus
  Genbank Accession No. AI177145
ttcaggtttgatttttaacaaatgtgtcagggagaaagcccacaggaaagggtaaagcccatgggggcaaggccttcccagatgcctgaggagggatcgtgtcccctccccccctcctcttcttgtcacccctatagaggggtttgggaagagacacaggcagggaagggggctggtccccagtctgtcagtggtgcttgggggtgaaggactatggagaacaggggaccagatgggtttgagtgggataaaggacacaagaccatttgccagaatccacagctttctgattccaaattgaattaaaaagaaaaagggagaggggaacctaaaccacaggcagtacccactccctttcccccatcagggctgcgagagaagaggcaggtagcttcaccaaggccatggctccctcatgcctggccaagggagctaggtgaagggcagggtctccccgacagtttgaaggggtgaggaaaaccaaaataaaacgtcaaataaattggataggagtccagccaagggcccagccagagctgggggaggggcctctgtaggctcatggatcactgctgccaccacc

SEQ ID NO: 2325 - DNA, 563 bp, Rattus norvegicus
  Genbank Accession No. AI177181
atacaaattactgtacagtcattttaataaagtgaatagtaagtcaaggtagaaaacacgaaactctgatgccttccttagagacacagcaaagggactgtccatggccccggttagtgacagagtgaacagagtctagaaacaggctaaggcattgtgaatgggctattgagaacggaagtgcccagtgctaaaccagggcctgagtgatcaccacccaatctgtttctgtgggaacagggccaaaaatctctaaggaacctggaaatgtacagaaacgtggttacactaaacctggtctagcagtgctgtcctgcagcttctcccaaccctactgaagtacccatgatgcactgcgacagaagctctttaaagcattaatcagcggtgtacacactaggcgagtgaacactctgcttccagacacgtgaactggatttccaagtacacacagggcagaaccccgagtgcacaggcagggccagctgcgtgggctctgtaacccgatgtgcccgagctcaattcccgtgtacttactggttgttggaaagacgacaaaccat

SEQ ID NO: 2326 - DNA, 600 bp, Rattus norvegicus
  Genbank Accession No. AI177281
ggaccgaatacatttacagatttattgatcaaattgttttaaaaaaccaatagctaacactgacaaggtaaatagctacagatggaacatttcagggtatatttacttgctcataggaaaccatgggaggtggaaaagctgtcctgatcacatggcatgcacaccagactgcaaaaggacatccacactgtgtacgtgtgcgtgtgcatgtgagtggctgctgcttatctgctccctgcctggcttccactgtgttctagtcaaagacacttcagaccaaaccagactgctaaggtacaagaggtcatgctggcctctgacatctatctcaaatagactgccttcaaagggcttaacaaggatgccaacaagtgtggcttcaatcagcccctttcaccactttctggtgtaacaggaccagagacctatttgtattccaaggaccatgggcacagaggctgaacattgtctttggaccctatataaaccaatgacaaaaatccatctgtcatccaagaaaacaaggccttttagtttaagatacatgtccaccgcgtgtacaggaaacctggcccatagtcacacagttctgagcaccct

SEQ ID NO: 2327 - DNA, 353 bp, Rattus norvegicus
  Genbank Accession No. AI177285
gcttccataaagcaggcgtttattaagtgtcagcacaccaaagggaaagaaagcataggcaccttaaagcagccaactggggagggagaagtcaaataaagagcagagcacttcctgacatgcttcaaaaaagaaaaaaaaaatcaccaaaaaaatgtagcaaatatagacagtcacaagcaggctctgggggactactgagaaaggccattttgtttgggtgggagtggcctctatttttacaaagctcatttctcatttgttaaactgcaaacaacttagtttagactgttttaaaaaatgaagaaggataaaaaaagtcggacatggtgtgcaggcccataatacttacc

SEQ ID NO: 2328 - DNA, 481 bp, Rattus norvegicus
  Genbank Accession No. AI177353
aaggcttaattgtgggtttatttatacatgtgatcgtggtgacaaaggcctaggcagctgacactatagctcccatcccaggaagagaacaaaaaaaaaaaagtgcagttgttctaattaatattagcagatgtgatatgacaccctcaggacccttgcccttcacccggacttctgtacatggcgaatctaaacgttttcaaattcacagtcatagtcagtcatccggcacattatgaacttccactggcgatccctttccactgcagagaaagtggttgttgctcctctcatatagaaatcatagtcataggaaatcatgtccatgtcttcgccgtagtggcctgggtactcggttgtcatccagcaggaatatgggcacctcttgctataccggcagcagtaaaattgccactctcgatccagcactgactcgaagtaacggctttggaaccccgccaccaatccattgttagagcac

SEQ ID NO: 2329 - DNA, 399 bp, Rattus norvegicus
  Genbank Accession No. AI177356
caggttccaaagaggccccgctttattacagagagcacgaaaagctctttccctactgggctaagtcctgttccccttctcggggtgataaatgtgtctctccagttctgtcctatctgtactttccatgtcggttaaagtgtttgtagagatagctgatccgtttgttaaggttgtgcaggtcctcattgaacattctgtttcccaccatttccttctttcggattcaacgctgcaattcatttcctctccaacctagaagccatactgggcccttgatcagttcttttgaatgcttttcgaaatcccccaggattccaatgttgccgtttacaccaaacagagctctcttctcattccagcgatcaatcactctgggaggtggaagagtaagcctta

SEQ ID NO: 2330 - DNA, 618 bp, Rattus norvegicus
  Genbank Accession No. AI177366
gtattttaggccttttattttaataaataacttcagttaacagcactgtcaaaattaaaaggcacttaaaacaaggtggtgactagcttgagtcagggcgagcacagcagggaaggcacgtgcaggaggtgcacagtggtcgaattgctgctgaggggccctgcccaggccctacagtcctgcaagcagcaggacggcttacagtatttgtgaaaaaggcaaatgtacagccacagaaaagaaaaggttataatagagtctgacccccaaattgcaaacagacacattagagattagaggtgataaaggagcaccaggaattaaagaaaaacaaagcagaacaggcccctgctccacaatgctactaaagttatggccttatgtaaatagtgctaagtcagggactttttagcagagaagttcccagtacttttatccaagcttggatttataaagagaaagcgttgggagttacaggatcaagtaactcacaatggcacacaggttttaaagctaagttttcctttccacatctcagaatttttccaatggacttgtaaatcaactgtgtcaaatttattttaattggaaactgtcaacacacttgtcttccgcacg

SEQ ID NO: 2331 - DNA, 601 bp, Rattus norvegicus
  Genbank Accession No. AI177428
acactctacatgcttttattacaagactaccgagcatacgagggaaatccatcatccggtaattacatctaaagcacagatatttgaaaaaaaaaagaagttgtttcattaaattatatgattaaaccatgaccaaatagaaaatttatataataaagccaggaaaaaagttgtaaaatatagtttacaataattattcacattcaaggctgtacatcaatacatacaacgtggccccaaacatgaattcaatccaaataattcatatattagaatttaaataatacagactgaactagaggccgacaatagccagcaaataaccttatataagaataaaaatacaaaagtgtatatcctagtatcattgcattatctgttttcataagtatttttaatttttcctttgcctgtacatcacagttacagctacagaccaggtagagaatattacatatgttctaactgactgccaccaacctgaatgacagcaatagactattgattcatcctactgtacgtggctagggaatagccgcagcagctctaaatactgtaacaatttttgatttgtgccatgttcaatcacactatggtcata

SEQ ID NO: 2332 - DNA, 454 bp, Rattus norvegicus
  Genbank Accession No. AI177482
ggacgtggaaaccaggtatttaatattttcattaaattgtttcaatacaattcccaacaaatgccaactgcaagacaatgtccaaaaactctgaagaagcaagctcccagacaaggaacaaggccatcatcttccactctagccacaatacttctctccatactcgtgccagtcagccagcctcatccagattatcgagtatttaccacatcatcaattttcagaatgctccgcacagtttcagttgctagggtcaacgcactgactgacaccaacagaggctggacaaccatttcctccagaatgttggagatcccaccctttcggacattaatgcctgtagttttttctccttgggcatggcggtttcttagctctgttacagtagagatgggattcaggccagcattttcagccagtgtagatggaatgacttccatggcatctgcaaaaa

SEQ ID NO: 2333 - DNA, 548 bp, Rattus norvegicus
  Genbank Accession No. AI177484
ctcgcagaagcttttttagtttattttaccctcagaaatttgcatatcacagcagaacatcaagtcaccgtagaactactcctttggctgtaaatgaagaaagaaattcagtcagcgacagctctgaaaaggtttcaaagacaaacaaattctaaaaataactcatgcagcacaagtattaacctaaaatagaaaccgtaagaatgatacaaacacagaaactaaactaacattcacgttagaaattaaaataaaaaaaaaaacaagtcaacttcattgaattttagacagtcactgttagtactgttacaaactacacttgcaaatctacttaaaaatgttcacgtgcttgttcaaactacgtcagtaacaaggagtctagtgatctacatagtagcttgaattatacctgtatccagtctccactcactgaatcagtggcagggaaggggatgggaaggaggaaaacagacagctcattagtagtcccttctcaaatagcaaagctatctatgtgaagtacatgcaattagatacctcaggtgact

SEQ ID NO: 2334 - DNA, 526 bp, Rattus norvegicus
  Genbank Accession No. AI177491
gtgaatatgtaagtaaaatttattatcataaataaaaagataaatcatataaacactgtacagaagtagcatgtgagctgtccttgcctggtctgaaatacatgcatcatcaatgtccggtttcatctctccacagccttcgtgcagtgctcctttttggtgtctccccagactcccggtacctcttccaaacctcacgttacgggataggcttctggtgttacttctgcagtcaactgtgactgctcatgcgatcatgtgaacactgccaagtatgggttttaacaccagcatttactgccccttacagaagcgccggacacagtatgtgttcccatttcatgaatggcagtttagtccacagaaaccacactgagactacctaggttaatgaggattagtgcatggaacaggtcctttaggcagggagagcgtagacaggcagcagcaagtacttgttaaagttttgtcagtaactgccatttaacaagtgactgtaggaagggtaaaacttaataaggtactg

SEQ ID NO: 2335 - DNA, 582 bp, Rattus norvegicus
  Genbank Accession No. AI177513
acattcataagcacaaagtttattccaaataaatcgttctataattactgaaagatgttgtatggcttggccatgtatctcataaagcctctaaaacatcagtgtacaaagctatacaaataaattaaaatctagactgatacagtctgtaaaatttctttcagagcaccatatttataaatcatgtatgctttttaagcgggtaaaagaaaggatgctttagggcttctttgagagtgattcttttggctggatcatactccaacattttcccaatgaggtcaaagagaagctcatgctcggcatcctgagacagcataaactccttcagaggcttacagcgccgagaaacatatctgccagcagaactgtgctcatcccaatccaatcgatcgtgatggaagtatgtgcgtttcctggttttctcaatcatgtgctttggcagtggtccaagaatcctttccatcattgctaaatgttccctgctatcatgagtcggaaaaactgtaaatccaagataatactcgataagaatacatcctatactccagacatcacatggttgtgaccaccctagggcta

SEQ ID NO: 2336 - DNA, 557 bp, Rattus norvegicus
  Genbank Accession No. AI177593
gggacaaataccaagtttatttcacaaacactaagaagatgggctggatgggggttggggggcatgggcgcacagctgtacacagtcaccatcagtagcccacttcccacactgggattcagtctggactgcaatgcctccaaagtcaacaggcagcaagaggtgagtgcaggagggccctgaacaccaagccccagaaaggctaagggacacagctccagccatcccaggaaaaccagcaataaataacagtggggcacggccccacccatacaggtcatctagtcacccatcttcactctggaggtctgaaggattgcgacgatgaccccaaagaggccaatggcactgccaaagatctccacgatgagaatttttacaaagaggctggggttctgtgcgtcagccagggcagccccactgcccacgatgcccacgcagactccacagaacaggttggacagaccgactgtgaggccagccccaaacatggagtagcctggaggatacaaagtagctcaagtgaggcccatggtccaaggtgggctaccagggcc

SEQ ID NO: 2337 - DNA, 515 bp, Rattus norvegicus
  Genbank Accession No. AI177631
gtatttatattaaaatctttaatttatttatttcaagtaatttttcaaactttcaatgcaaagtttaagtgaaatcttcactctgagatacaaagggttaatgaattactaagtctctgtctctctctttctgtctctgtctctttctctctcacacacctatacactcaccacccccctcacacacctatatacttacctccccccacactctcacactttggatgctgttttaggtaggccaaggctgatgagctcgcactctacatctgctatatactacatctacaccagcacacaccagcttactccatattcatgatggtagcacttggcatagttatacatgcttttatactaaagaacaggacaataaagattatccattatacagtatgagggtaccttacaaaatgcttccttgaacagtctattccacatttaaacaaaacaccaagtagtgctctcagtcacctaagaagacagcctcacgggcattccattggcctcgtgcc

SEQ ID NO: 2338 - DNA, 525 bp, Rattus norvegicus
  Genbank Accession No. AI177645
aataaaatatttatttattaaaaaaaacctgaaacacgcaaaaagaaagtccagcttcaaaccaggatttcctgttccttatccatatttggcattcatcatgtgcttagagactacatataggtcaagggtgtgagcttgtgccaatagggcaagaggaggggcttcgtgtggctcagggcccatcgtccctaggctgggtggtggtagcatctaccccagtgagggccctggcctacctgaggacaagtgagggtgcccagcagggtgcatgctgggagagttcaggtgggcgtggccatgggagagtccctggagggtgtgggtagagcaggggctgtctttagaaggcctcatgccctccagtaagctgtaggaacagatcctcgtccagctcctcccctcgggcccgctctcgagtggacaggaaaatgtagcccccgatgtactcgtgcacgatgcggcagcttgcagacacacagctgaaggccacattgatatgttcatcgaactcaatggccacct

SEQ ID NO: 2339 - DNA, 587 bp, Rattus norvegicus
  Genbank Accession No. AI177706
ctaagacattttactttattccaaagaagccaatatacaggatataaagggcacagtatttacaacagtacagtaaacaggttggttttctggtagggtcagtagtctttttatgagtacaaacccctcccggtgattttcagacccagctgacagacacagcaacggtgggtagggtgggactaaaaaccaggtagatgctacaatgtgcggaaaggggtcatgtcatggtggggaattcacatctcttccgggcttgggaaggaactggaaaggtgaggcatttgcctgagactcacacacagcccacgctgagcctggaaatcccttcccagagagactgtatgtctgaggagagcctccagtttcctggtccttcatctaaaaccaagcttgaccttgacctggagtagacacagacagggctgagctctgagcatcggggtcccttctgtgccggctccagctgcctgacaactttacacatagtaagcccctaagccccaaaggagtcctgtgttccccaaccccacagaacttccctcctactttctccacacagcttaatggaaacaggtctggccaaa

SEQ ID NO: 2340 - DNA, 454 bp, Rattus norvegicus
  Genbank Accession No. AI177748
gtggtagtctttattattattttagctattgataacatagcatggcagcaagattacatgagtaatgtaatataacacaatcttttaaattgaagccttacaccttactatgcttaagggtatttggagctcccaactgtgatgcctctcctgtctctcccaatagaaaaatattgcactacatcaaaggtatattttacaaacataatcagcagcactgttgagctttccatgattgtggttccacggagataaataccttaaagcatgagtagattctcagaacgaaagctttgcattacttctatagctctttcaaacgcatcagtgcaggagcatgcttgggcaccactaaaacttccatggcgtgatccgtgaacacaccagccacttacagccgtgcgccttcagggtagcaatgcctcgtgccgaattcttggcctcgagggccaaa

SEQ ID NO: 2341 - DNA, 551 bp, Rattus norvegicus
  Genbank Accession No. AI177765
tctagtatttattaaattataaagtgtttttaatcaaaaagaaaaatgcagactaagagaaacctccaagtacaaggacaagacagcaaaccttatggaaaggaacaccatgaagtatgttatagagtctgaaacttaatagctacagcttgacatttctatcttagtgagaccaactgtaaagtagttgttagtcatctatttttaactcccaaattcacatctcttttccacattaagcttcctgctcatgataccaagtatctcacagatgccaaattttagtgaagattttataccaatccatgcagaaaaataaggtagtgcaagagtcagatgagagccattaatgcacggggacacactagccaaaagaactaaagactttaaaaaacaaacactctaatgtaaacagatgccaagaaaactgtgttatactgaacagctctcaactatcaacaccccaattcctcacattaaataaatttcagcagagacatgttagacattttcctcgtgccgaattcttggcctcgagggccaaattccct

SEQ ID NO: 2342 - DNA, 429 bp, Rattus norvegicus
  Genbank Accession No. AI177790
taaaaagacaaatcccataaaacaccatatttcccaccagatccaatcaggggcaaacatatatcctgatttatttcccgcccgtgtacctccccactacctgtgaacgagcacacccagtgtggtgtgtcaaacaaagttgtttaggggagcaggccacatggcttgttgtctcccaccaacagcagcctccagcctttcaggaacgtggcccacaatagaggtatttttgtttagtgggtctcttaggcaccgtaattgaaacttaaaatagtatagcattgtctctcacatcctttcctcgagttgtatcccgagtcgaatccctggctctgcgatgggtacctgtttacactgggatctaacagccatcagcctaacagtacccaggcaggaattattatctacttaagtcactaatgagcaaga

SEQ ID NO: 2343 - DNA, 480 bp, Rattus norvegicus
  Genbank Accession No. AI177797
tttcccttatggtcaataacgtctctgcattgaattgtaaagcaaagtaagataaaatcccccaaatgacaaggtatcagaaatccagatttagttacaatttatttgtgaaaatgttcagctttttttttttttttcttaatattggtctgtaaaagaaccatcatctggatcaagaatgaattctataaatcaaagaatattctacaccttggaaaaggaagtcagcagtaacattctcacggagcgttgtaaattacggtttcttcataaaaggtacatactgttctgtactttcccaccaaagcagtggtgtggtgtgtaaaaagttctcctgtggcaggaaacctctctctcactttactaaacaactggataaagttttcaagtctgtataaagttgcctataagctggaaaatgaacaggttcaatctccatttatattttagtgcatcttttgacaattgtcacatttgtaa

SEQ ID NO: 2344 - DNA, 487 bp, Rattus norvegicus
  Genbank Accession No. AI177809
ttagctgtggccacaacctagcagcacagagcaaggtgggtgtccaggctgctggagccacgttcccagagggttggggcttccaccctcagcaagcacgttgcataggctgctcaggccagccaagggcattggtgcagcagtgaaagcagcagcactaaatgtgacccttgggttgggggcctcaggatgataggtgatccctgcagaagaggcaagggttggagcccagggctgggcctcagcaccaggacggagcctcagtacttctaggccatgctggggccctgggtcagggcacttgagacacaacaccaatttcacagggcctgctcagacagccccctcctgctaccacaaatgccacaccatatgcacgcacacacacacacacacacacacacacacacacaccctgcctgctgctgagtggcctgtcagtatgaggatgtaacacaggttgaaagcataggttaaaccccaaaag

SEQ ID NO: 2345 - DNA, 675 bp, Rattus norvegicus
  Genbank Accession No. AI177866
ggtagcaaacttttatttaaatcttacataactcaagctttataaaaagccaacataattgaaaatttgggttctccctctaaagcctgcagtatccaaaagcttgaacagttaatttaaaaataagcaaaacaaaacaacagaaccctgcagcagatcccgctgcaatactttaaaaaaaatctaagtgagcttaatctttacaaaagttattttagctcaaaggctacaaaatcaaaattatcttaattctacaaagaagggagagggcttcataccaccattttagaacctcatcttttctcattaaatttggccacaaatcaaattcctgtgttcccttttcaggaaatcctcttgaagaagaggccgagtacgaactcggaagagtgactgcctaggcaagtaggaaagagttccgtcatagtgtgcaaagaacgtagagttcagggctaatctctggaacttgatctggacctggaacgagatctagaacgggaccttgaagctctttttggcggaggggacatggaccgagcctttgaaggtggagcaggcagaggcgaatgggatcgagactggctccgggatctggattttgactttatatctccttttccattttctttgggggaccgagaacgtgacctacttcgtgacttcccatacttatcc

SEQ ID NO: 2346 - DNA, 443 bp, Rattus norvegicus
  Genbank Accession No. AI177898
  misc_feature (1)..(443): n = a or c or g or t
tttttttttctttatatttgtgttaaacagctttaatctcggtcattgcggcttctcggcacagtaagaaatattgcacatgatcaacatgttttgttctgggaatggggacaatggtaggggaatcaccttcttagaaagtacaacccaagttgggagggcagagggtgggaagaatcctccccatgcctgtggcaaagtgcaggagcccccccaccccaaactaacctgagtccagcccctctggggaaaaaggggggtgcatgaactccccactactccacaggcatcttctccctgtggcccaaggctcatactaccctccagcttgcagccctcacaggagccattctgcataaagtacaagtgaaaagctctgaaggtcacacacttcangttatatatacaagagctcagtggacggtatctgcccctgctgccct

SEQ ID NO: 2347 - DNA, 439 bp, Rattus norvegicus
  Genbank Accession No. AI177901
ctgagtttgaattttattttttagcattttaaagatctgcccacctccccgtcccattaaaaatatttaattttttgtgcaagttaacaacttctatggattttacaatgtctaacactgtagaaggagacgacggacgaggcgatggcgtaggcccggttggtgacgaaatcgcagcacttggggtcgttgtagcagcggcgcgcttcgtcgctctcgcagctgtcgatcttcttcacctgtttctgggcctcgcggaacacccggaggtacacgaaggccatgatgcacaggggcacgtagaaggagacgacggacgaggcgatggcgtaggcccggttggtgacgaaatcgcagcacttggggtcgttgtagcagcggcgtctgcaggcggcccggcgcgcgcagcatagcaggcgctggaaagccttgcggaagt

SEQ ID NO: 2348 - DNA, 395 bp, Rattus norvegicus
  Genbank Accession No. AI177911
aagggggtgaaaggtcaagattttattgtcttcataacaaaatcagcttagaactggatcacttggccctttctcttcttgtcacctcctagttcaaaatgcttgcatctcttaatagccagcatcctcttagatctgcagttgggctcaacgcactccagtctcagcacaatcttctttgtagttttagcctttttgcggaaaatgggcttagtctgcccgccgtagccactctgtttcctgtcataacgccgctttccctgggcatacaaagaatccttgcccttcttgtactgcgtcaccttgtggggttggtgcttcccacatttcttgcagaatgtccggcgggtcttaggaacgttcaccatgtttgcaggagcgctacccctcgtgcc

SEQ ID NO: 2349 - DNA, 469 bp, Rattus norvegicus
  Genbank Accession No. AI177919
acgaattcaattaaatatttattgaacaaatgcagaataaatgaaccagggccgttttaacctgaagatacattaaccaactcaaatcttcaagggctgctgccataggagaacaaaaagagatgcactgagcttttctacacggggtctggatgcgcagcaggaggatgcgcagcaggagggctgcaggccggccctcagctcaggagctccctcagcacacactgcactccatgctcctcccttcctctgaaaggaggcatcagaacttcgagtttcccatctgcacctaagttgcgttctcattgcagactgtctgtctcatgcaatggatgcttgcacaatgggaagacaaacatagcattgacaagctcctccccaggagacacctgccaccatcggctctttctgattctacatcactgattccttgttctgtgaagggaagaagagcacattctccagagca

SEQ ID NO: 2350 - DNA, 562 bp, Rattus norvegicus
  Genbank Accession No. AI177965
ggtgaataaactaacagctttattaatgaaggcaaacatcagataattgtatgaatattatatataaaagagaaattcataccaataacattgtatttcaaaagtactgtacttcagtttcttttaaagagacttgtcatcagttgtaaaaaaacaaacaaaatgggtattcttctcctaaaaagttctggaaaacaaaataatcactttcaagcagatgaagtgaacacacctgtctgtaaatgcagactctcgctaaggtgcgaatgaagccaagcatcatagagatgcaggacaacctcacaaaagccagagagaagggatgtagcaaagattactcaaaggtcattcaaaactggtctctcatagaagtataaaacaatacagagagagggaactatgaaaccacacccatctgaaatccttcatgatgcttctggaatagttctgattctcttacaagaaggacaaagttaaggtttgggaattgggaaggaatgaagatgtctcatttaagtgtacaagtaaggcacaagattaagccacacccgaatctcgcatg

SEQ ID NO: 2351 - DNA, 558 bp, Rattus norvegicus
  Genbank Accession No. AI178025
aaagaaaatactttattacatcatgaaaaaggtatccaacaactagattcatacttgcttgaatctataaaaaaaaacaaacaaacaaaaaactgaaagtttattcattagactgtatgtggggtcatgttccacatgggaacagagaggcacaagggcttctaagtattgcacagtcttgaaaaaaaaaaaaaggagttgggaggagaagatcacatgatactgggaacgtctcacattatgagaaactaccaagaaacattcgaaaagaaaaccctctgtttctacagtagctttagtctgcagttcttggaatgactattccattgaagacatcttagtaacaggaagcttcgtttgagcaatcccatgtgcaaatattaataggaaaatatataaaataatgcatctcttgccatcacccccggcaattcaggaccgtattttggagaactgttttgtttgacactcggttaagctgtgagtttggcctgaagctccatctctgctgcctgcttgagcgcaacgtccaccaggagctgaaatccactaaaatcc

SEQ ID NO: 2352 - DNA, 510 bp, Rattus norvegicus
  Genbank Accession No. AI178039
acagtacacaaaacccattaataatgtagtgtagagaccagaatgtaaagagagaaagagagaatacattattgatttgtatattaattcgagttcaggcatctacttgtgttacagcacagctgtcaaaagccgagggtgagtaaataaacagacgggtttgtttctttccacgttattttataaatgaacaccgatgggtagtgaagcaatggttttgctgtccaagttcagaggccgctgctgtggcggggggcggggtttagttctgcatctgctcaaagaacttgtatgttggattctcatatccattctgctgcatcttggagaggtggcgctcctccggggtcacagcagcgtcaaccttcaccacgccatgatggatggatgtgtactgtgtcttcttcagcattaccaaggtgatgacaatcactgttgctatgacaacgcctcccaccatgagtccaatgatggcacctttgtttgaacccacatcttctgcaaagaaca

SEQ ID NO: 2353 - DNA, 432 bp, Rattus norvegicus
  Genbank Accession No. AI178069
ccaaaaaattttattgggggaaaactacaaaacatttacagtacaatgtttacagtcacaatttgtagtgaactgattccccaaaatatattacaactcaagttgacttatctcgttacattcaaaaacctacttctgtcaaagtagtccagagtgcactcgtggtgctccaactgtacctacggcacaaactaagcggctgatcattcatttgtcatccggcaaagccgggagactttcctgcctctttacaatgaaaaataatagtacaagttctggactgtcattaagcaaggtatattcgtgtaccaccaacaattcagcgtgaagacctggcctcttcacatcatagctatggttaaaaaaaaaagtggtaaaattcttttcctcttgtgcaggctaacccatcccacattcaaattctcaagcact

SEQ ID NO: 2354 - DNA, 419 bp, Rattus norvegicus
  Genbank Accession No. AI178104
aagttctgaactgtgcccatttattacttcttcaggggacttgggagatttggaaaagatcagggtaacagttgccagcactcctctctcctgaagcagaaaccgcaggacatcatagccttggggaaagaatcctgtgatcatactctcctactatccaggttgctcatcccagctgtgctggctcatctgtcttcatgagcccgacttgggcaggaactgttacctccaggagctctgcctcatggggggaacctcaggactcaggctggacactaggatgtggctctgggggactccctggaggagctcttctctagttggaggaggaaggtcctgtgtgctagttctatccagctgtgggggcggtggcaacgcagcccctgtctgctggatgaactgttgcaggttgcattgcc

SEQ ID NO: 2355 - DNA, 539 bp, Rattus norvegicus
  Genbank Accession No. AI178133
cttgtaaaaaggtatctgtttggatttttaatacaaaatgactcaaacacagaaacaaatatcatacaagctagttattcaatttaaaaataaaacaaaaataaatgcaactaacaaatttcaaattgccactccctgtctccagcctagattaaaaacaggaaatatcaaaccaacgtttgtctttctgaagaaatcttatttttaaagagaagaaaccaatccctgaatctggcgggtggtaccagaggccacagtggttctggtaaatggggtacaagaggttgctggaatatggccatcaggtccagctgcttgctaacgatggtcatctgaaggcaggtcagcccagacaccatctgactctggccaatggcgtagtctgagccttgggtcacggggccttccattccacattttcactggatctcacccatgtacagcctcttgtcactggatgctgagaggatgatgggctcatcgggatggaaggccacctcattgatggagccagcatgaccaggaagcttatacaggat

SEQ ID NO: 2356 - DNA, 506 bp, Rattus norvegicus
  Genbank Accession No. AI178142
acaatcacatcacattatattaagcactcaaaacaggcgtattaataaaaaagaccagctaaaaatgtaacacatcatacagtccacaaaggtcacgtatgacagtaattttaagtacttcatttcgacacaataaaaataacaggtgaagtggtgtctctgagaacactcatttatacgtatgacaaaatcaaggaactttacatttaaccaagattacatcactgaggaaccacagtagacacgccaaccacatacataagaccaagtgctgcacaagtaacccagcaccggatcctcccttcctatgaccgccacacaccttatacaatcttttcatgaaccaagtggaaaacattttcccatcatccccttcttcaagaggaatcaagagaaaccaaacaaaaaattcaaaagttggtttcgccatcctcctcaggtgtggttttatgaggacaaaaaaaaaatccctccgttacagaggaattgcgtcatctgtaggagtt

SEQ ID NO: 2357 - DNA, 580 bp, Rattus norvegicus
  Genbank Accession No. AI178151
ccttggaagaaacatttatttataatctttattgaacagtttcaacgactccagaacaggcttcacagtttgagtgtggtgcagagacactaactcatgcgggaatagctactgtccagcgtgtccctgacgtatgtgagtgtgaggatgctcaggcacaaggcagtgcgagacacatctgctcagaaaccagctggaaaacatgatttaaactctacagtaaggtttattacaacgaaagtgttcttaacaacttctaatttcaaaacaaagtaccccaggaatcaactatccttttaaataaaaaaaataatttatactcttcttaaaggaattccaacaacataaaggaagttccaactccatgtatgtatctatgcatgtatatacacacgtatgtatatgtacatataacttagatattctggcactctatgcttctgctcatgcagcagtgacgctggcgaggctctacagaggcctctcggagaacgccgtgtagcttctcactctggcgaagaacaagggggtgtacatcttgtcaatatcaaaagcactcactgcagtctcacctcgtgcc

SEQ ID NO: 2358 - DNA, 601 bp, Rattus norvegicus
  Genbank Accession No. AI178159
ctgaatttcattttcctactttattttttatgaacaacttgctttacttcttaatctgtaccacttcatttgacatttatcaaagctgtataaaagccatgcagtttatttacaatattgtacattaaagtgtttgaagatcacacaggaagttcacaaagctatacatgaaacacatactgagaggttcttataaaatgtaggacagaatttggcagactgttatggttggtgaatattatgcaaccattagctagaaataagacgaaacatgcaaacctgtagaatttgaagaaattaaaggctaaaaacatttagctaatagctaagttattcatatagttgaaagtttactatgtaagaatgggaatttataaaacaggtcagtttttaaaagttctccatgaataataggctttcagtaatatataaaaatcttcagaagttatttttcaaattatgttcaggattgaactatattatcaatagatatatagattaaatctatgacttttatataatcatttattgcattctaaggaagtcttaatttttcaccttgggaacaaaggtgataagaaagccaatcaggtaacattgg

SEQ ID NO: 2359 - DNA, 644 bp, Rattus norvegicus
  Genbank Accession No. AI178241
agcagttgaaatgggaaactttatattacatatatttcacaacttaaaggtaagggtacaaatacatagcatagcatagattaaatttaaataacattatctaaattttgtcatacacaaaactcatgtgaatccattcagaggaaaatgttccaaatctcactacatatacctatgaatattcaaaaaaaagccattgaactttacagtttgaattgaatattacacatgaattatacttcaataaaactgttggaacctcattgatttgactcctaaggagaagaggtatcccatatattattgacccacataccaatgacatgcttagaaagaacaaagttaataaagacttgacttgggatggttgcttgaaagatgaggaaagtctgtgcctgaccacacgggttcccagtcacagggcaagagcaaaggcaatataaaacacaggaacgaagccgaccaaagacctttattccagtcttctgtgatcattaaaccacctatgcagaacggtcctttcatctctgccccaaacagcatcagctacatccaggcctgaattggaagacagactcaagtaatggaagactttatggagaatgctatccaagagctttttgcttcttccatctacaggaaga

SEQ ID NO: 2360 - DNA, 545 bp, Rattus norvegicus
  Genbank Accession No. AI178267
tcagatttatttggaaattcacagtttctaatggtactacagctctgtagttacatatttaaaaccctcttttcacaacacatagtgacttcccactctggctctgctggcatctggacttcaagggcctgctgtaccatcaggccctattgctctgaatggctaattgtgcagactggaaggggtaaaattcatttcctaaaacgtactgttcacctaaagcagcaacttaaagaaaaaggccttaaataaatcacattacaaacaacaccaaaaaaggtattagacaaatttaaaaacaattattaacaaaagtgctcaataagttataacttaaattttacaacacaaaatggtcaattctctcaaaaacacatttcactttcactcatccctgtacaatccaccttaaagctttgtagtgttgcagcttaaaaaacctaataaagttacaaaacaaatcaactgacagaaaaagttctccctcctcttccagtggcattataaatagacaaaaggcacataaatatgggaaggtgcaagaa

SEQ ID NO: 2361 - DNA, 513 bp, Rattus norvegicus
  Genbank Accession No. AI178321
  misc_feature (1)..(513): n = a or c or g or t
gctacaacaanngaaattttatttaaaaatatttttttacagacatgggtgcttgaaaaagctctttagttaactgtatggaaatgaaaaaaattaataaataacattagtataacagacctctaattagtctaacagacctctacacatcagtacactggcaaaacaacatggactgaagagaacgagtcttaaagctccactactctgcaggagcatttacctctgcctgctttctacaggagagtgtaaatactgctaatagaaattttcttatattaatgacatttaaaaatagtccatgagaatctcacctaagtgtgtgttttgttttcttaacactgatatacaaattgggactctattctggggaaaatatcaagttctctcttgtcccacccaaatcaagaatttaaaaatctcaaatgaggcagatcttaaaaagaactggtttcacccccactctttgttagccacaggcaggggagaaaccaggagaagggagggtaaaaa

SEQ ID NO: 2362 - DNA, 488 bp, Rattus norvegicus
  Genbank Accession No. AI178326
tgcctagggaacaataattgtatattcagtttaacagaaataaaagagtatttgtcttaaaatgcaagattttgagccatgcaattaaattgttaaaaaaaaatttcaaaactgaaaatcctttgctatttaagggctggaatgtttcagctttttaaaggaaagcagagatgtatggtacagctcccttgcaagaggggattcagattcacagttaacatgaaaatcatgtagcagacgtgtgtggagcattcttcgtacactggtttgcagcagtgacattcacacagatttcccagcgtcctggtaagcccgtgtctgcagccttaccttcccacatcgtggaaatacaagttcgcacatatacacagcatgatgatagaaaacaagatatagtaaatgagattcctaaatttcggttctaagtctcctttgcgataccagtagataagtatgcaggcagtaatactactcaaagagatgcagac

SEQ ID NO: 2363 - DNA, 443 bp, Rattus norvegicus
  Genbank Accession No. AI178386
cagtaaaaatgtaaacatttattgttaaattcatacattataaaaatatgttcggagtaaataaaaaaaaaaagcaggcccaatatctgcttgctatggtttgtgccccccaggagttcatgggttaaaatcatggtccctagttcagcagtgtttagaggggaaacctttgaggtgtcaggctctgcctaacaagcctactctgtcttttttgcattaagccctgtgggatgcaaaaggaaggtcctcccaggtaccgaagaccaagcctccatcctttacccactctccagtgtgcgctgttcagttctagcaacagaaaatgggctgaggccacctacggcagaaacgtggattttggtcattatggcatcatattttttttgtgtgcttgttgtgaaaaatgtccaccgttgtttcatgacacggcctcaggtctaaat

SEQ ID NO: 2364 - DNA, 624 bp, Rattus norvegicus
  Genbank Accession No. AI178475
aaaaactaaaggttttttattataagcacacagccaatgtattaactgaacaaagcattaccaaaaaacctcagtatttatgtgaggtcgatctttagtgatgacatacgtctaccttaagcccttcgggaaactgaggcaatgttaatctacagttgtcttgagtcaacatgaggcaaaacaagtaatccgtaatggtaataaactttaaaaagaaaaaaaaatggctgaccaaggttgtgacgcagttcaatccatcactccatcgctgtagcaaacaaactgttaagtacaagaaacaatcattcagccccagatcagacttaactgaggtcagtcgtccaggtagctgccccctcatatgtcttggcgccagcatcggacttcctcccacacttcaaggctaacacccacaggagacgctgagcccagagggtaagtccggaacgcgtttttccacaggaagcgcaaagttcggaatgacgcccaaccaaactgaatgaagtcccaagtggaagtgagccaacagaggaagggcggaacttccaaatcaccttacagtccaatacgggctagcgccaggggttgctttctgctgttgacagccttggggagggtgcaaca

SEQ ID NO: 2365 - DNA, 552 bp, Rattus norvegicus
  Genbank Accession No. AI178483
attttgtaataaaatttattagctgtctatgtaagacaagttgaagaatttgtagattttctcaccctaaaagagccaaacacaatcatatacatctaacatattccaggataatatttaactatgtataatatattgggccttacaaattcaatatattataaatcaaataacatagcacagtcatactattatttagacagataaaccacacattaagaaatctgctgtgacttttaaaagaaaaggtaaaagttgaagaatctctaatctgaaaagtaagacaatttctattggctcatttttttaaaaaaatataaaatgccccttttagactatctttggtctttttagttaaagagaaaaatgtgtttcatttgttcttagtctaatcttccatatctaaatgtctaaaataaactcttaagtatcagaatccagggatgtaagttttgctttaaaaaatacatagaatcctaatggtagcaggttataatcccacaaaaaccttaccatttaagacgtcccttatttaaataatggtaatgccat

SEQ ID NO: 2366 - DNA, 552 bp, Rattus norvegicus
  Genbank Accession No. AI178491
tttattataaaacttgccaaagatcatattaaaaacaacttgcacctgatatccagatatggtggcactgccctggcccgccctatcactaccaggcaaagagcccaaagtcttacccaaagtttccttctaagctgctgggcacacaccatgttgataccagaagagagagcacgatagcaaacccccatgaacaccttagtactattgaacaatgacactgtcataaacagtaaagagttacagaatgcagagtgacacgtcgcaattacatgagcacagcttctttgcgtatactctaagctacaggacaggatgaacactgcatctggctcatatgtgatatgtgcaggagaaacaaacccacacgtatacactgtatgtgtatgcatccttaggttctgaggacaatgtagcgttgaataaaagtctagtgaatttgccacttgtcctgctccaggacagttaccgtcaaactcaacctcactagacttgaatggctacaaccagcttatgctcgcacatttaccaaacagagagaaaacttaaaaa

SEQ ID NO: 2367 - DNA, 366 bp, Rattus norvegicus
  Genbank Accession No. AI178503
acccaaatgataattttcaaaacaagaaaatttgacaatcaaaaaaaaaaaagttcatggcttctaagtgactttttttgttgttttaattcttttttaaatcaaaacgttgatgtactaagataaattaaagcgatactaccacagacaaaaatttgacaatagtcaattattatacaattgttcaaatgaaaggaaaagaagtcaaaggattggaaggtgattctgtctaatctacggtggactgatttctacaagtgttcaaagggtttgtgtagtgcaactgtctgtacttttggtgcatttaaaaaggctagggtgagaagaaactgtcctgcacagcgctggaggaagagaacgcagccc

SEQ ID NO: 2368 - DNA, 616 bp, Rattus norvegicus
  Genbank Accession No. AI178504
cactgcaaagttacaaatttattggtctggaaataaatacaaacatctcattaagaaactgtcctggaaagacataatacaatgatttcttgtcagcattcagtcactctagcctggatccctgatctttctacacaaggtcagtggaaggctccatagtaggagttggcaggtaaactgattccttttctctcatgccacctacatggtgtgactacattcctctagcaactccaagatcctgggactcaccaagccttgagggctgactcccaacagtcaagtgtctctgatctgatcacatttcctataggaaaattccaaggttagccacagtaagaatcgaaagacagtagtatagggcatgggcattaggctggcattgcttagagaggccaatgctgcaaacccagtcagcaggaggggcaggaaagggaagcaagttcccacggaatgtacagaatccaaaaaccagtcattcccccagcagtacacatggttctctctgaagaaccagcaaggggccaggtgagagacattcagttatcaagtttaaagtcaatgctacatatcaataatgggagacaaggtgtgactcattctcacaagattcccc

SEQ ID NO: 2369 - DNA, 490 bp, Rattus norvegicus
  Genbank Accession No. AI178516
aatgtaagcaaagatttactaatttttggcatgctggtacacacagcactgggcaggaaatggctaacttgttgacaagttacttcattcttttcctctttttcagaagtgcatctcgcagtgctagctgcttctcccggaaggagcgtgatgtttttgaccggacattctggctataccgcatcatcatgaagttcttctgctttttcttctctttatttgtggaactggaaaatggatttattttggttttcttcctcacaaactcctttcggtctgtccttccagccatagcggttgctagtctcgtctccttgtcggacttgggctttttatgaaggcgttcaatgtcccgaagagacagcaactcccccctggactcctcgtcactgtccatgtccaagtatttccttttctgggctttccccggggcagcgtccatttccttcttcatctgggccatgcggattttctggaagtccctcgtgcc

SEQ ID NO: 2370 - DNA, 480 bp, Rattus norvegicus
  Genbank Accession No. AI178530
aaaagtacataccgatttattgaacttgagagtaacagcatagaatactttccccagaacaggagtagattcaagcacgtgtctcaagaacactgttttgagtccgtgggttttcattagaaatggaaagagttcattcaaagggcagacctatcgtctagtgattgtaggaatggtttcctacgtttgctagaagaggttctacaaccttacgacgatccactggagtctatgtactttcttggttgtagggctctggagttaaattattgtggctgatggtccctcttttctggcctttcttctgcattacttctccctcggacacatggtctccacaaattcatatgggagttgaagggcaggggacaccatctttgggtggtactacttctgggtggtggggttaaaagtccctgtgacccctgaaggctatactatgttaggttcatcactattttgagttcttacatgtgtttt

SEQ ID NO: 2371 - DNA, 459 bp, Rattus norvegicus
  Genbank Accession No. AI178566
ctttattaacatgcacagtaagtagtgaggaggctggtagggacacccaggaacacggctgtccctcccagctagcacaagaactctgggaggggaacagtggcactaatgccataggaaggggtacttcagtaccttccagagacagggcagcccgggctcctcagctgacccaggagccctccttacaagacagccaaagaaaagagactctctccttcctgcgtcaccggcaagtcaccttgagagggttctgtcacatcagagttgggtctggggaatgggcaggtactgcctactctggtttccgtcctctgagctctctgggatgggcacagacacaggatcctgggagtgcatgtacagtttcccgcagcagggtggctccatctgagaaggggcctgcgggccctggaggctctcacccagggcagagacaaggccacaatgtcaaagtcc

SEQ ID NO: 2372 - DNA, 574 bp, Rattus norvegicus
  Genbank Accession No. AI178573
  misc_feature (1)..(574): n = a or c or g or t
actcagacacggatttaataattgtagaaatccaaagaataagcatcaaatctcgaagtcagagtgaactcttgcctgcgggttggcttgactacgcccagccactgagctgcctcaaccagccagggatctatgaggctgacttctgttttcatgatgtcaccatatgtagtatgtattttgtctcaataaagcatttgtaccgatggctctggaggcagcggtgctgaggatgagctcactgctgggagtcggtctggaggacccactggagtgaaagctgggttgtgccttggactagcttgaacactgtaggcaagtaagtcatggacggcaccttctgcctcaaagtgttacactggaccaatggcagtgaacatgtgttcatagccagacattttggacattgctaaaatgcttgactgtctgagatctttaaggaaatgtattactttaccctnccagcttaggctgaatttacccaagtattcctagtcccctagtcccagtaacacactgccctccaatccgtcctggttacccagggaggaatgaaagaaagggtttgtgacat

SEQ ID NO: 2373 - DNA, 501 bp, Rattus norvegicus
  Genbank Accession No. AI178635
aaaggagtgaatgttttattctttagtgtttaatagaatacataacaagtcacacaatcaatgattcatttcttcacacacagcagggaaaccggcagagtgtttccatgacacaactggttgtgagtagaaggaacggaacagcatttggatggatgaagacaatttcaaaagtgtgagcacctctgaaaagatttcacccatgtgtttttgtttccttgctgatatggaggggcttttattcttgggtctatgtttcactagaaaagtgggatattaggatatttttccacgtccccttagatttctaagaaagagctcaaagatatgtatcacctagcaagtgacgtttttcaacatgtcggaatccaaataattactacaaagagcaagttttcaaatacccagaaaatttaatttacatgttcaaaatgtatgcccgtgatggatgtttcaatcctgtgtcatcaaatggatactaaactggtcgtaatgaaagac

SEQ ID NO: 2374 - DNA, 571 bp, Rattus norvegicus
  Genbank Accession No. AI178665
aatatctttaattaccattattgcaccaatacagcatacgcttatatacatatatcttcaacttcattttcaattttcagcaattcaaatacataatatattatcatcttaagaatacaaagaacacaaaatggaggaagattgagaaaataggtttcccaacagtcactagtgattctatactttcttcttagtgtttttattggaacttaaacgtcctgccatggctctgcaacaagagagctgcctgggaatgggaagaggcgatgggaaaaatggacccgaagttagaaaaagctacgaagaacattgagaaacaatatatctgaaaggactctctgcagccagtgtgctacccaaacaggtacctgcaggagtgtgagtcctcccactcctccctcaaactgcccgaccaacaggagacagtacccaccgacctcagaggacgctcttcacagcactgtaaaaggaatggcggccagagactggagagtgatggggcggtaacttcctttaagatatcctagctggtatcaacgtctagtgcaaagcctaactgtcataggtaaag

SEQ ID NO: 2375 - DNA, 443 bp, Rattus norvegicus
  Genbank Accession No. AI178672
gctctggattatgtggcttttgttcaattatgagaacagattttaacggatggtggatttttggctagcttaatggatgatataggaaagtggaaagtagaaaacaccaggaaacatacattcagagctagatatgtttgttcaagaaacctaaactgtctaatccattaaacacaatctcctcaaaaagcaatgaagactctactaactgatacacagggtttcctcattcaaataaaatagacagaccaactaacctagcagctagctgaaatcaagtggaacataaacatctactattggaccataacgaccaaattcccgacgtaaatcttcagacctggtgtcgtccgccacgtttctgacgaacagagacgtgttgggggggcgcaggtatcgggacatgacggcggcggggctcttggccagcggcgctaacgggc

SEQ ID NO: 2376 - DNA, 527 bp, Rattus norvegicus
  Genbank Accession No. AI178687
aaactattaaaagtatttatttaaaaatgaaaaaactcaaatatcaaatagagtgcaaattcttaataaaaattatcatctattaaaaatcatagtatattaaaattatacacagaattcttagatacagaatatatataagtagccaaagtcctgggacgtttatgcagaacagtctacaattagcgactggagcatttcagtaactctgcggtctcttcaaacatttttttcatcctttccattttctgcatagttgtttcctctgaaaaattgttcaagccacagtaattaatagtggagctcctgggcactgttgccgacgatactgtactgtagccagatgagtgacaggtactggccggcccctcaacactgtattttttatcatagggcacaacatccacaccactaactgactcagagtcttcacttgttgtgttaggctctacagattcattctttttagacagaagcatctctgtttcgagaagagtcactcgacttagaatattattccaggcctt

SEQ ID NO: 2377 - DNA, 513 bp, Rattus norvegicus
  Genbank Accession No. AI178688
  misc_feature (1)..(513): n = a or c or g or t
gcctgaggacggccatttatttccaagacatagactgtacttttacgacagggctttcagaagcagggatcttagttatagcctagagaggtgtcaagaacacagtggaggagccatgcagacgtgggggctttatccaacactgttacaacactttttaaaatgagcaaaacatctttaaaaatccttataaattctttatatgttacacattagagacaatatttacagtgaaagggaggggagagactttacagcaaatctttgcataaaccagaaagatggacagacctgggcagtagggcaggtcaccccactggggctcccctggaatgagtgagggcagaggggcgactagtgctttaggtttatttacactgtggggaaagaggagctgggtcccacccaccctgctggaacagcctggctaagaccctatccatcagtgccggacagacttcttcccgattgaaagtgagagccggcatgctaaactggcaagaagcanggtga

SEQ ID NO: 2378 - DNA, 560 bp, Rattus norvegicus
  Genbank Accession No. AI178689
ctttatagaaatatagagaaaaaaatacaattgattcagagatttctcccctccctaaaggacggatggacaaacagttggagctcctagaggtgacaagggtgttccctgtctatctcctcctctaggagcaaggcatctagctccttcagtcgttcttgcagtagagatcccacatcctggctgggtgccagattgggagtaagggttctgctggctgcagttcggacccctcgtgatggtcgccgggatcgaggaaggctactgtcccgaaactctactgcccttcggagcttcctagagctggtaaaaatcagagttccattgcgctcctgtggttcctcaaagatggtctcaaaggtccttctggctgtgggtgattggtaattcttattggtataaatttcttccaatgtgaactccttcttattcaacctgattggtcgaggcagccccattggtgtaaggtttggttgtagacggacaggtgtcctccgtattctgaatctagaaacctttcccagggtcttcttctctggatcagaaaccaccttgtcttt

SEQ ID NO: 2379 - DNA, 257 bp, Rattus norvegicus
  Genbank Accession No. AI178731
gttctatttatatttattgctgctaatttggctggctgttactccttatttacattcaactcctttgcccaaactagaagttatggaagttgcggtagtagatcagaagcatgcaggtagccctacctgtgatgggcacagtttgggtcacacgggaaggtggagctatttcattggaaaccctaggcccttctagcttcttcaagaagagtaccactggtgtcctgggtagcaggcagctggagagcaaatattta

SEQ ID NO: 2380 - DNA, 487 bp, Rattus norvegicus
  Genbank Accession No. AI178734
caagtgaagtaaattcaatttttattcttctttacaatacatggatatgtggataaatttttcttttaagagcttgcaaccctgaggcaatgctgtgggcacataatggataaagcaacagtgaatggaatctgaatgtggtaaggacatggacttggaaaacataattgaacatcgtgaaattgcagtctatgctttctctggtctcttaacccagctatctctcagccatctcgcacactagacatcctgactctacgtacacttttgtcatatataatggcttccttctgactgaaatgtaataagttaacaggatttgtatctaaggggtctttatctggggtgtgtattgccagaagtgtgcccaattttggaccacataaaaactttggccccaaaggaagctggctgccatctggctgtggtaaccgtgaggtttccgagggtcccctgggagcccccacaggataatttttcatccggg

SEQ ID NO: 2381 - DNA, 563 bp, Rattus norvegicus
  Genbank Accession No. AI178740
aggatcgctattttattgttgccctttccgttacatgaatgcacacatcaggtgttaaaggtacaatacattctacaactgagcaccactttctgtaactcaacaggcaaaggatcacactgaacatcagcatctggcagtatttttgggaaaaaaaaagtgactaaaatgggtttaaattgattaacactattaaatcacatctaatatttgatactacatgattcaatacagctatacgatacaattatacaaaatgtgttaacatcaaagaatacaaccaaaattaagatagcaaacaaaacctatataacttttttttgtacaggaaaaatacttttgaagtatgcatgtaactgcccattcttttaaagaaaatctaccgcaagcaagtcgtcaccctccagaaagtcacacagcattactaagcatatccccaaaaagtgtacaatatgcacacttggaaaatacaaaattaaaaaaattgtaagcaacaggtgagcttcgtatttataagaatgtgaaaagaagtcccatttttagcactgttgtataaagaattg

SEQ ID NO: 2382 - DNA, 542 bp, Rattus norvegicus
  Genbank Accession No. AI178746
aaaaatagagtgtctttattggtacctgtcagctcaggtacaatgtgttctcacaagcacacaggctggcaaggcctcctgggcaaggaggcaggcccagagcctgcgtttcttggcacacacacacacagagaaatgaataaattatagttctgacacttagagacaatataaaaatgcatataaaatccaacatcagctaatgaagggcataaaagcccccaagagccacctctttcttgccaactggccggggggtgtgtggtgggtcaggatggattcagtgcccagaaaggctagagacagtgatctggggtgtgcttcatgtcttagggcctctggctccccatcctacatagggcctttataacccatggccttggggagagggaaatggacagagggcatgttagagcgtctgggcagggggcagagggagttttgatcaccgatggtcaagcacagcctccgtctgctcagctcgaacctacacgccacaccgaagcccagaccggcgggggacaccgaagactttgcctcaa

SEQ ID NO: 2383 - DNA, 658 bp, Rattus norvegicus
  Genbank Accession No. AI178752
gatgattaaatatatttataagattaaactctgtgtctgtgtatgacaatctgacacgttcgagggactgacgtccatccacagactgcctggggcatttgagaacaaggctcacccttttattgactgcacatgcctgtcagggaggagctacaggctgctatgacccatcaccaaagaggatttggggctgtgaccatacccgtaagtggtaccttctggcgggtaccatgtgtggcttgcctggctgtcctggaacacagcagtccacacacttcaggtcctaggcaaccaagtgaagtctttccccttaggcggctggtccagtggggacaactcagcttcccgtaggccctgcagggagtcgccagggtgctttggagtgacagggctgcactgccccaatccagggcacacctactctggggcttgtcccttcccactggagtcattggtgggtggcaggtgtctcttggcctgccagctgctggcccccagctctggccccggtttcatctcagggcgaaactgtagacgtgatagatctcatctggcaggttctcctggcgctcctcagccaggaggctgaggcctgcactgcggatgatccggcggaccacctcgaggtcacggcacacactgctgtccacatcgtcca

SEQ ID NO: 2384 - DNA, 552 bp, Rattus norvegicus
  Genbank Accession No. AI178762
tgttttgtttttttatatataaaaataacaagttttcctccaatccttgctctgggaagacatgctatgctcaccatgtcattttaagtatgttccctccacccctggtcctgttggacatgtgccatggccatagggttcctgaacagaaaatgctgaggactgaggaaagccagcaggaccaggcaggcggacaggctgccccagcagggggtgaggatggctgtcaatcttgcccagtgacttggtgattgctggagtctggacccttacccccttcacaacccacgagggtgctgccttcactgatggaggtacgcatccagccagatgtcaccagacttcttcagggacccgatgatatccaccagggcggtgaggaagggcttcacttcgtagtgtagaccatgcttggcacagaatgccttgaccaggggggccaccctccggtagttgtgccttggcatcgtgggaaagaggtggtgttcaatctggaagttgaggtgcccactgaacccctcgtgccgaattcttggcctcgagggccaaatt

SEQ ID NO: 2385 - DNA, 562 bp, Rattus norvegicus
  Genbank Accession No. AI178768
ttatttttatgaaaaaggcaaacaatatatacatgaaacaaaagataaaaacaaaattcatagggcaaacttaactttgacctcctaaaaagttgtaaaatgcagcaaaatgtcctttttaatatgaattaccttagtaactctgggccaattaaacacacacgagaacacacaattttcagtccttctctttacttatcaagtcttcctgtgtttgaggaatgcaacattgggggctacgtaagagtaggaggtacaagctgttcagatgtgcactgaaggatgtacttagtgactgataggactcaagacttttacaaaaacggtaaagccaaaaagtctctggattctaacttactctcactgtgccatcactagctgcttttggtgagcttcttgactactacacgaaccatcacctaagtaatctttaggctcctcaagtgctctaagatcactatcactgaagttgagcaggcagcagaattaaaggctgccggggctcatgccttgtcccacttccctgaggactggactaagagggcagactaccttgctgaca

SEQ ID NO: 2386 - DNA, 664 bp, Rattus norvegicus
  Genbank Accession No. AI178804
acaccattaggggcctttattaagggtaggtgctgggaggtgaccctgccctctggtggtcattgctggaactgtctgccaaacacagcctgccctggaggacttgtcctcacagagaaccgagtgaccataaggcagagtcaagacagagaagagactctggctgaaagagcttggaccacggggtgtctctcctccaaggcaccagcacatagcacagagggtggaaagccaccaagagcagcactggggctcagagacgtaggggacagttaggtgacaccaggaacgtgcctggagaggggcacattggacatgagaaaggatgcaggaaggcagatgaacaggagtggataccaggccagtggtgagtgtgtcagtgggggggcgtcagtgggggggcgtcagtggggggggcatcagtggggggggcgtcagtgggggggcgtcagtggaggagtggggggatgagtgtggcataggcaaggctggcctcctcattggagggcagttttagacccagatgacaccagtctggtttcaggtggtggctgcagcttgatggagccccccaggcaacaggaggctttctttacaaggctgttttcttgtctctctcatcgtctgagaactcctcctccaggtccaagccttcattgctctg

SEQ ID NO: 2387 - DNA, 672 bp, Rattus norvegicus
  Genbank Accession No. AI178808
attggttaaaaactttatttcttattgatttggcaacagttgaatggtaggtagaaaaagggagggagaatcctgtaaaagaagagggccgtgctggatgtggtggtgcttgccaagaacgccgacacttgagaagaagaagtgggatgatcgcctctgagttataggccaatctggcctacgtagtaagttcccagccaccccggactacagggtaagactctctcaaaaaaaaagtgaaaaagtactagactaggcacgggagggcttgtgcagggaaagggggcaaggggcattctcaagtagggcgtatggaatggaaaagcagttacatgggacatgaaattgaaaattagccatagcgggaggcaataagcattggatccaggttggcaaaatgtgtagggggaggttagcatcacttagggctataggactttgaggttccatcaagggattggaggctcaggcttcaggcttcagagaataacatgggggaggccagtaagggctatgaaggctgcaaggagagcctccaggcccctctcctaaggctcctcctttcgggggaatctcactgacgtggcagaaccgttcactgtagtctggctgcagactctcagtcagccctttagacacaccactccaggccgaaaagttcccatggtattc

SEQ ID NO: 2388 - DNA, 380 bp, Rattus norvegicus
  Genbank Accession No. AI178850
cactgcaaattgtttattaaaacacaaagcaatggacagtgaaaacatcctgacttcttactttttggtgggagtgggtggggcatggaagggatagagacggatggagacagcccagaaggagcgacagctctacctacccctgctgctttcctggccagccaggttcaaggtccctcactacaccttgccacgctgctgtagatgcatggcgtggccgagtcaggctggcctcgcagggagagatggaaagaataaagcgctacaaaggctaaggacttgacgcctgctctccagaactggattccacacaaagcagccaagttcatactgagggacaagccaggctgggccaacagtggttgaagaggctaccctga

SEQ ID NO: 2389 - DNA, 477 bp, Rattus norvegicus
  Genbank Accession No. AI178884
agttgaagatacagtcttcatgttctccacactctgagatcagaacagtgtcaatctgagcaaagtcaataatccaagaagctcttacagctcagccttaccttgtgccaacaattcgtgagttctaagttttgttgaaggtttttacagtttcaaccagacacattccaatattcttggtcatggggaatcctatattataatcagatcattggtataaaatgtaaatggtattaaagccatgatctgagggaacaatacatccgctcagcacatattcgttctatatagtttgagaaacacttaaatacatagagagcgtgcactgctttacagatgctatgaacaatgttggtagcctgggtaacagagtccggaagcgtgcactgtaagagacaatgtgagcaacgttggtggcctgtgtgacagagtccagcgtccttcaagaaactgaagacactcaaaagttgatcccca

SEQ ID NO: 2390 - DNA, 540 bp, Rattus norvegicus
  Genbank Accession No. AI178901
aaagatcccgttttcttttatttaaacaaaaaaaaaaagtttctttttaaataaaatttaagaacccccttccaagcaccggtgtcggcccccggttgaccgccaccaccctccggccccttttacaacatcacccccccttccctccactcaaaacacagcttgggggcacttagggggagggaaggaggaaggaactaactgtctgaggctatggcatttcaaaggcactgttctaaaacatatcaacgggtccttgttcccaacaggagatagtcgaaccaggtacccttcaacgcacaaaatctggacaaggggggtggggagggaagagaaggaggaaaaaaaataacaaaataaaaaatagtaaaactccagaaccttcaatatgaaggcagatgagggaaggagcatttacaagggaaaatgattgcctttgggggggacagcaagttgggacatcagaatccaatggttacatcaccgagtcctgaaagccccgtcctgccttctgggacggcattttccacccccaagttg

SEQ ID NO: 2391 - DNA, 667 bp, Rattus norvegicus
  Genbank Accession No. AI178902
acaaaatatattttattttgacagcaatgcacacgatgctgtaggtgaggcatgcgactaggaatccgcatcacaggccagtgcagaaatcagtggaaataaatattgttcttaagtcttgaagcttcattcaaggtgaagacagagttgtgtcactcaactgggacgcagtattatacttccactgctccagacagccatgccgctgaccaagagtgcagagctatggtgatgactcttgttccgcagttcatgaatccgactctgatgctaaggtgacagtgtatgtaaggagatttttgttttcagtgaaggagacctgggaaaagatgggtttatcttttttcttcaagagttatcagatggtacatgctcctcaaagccttcactctctcgaactagtgcacgttccaggatcacacggccttccttataacgctggctgtcttcagtagcaaactcatagatccatcccagtttgctattgcagtttttgcagctcacatctcgaaccatgtggcggccagtgagcatgacccgatcttgaacttcactgtactgcaagttaactaccttgttaaaaagaaatgctctaccagtggcgcctgtgaaccgagtagagatgagttctgagcgattggtcaggattgtatcacagtttgcacaa

SEQ ID NO: 2392 - DNA, 712 bp, Rattus norvegicus
  Genbank Accession No. AI178912
aaggacaatttactctttattgattaaaaatgaaaaaaaaaaacatgcagtaaaatacaagtcaagagaagagggagaaggtaatattttacatctttcaccacccagcaaacctcccaaggaggaactgacattcctggttcattcttgtgttagccttcaggttacgtatcagtctcagctggctctaggatttggttgaaaacagaagggaaaacacaaaaaacaagaaccaacccaaatgatgcctttatcatttagaaagactatttcacacattctcttggctatattggcacacactatcttgtgctatagtcagtccctactccagggacacgggcatcttgaggacttaatggcagagtcccctggaagctctgctctagctccctggcttctgagctgtcccatctctgcagtttccgccgctgactggttctctcgccatcactgcataagccagcagaaggaagtcaccacacatcacggagaagtaacattgtcctgggtcttagtgccgacctcctccttgccaaaaaagcaaaccatgaacagaaaaagagccccaggccacttttactgtcatgtctgtcccctcacagcaaggcaaaggtgatgatggtctagagaacaagagatatgctgctgcttacttccaacctggcactggagcaacccctaagtcgaaagccagaacagtgatatccat

SEQ ID NO: 2393 - DNA, 692 bp, Rattus norvegicus
  Genbank Accession No. AI178929
tttttatttttttttaaaacaagtttatttattgaaagaatctgaaaatagtaataaggccttcattaacaattaacaaaattttaagatattaacaatatgaaacattaagaatttacgtgaaaattccatgtgtttgagatcagtctggtggcagctgcttctgtacttgtcaacactcgctttttagatgcatggactatgcttcagaccttgctctcctctggatcatagcagagcctgctgtgcgcagtcacagatgaacagcacaggtgaaccgtggggatgagccaccatggcttaacagcactcaagccagaccactgtgtaagggaggagtggcagcacagagccctgtcctggatacaatgtaatcctggatacaatgtaaacaccagacaacaggcagtcccctctaaatcttcacaaagtgtgtacaagaaaatatgtacataatcacttcagaaagtttaaaataacctctaaaaagtgtatataggatttaaaatgtccccaggagctgctgccctgatgtgtgaggaatgtgaggttgctggatggctgtgccaagtgttacctctgtctgctctggaaggagtcagaggtcttggggccagactcagagggaaccgagccatctccagaaatacaggaagcaagcttgccttgccaacccagagcaaagctgccaa

SEQ ID NO: 2394 - DNA, 520 bp, Rattus norvegicus
  Genbank Accession No. AI178951
acggataagttgtgtaactttgttaaactctatttatttcctcatttggaaaatggagatgataacatgtactttataaaactgctcaagatgagataggtacattgttttcctgtcatgtctgttcagactacttctatagtttgccactattagcccgcatgtcacctcaatgctaactggtcttaacaaatgcatcaagacagctggtgctaacagaacacatcaattccgaacattaagaattgtaaaagaaaaacaaactaaaagacagccctacccttttttaattttagtatactggctttttaaaaaatataaaaacaacatctatactatcccatcggaaattccaatttcacttaaagtgtttttttcttaaacctactcacaatgaatacctacgaatgtgaaaaccccaagattacacgtgcaattactttgcagtttccccctttgcataatataagtaaaatacataatatgggcagttaaatacttttctcccaagcatcaggga

SEQ ID NO: 2395 - DNA, 570 bp, Rattus norvegicus
  Genbank Accession No. AI178968
  misc_feature (1)..(570): n = a or c or g or t
aaactgcacagcgacatttattgttccagcctngaaaaaacatccctttgaaatttcacacagcaaagcaagttaaaaacttcactcatcaaataaatgataatttaaacaagaacttgctaaagaaacctcatcacaacaatgctttagggcctgatcacttaagtccacagggccattatgaatttaaatctgcaagccgttttcctacaacaagagggaggaacatgtttccttgactcaggtgacacagaaaagaaatcatgatttttttcttttgctgtaacaggcagacattgatttcttgttgtgatcaggaaagatggaatgactgttggccttctcttgctgctatcaacagtttgtcacgcattatctcaatgctcgagtagtccggtaacttaagatagttcacacaagtcattacagatggtaagaagtcatctgggttttctgttgattcaaatgtcttccgcacaatcgtcagaggtggatttaaactccgaaatcctccgactggcaatcgtgggctaccagtcacaaactggagaaacaacctctcctcgtgcc

SEQ ID NO: 2396 - DNA, 556 bp, Rattus norvegicus
  Genbank Accession No. AI179039
cttaaaaaaaaaaagtttatttagaaagtataaaccaattgtaccacttttgagttttcttttaatacaagactcatgatgcaaagctgacgccactgtgagcttggccaatagagctgcttttcacggacagctatggcccacacatggttaataacaaacgttcataatggttggcaggcgcctctgcgcctgatgcttaggaagcagacgtagtcttgtttcgagcctccttgccacacattttgtgccaggtgttgacttcaccctgcttatggggaggtgggtgaagggctgggcacaaacatacggtttggaggacaagacagacaggggcatggcgcgggctgcatctgcagggttaagagcagcagtgtctgataaccaggacggcaggaacggaaccggaaggagctgtgtgacatccaaccttagacgtcctgccgactgcagtctttggtcttgaggtcaaatgaatcccactgctcatactttattagaaagatggtcagcctccttgatggtggagattatagagcaagccgctaagaggact

SEQ ID NO: 2397 - DNA, 552 bp, Rattus norvegicus
  Genbank Accession No. AI179049
ttttttttcctccaaatttactttataattgggtggatataaattaatgaacagaaattaagcaagagatacgtgaccatttaacagaacctgataatctaatttcagtattttccaagttcatctttaagtatttccatcatgggatccactgggaaactaagcaaggttatgaacactgaacagttaatcgactgaatgtcaattaactatttatgacaatttcttccataacgcaattatgagggccttcaagaagcttttgtatgtaaaaacgtgttagtcaagtactcaacacaatataaaagaacatcatttcatttgtaaggtggagtgcttctgttcatcatttttaactacaatgtcactgagtagaaggaacaaattacctcgagaacataaggaaaaataaacacatgctaaatggataaacattacatctttactagaccatttctacctctaatccttcagacgtgtagagatttagagtgttcttacattaattgcaagataaaggagaagttcctttgagatcacaactataaagtc

SEQ ID NO: 2398 - DNA, 387 bp, Rattus norvegicus
  Genbank Accession No. AI179066
caggatgaagctgtttccagggcaagcacatttacttaactgacattttgagggagcagagcaaatgacaatgggaatatgcagtatcagaacttgagaccagtctgaagaactacaattctgggtgtagacataaaacttggggtgaaacatgggattgggcaggggtgaaggctttaatactagatgaagatcttggggttcagtgtgaaggcaaagactatcctggaaagaggagtccgagtgagcggagccgaggcacgtgtgcaggccataagggaggctggggagagcagtgacaaagctgtgtgccatcgtggacctggggtggagggcacatcttccacctgggcccttctacctaacttcccagctccaccttgtgcc

SEQ ID NO: 2399 - DNA, 447 bp, Rattus norvegicus
  Genbank Accession No. AI179089
ttttttttgagaattctgccttctctttatttgtttactaatcaaagttttatgaagcccaggctttccagagccaccatgtggactggaattcagggttcaagatcataaatgcagactgccttagacactcaaaacgctcaaagtcaggagacgtaagaaatgaaaaggagactggtccttattgtacaagaggctgaagggtacccggcgaggaaagggtggtgctgctgggaaaagggcattttctttgaaaagctccctgggatccatgccctggtgccctgtgagcagcttcctcttggactccctgcacacttggggacaagtgtatcgcatcgaggtgcaaaaggtctgaaggcggatctttgaacacggggaagtcacaacagttcccggccgttggctgtcttgttaactttggacaggccttcccggaacccatag

SEQ ID NO: 2400 - DNA, 443 bp, Rattus norvegicus
  Genbank Accession No. AI179092
agagtaaaatgatttttatttgctcaacaagtctgattttaggtttctttagcatatttccattttattaaaagcaaaggccaattagtcctcagactctgaaccatcttcatcttgactaatttggaagtaacgaagttcgtaagtctccttgtcagatgcgaccacacgaagccaatcacggagattattcttcttaaggtatttcttggtaagatatttcaaatacctttttgagaactgtttctcagaaacaactgtgattttattcttcaggcgttcaatgtgaacaacatttccaagatttccagtttttccattgactttaaccttctcccgtagaaactgttcaaaatttccagaatcaaaaattccatcttctactggatgagtaaggtccaaatgaaacctccaggttgacttcttaggcttctcctcgtgcc

SEQ ID NO: 2401 - DNA, 467 bp, Rattus norvegicus
  Genbank Accession No. AI179099
ggaccatttaaaagagaaatttattgcctcaatattctgggggcctggaagttcaacatgttagcaggttgctttctcctgaggcccctttccttgttgtagacggccatctttctctgtgttcacatggtcttcacttgattctcacctttgtcctgatttcttctgaggatagcagtcatatcagattaaagcccatgctaaggatgtcacttaggtatttatttcccaagacaccaagacagtcacgttctgaggttgtgggaactgggacttgaactgaagaactaaagctacaggatttgcctcttaagagaatggaaatgtatttattgagataatatacttaatagcccaaatgaacaaacttactgaaaattttaaccataaccgagtaagatgtataatagattcaaatgtcttataaatatatattatgatattttgaagtgccttttcctcgtacc

SEQ ID NO: 2402 - DNA, 429 bp, Rattus norvegicus
  Genbank Accession No. AI179100
gttatggaatttcttattaataccttaaaaaatttaaaaacataaaaaaaccccaaaatcaaaaaacaaaaaccctctcaaatgcttaagatgctgaacctagagaaggagctaaggatgcagccaaaaggaaatgatttaaggacagagggtgaataaagagagcaaaggtggaagaccatgatgtttcaaagctggcaaggttggcctcaatttcttttcttctgtctggatactggttctgcttctaggtaccggagcccaactagcatacccaggattgagaaacttgctaccatcaagggtgccagcacaccaactgtgggagccgctgttccaaatacaaacaactccgagaggaagtgtcccagggcaaggaggaatgtccacagtgtgatgtgataaagtgttttgttgtggatgtcaatg

SEQ ID NO: 2403 - DNA, 539 bp, Rattus norvegicus
  Genbank Accession No. AI179123
gatggtccagcctggtacacaggtaggctgaagagtgtattttatcactgacagaaggacctagctgcacacaactatcaggttggtgttgtagacagtaaatctgacaggagcttaaggtgccaagatgtcacttgtcaggtctataccactggcaggttctgtgaggcactacatctttatccagttgctttaaagttctccgtctcctttaatcagtcacggtcctgtaaatttcctgcttttctcggagcaatcgggccttatctcgctgcaagtcctccacatcacgttctaggttcaggatggtgtccaacttgcgcatgcggcagttctgtgcagccatcttgtttttgccccggcgccggatatccctgatgaggctcagctgggcctcgctcaactggtatttggacagcagctcattgaattcttctacaggcaggttgatgattttgtcattggtaaatgggatcttcatggctcgggctctgtgctcatctctgctcatctgcttgtccaagaagtcagcctgcttt

SEQ ID NO: 2404 - DNA, 618 bp, Rattus norvegicus
  Genbank Accession No. AI179125
tttttttttttgaacaaccaagtaactttttattattggttataaagccattacagcactaagagcacagtgcgcctctccactttgcagtacagaaacacattttccaagagtcactctggtggagtctcaacagtctgtcttctttgcaggaagcttccttttcttagttactgtattcttgaagagcctgagccatgaagagtttgcctaagttttgggcagtgaactccttgatgttctggcagtaagtgttaatctggcctgcaatgagcagcgagtccatcctggcaggggcttggtggggcttgaagagtttggagaggtcctcctcagggagcgggggctcgcctcgactctgccgctgcatattctcctgctggcgacgctgctgatactggtgtttctgctgttgctgcttactgctgttcctcatgtatgtgttgtatttgattatgtcctgactcatttcatccacccggtccatcagcaactgcagattcttccccaagtgattgctgctagcaagactgagcaattcatgcttatcagccacagcggacttcttctcaagctcccacatcaggacattggtcaaatgtgagtttttaattacaa

SEQ ID NO: 2405 - DNA, 632 bp, Rattus norvegicus
  Genbank Accession No. AI179144
acaactttattggcaaaaaggggagaacttcaaacatctttcatacagggcgctgtagctgaccctgttggattgaacaagtcccagtctcatgtccacgtacaatactgaacctgcatatgcagtttcccattctcatgtccacgtacaatactgaacctgcatatgcagtttcctttatcaagtacagtgctcacttttcaggtcgtctctaaaacataaatacaaaggaaaggaagccactcattaaaaactgcatcaaacacaagtattttaagtgtgaatttgttgttcctggaaattacacatgcccaaagaaaacaaaagctggaaaagcggttacacttcctacatgagtggacagttacaacaacaatcgtcttctgtaatgagcatttttaatttatcaccaactactctgaacttactaagagctgtagtcagagtcagaagagaagacgcagggagagtattccttttggaggacagagtccctccagaatcatcacggggaaataaacatcctgttgattccgggtggcaaaacaattaacgttgtcaatctcagttcatgttgatcgtactgagccgacctaaatttcttccttgtcgtcattcttctaaatcaagtg

SEQ ID NO: 2406 - DNA, 465 bp, Rattus norvegicus
  Genbank Accession No. AI179147
cttggaaaggcacagttttattgtggcgtatcagggagggtctcagatcctccccacctccttcagcttggccaccaggtcttccgtggtctctacctttactcctgctaagcgctgagggggctcctccacactgatcacggagaccttggaggtcaggtccacacccaggtctccagccttgatcacttcaatcttcttcttcttggctttcatgatgttgggcagtgtggcatagcgaggctcattgagtcttaagtcagcagtcaccacagctggcagtttcaggcgaatcgtctccagacccccgtcaatttcccgttccacttttaccttgtccccctccagtgtcacctgagaggcgaatgtaccctgcggccagtccagaagtccggctgtcatctgacctgtctggttacagtcatcatcaatagcctgcttgcccaggaacaaaagcctcgtgcc

SEQ ID NO: 2407 - DNA, 261 bp, Rattus norvegicus
  Genbank Accession No. AI179167
tcggtgctcgtgtaaggtttttcttttcccctcaaattttatttcaataaaaggagacttgggcgaggtggattccccatagccggattctccccctccccccgagggtggctaatgctatctggggatgtcttcacagggaagagagaactatgggtgggctcctgcctgaggtctccaccctcagcccagcggacatatcacaggcagcttaaaaaaaaatcctaaaaaaaccaaaacacacatttaaatcctcgtgcc

SEQ ID NO: 2408 - DNA, 531 bp, Rattus norvegicus
  Genbank Accession No. AI179185
tgtgttcctttgtttctcttttaagtgtggaaaatagtgtatttatgcacccaggaaggacagctgccagccctcacagaggagaccactcaaaagcaagctctagcctcagcagagcctctagcaccgttaggatcccctctccatacagaacacaaacaagaccacaaacagaagctcttgccacaactgagatccagtggaagctgggtgcctggtcatttctagagcgcagacagtggcttttattataaagctaaggcgggggtttgggggatgctgagatcttctctgggccctgtgtctttgactcgctatgttgagagccagcagcaagggagagttcatacaggaaattggaggaagtcagtaatgggttcttggggacacacacacacacacacacacacacaacacaggtacgtgcgtgtgcatgtatcacagggcacagttgtgcatttttcttgggcttggtaccttctctacccggcgttctctctgtcagcagcctagtactttgtacctacgatt

SEQ ID NO: 2409 - DNA, 464 bp, Rattus norvegicus
  Genbank Accession No. AI179269
ttattcagaagcaagttacagagacaagagaaaataagctcactgccatcacgttggattacacgccactcgcaataaaaacttgggaagaggtaaataaaaccattccttgatctgctcatttgtaaaggataacacatgtccgtcatatctaatatacagtagtctttctcctccccttcttgaggccagcgttctatcttctaagtgttactccggtttcccaggcacgtgaaacgtggggtggcagagctttgcctaactggtcacacaactgttccaacccctagacagattgcctaactacaaaagaaggttgtcaagtgttcacagtgtttataatgtgacgactactcaaatcgttactaggaaatgtcaaatcaagaaacagcaaagcctagacctactaggtcttactgaggtagttgagggctcaaaaagatcaactgcagttctcatattta

SEQ ID NO: 2410 - DNA, 507 bp, Rattus norvegicus
  Genbank Accession No. AI179289
  misc_feature (1)..(507): n = a or c or g or t
aatatataatatatttatataattatgtttaaatactcataaagaaatagctaacctcattatttgagagagaccacacaaaagaaaggcaaagggtcagtctggagtagatgagcccggaaagatgacagacagtccatctgcgatggggattgactgagtcncttggcagcttaccttctaatactttgatattggtttacatggtangtggggctgagccactgacagcgtgcagagtggggaggagattaagagttgagagaaggacggagttgagtacagatgggggaggggtcttgtccatcaatttctccttcaatttctaatcagttgtccttttacagaaatgtttacctataatccctccctacttggtctacttaatgcattaattggcacctacaaactttctcttgcatttcttaaaggctctgttctagactctccttccaccatgggacctgcattgttcattcaccctttgcatcctgctatgggagcctc

SEQ ID NO: 2411 - DNA, 493 bp, Rattus norvegicus
  Genbank Accession No. AI179300
ctagatttaattactttattaaaccgacatttctgtaatcaacaacaactacttagacagacccactgctgtctgattatgtccataggtcaggggtgttctgcttacgcatttggtgcctcataattaagttcagctaacactagggcctatagtttgctgtcagtgagaccaggtctggtcttgacagtaaagccaccatcaaaagctgcattgagaacttcatccaggcagctcgctgtgacaaaacttagatcctgtttgacgttgcttgggatctcctcgaggtccttttcgttcctctgcggaattatgatatgcttcagtcctgctcggtgtgctgccaggactttgtctttaattccacccaccggaagaacaagtcctctcagtgtaatttccccagtcatggctacatctgagcgcacaagccgcccactgaagagtgaggcgagacaagttactatggtaacaccagcacctcgtgccgaat

SEQ ID NO: 2412 - DNA, 508 bp, Rattus norvegicus
  Genbank Accession No. AI179380
actcagaacgagaaaatttattatcgccaatgctggtgcatcaagagtaacaagcaaatcaggagggagggggaagggaagaaagaggcagagagggagagagggagagaacatgagtatcaagcacccaggtggacttctgggtaggtttaaaatcttccaagtttgacagcataagagctcaaaaatcttttctagatacaggtagggtttccttttacttgacaacttttgcaaacacttcttacaatatgaacgtcagttatactcttaccatctgtcaaggtaaaaaacaaaaatgacaatcacaaaaaaaacccaaaaaaacagcaagcgaaatttccctagtataaaagggtattagaaactttgtctttgggctttcccatacattttatttaatgcacgaacttaaaaccttaaaaagacatccttttttttctttactttataagtcatcacaatagatcagggaccacagtagctttataaatcatgaagatgcatg

SEQ ID NO: 2413 - DNA, 622 bp, Rattus norvegicus
  Genbank Accession No. AI179388
cctggacactttagtctttaattaagcacataaaactgtactacttgatatatttctccatgaactttttgtgaaattcagatcgcagcgtatcgtttacaaatcttttgtctttcttttgatcatctataccctttgcacagttcttaaaaacaacatcatcgtcccaccttcttttaaccttgaagttggcctgaggctgggacgggcccgtgagattcaggagagggtttccactcagaatgttttccatgcgaattctctcttcctctgctttttgttcttgctcctttctggcctgctcttcagctctctccttcttgatcttttctagctctgcaagaagagctgcagtgtcatcgtcatcgctttcctcttcaaaatcctcatcttcctcatctgtgagaggatcgtcagcatcaaggttggcagcaggaatctggtctaagcggggcttcttggacaccgaagaggaagttgtgtgttctcgggttggacggtccctatttttctcccttgcagcagctctctccctctcttccaactctctcctgaagtcacggttgcgaagctcttcaggggcatcctgtgtggtttgtctgtactttatctttgtatgaga

SEQ ID NO: 2414 - DNA, 650 bp, Rattus norvegicus
  Genbank Accession No. AI179391
atggcagttgtttattgagtatatgctcattacagcatcactacacagattacatttctcatgtgatttttttttaattaaaaatatatccaaaagcaaaagagcagctgtacacagactttaaaaggtgaagaaagaaaagacagcatggacaggttcggcacattacacataagagtccaataccttaagcatttggaggtgaggggcaggacgcaatacatttgtgtaagactgtctcatggtttcctctgcatcatggagatgactgaactgcaaatgccgaagaacattaatgctgcactgaattcacactgcagtaatgacttttctatggaagctccttggaaagagtacattttgtcatagatcattttaaacatagttttatatcaatattcaaaggattttgtttacaaactctttgtgaacaaatggttacttttgttttaataccatggccaaataattaggcttcagtttttacatggggaaggtaaccttaccaaggggaagcacggagtcacaggaacacaagcaggttactaccttgactggcaacagtcagacaggacaacagagaaacaatcaatctgggcccgtaaaaatctggacaacgtgaaatcgaatgagggatgtaaagtcttgca

SEQ ID NO: 2415 - DNA, 235 bp, Rattus norvegicus
  Genbank Accession No. AI179397
gtaattcctcttcctcctcctcctcctcttctttttttgttttgttctttttgttttatatggtggtggtggtggtgatttgagacagggtttctctgtgattacagccttggctgtcctggaactcactttgtagaccaggctggccttgaattcatagacatctgcctgcccctctgcctcctgagtgctgggattgggcgtgggtcaccaccccagcagcctgcctcgtgcc

SEQ ID NO: 2416 - DNA, 357 bp, Rattus norvegicus
  Genbank Accession No. AI179407
cagattgtcaagacatttaatatttggagagaaggtgagacagcccggtgttgatctcaggacaggggtttcagagtcctcgaatcacgagagagaaacctggctctgcccagccacagatggaaaggaccatccatcccagccacccttccagactctgtctccagcgccacctcactgagacttagtaccttgggctcattttttccttggctcatctctacatttttccttgcattgatgtcccttctcttcccctgacagttcccagaacgaaagtggtgtcattacggaccagctgacccgggatgaagcatctgtcgtcctattccatggatcaaagaattgcctcgtgcc

SEQ ID NO: 2417 - DNA, 668 bp, Rattus norvegicus
  Genbank Accession No. AI179422
ggttattgaatatgtattttttaactgaaaaaatcattcataaattaacatacagaaatgtacaaacacatgagtgaacaatgtaatgacaaggaccatttctgtgaaaagtgtttttaaaacatctttaggcttcagtgcaaaaatgtccccctggcacctttaaaacaaagagcaagctcagaacaaagacagtaatggtggctaagccagtggcgtcagtgcctcgtcgatggtatgcacagtcagtgtgtgctctgccgctctgaggaaggaactcgatgacaggagtccccattttagcaaaattaaagttttgcaaatcccccctccccaaagaaagcctgtgcggacagagaccttgcacacacagggcagtcagtcaagggcaggtcggcttaagggtcactcgtctgtagcatggagtaatttcagctgccaaagtacaccaaggtcacacttgattctcaatgtcattttctttaagcaatgacctaatgtgtggtccagtggtgtggctctgactgtgacatttcccactcggtatgtgactgggcggacaatgactgacagtgcccacaagagtccacactaataacaaacttggacatgattgcaagggaacataagtgacccgacttgagcagtaaaaagactttctttgtccc

SEQ ID NO: 2418 - DNA, 438 bp, Rattus norvegicus
  Genbank Accession No. AI179445
tagattgttattggtccgtaactggtatgaacagtctctgtgactttggcaaataaccaggagccaagtccatataataaagttgggatacccatgttgatgaccttgagcgcggtgaagaagcggttttgcgcggccaggtcttgccagggcgccttggagcaatggtacttgatgaaggggaagcagccagtgcgcaggacgtggtagttggcgcccggcaccggccaattgaagtgcgaaaggccgaactggtcgttgtggaccgcactgtagggcacgcagaaggaggtccagtgcggcaggcgccgctgcagcaggtgccgcgtcagcacctccgaggcgcggggcttcgcctcgtgccgaattcttggcctcgagggccaaattccctatagtgagtcgtattaaattcgtaatcatgtcatagctgtttcc

SEQ ID NO: 2419 - DNA, 663 bp, Rattus norvegicus
  Genbank Accession No. AI179458
  misc_feature (1)..(663): n = a or c or g or t
aaaggcataagaataaaatagtttattaaaggactggaacatacaaggcatcttttctcaagtacttcaaaacaaaagcaatactagattgtagttagcgtctttttatataaaagatgtgcagaaagaaacatgccttatcagtttctattcactgggtatggctataggtgacctctataaaagtgagccggacatcatcacagagtgtacgtgagttcactcacaccgttcatctctattgctcagctctaaacagtcagaaaaggctagagttagagtctcgagagacaaaagcaaacatttgtttttctaaaactacccttttattaatacatttcaataggttatattccctcaccaaaatcaaaccccttgttaaaggggccacctactttacattgagtctaaagtaacgagactacgagactacggtgtttttcagtgttttgtaatgtttgccacttagggtaaagaactaggaacattgtgattataaatgggcaccacactgtgcagtctcctcagagtgacctctagagtgcataacctggcactgagtgggcgacaggaaagtctacctttactgtctacaaacttaaagatgctaaatggatgctagtttcctgcaaaggcgcatttgtgcaanagtgccctcgtgcc

SEQ ID NO: 2420 - DNA, 567 bp, Rattus norvegicus
  Genbank Accession No. AI179464
aaagaattaacttttatttttgcttagttttattaaaaaaataaatatgtcataaagcttttgtttcctttagggagaaaaaaaggaacaagttccataaaatcaaacaagcaatggtaacatgtctaacttgaaaacgattggggatcactggtttacaagttataactgaatgaatgattgctacagttgcccatttcctcctgccaatggcagcaaacaacaggatcaactggagcaaaataaataactgtgtggaagccctgataagtgcttaaacagaccgattcactgagacatctgtacagctatatcttgctttaaataacaaagaagttcctgtaaagtttgggtaaatgagataaccacaaacatacaaggagagcttggtatctgaaggacttctgtggtttattttatcaacaaccacttttcactttactcaggcttttgctttgcttagaagtacttactactgctctgaattgaggcaacagaacattcacccaacagtgcttttgctgggccagtggcacaatttccaagtctgtgtttctattaaagtaa

SEQ ID NO: 2421 - DNA, 607 bp, Rattus norvegicus
  Genbank Accession No. AI179481
taaatttttgctaaaacacagaagtaagaactgtttttgagggttttttttcttttttaaccccttgggcagtgatggtggggacttggggatcagtgtgggacccagtgatgtttgcacaaccacaggaaagtgctgattgatctgatgggggctcagcgtacttccggatgcttggcgtgaagtccgtgattagaattcaccaggggaagtcacagagagttctagcaaagacaaaaggcgtggtcatcacaagaagccgtggatgtccgcttctaatcctctctcgtctcctcccagggaagccccccgaatcctgaaagtttccgagaattccctgaagtaaagaggctgctcttggggaaaaactgtggcacccacccttgcccaccagcagcttctacttagtcccatcgtattatgtactagaaacatagctcagaagaaaaaggctccaacgtagtgtcttcagcttgcaatcagaagagtagactttcctttatcgcgtgcttcctgcgttgtaatcaagttaataatgtggaatggatttctccttcagaaaggactgactgggacagcgactgaccccgccccagaagactgctac

SEQ ID NO: 2422 - DNA, 490 bp, Rattus norvegicus
  Genbank Accession No. AI179498
  misc_feature (1)..(490): n = a or c or g or t
ggccaaagccatcctcatccagatttatttcctttatgatcattaagactgtcacttaaacaagtagtcaaaaatacataaactctgattttatagactctaaaacattaaggtacaaaaagtaagtaacatctacaattagcagaacatttatgacatataatttcatgtataggaaaacaggtagagaggactacaaataaattataacctgaagacatactataacctgaagacatacatataaaaaaagccttgggttatttattagaatctcccagaaaggtgaatgatgctaggacactatcaacaatgtgagcacaatctgacagcattttcttccacttctaggctgtgctactagcttaagaggcactggacacagccagcttcttcaaatgatccatgaacacctgcaggctgacatcgtctgtcaggatgggcgctccagtttcctgtncccaagcatacaggttattgtgtgtctgag

SEQ ID NO: 2423 - DNA, 511 bp, Rattus norvegicus
  Genbank Accession No. AI179506
  misc_feature (1)..(511): n = a or c or g or t
aacttctttagagcactttatttgattcaatgcacactaaaaatattcacttcttcgacaattacgtcaaatagttttctgaggaggtctacagtttgaactgcttacgttgaattttttaagaggcaaatgatttgccacacatctgctgacacctgaaatgtttctgatgttgaattctactttggtcactttatattctactgtgtccgtacagaagtaggactacaactcttaatccagcggagaggcgcacacagtctagagcacacttgatctgagcatcacaacgaagaggagaaaaataaaccagagcaagtaggtctatctgcttcaggttctgctcctgccatcaggtagtaaataacgttaggtttgttccaattaccattcaagtggggattggctcgtcttcaggatttacttaaaggtctcttctaagtcatttaaagcccccagtcaatgcacgtgntccacttggtggacagatgagtaatctaacccaacgggt

SEQ ID NO: 2424 - DNA, 353 bp, Rattus norvegicus
  Genbank Accession No. AI179510
atgtagggggaaaaagccctaaaaggttggttgagccaataaatataattagggaaacaattattagggctcaggttcgcccttttggagtgtggattaacattatttgtttgatgataagtttgattacccagtgttgaaatgagtgtagccggttgctgattaggcgttttgatgatgggaatagaattgatgggaacataataatggttacaacaattggcagacctattattgtgggggtaatgaaagaggcaaatagattttcgttcattttgattcccaagggtaattcgttttttctgtagctatagttttgggtgagggaggtgcaggaaaggtttgggaaaaaa

SEQ ID NO: 2425 - DNA, 490 bp, Rattus norvegicus
  Genbank Accession No. AI179560
cagtgacgtttacattttatttacgtcagtagcactaaaatacattcctccttgagggtcacatttccacaacacacattaataccaatccacactccataagtgcccacacctcctcccaccaaaaccaagcaaacacagcaaacacttcatggttacttcttcaaaacccaggtaaccctgtcccagctcctagctacagcagtgcccataactcacagaacttcccctttccatgctgctggacccatctcaagctcaccaacaccctttacaaaatcctcactgccaaggggacaaagttcaagcaacagaccctcatggccaaaagaaaggaacacagccccaaagaggcacgtgcagcccagaagtgagatggcatctgaactacctggtgctcagtgcaagccacaggttaggtgacagcgtggcatgggttgggaccggatgaagcttgtgaaggggccattatttgcattttaaagaactg

SEQ ID NO: 2426 - DNA, 472 bp, Rattus norvegicus
  Genbank Accession No. AI179601
ctcagaacggcatatcaacgtatttattcacagccttgttacaagtgtacgtccatctgtggagttttgacacactttaagtcacccatgcctcttaagatccaatttccaaatcatcgaggacatccttaagccactctgtgctcccgcgtgtcgttctggaagttatccgtcagcttcagacacctaccttgtgacttggatgtccgcgccatttccgcccagttgtgcgcctgggcatgcggcggagatctacgtcgcaaacggagctcggcttccacaccgacccacttcacgcggggtccggcgggccgtgctcctcacgcggccaccgagttagggccatcccccgatttcccgggaaggggacgtaggccaaagtctaccgcggacacgctagatagcaggccacagccacctcccaagccccagctaccaggaaacccatactacgcgccgcgtgcctcgtgcc

SEQ ID NO: 2427 - DNA, 613 bp, Rattus norvegicus
  Genbank Accession No. AI179610
attagataatgccatttattatttcacacagaagttagagaccaaggttacaattattaaataccacccacccctcaaaagacagccctacttggttagaataaaaaaacaatcgatacaacaaaaaataccattacactggtagaactggggaaataacaaaaacaagacagaaacacaagacagaaaatctctgcacactgatatcaaagtggccatgacgctgggggaaagcagtcatggtcagtcaacatggacgccgactaccaagggcactgggctcagaacagccgcctctaccgaccacagttctggggctctgttgcaggatttggggctgctggtttccaagttcaggcccctggctgtgcttttggtgagggaaatgtgccaggcatctccttccattccagagagacaaaggaagacacaggaagggggcgaggaaccccaaaagctttcttagaggcccaagaaaagagagccaggcaagattctcccctgcagagagaaggctacatgagacagagttcacagcctctgggggccaacactgcatttacatggcataaattcccactgccacggtcgccaacaggaaactgagtgttga

SEQ ID NO: 2428 - DNA, 568 bp, Rattus norvegicus
  Genbank Accession No. AI179620
aaggcctctctgccctgcccagtaccatgggtcaaatgaggggtgtataaaaatgagggccttgggaagcttccatggcatgggctgtagtcctctcaggtttgaatgtgagacacccacccatcgagacctttacacagggaacttaaatctaaccttgataaataaaaccaaatgtttatttacaccaaagaattccaacactggatctttcacatatgaaggacaaagtattatatatacacacagcaagggatggcagggccattacaagagaactgatagtttcccacaattacaggtctaccatttctggttcactggagatagtggctctgctcctgcctctcaaatacacttacaactgagagcagggcccctcactagatggcatgtgaagaagagggcaaggcaggagggggagaagtacaaagcttaaaatgaacccagtgtggccacatcacccgttagcgcataagaatgctagcatgaaacttatatggacaatatttcttttttaaaaagcaataaattatgcccactaactaactgacttcaaaatggccaa

SEQ ID NO: 2429 - DNA, 574 bp, Rattus norvegicus
  Genbank Accession No. AI179634
acttggactcatggttctggaggcaggaagagctacgattcggagggtgagtgggaagcagcaagtggaagggagaccagcagaccttgccttaaagcaacctattctcagggttgcaagcccggcccagcaagagcagagaggctcctgagtctgagcatcttcttcagcccctgtgcccagctcacacctccccccacctcctcccacagtgcaacaggtgatggagagccacatcctcaaactgttccagggtaccctggggcctgcggacccggagtgaagacagcctgttgggaacccaggcactcagggacaaaccagtcagcccacaactggcttggaaggcagctcctggacagtggtgggaagagccctccccaacaggaaccaataaatctgtgcagaacttgaagggcttctgggtgcctcccagtggggcttcctggaggaagtaaccgccgatacttctcaccctgccttctcacccagcacccgcaggtggtagatgactacacggtcaaaaaagtcggtggtatcctcaaaagtcaacttcagccggtccacctccatg

SEQ ID NO: 2430 - DNA, 581 bp, Rattus norvegicus
  Genbank Accession No. AI179636
aaaggaatgtaagatttttttttaattatctcaatcagaaaagttataggcttattaatttttgaaataaaatattagtgacaattgttcccagataaatactaattgggataacatgaaaagatgaggtttttaaacagaagagaaatttcatgctatacaggtaagctgagacatgtagagcttgccaggctattttaccgaggagtacaacacatacacttctgagcataacccactctgattctgaaggtttctgcatttagcttaaaagatgtttcttcccaagaaactgaacttttctttcaaatgcagttgaccgaataggagaattgggttcataaaagggattcatggcgaacttgatgtatagatcgtagacgtcagtgaagaagttcttgattccatcttcttgcctcacatcgtgaagcatgatgagcctcatgtggccagcagtgacgaaggccgagacaaaccactcattgaacttgtccacagtttttaagtacatattgttggagagccacatgttttcgtcaacgaggtccaaagcagcatgagctatgaactggttcagatga

SEQ ID NO: 2431 - DNA, 513 bp, Rattus norvegicus
  Genbank Accession No. AI179697
aaggcacttaaacaggtatatcatattttttctgtaaaaaaataaaataggcatgaaagcaacattcacaaggacggggcctcgggatccctgtatgtacaaccctgtacaaatgcacacttctccaggaaggggccgccgcagtcacactgttggcctcgtcagcttcactcccttctgcctcgacaccatccaagactttatagttggcaccaacacacttcccaggaggatctgagccgggtggtagataagcaagggcagggatatcagcgagagatgctcatggccggcaaacactatcttcagcatcgggatccccaaggtgagggacttgtgtgtagagcagaagatgatagccactgtgtctgctggtgtgaaccccgagttattccgtgtggagaagacgaaagtcagaagcatgaagctcagttgaatggagactattatgaacagtatgaggatgaggctgaatttgtccaggtcaatgtttgggttggagaaagtgtcaca

SEQ ID NO: 2432 - DNA, 509 bp, Rattus norvegicus
  Genbank Accession No. AI179711
gtgtaaacatctgcatttattgagaaagtgcatggcgcagcttcacaggctcttctgagatggacaggaaggttcatctagacgagactctcccgtgtgctggagaaaactgtggcaagttgtgcatccagagttgggccccacaggggctgacactggcaatggccacagggcacttggctgaggaagctgagaacgaggccttctgggccacaggcacctttccagcaccctgtcctcaaggctgtcgctcccagctaatttgacctccataaggaaggaaaggagatcagaacataactgtgaaccaagtcagtgtttctaacccttatcaagtgctcatttctgagggtcagcccaacaaggcttgcccagggtacccagctgcagccttgctacctgccatctgtcaccataggagttcaagtccatacgatcgttgccagctcctagcaatgggacaggcccgcctgggactgaggtagcctgggagttggcctcagtgttca

SEQ ID NO: 2433 - DNA, 444 bp, Rattus norvegicus
  Genbank Accession No. AI179750
cagtttccttaaattcacatttataagttagtcttcacagttaatcctgttgggaataaaaagtaagtgaacatatttctgcttttcctgcacataatacaattatattttaattcttgacacgaatggtccatgacttgaattttctgaaggggtgacaggccatatttttggatcacctgccactgctggctgatctgcatctctgttggtttggcttttgttggttggtttatttttgagacagggtcttatttatgtagtccattcctgtttcaaacttcctgtattgctcagggcaaccttggattcttgatcctcctgcctctacctctcaagtgctgggataacatgcttaaactggcccagctgaataacatcttttgtttaaatcctgtcagccacctggaagatagataccttattagtcccatttgcagatga

SEQ ID NO: 2434 - DNA, 427 bp, Rattus norvegicus
  Genbank Accession No. AI179755
gtatgtaactctctactttaatgttatttacacaaatagtttggaatgtatttaccacagggactaatgtgaatttcattaaattacatattaatatacatatacaaaatatgtcacaatattaaagtcagttgtgaacatatcaactgggcttccctaaaactatccctagtgtagatttagtcctcattctgcctcaaataaagtatttgtatattttaaaaaaggcaagcaagcttacttgaattttagaatgggttaaaaaagcagtgtgttgtcaagagttagtattaacatacacttttaacaaactgttaataatttgttaatgaacacattttatttacattatgttattaacacattttgcttcattcttacccttgtgcaaagccgcaatgcagctctgccctggagtcctcttaat

SEQ ID NO: 2435 - DNA, 390 bp, Rattus norvegicus
  Genbank Accession No. AI179854
gatagtgaaaatatatttatttttttaatacaatagctgccagcaatatactggtgttgatgttccagagagaagaaaatgcaagcattttgtaaagagctttcattcctacccaaggaatcccatgaaatgctccaaggctgtccagcattaccgcctgggagtccaacttttatggcttgggactcaactttttttccttgataaaataatttgtttcccccactttgatcattacaacaatgaacttttcaaaagtctgggagttttgctaacaaatgcaacacagaggttctggaagtataactgcctagattctagagccggtccgcctgtgcacaaaccagtcagaacctctcaacagtataaactgctcatgagcctcgtgcc

SEQ ID NO: 2436 - DNA, 516 bp, Rattus norvegicus
  Genbank Accession No. AI179906
atgtttgtattggtattattgcctctcgggtttacaattcagaaggaaaacaaagttatttatgtatcttctcatcaatgaaaccctcaaaactgatctaaaattccatatatgcttatataaataaatatatatgatgggtcacatttataaaagatgctcaatactgatccttttaagaccgaggtctcattatatggcccagactggcatcaaaattggtaatcttctgccccttcctctaagaatactgacttttgataaatgacctggtactcctagtatttctctgcaactgactcaactatgctataaaaaccttaataaccaactgaatctctttcttacaagcaggacatgaagccccagacttcttcagtctcctggcacagtggaaacatgtagtcagatggctcgtcttcccatgaataatgttcccatcccgaggccttttttcacataagctacagggcttcaagacattctggaaatcttccatactttctgtttctgtcc

SEQ ID NO: 2437 - DNA, 520 bp, Rattus norvegicus
  Genbank Accession No. AI179916
ggtgttgtaaaatcaaagcactactttattaaatgagttattttacacaatatgaacatcaatataattacaattgtaaaaaaattttataacaagaatggactgatttttcagatttccacatcagagtcaactgtacatttacacagaattgtctttgcatgaagcccaaagggaacagcataaaaatgagtgtttctgtagcccctttattttttgctgatcaacagtttgtttaaaaaagcagctgcaggtttgttacctaatgtctgagacagtagaagagtccaaggtgtcatgaattcacctgtaaacaactttatgcctgaacatcagccaattctggaggaagtggagtcttagggtgcttgctctcaaagtgctgcttgaaggtcttggggtcaggcatttgtgtcctacagactgtgcaggtatatattaaggcagctttggcagcagccttttggtcatgtccttgtttcttcttttgtccagcctgctttttggcatttttctgctg

SEQ ID NO: 2438 - DNA, 568 bp, Rattus norvegicus
  Genbank Accession No. AI179953
gatcattaaagtttggtattctattaaaaaccttatttaattttaaagtatacaaaataatcatattttaataaatgacatttaggagtttacaaaattatatcagtgacaagcatgaaaccacaactcttatttattgttacagaatggcttcccaacgacattcttggcaggaagaagtgtcccctgttggatttgttgactgtcatcttgtggacaacacatcaggcagaatgacaatgctaaggttcaacttgtcctagaaaagttacacattgacctaaactagtttcttctattttttccaaatatcaacatttctgtttccagtttagaaggcaatgctgaaaagggaggcaaacagacattcaaagtagaaaaactcagttttaatcaacaggatttagagtctagaagtttcatcggttctttgaaaaccaccccatcttgtttctgcaccattaaattgtaccatggcagtgaaattcccaagcaaactcatgaagtcttttgatactgactgccacatcccacagctacagagtagacgagctgggggtggaggggg

SEQ ID NO: 2439 - DNA, 471 bp, Rattus norvegicus
  Genbank Accession No. AI179967
aaaaaatagttgcgaccacatctttattgcatacccgggtgaataacttatcacataacaaatgcatcccacgccaagaatagacacttacggaggtcagggtgaacggattactttagataaagagcagcggttggggaggagcaagtgccaggaatttatggccagaacaaagcccaaattctcctggctggaaaaaactgaccttgtctactacagtgatgtccggaagagcttctggcaaaggacacagaggtctggggttggcagcaagtttaaaggtgagatgagatgaaaatatggcccttataagtcggtgtcggtgtcgacaccgcgaggccatcgtggggcagtgcacagagggtagacacgtgacctttagctgctgtttctctacctccagccgatgcactttgtcccgaagccgtgcctacaccggttccccacctttcaccagacctcgggcctcct

SEQ ID NO: 2440 - DNA, 546 bp, Rattus norvegicus
  Genbank Accession No. AI179984
aaggaaaagctcttttattgcagaggctacattgaagctatcggccaccttcctggaatgtgtaatcagtcctccctccctctggggttttctgtagcgcactgggacattaagtgctgctggggtccaggattctgcctatgaagaggagggcccccgtgtccgtgtccctcagaacaaagatgaacggtcggttaaggtgatagtcgagcgggaaggtgaggcggacaggctggaggtctgggttagagctggtccctgccccctcctcattccactcaaaagctgccctgtgttccacttgggtgagcttcacaggtttgccggtaatcttgctgaagtcaggggactcaaacaaggactgtagcttcatgtcctgcaaagagttggtaacgtcgccttcatagctcagcttcagcttggggacagtcagcacagcttggatagtcttcagttctcggccaatgtcatgaacgaactcagaggtgaggctctcctctatcatggtcaagttctgggtcaccgtcaggggcaggaagaagatcc

SEQ ID NO: 2441 - DNA, 540 bp, Rattus norvegicus
  Genbank Accession No. AI180015
ggtttaataaggaattgtttatttttgagaaaaagatcccaaacatcaggctgttcacaaaaataacccatggtataactttagaaaacaaatattaagactataacactattttcctgtaagatgcatttgacatgccaaccccattcacaaaaatacatggttccattgggtagtaacagtcccactcgtgtgagggaaaacacacgcctctaatgcaaagctgctctcagggttacaagtaaaggagatgcctctgcagttagggaagcgactactgcaatcgtgaacgggaataactgtactccctgcataacgagagattattttggagacagttgataaaaaccatacaactttttattgttaagtcaaagaggtatcaaaattaaagcaaaacttacagggtaagacttaacaaaactactaaggagcatcacaggaagtgaaaatggaactaggcgcagggcaattatgaattaatgaacacaggaaggataaggagggagaacagtgagaatgtgcagaagattctagggg

SEQ ID NO: 2442 - DNA, 535 bp, Rattus norvegicus
  Genbank Accession No. AI180113
ccaggttatatacttttatttttgcaaaactttaatgtcccaatagaaaatacaagtcttatttctttaactcactgatccagagtgaaatgctttgactgtaagcacaatgatcacaaaagataaacaagaacagcatcagtagcaagttttataagaatctgtgcagaaatcatgctggcactggccaggaagcttcatccctactagctagctctcacacttcttgaaggttctatttatatcactgaaggagaaattgttcagcattgaagataaccaactgtgtgcggcctgctagctacagaaaggacaggcctatcaaggtgtgtccactggcacaagaattgcacagttatgagagtaaccaaccactttctgattggatttaaggcctgctctaaaagatggaagcctgcttggtactgctaactagctaaacacctgtggttggggagaccattgccccaggggactatctaatgctattatactggtaaagggatgcagtaataaagtgccccactgggaagtt

SEQ ID NO: 2443 - DNA, 526 bp, Rattus norvegicus
  Genbank Accession No. AI180114
gtaaaaattgttttatataaagtgtagtttttgctatttagcaatataaaacgattacaatataattagttattaaagagctaaattcaacagttgcaaaccatgacagcagtgaacagtcccttgtacaagagttcatttggaaagaagtcaagtaaattttgtaacagatgacataaacccttgagccagcagtgcactaggatgcactacagccctgcccccggtgctctgcctcctccgggatggatgcggaacttactgctcactctttggtggttcctgtttcccattaagctcttgatcaacttgtttgatgcactctggtatgccgacgtactccatgggaacaagctccgccagttcagccaaattaaagacgtatctaatcttctgactgaattttgaactgataaatggtcttgtaacagccagaagtgttcggataaaccaagaggggtgcacaatgattagagactttaggtttttccttaatcgtctgtcgatttgctggtagcatctcctg

SEQ ID NO: 2444 - DNA, 600 bp, Rattus norvegicus
  Genbank Accession No. AI180187
gggttattatgtgtgtgcttttttttaattgtataattcgtttatacaaagaaatcatttgattgatttatttacagccttttccaattttcagttccactggagatatatttcacataatggttaacaatgacttgaactgatcaccagtaaaaccctgggctgacatggggcctctgtccttctcccccctttaaagagcatgaccccatttctaatgcaaacattttgcagtgaagaatcacgagctttcttgaatgaagaaaaccaaccagaattaaccaaatttccaacatgccgtgtggcttcttctcaaatttagcatttgcaggtatgagaaaccaaagcaaacagagttcacattccccctggccttctccaacttcctacataccctcaggtcaggctgctcctagctccgctcctctggttcagccagacaattttagacaagttactctttcccttccctttactatcccagtctcctgccttctctcttgcttttctgacaacacaaaaacttccacccacccttcctgtggtttctttcagtagtctagaatacactaagtcatttcatgggactttatcaccctg

SEQ ID NO: 2445 - DNA, 368 bp, Rattus norvegicus
  Genbank Accession No. AI180239
gacttagcagaggctctttattaggtgggacagttgaatgaagccagtgggggaggggatctgtgatagccgctgtaggaactggcaaggcctggagtccacctgacatggcaggaggcactggacctgcaggtagcacgcagcctctgggccggctgggaactgccacagccaggacagataggggctccagcatcactagagcagagccgggagaggccctcagaacccaaattctctgcaaacctgggtagacacccattagacactgagggttaaagagatctgactgagaagagagggacagtccctgtagtgtttcacagcactgctataaaacccaaggatgccacaggctgcctcgtgcc

SEQ ID NO: 2446 - DNA, 524 bp, Rattus norvegicus
  Genbank Accession No. AI180249
ccgttgagggacttcagaatgttgtaggcctcattagagcttgttctccaaaagcctgcttgaaaaaggctacgtgttcctcacagtgttctcctggtgtgaagttagggttccctcgcaaacgctggtttcgctgttcaaagaagcggaatatggtatagaagagcatgacatcatcagtctgcttagcagcatctaagaattttcgtgcggaaatgttgtcatggccgccaataccccggatgaaccttagggcagccagcacctggtgcttagacagaagcacttctacgatctcatcatttgctgttgaaagtctcttcaacatgtccagagacagctggtgggcgggaggataaaagctttctagggacagcaacaagcaagccagaggcttggagtcgctgagcacatggtactgcagaaactggtggagcatgtaaaataggttgtgctggacaagtgtcttgatgacaagttcgtgtaagtaatgctgcactgggatctgaaactggttcagagaa

SEQ ID NO: 2447 - DNA, 511 bp, Rattus norvegicus
  Genbank Accession No. AI180251
agactttattcattttgatcaggggaaatgacaatctcaatgtcaacttgtcacctaattgtaagcttgaactcacaggtatctttctctggatactgtacctactaacaatgtgaaatgatctcccttctactttctggctgcaaattgaaacaaacaggtcttttttaatggccaacactggtaccaggccagaggaaaatcaggccaaggcatggtaacttgacagccttgctagcaagtacaaatatcatggaacaaagtcgtaggcatttaaaaaaaggtatcagtataaaaagcttacactggtctaagaccaggcactctaaacataccccccaaacccagaagcttttgtggaaccgtggagacctctaagcccaacatttcccgaaaaaacccaaagcctgtattactgttaaatccttaaagttttaaatgcaccacaagatacacacccctcgtgccgaattcttggcctcgagggccaaattccctatagtgagtcgta

SEQ ID NO: 2448 - DNA, 523 bp, Rattus norvegicus
  Genbank Accession No. AI180281
aaagggcatatgccactttattacaggttacttaaaaatcaagtcagaggaagctacatagggggtttgtactttaagcattaacattagacacaaaaactaaactggccattaaaagggggcacagtgaatgataagatctttcagttggcttcacctaagttctccatcacccaggagccgtaggccccggtagcctgccacctttcactcactgaggacagtccccctctaaacataatggctttatttgttgaaaataactatcagttgtactaatcccttttaataaagaaaacacagaaggttatcaggcaggaatgatggactgcaggtgcaatgctggcggcaagagcaagtggagtgcagcatgactccacagctccctggcaaaggccaggccgagggaaagcagcggaagcccagccacagctgcttggatctgtgctcaggggtcagcatgtgcacactcagactctcttctcatgcactttcctactgcctaaaaaggcctcacagtccc

SEQ ID NO: 2449 - DNA, 608 bp, Rattus norvegicus
  Genbank Accession No. AI180283
aaaaacccaaaacttctttcagtttattcaaaataaaaatacacatagaattatgaaaatataggtttactatttccaccacgtcagcctgtgctgctgttgaaaggctgtggtgttcttgagtttttacagctcatctcgatccctcaataaagtatacctatattcgctgggcgccagcttctggaaggagctctcaggagaactgctcgctacatcctggtcttgctctcctggggctgtatcagttgggtcaggtccatgatggaattctctgtgtagttttccagaatgtaggtcaaatacaaactgcttgagttttccaggaattaatacatccttaaagtctccaaagacatacatatgcctaaagctgtcaatggctatgacagggcaatctgctggagtcttctggatatggagaagaggatgtctaaatttgtcacaatctgcatgtaagaaatttattgtacctttttcacttatcaactgccgggctacttcattctggaatatttctaaactttctgtatcctccttcatgtggaagagaatgagaaaaggcagtccttcttctgtcaattcctctccattttcaaatgttattt

SEQ ID NO: 2450 - DNA, 450 bp, Rattus norvegicus
  Genbank Accession No. AI180300
gaattttggactgaatttaatgtcaaaaattcagaaatgtaaacaaaattattcagtaacaaagccagcattctgaatccaatacaaaaattagtcactgatacatagctcaaacataaacagggtactttattaaaaaataaattgtaacacaataacttagtaacgacaaatcaagtaacataagatacagacaaaactaatgaagaggcgttgctgaagcttgcactagtgatctcctttaaataggaaaagctgctggtctagtggttctggccccacctacacaatacaggatacagaattggtgcaaaaataaaatgaaacaaaacaacctatgtgtaaagtcacctgcaaatagttgaatgagatctctctaggaccagggctcaagcagagatggttaaagtgctctaagtgttgagaactacagatctgaagtaatcaaca

SEQ ID NO: 2451 - DNA, 483 bp, Rattus norvegicus
  Genbank Accession No. AI180327
attcttaatgcaatttatttgaaatgcttccagaaaagtttaaggccattatacaaaagtattcatttcaccagaacattcattcactctcttcccacaggctgaccctgacagagacccttccttaactcgctggtcacaatggctctgtagagaacatttcaggcttttctctatcgtccagtgcccggtccgtctcagcttcctactgtgtctgcccggagcaggtttattcgctacatcagcaacttgagagacaaaatggttttaaataaactcataatagaaaaaaattttcaccatggttaaaaactataaatacagaaataggctttacagggtagaaactggtcaaaataggtcttgaaaaataataatgtcatataccttgtttttctattggttgctcttgccacacggcttctttcagtgcgcacgacacatgtgcatagtaaagggacaactttgcattttgctttcttt

SEQ ID NO: 2452 - DNA, 574 bp, Rattus norvegicus
  Genbank Accession No. AI180336
cattgtttaaatacactctatttttattttatcttaaaatagtttaacctttatgctacagacttgtttcaaaaaacaaaatcttatcttgcaccaaaaaatatatatataacactctgtttatttttttctccaaagaccattaaatactaaatggaaacaaaacctaaataatgatgtaaagaaccaaatttcatttacaaacttgagttgcacatttggaaacattacttctacgcaatgatttgtcgtcactgcatcaagtccacgctcaggccagcaacagcaggtctgtgaacaccaagtgcactgggtcctagccacacaatggctgacaattcatgttcaaggtaagaagagcaaaagagccaacgacctttgcactctttaaagaacaaagcaacaacaaacgcatttcctcgtttccagtgattttttttaaagatctctaccctttgaaatttgttagagaataagtagtgttttaaaaaaaaagaaaaaatacaacagcattgaactaaaatacgtgattattttaaacaaacagtgcacagtctgaggaagtttggttagg

SEQ ID NO: 2453 - DNA, 490 bp, Rattus norvegicus
  Genbank Accession No. AI180413
gactgaggcaactcggtagtttattctgctatttcagttgattcctcagacaagcagagatacaaatgagacattcaattttgattctgaaaatgtcttcagcacggtgtcacatctgatgcatccgttttccagaaagccagagaactgtgctccttgaagcatttggggatctcgatggtgccgtctatgcactgagcctcctcggtgtagctgcacttcttctccttatttttacaatagaagtgaaccttgtcaccatgcatcatcccattcttaaactggtcctggatcttcaccctctgcccttggtacaacacggtggccttcttaacagagagtttgcaagatgctttacagctcggcagggccgaccaatttcctgtcttggtacactccacttcttccgggccatccagtttgtatgtttcatggcaaccaaatacggctttatctttataagaaagcaccggctttgcagcctcgtgcc

SEQ ID NO: 2454 - DNA, 905 bp, Rattus norvegicus
  Genbank Accession No. AI227612
  misc_feature (1)..(905): n = a or c or g or t
cgggaatcgtaccccttgnnnnnatttgaactcttttaaccctcactaaagggaataagcttgcggccgcttccatttttttttttttttttttttttttagatgtaaaatactttatttgtaaatggtgatcttctaaatctgtgtccacaaattccaaaacccataacactctgtatacttcaaaaaattcaatttttgccaacattagatactattttacagaacagaaaacaacaaaactcggcaggacaaatactggtaggatgtcagagtattgtacaagagaagaaaaatattcaagaaacaaatttcatacagctatttatcaagagaaaaatatatacaattgatttattctgtaagataaaaatacatcatgccatatacattacaagctgagagctgagccactgatgtgtacccgaagctcacagtccactcgaattgtgcacacaaactccattttatacttagcctgtgaagtgtcagtaccagaattttaagtacaaaataaaaagctaacctggttcaaatgctgattaagtttctacaagcaaacacaaaacagtgtgttttttattaaagaaatgtaaacaaacaagttcatacaaacacattttaaaattacatcttcgaaaaaccccattgccagattcctgcagcttgaacgtaatcacatttaactctctccatctttctttttttaattttcaaattttttgttaaataaaagcctacgattggttagccctgctcatgacttttgttacatgattctgtgagtggaaacaattttatcaaactcttttgtgaaaaaaatcacctccttggttggttaaacgtatccagttccaattttacccaaaactcctgaaatggttcccattaagggcttgttttta

SEQ ID NO: 2455 - DNA, 441 bp, Rattus norvegicus
  Genbank Accession No. AI227641
gaaacgttcttatgagccttttgttttattctcgttaaatgcactcgacccaaaattggtttggcatatcgaaaaggagaccaaggaggggagggagtagggtgtgggggcagggaggaggcccaaatggactaagaaattgagaatgagagaggaacactgagacggcaaacaaggacacaaagaaagaagtcggatagctaggaaaacccaaaagaaaaacctggagaaaaagaatgagcaaggtttaggagcaaatgaattcaggagcccgaggaagggaggaggagaccaagacccttctctgtaccgtccccgctggggtgggggcgtcaaggcaccaggtctggttaaagtaggggacacctgggctctctgggtggctttacgctggattgtagtggatccagccggacttggggacctgccatgtacctctga

SEQ ID NO: 2456 - DNA, 589 bp, Rattus norvegicus
  Genbank Accession No. AI227670
gatcatccattcacaaaactaaaaccacactttaattctgtgccaaagcctctgagctttagccacttaactacaaaaagaaaccaaatacagaatctagttatccctttgcctttgatgacccaccgtgtcccctgtggagggcctctccccacagccgaagacgtaggtgtctttgccacctggagcctttcctgatgaacaatggctgtccaggtcacccaagctcatggctgagtatgaaatccatttggtcatagcaacaatttctagggtaatcgtgatggcattgattttaggaatttacaatttcaattctttttgcctttgatgataggttatatttcagtgcagatgttaatcaaattttaggaagctccagaagaaaaaatacataaaacttatctgatacctgtaaataaataagagcaacatgaaaccttccacatgcacacacgcacacacaagccactgtagagtgtcagaagatgtgctgtatgaaaacaaaccctaaggtggtaagatgccccagccagcaagccaggctcccatgatgaggacgcacaggactacagggcctgcacagtct

SEQ ID NO: 2457 - DNA, 634 bp, Rattus norvegicus
  Genbank Accession No. AI227672
caccaaaaccatttatttttaagccatggttaaccttacaatcttaatgaagcaatcataggtcatgtgactttggaaataggaatgctaccccagtctcagcctttagcaggcctggaatacagcttggtgtagtgcttgcatagcacatgtgagggcctgggttcaataaaaaagacccaatcttctgagtatcttctggcttgtttatatgataacctcaagtcaggtacactacagatagaaactggtcctgaccctgagctacagtaccaaggctttggctacctcagatttgtgatgcagtccaaaattcatgaagaggcaccccccccccaagttaataaggtcaaataatcacagaactcagtctctaataaatggatactgtgaccagccagactagcaactatttagaatgctttctattgctgtataagaatttatatagcaatttgagtttgagaattccaaaaacaacctaaaactcataattggggctgagtctgtagtctagggtacaactgtgcttcctcacaacattggacggtagaagagttgggtcacaggaataagtctttccataaattactaagaaccagttcattggctgcttcccaagcctacagtacct

SEQ ID NO: 2458 - DNA, 553 bp, Rattus norvegicus
  Genbank Accession No. AI227689
gcatagtttaaacacagtgaggctcttccttcccccacagtgcctgtccccacacatcgccactagatccaaaagaagaaaaaaaaaaattggtcttccctccctccacttccacccatcgctgtctcggtgggtgagaaaggattgtggactcttcctcacccagacctggaggtaaatagtctccttcctcgggaaggcagattcccgcaagtcatcttgggacagagggagggagcaaagctcatgtccaatcagaggagcaggtgggagggagaaaaccaaaagataccacgcccccaggccccaccctcaccttagttttgtataaaaaaacacctgctaggaagaattctttggagctcaaagtggctcagcttaagggagaaggcacaattgcactgcatcgacgcacagaagtctgcatttgtggtgtggggggggacaatagaaaaatcgacagcaccattccatgggtgggtggtggaggaaggaaggaaacagcggtcccgctgggccttcggagaagggaggacagaagtctgtgtgtcga

SEQ ID NO: 2459 - DNA, 523 bp, Rattus norvegicus
  Genbank Accession No. AI227694
ggggcgggacaactttgaatgcctctgggacacttggatttctcatccgcaatatggggcacagaaatgggtttggagcgagtgttcagctgtcactacccggacagaagtgacaacttcaaatttccttgtctgtggttgtttggagacccaggcaaaagggacctgggtcggtctatcatggccaagcaaggaatgttcaatttgtggcgggagatcgggataagtgaggcgagaaatacaggatgcagaaatcttacatctaagatcccgtcttgagtgactggtgtgtttttgtttgttccaacagtgtttccattcactgtagaaagaaacacaagcgattggcggaggacgatgagtgtccagtaagaaagaagcgcttgactgaagcagaacttggtgcagttgccgatgagtgggttcttggcacacatcagggtatagaaggtcatggggtaaacacgtgtcctggtggcctttctgtgcctagcatcctagatgctgtctgtgaagaaatgcc

SEQ ID NO: 2460 - DNA, 575 bp, Rattus norvegicus
  Genbank Accession No. AI227705
agaccacttattaaattagaaggctgaaagtaaaaatatatcatataatcaaagaaaaatctggacatggacccccatccccaaaataaccacagacagggttctgagaactattcccaccaacctctagacagtgtgtcggatgatgccagtgtctgtaaagagtggcctgggagggcgagggcagagcccatcgcaccacacttctgtcaattgggcaggcgttactcacaggtgagatgaaagccactggccatgtcagaccacaaatgtgcagcaggttacaacttcagccaaccaacatgtgcagagaagagaacagcgcaggccatccctagacccatacctacctaccctggagttggcctgagggcaggggccccagtgaacaccttgagggcagggcctccaatgaacaccttgtgaaattttgctaccaacatcaatcttcaaacttggcaagagcagcaatgatacccagaaagagcctggtccccacgcagaagcttgtctgtctctgctgtggcctctgcctttgagctccttccaagggtgacttctcaccttgagaagat

SEQ ID NO: 2461 - DNA, 548 bp, Rattus norvegicus
  Genbank Accession No. AI227724
cacctcctgacaagacaaggtactttatctatggatatatacacattttttttttttcttcgcaggaaacggcactgtctgagagatcttcgacctcacacctttctcagccttaattttaaaacctgacctgacaggacacaaagttgtgtaactaacatacaaaatacagcatcactgggagctgctggcaaaaaatggatgtggaaccccgagaaagaacagactgcaggtttaatctctatagaaagctacatgaaaactgagtacagcctaggcagccgacggtccaggtcctcacatattccccatggggatacatgcctgctgtctgagcctctagaatcctagcagttaaatgtccaactcatccctcccaagggatatttatcctgaatgatgtgacgatccaaggcctaaccagggctcttctccctggctgaccctaacccttcttgcaagggtggctgtgagccaaacttcttccccaggcagggtctctttccttcctcatgaacacatgcatcatctaggagtgaggatgggac

SEQ ID NO: 2462 - DNA, 582 bp, Rattus norvegicus
  Genbank Accession No. AI227743
caggaaggaaagggattttaatgaaaaaaataacagggagccaaagtgcaaactgtccaccctcctccccataggggatccatcctgtgccccatgtgtactgtgtgtactccctcacccaccctcaggtccccagcgaagacctaaggcctgaagcttctgcctcaggtagctcttgagctggggcaggcctctctgagattccagttcttcaaatggcagcggcaggagttggtagcccattaggcccaggtgccgctccctcagagcccgagagcccagcagcaccctgccatcacggcagaaatgccagcgttctcgcagcatcagcaccaccctttgggtagggtcttgggttgtggaattagagttagcctggtcctgttggcagggccgtggtgggtagggcaggaaggggtcctgtgtcctcataggtagcacagcaccagaacctcccacacagagtaggaagtctgtgcagtagccgggtggtacagtcaggtcctgacggtatttttcttcccctaacagctggcgcagcccctcagctaccatgtccttgtgactgtatttgcagcgggc

SEQ ID NO: 2463 - DNA, 480 bp, Rattus norvegicus
  Genbank Accession No. AI227761
gcggtaacagctttaatctgtggtggctgacacatgggacaggatcctgttggcctcccatccttccatgccccagaggaagagctacttctcagggagctgaagcagatgccatgagcaagttggtaattggtgtgtttcccagtgtctcctggagacctgtgtttaaagtgagcactgcagggcggacagcagagacaggctgcaagtccttacacacagggcttggagctgggcacagaaaggcagggctccagtattgatatattatacatatatatatatatatatttcatatgtatacacagatagttttctctctggaaagtattaaaaaaattgatcaaccttcaatctataaaaaatacctactctacatgatagaaaaatctctcctccaagtttacactgatttacacacaaggctttccccaaaatgtacaatacgaggcaacgtcttaaaccgtagtgtagaaggga

SEQ ID NO: 2464 - DNA, 637 bp, Rattus norvegicus
  Genbank Accession No. AI227856
ggaaaacacatttaatttcaaagtaaacaaagatgtctgtacatgaaagtatttaattagtgaaacaattattatcagtgtaacaagctgaaaaatacagcaacttgatacaagactgaggtaacaaaatacttcaccaaaaatctaaagaatcccaaggagggatgatgttccatggttattgcaaatgagacaatttacaaatgttagagaaaaatcctcacataactgcatgcagggtctgctgggaaaaaaaagcttgggaggtgtagcagatttaacaagaaacagagtaagatgtagagtaaaatgtgaaaacttatttccagtttacttggaagaacacataagaaattgaaaactactctctacacaacattttgaatgctaagtgggaaaacatgcattttggcacaaaatttattaaagagtatacctcactaataaatactattacttcattactgaatggtcacagtccttccaaaatggcttgctgctgtaagtggcaatttggggctgtccacgggacacacacttgtgcagcagcaggttacaaggtggaccaaagtccaagtcctcggctcccaaggacttgcagctcccactcatactgtatttgaatggaacactgaag

SEQ ID NO: 2465 - DNA, 613 bp, Rattus norvegicus
  Genbank Accession No. AI227887
aaacaaggaaacaaaactagcactcatcgctttttagacaatacataattattcaaaattaactattaccggaagggcaagggggccatactaatgggccttgtctcacatgagtgcatgtgggtaggtgcaggtcgtctgtcattattgcagaaacgaattttaatttttaatctttagtttgatttaaacattgcttttagtatgatgacaacaccagctgtgcagaaagggctctggagatgcgttcatagcagcacacacctgcggctcttcttcggttctggaggctccaaggcagccaatattgcttcatcaaacacattctttaggcctttctgaaaaggggtagaaagaagaaatgggcaatctgactttcagtatctcaacagaactggagttcatgtttaaaacagtcaaaccccaaagacagtgagcaaacaaagaaacattaatgaccctgaaaccatcctaataaacttgcttcactcagttgtcttgccagggcacaggagagattcagcaatgctggcacagatgagcagatattcgttaagtggtcctctgagatactttttgcaaaccaatatatgtcacaagaagcaaacaacct

SEQ ID NO: 2466 - DNA, 620 bp, Rattus norvegicus
  Genbank Accession No. AI227925
gacttgagattgttgagtgatttataagcattacattaattcccatgcaaaactccaagagcctgactccaactggccaaaatacaaccgatgagtctggacgttcaagactgaaacagccaccgtggcttgcttgacgcttccattagcaggcatggggtcattggcgtcatctagatcagcaggtccgtccacggctcaagcaccacggtttgccttgaattcacaccaaaacaggggccagcacgccctgaagcacctaagcctggcaaatggtttctgtcagataataggactcccttactccgacagagcaatttaggtatttcctggttcctgctctacagtgaaacctgctttggacaggcacggttatcttcaatctggggataattctgcctgtcagatctcaggagaagtaaagagactttataaaaggaaaggggaagagaagatctctaggacccccttccccccacagaaataaatacaaagatacccactttatcaagtattatctcccccagcttcagatgttcggtgaataggtataaagctttaagaactccccacaataaggcagaaaccagagctatcaaagagggcaaaacgggacccac

SEQ ID NO: 2467 - DNA, 693 bp, Rattus norvegicus
  Genbank Accession No. AI227941
acattctgaagttctttatttatgtcaatgaaaagaatttcattatcctataaagtcacagacacttccacttcaaagtattacaatcaaccagttttcctataatcataaagtaaaagccttgtcaccttcttggcatgattaacaaaacagaaaagagaaggcagagctcacaattgttctgagcttccatgtatgtacattcctggacctgatacaatttaattcaattcacttactagctgatgactgtgtgaagacacccacatcctaatccctagatcctgggaaagagatacatggcctaaaggtgttaaggctgcaggtggaataaggatgctaattaggaaccttaaatcccatgagagcttaggccaggcagaagaagggagtcagaagggacctaaggacccacacttgttgcctgagaagatggaaataagggacaaaacaatcaaataaaccaaaacaaaccaaacataaaaacccacacgagcagactctagcatcatgggacggcagaagtcatcccttatacgggccccagaatacatcgcagccttagcaacacgagctttgctgtcagcacagtaagccctagaactctacagaattgagatgaaacagtctgttgtcttgagacatggcgtctatggcgttttgttagtgcagctacaggacactaatccagcg

SEQ ID NO: 2468 - DNA, 581 bp, Rattus norvegicus
  Genbank Accession No. AI227953
cgctccggagcttctgcttgcgccttttggccagcggcgcgttctccacactcttcaaaaagaagccctcgcgctttcctcggttaaacgccatgaaagtggcattgagcccggagcgcactgctggcccagaggactccagcacatccggcgtgcggagcgggggcgaggagcgcgcactgccgtcctgaagccacgagctgctacgcagcccctccagcttcagccgcttggcggggtccactgtcagtagccctcggaccagctccttggcttcctccgaaacaccttgccaggcttccccgtccagagagaagcgcccttcacggatcttgcacatgatctcagctgcctggctctgtccaccctggccagaggccccttggaagggaacctgtccagacagcatcatgtacagaatgacacccaggctccaaagatcacaggactcgtcgtacccctgctgtgccagcagctcgggtgcagcgtactgcagggtgaagcaaggcgtctgcatgggccccgccgggctctggggccgcagtctcgcgaacccaaagtcgatgatctcctcgtgccga

SEQ ID NO: 2469 - DNA, 545 bp, Rattus norvegicus
  Genbank Accession No. AI228005
agaaaaatagcaaagtcagctttatttttaaagtgcttgagattattaaaaaaaaaaaaaaggcgatggcagtatgaagacagcacagtccaagtgtgggggtgcatgagggttgaggagatgtgtataatgggatggatggcaggtcaacattgaaagtcagagcccagactacagtcaagatgtctacctattgcttacaggttcctcatgaaggtgtttacctgccccatgagctcttcttgtttggcagcattttcagagaaatcctcactgatgttcaacaccagcaccggcacatgccgcaaagcctcgaagtggagcttggtagtcttgttaataaaccagtcttcatgttgcccatgtagctgtttaagataggccagctcaatccctttctcttcttctctgcccctctgacacagtctttccatgcaaacctggggagaagcctggaggtagatgaagccatgtaacaaaagccggtcttcaaactcctgcaagaggaaggagtgccaatcctgatagatgtgccattcgacgtc

SEQ ID NO: 2470 - DNA, 380 bp, Rattus norvegicus
  Genbank Accession No. AI228064
aaaaagaattacaagtctttaaaccgatgggtaatcagtgtttctcacaaggagcactaagaatgagtcacagcactctaatgtagtcatttctgcaaaggatcatgccgctcttggtgtaacaggacgtgccgatgtcgcccagctgcgcctggcagcaggagcacttgaggcagcggctgtgccagtagctgtccatggcatagagcagaaagcggtccgcaatcttgcccccgcagcctgcgcagcgcttccaggagagggagccggccgtcaccgggggcggctgcgagctgctgcccggattcaccatggtctgtttctcccctatattgcaacactgcaagaggcggcggcggcggcgaaatgctagcggagcc

SEQ ID NO: 2471 - DNA, 366 bp, Rattus norvegicus
  Genbank Accession No. AI228103
gggggttgtaaaatcaaagccctactttattaaatgagttattttacccaatttgaacctcaatataattcccattggaaaaaaattttataacaagaatggactgatttttcaaatttccacattaaagtcaactggccatttacccaaaattggctttgcatgaaccccaaagggaacagcttaaaaatgagggtttctgtaccccctttattttttgctgatcaacagtttgtttaaaaaagcccctgcaggtttgttacctaatgtctgaaacagtaaaaaagtccaaggggtcatgaattcacctgtaaacaactttatgcctgaacattagccaattctggaggaaatggagtcttaggg

SEQ ID NO: 2472 - DNA, 206 bp, Rattus norvegicus
  Genbank Accession No. AI228112
ccattctttgtcacttttattcagtagtagtttttttttttccttattttcagtgccagacatggcaaggagtgattacagccaactgtttttaaaacatttgttcggaacataggcccccattaccactgaccccaaactgactcattttgagtgctttcgttgttcctttttaatacgccaccacggatacaaggtggaaaggg

SEQ ID NO: 2473 - DNA, 545 bp, Rattus norvegicus
  Genbank Accession No. AI228165
ggccgctagagtttttttttttttttttttttttttcttgttacttcctttattgtaaaatctaagggaaaaccaggttttcttgtgcacacacatgagtctcaggactcagaaactatatacatttttcgtcggaccctaagatgaaattcttcggcacattttcaagtctgtttctgatccgacttctagagagcaggccctgatgaggaccagagatggctggcctgttaaagtactctctggcttcttttccaaaagcaatggtttgtacacacagtactgaatggtgcctgaggagtcgctgctctcagtttaaatgtgtcacttttctaaccttgcacatgtaagcaggctgtgcgtattggtggagatggctttcaaaggctctcaaccatgtgcttcaaatcaaggcagtgcccttggtcacagccacaggaacagtgacgacacaatgaaccatggcgcatctggtagatcgcagcagaacgctgggacggtgtcatccggttgtcacacaccctgtgtcacacagtgccggaaga

SEQ ID NO: 2474 - DNA, 397 bp, Rattus norvegicus
  Genbank Accession No. AI228180
aacattcaaaggcattttatttaacccttcgaaaaggaaaattaaaatgaaaaatgaagaggccatacagagggccatgaatgggaatgccagcgacacacgtatccctcccttcctaacagacttgctttgggtaatgggtaaaaaggaagccttttgttaagaaaaacgtgagcagggtggtttcgattttacatcactgaccccgggtttggttcttccttttttttttctggaagagggggtctcattttttttcttcccgaaatgtctttaaaggatgtgtcagtggggaagatggtgtgggggggctgatggagtggggaggccgcaaacagggagacctgctgagtgaatgggaaaggcgccgcccagacaccacggagagaaagaggaa

SEQ ID NO: 2475 - DNA, 509 bp, Rattus norvegicus
  Genbank Accession No. AI228195
ctgtacaggatttttgtttatacattttagtaacgggcaacagtgcaagggctacagggagaataagagttcgagagctggggtttggcgtaaattttacaaagtgtataaagaatctgtgtttctctacaataacaaaaaaccaaaggctacaagagcagttgtatatacaaaacacggagatattgcttcacttgcagacaggttcctgaccagacaaggagacgagacaagagaagtggggacgggcagaggagagcgctgcgtgcagaggaggaaggaggggggcaagggtgtcttctcccagcataaatctacaggcaggagcaggagtgcgcaggcctgggaatgctggaggccgtgctggcgctggcgctggcgctggctatggtggtgtaggcaggaggcagagcccagaatgtccacctgctcagcccctgatgcctggctcttcgggtatcagctcagagagggtttggggtggggatgcagggccagctgggtcacct

SEQ ID NO: 2476 - DNA, 391 bp, Rattus norvegicus
  Genbank Accession No. AI228230
cagcaatataacatcaattttattttaaaaaacaaaacccaatccacctgacctgtctgtccctcaagggacctaatagagacctcaggaagggctagctctggccaagcaggggtaggttgtcaggtgtcaaagaagacactgtgctcatggactctgctccctctctcagcccttgtcttttgctcctgacaagaggaacaactgatctgtggtcctacgagctctgctgtacttgaggaagaggaaaggcagggctatggacatgcagggccccttttagccatggagagctgccggctgggcccaggctgtgcgagacaggctgctgtgcatggggtggattcgtgagagggggcatgcacagatacctagtgctcaccctcgtgcc

SEQ ID NO: 2477 - DNA, 567 bp, Rattus norvegicus
  Genbank Accession No. AI228265
caattttaggaagaaagcctttaattgggattttcttaccaagttatgatttaatatttatcagatgtgtaaatatacaaacattatatttatgttgtaaatagatgaccttacaaaattacagcacgcagtaaataaatccctcccacattttgtacaaactacatgattttgatatacaaagattctgtttttattccactgacaatgtacaaccaacactatttacaatgcaaggggaaaaaaaatcaaaaaacaaaaacacgtttataaaccacaattaaacattctgctactggcagccactatagtttaggaggtagctttaattaaacaaaatgaacagaagccacatttcccaactcgtgttctaaaaataatttacacaagataaaaattaatcatatgcacagtatgtacagtttaatcaaactgcaatctagcttaagtttctgtttaaagtagaactaagatggcagtgggtttgctactgactgaacacagtctgaagtcttcttacagaaacacatcaaaagcctataggtaagaatcaagtaaatcttaaaa

SEQ ID NO: 2478 - DNA, 461 bp, Rattus norvegicus
  Genbank Accession No. AI228291
acagagctttaaaaatatatatttattgagtgtctagcacaataaaagccacggtaccaggcaggagcaagctggagataggaggtgaccagggcacacagctcctgccctccatgagtgagcatccccagtgagggataaaaaggaagtatccaatactgagtcaaatgcatacgatgttattggttgagcgacagcactaggaccaactgactaaaccagaactgaaggaccgggaccgggctcagggggtaaccagcagactcccacattactccgagaactagcctaggatctaccaagaaaggactgggagcagggttccgtggtggcacttagcttatacaaggccctgggttccgtccacaacaccacaaggaaaacaaacaagcaagctacttgttggatttgaattcactgttaatgttgtcttttcacacaaatgaattatagatagattg

SEQ ID NO: 2479 - DNA, 505 bp, Rattus norvegicus
  Genbank Accession No. AI228299
cctttcaccaacctcacagagggcttctatttgtttatttaaaaacaaattttaaaaagtaaaatgaaaccaggtgagattaagatacattaaccaaactgcaacgtagaaaaagggacttgctggaaacatgacggagaccactggagatttcacagacacacagaagagctcacattgtcaacagaattaagctgctacgaattctccccagaacatcaaggtttcattttgctcagcctgagatctcgctcaatttcaaactgcctgtggtccacgcgctccagaaaagctttccgttcgatgtacccctctttccctcggttatggatggccagctcttcaccaatcccttcttcctccttgaagctctcccagtccaatttggatttctcaagggtgctcattttctgtttcttggctccaattttccctaaaaggctgctcatcccacttgttctttttatccctgacccagcagggggtggtcttgtcacttcagccg

SEQ ID NO: 2480 - DNA, 462 bp, Rattus norvegicus
  Genbank Accession No. AI228301
ccagatggacccgttttatttccaaacaagactgcaagcataaataaacttccccagtaccatactgggttttcattctataaaatgtatttaattcctaaaactcttcataaaatctgcctttccccttgcagcggaaaattggcaaaagtcaaaggttgaaaggtcatgcacaaaacattccattcggcatcattctgtaagtctgtgagtctgtgagtccttgcaaatggacaccaagaggattcctgcttcactgtactctgcagtacctcaagattttccttcagtattccacagtgtgacctttccataacacagggaagcgaggccaagctgtcgtagactgaaaagatctgctgttagcctgctgtggagcgtaacatatctctaagaataaagccctaaagagaaaggaaactcaagtttgccatcaaatgcagtgggtggctcctttgcccc

SEQ ID NO: 2481 - DNA, 432 bp, Rattus norvegicus
  Genbank Accession No. AI228335
atcagttctgctgtttatagatttcacgggaaggccgaatacattttaagggaatgaggaaaccgttcagtgtctagtaacatgaaacagtatcacattattccataggaaacgtgtatatttatgtagaacaggtcagtcctgagaaacggcgtcagctcagttcgtgtcccatccatcctcctctgagatcgctcttgctgcgtccataccagacatcccaggttggttagcagggcatacatctgaagctctcaccagacctccgcacctcatctacggctacatacagcagcctaaagaagcacggctttcaggtgtggtgtaaagactctgaggtaatagggaacgagttaatttgttcttggctgtagttggctcccaaagagtgcctgtgtttttcaaatgatgtcaactagaaaaagacaatgt

SEQ ID NO: 2482 - DNA, 314 bp, Rattus norvegicus
  Genbank Accession No. AI228455
aaacaacttcaaacagggctttaattccaaataaaccacagacccaggtgcccaggagaaagcagaaccaagctgatgcgctgaccagggctggcagtgtcgagtggagaatgctgggcgctcccgacccactgctcttcctgactaggccttctggtgagcgccttcatgtggacaggcccttgtgtgtttgggcttaggcagtctgactccaagcagtaaggcctccaggcaccacagtccttggtccatgagcagagcaggccctcgggacagaggtggccttgagacctgaagagcttctgtcctttccg

SEQ ID NO: 2483 - DNA, 181 bp, Rattus norvegicus
  Genbank Accession No. AI228524
aaaaaacaaggccaatttattttacagtgactcctgaggtatttaatgtgggaaggggtaggcaagctgtaatgtcctttctggcctgggtgcctccaaaatccgtttttgcacaaaacaagagggctttcagggtgccaggtttaagggagcacaggccagcccaagagggacccccaca

SEQ ID NO: 2484 - DNA, 404 bp, Rattus norvegicus
  Genbank Accession No. AI228589
aaatttccaaaggatcctttattaaaatagctgaaagaggtctataaatatttctttatttttctaaaagagtttggagtttttgagtgagaatgtggtacctttttgctcctgccttcccgcaggggagaggatgagggcaggattccagtgcctcctacaagcagggctatcaaaaagaagaggcggtagcatctgctcacacacaacctcaggtaactagtgatacaacaataaacgtaaacggcttaacattgttgtccacatctgcatggctgagttcttgcctctctggccccaccgcatctgggagagggcaggagggagggagggaaggtgacctctggggtatgtcccttgccccagcttcagaattcccactccagagcctgtttccggccttt

SEQ ID NO: 2485 - DNA, 575 bp, Rattus norvegicus
  Genbank Accession No. AI228595
ccaagggttaaaaagcaatctttattttacaaaattaaaaacataaataatttttacaagcattttaaataccagctttaatacttgacatttggttatttcaaattcagtttcccacaagcttttaaaaggtaagaccattcctgcctaagtgagctgctgccatctgcctttgccttccaaacaagttcttactttcttacagttgtccttctgtaaacatttaaaaagcagggggcttcctaaatgcctaaccttaaaaataatagtcaacaggcttccaagcacagctggggggatgactccacgggttccgaggtgaatcccctactgtcctgctcacagttgactcctgtgcctttcctaagactccagttccagagctcagctttaccacctgttgacatctcaggcttgctaaatacaggcggggaaatggaggctaagagcacagcggacagatcaccctgctgagaacaagatggacttgcagtatgatctagtctagaacagttcatcatctgaaaaccaaggtgaacaaggtgaggcttgggccagcctaacgacatggaagg

SEQ ID NO: 2486 - DNA, 611 bp, Rattus norvegicus
  Genbank Accession No. AI228596
caaaaataaacaatttaactttattaagtcatgacttcagcccttacatggatttgttttttaaaaaaatatcagttcagactattattgaaagtgactatgcacaataaataggaatggcctgcgtgtgctgcagacatgggacacaaaaggttggatgcaatcagcaaagagtgcaaagcacctgggaggaagtttcaaatgtctagaaaagtagctcagagctctggaccactcaccaaataaaacaaaaagcaaaaacaaacaaaacaaaaaccccactcagtacatctggcaaacaacttcccaacaacactgaactatctcctgcgacccataagaacaatttaaaatacccaaagtgctaagacctcattagcagtactttaaatctgagttttaatgttaaatatgattactcgaataccctaaactgtatgacatgcctaataacaataagttacaaatattcaacctaataacttagacatgatatggttaatataacagacattgtatctcagctaacctttcatgtaaggtgagaattaaaagacttgttcatctgtgcactcaaatgaggaatgtggtatcctagcaacagtgatgac

SEQ ID NO: 2487 - DNA, 592 bp, Rattus norvegicus
  Genbank Accession No. AI228624
agggacccaaaatacagagataatttattggtcacgcatattgtcccttgcatgtttatctgtatagcatgtgtgctgatcccagcagagacatgaaagagggcattgtttttaattggcaccatgtgggggcaccaagacatgaaccttctgtcctctagaagaacagctaacggaaatctttatagctgatccatcttgacaggtcctaaagataaaccttatttaatctgcaaagtgaaaaagttttgcaaggtcatgcccagagctaaaattttgacgctttcctttgcaaagctgaatggtgaaggtgtcaagaagaccagttctcagagagaagactttaatgaatatattttacaaacacactggagaatcaggcaatgcttcctgcattggatgcaatcctgggccacaagtctgcacactcctttgcaactggacctgtgatagcagaacctttcatctcgcctttattgtttactatgacccctgcattatcttcaaaataaaggaacaccccgtcttttcttcgatatgactttcgtagtcgaatcaccactgcaggatgtacctttttccttagttatgg

SEQ ID NO: 2488 - DNA, 617 bp, Rattus norvegicus
  Genbank Accession No. AI228628
cacagtacacagtagttatttatttaaatacttgaaaaggtcaatgatggaaaaaataggtttattgtgagagtttatattcattagatttattttaccattaaaaaaatgttgcctctaggttatcctggccagatatagaacagttcatgacacatgcagctacggcaatatactacacagacacagccatgataggacggttttcactctgggtgagtcagcggtggtcagggtggcttctttaatagaactaaaaacattgataatatacaaattgttttccccatttgactgaaagggctataaaatccacactctgacaaagaagcaatgtggtgacacgggtaacctccgctacctgtttctgcctcaggtcctcagccacatactcagctccacaactttctaggtttcatgatggctttaatgccggcctaccacagtgacggaaacagagtggttttggaaagctgaccttgactcctgtgtgatcttaaaagtggagagaaatggctatagaagccaaaggctcattctgagtccccttgaaataacgtgtgatacctgagtaaacacaacccctgggactgaacctaacaggtgggccacacaac

SEQ ID NO: 2489 - DNA, 634 bp, Rattus norvegicus
  Genbank Accession No. AI228642
acttttccaaacactgtttacttcactaaaatctggagagaggcaatgaaaaggtacgccaacccctgggatgccaaactaggagtgtacattgacaacagcaacatacagggccaaggtgctgagggccagcaatcctgtcaccactgcccgggccagcagcgctgtccaactacccaaggagcagagatggacaaaggtctccatgacaaaggccttgtagacactaaggaacattaggagaagaacagcaggccggaaggtgtggtacaggtcatagcgtgttatcatccagacctgagctgatgcaacaatgtagtggaccagactgatgttggagtcaatgctcatctggatatatttccagtcaaattcaatgcctcgggctcccacccagagagggatgcagcgggacataatgagttcagcagtggcccagcccagggcagcaaccatgatcttgtactcccccttgcctgcattccgggacatgacaaggtttaggcctatcaggtctgccacatccacactggccttcatgaattccccaatgaagtcatagatgcccccttcccaggtggggaagaaagtggccaaaaacaacatcttacatagctgcacaaagaggtaggtg

SEQ ID NO: 2490 - DNA, 552 bp, Rattus norvegicus
  Genbank Accession No. AI228672
ccaggttttctccttttttaatcaatgatcatctttgtccagctttggaaatctggacaaagagaaggctaagaggaggcctggtccagtgtctaaaggtctctgagtgagtctgtcagcacatggaccccgaacgggcctgtccatcagctgggcacagcagttttcctgagtatgagccagtcccaccctcagggcagcatcctggtccagagaggaataaaggccccaggttgggcctattcccaaggccctcgggacagtcaataaataggttctgagccaggcctgggaggacggggtgtaaagagtggatcagctacccagggatcccaaagagggcctgggaaccctcctgctcttcttcaacaaggaagtaaataaatagaccttaaactcaggaataggggtgttggagcaggggatccttccccttagagttagtaattaaatcccatgttaaaaacaaaccagccctaacccctaccggcatctacaaaaatcctacaggatagggcaatgggcttgcctgtctgggggtacacagttccc

SEQ ID NO: 2491 - DNA, 509 bp, Rattus norvegicus
  Genbank Accession No. AI228676
gaatagttagtttgattttatttaaaaataataaatcacaaaactaaagtgtttgaacaaggtcacttaaccccctcccaggccacttcttgttatcatttggtcatctttattactccgcactacacgtctaaaagaggatcttcagtatgccagtgacaccaggacacatccctggcacaggtgatctccagaagaaaagctgatggtctagagagctttctcctctgccttcacagtgctgactctgggtggaggggacaggggtctctcggagtttatcactgagggaccagttcccttagagaggccagagcagcatggacacggacgtgcagtctgttttcaaagtcgtagccagaaaaatcctcctttgcctgaaggagtagcgttctgcctcttgctacagactctgctctgtctagcaggagacagccaagctcatagcaggcatatggctggacgtatgagttattctgacggcacgactcgtctttagccctcgtgcc

SEQ ID NO: 2492 - DNA, 541 bp, Rattus norvegicus
  Genbank Accession No. AI228695
acagataaatttgtttttaataaaggagttaattttctttcaatcctatataaaacaatagcaattaaaaacttcatttctgaaagtaaaatatttacatattaacaagtaactgtgcaaaatttacatgaaaaaatggaaagacggggatttcctaaaagataaaatgaaaggtgtaacagttcttgggtgtcataaaaaatactgatcagcgttcagttcacacgtgcgaattgaagtctaacatgagaatccacacggagaaagccaagtatttacagtcataaaagtactatcatagacaatttaatacaataacctctgaaaatataaagaaccaattagtatatttgtaataaaaaaataggtacaaagaaggggctttgctctggacgcctgtaaggttggccacagcttgcatacagtctcttagcaaaataattatagtttacatagccatcttatgttatgtgccaaaaattatgtacaattactgacaaaatacaccaaccatttccaacactggatccacactgagaaa

SEQ ID NO: 2493 - DNA, 591 bp, Rattus norvegicus
  Genbank Accession No. AI228696
attcttgctaaaacacctcaaattttactcattttacaaaagtcctaagtgacagacacacagctacagaaaaaacagagcttagcttagcttaaatcctttaaagtcggaatggtcacatggaaagtcatcgtggattcttatgtttactataaaagttaaagtcaaaagtatacattaggatctgaagtgttctcttctttctagagatgtgacacacatgctttctggttggtggccgtccaccaaagatgacagatgaccagaaaaactgtgtcctggcccttccaaccagaccgagctggatcaggggagcattaacttagcaggagacactgtatgaaaacaaacaccaaagtcccaaccccccagtaaaaacccccgctctccggcctgcacgaaggattgcacgcaagcatgcacaagcacacccagcacgccattggacagcatggcacacaaacatgcacggacacacccagcatgctatcccgacagagctgtggcccgttctagcacacagcctgtttgtactggtgcccagcgagaggacaccattggaaagcagtttgcactcacaacacttataac

SEQ ID NO: 2494 - DNA, 272 bp, Rattus norvegicus
  Genbank Accession No. AI228798
cagttacaagtggtgactttccgtttattgctcaaaaacaagaactcagaagcaaataaatgtggagagagagtgggtggggagacacggggaagggatgggtttcagcccatctctcccttcatccttctcaccctccaaggcccagcagcagtcaggcatttgggggtagggagccttcatggccatggggagagtaatgctgggggacagttcttgagtagggccctggcctgcaggagcccccatagttgcaaggggctgagttccct

SEQ ID NO: 2495 - DNA, 390 bp, Rattus norvegicus
  Genbank Accession No. AI228830
ataacagtcccactctgacaataaggagtgaactcattattgtcagagtgggactgttataaaaaaacaaaacaaaacaaaactgagagtttgtaggcggccctggccttcaccaccagcgtaacacggccaccgctttcttaacttctccactaacctatttcaactaaagaagacacgcagaacactagcaaaccaggaagaaaaagctttcactttaaatgctacaaccagcctttaaatcttaaaacaaataacaaaacctacaaatcgcgtacgttcaaattacttccaccatccatcagctacgggcacttcagcaaaacagccccaagaaatattccccaaacgaagaccccagatggaacactgcagatcaaagtccaccta

SEQ ID NO: 2496 - DNA, 486 bp, Rattus norvegicus
  Genbank Accession No. AI228915
cccgtgaagtagctaccacgtcttgtgtcaacgaataaagctccgggacagcggcgccctcggcgacagctgggtgggcaacctgggctgggagcggtggcccgtagcttccgtgagagctagcagcggaagcaacctccagcctggccacacaacagccgccccgcaggcgagacctgagcctggtctggcatgcgcggaatgctccttgagccctcttctggctgttaacttcgggggacggttgtggccacactgacacgtattttccaaataaatcgtttattcttgccgcggcgggaccgaacacgttaatatattttaaatttacccaacacttctatccagtgatacaacttggtaagcgtttcgagcgagcatccgacgggttaggaagtcgcggactgagcagcttgcatttgccacgaccgtactcaactgttttgaagattgctccatcttataactaccagtgtgcacagactc

SEQ ID NO: 2497 - DNA, 503 bp, Rattus norvegicus
  Genbank Accession No. AI229059
gagtaacacacacatatattttattagaaatgggcacgggaggaggggatttcttattctctgggcatatactacactctcaccaccctttctgccccagcttgatgcttctccttggctcacaagacacagcctctccagacaaagcaacaaaggcagagtctgctaacagcaggatggttctgagcccacagccttcctctcctatatgtctgtcaaatatctaggtcgtcatctgggtcttcttggtccacatcatcaaaagcatctggctcgtagaagatgcggccagtggtctggcctggcactggatgcagcagagcttgctgtttttcagagctgaactggaaaggcagagtgaggctgtctttggcttctctttctttcttggataagtgaaggttaaaggtcaaatgactggcaggatccacctgggttgtgtgaggatcccggtgtagctcagaatggaggggaagaccttcatggagatccaggctgaagtc

SEQ ID NO: 2498 - DNA, 584 bp, Rattus norvegicus
  Genbank Accession No. AI229071
  misc_feature (1)..(584): n = a or c or g or t
acagaatgaagattttaattaagctcaagttattaatggaaaggcatatcaaaatagatttcaggaaattaaagaaaataagcaactaacaccattacaaataaacatcaacaagtgattctaatgactctgtaactatctttgaaattaaggcagtcatcttttttggaaagattaactatgtctatgtgcatgagtgcattgagtcccctaaagctgcagttacaggaaattgtgagcttcttcccacggactgctaggaactcaatcatgttctctggaagcacagcgtgctactcttaattgctgagccgtctctccagatcttagatagtaatcttactaaggtaatggcaatgcttagaaagggtaagcaagagggtcacagcagtcctaggcccagagtacagtagagcatctaaaaactgcccggcctgctactgctccacatccagtgcctcttctgcgcctggcctgatactgccatgctctctgnctttaatgcttttaaaagataattttttagttaaaaaaagtatgcatacatgtatgtgcagcacatgcaggcagtgcctgaggagacc

SEQ ID NO: 2499 - DNA, 313 bp, Rattus norvegicus
  Genbank Accession No. AI229087
aaagcctatcttctgaatgagactgcccgatttttttttttttttttgttttgtttttttaaacagaacgccatcttcaaattctcctttccttgaaattaaagactggaatctgggaaggaaagacgggacaagaggagctgtgacagaactgggtccccactgggctcctcatctcgacagccatgcatgttactgggctcaagagccatcactcggggaggcctggatgtgtgacgcctccccggggacaggaggctggtgggtgagcaggatctatggggccgtttctcccagcagacagcagttctga

SEQ ID NO: 2500 - DNA, 557 bp, Rattus norvegicus
  Genbank Accession No. AI229104
aaatgatgaatcagaaacagactggagtagtctttaagaggcaggcagcagcacatgtggtctctcaggagaacagttctaattattatcttaaaagtaaactcacacaactttgtcaaggtcgtaagataaattgctacttgaaaactaggttggcttaacagaggggagattttttaaacccactgaatcaggacaatgaaaaggatttcagaatggcttgaactggagcaaagacccatcagtcccccaacacttctggtgcttcagcatctcagcatctcgaatcacgatgtttcttgtccccgctgtctccatcacggaactaaataattgttgccattttgttaggattcagaatttcaatccagtagccatcaggatcttgaacgaacgccagacctttcattttcccatcatcaggcttcttcacaaacttgacacctagttcttcaaatctcttacaggccttgtagacatcaggaacagcaatcccaatgtggccaaatccccgagggtccgagttgccgttgtggtaactctgcgtctcgtcatct

SEQ ID NO: 2501 - DNA, 605 bp, Rattus norvegicus
  Genbank Accession No. AI229166
gacaaataaccacttttatttatttaaatcaaaagggtagtttcactcagagtcaagtagactaaacatactagacccctatgaaccctagggtttagtcttaagtcttttgccaggactggcttccctggcagctgggcaggtttggaaactgtcaccatattgctcgctggactccagaaagtagcccatggtcagctaagtgtcggaaaacaatgcgactaagtctccagcgacgcttaacaccgcgggggcgagatgtcatgacacaccgatttctgattctaacaggacagctatcccgtggaagggcagcaatttcatcaccagccatttcctgaaggtcttttggcaaaatggtattctttctgagcgaattgatccgaagccgctcatctgcatattcataagccatttttcgtctcttcacatcacgcaacattctccagtctacatagtaacctcgagcttgacctgacgatgacagaggaactgccttcgattgccattaggggtctcctaacttaaccggagcgggaaagcagataggagccttgggattgggcctccgtgcgcattacaggtgtcagggttactagggacac

SEQ ID NO: 2502 - DNA, 467 bp, Rattus norvegicus
  Genbank Accession No. AI229178
attgtcagtataaaaattaacaggttttattaaatactttctccaatttcaaaacacataaaatcagtgtagtctgcactcctgtcacatgacggtagcaaggtgagtgggcgtgtccaaagcaaagcacaagacttgaacacggaaatcaatggtaagcgttctcttgtcgggtgtagctctcgggccagatcttttagtgaggagaggtcttgtcagaagtgggtggaagccagaagcaaaccctgcagaagatggaaggaggtcccaaactctcgacagaataaccctgggctttcactattctccgagaggatggagagtccccaaagagtttttgatgctgaagaatctgaagctgttatcaaaactcacggagagggagcaaggcgaatgtgacgggtgtgtaactcaggcataaggccatctgccagacaagacccaccctgccgtctccgatgggagtc

SEQ ID NO: 2503 - DNA, 461 bp, Rattus norvegicus
  Genbank Accession No. AI229179
aaataattaaaaagagtttattgatattagtgttatgaatgggccagggaagaaaaagaaaaatgacaagcagaatctttatacatttatttataatgaaattatggtctaattatttacaacatacaggaaaccagagtttgtacaaagccaacctgcaaagtattcaaaaatgtgcaaaaatgacagtcagtatctcagacactcctggctcagccaccgattccttcacttccacacatcaatatttgatacaaaaaagttcttttggcaaaagtcacaatgccaagaaaaaaaggacaagttgcaattccagtcagagtcaccgtcctattggtagcatcacatttctcttctcgctgcgaccagttctgagacaaatgagtatttcatttgtgtgatgagctctgaccagctttccatcacgttttctttgaaacgtgaaaacagggaggttggaa

SEQ ID NO: 2504 - DNA, 474 bp, Rattus norvegicus
  Genbank Accession No. AI229183
gattttataaacctttattggaaaggctacaaagtttctattatcactgcattgcttaccttaaagtgttatggggaagtaacctcaaatacaaaactactatgtggttgaattttgccaggcttgttgcaaaatattttttgtacaatggaggtagagtggatagggcagtaatttaaccctcacaggtcttgattagttttgggacattttacgtccacgttctaatagctctagaaatgcactcaagtgctattaggctcagagatggtaaaatacattgaaaaatctgaattcccatttctgtcctgttgttcctttgacaaatgtaaacggtgtggacctggtatgacttggatctcagtggacatgttttaaagtcacatcaggtgtttccatcctatactgtcctttcaccaccgccttaggacagatgtaatccaagtgaggcaccgagcagggagtgggtcaaac

SEQ ID NO: 2505 - DNA, 386 bp, Rattus norvegicus
  Genbank Accession No. AI229192
tcagttcttttgcatttttatttttcttattgtttcaattttaatttcttccacccttttcccaaagggtttttaagtaaagggcagctcaaatcaactccatttacccgggtgcaacacaagcgttgacaccccacttacagcacattgcaaatgtgccccccatctttatgctggattacgaaccgcccatgtgcacgagtggggaaatacaccaagtaaggcgtgtgtaagggcctggttccctgagtgtacgcgctccgcggcaccagtggggtgacagccgagtcacgtctggtccgagtttcctaaaaagtctgtccattctgaggcaaggctcagcagaagtgggggttcacgcgcgggccaggggcacccatcgtgcc

SEQ ID NO: 2506 - DNA, 482 bp, Rattus norvegicus
  Genbank Accession No. AI229253
gagtttaaaaattatacctttaattatagaatattgttaggataatacagctataaacaagacactaggataattgaccaataccaagggaacctgttctacagatttacctgttcatccactctccacaaccatagaacacaggcacagactgtctggtatgtgcagaaacggccagggacttgtgaacagaaggcatgcacttagcgttagtgaagggtgacagttgtgtgacttctgcagctcagcgcaggaaggggagcagctgaccatagctgagtggacagagctggcacagccactgcctttttagccacccagctagagtgtacacatacgaagaggtgggaaggcaatcagaaaccttccaggagccttttcatctcctagaaggcataagcagcaaatgaaacacagcataaccttttaaaggaaggctagggctgggtgtgtgtgcctggtgtgtgtgtgtgtgtgtgcct

SEQ ID NO: 2507 - DNA, 494 bp, Rattus norvegicus
  Genbank Accession No. AI229291
accaaaatactttctacagagtgccgaaccaaaatgtactgtatttagggcatcttttttatggcattttctctgcactcaaagatgatagtcatgcagcagtttaatgataaaaaatatgttaatattttactatacagcagcaagaagttagttgtcaattaaaagcacacaaacatctttaaatgaaaacctgtaaaagactatcgttacaaacaatttcagtggaggacaccagctgggtaaagtgctctcctaagcttgcattttaataccctacactttgaatatgagtgataatagaacatacttttgacagaaggcttgtacacttgggaacacaaatacacttagcatataatgtagccagtaataactagcaccacagctacatggaaatcctttacatacaccaacttggctttcacttttgaaatgaaactcagaatccatggcttcataggataactagaatggtgttgctttgcttttaa

SEQ ID NO: 2508 - DNA, 501 bp, Rattus norvegicus
  Genbank Accession No. AI229307
  misc_feature (1)..(501): n = a or c or g or t
atgagaaacttcctttattcttctaaacaggtgaaaataagcaattcttatatttctcacttgtaagatttttaaattcttaaaaatgcaattttcttttcaaagcacatgccatctttaaaaaattctcagcaatatacatttgcacccaagaaatacatgcagcatcactgccgtctgacaatgtcctgcactaacccaccgactcctgcacatgtgcgttctacttggggactcagaacacaggcttcagtgcaacacttatttccgtaggaaacacaggcccagtggcgtcttctgacaactgtttcccaatggctgagcacagcctccatctgccttaaagcactctcccccgtgccaatgaaagaaacaactagaattcaggagcatttgaggatcccagtgcgggaccgaggagggatacttagggctaccctgtgccacanaacttacgcaaaaatttacctagaaaacaaaactgaaaaaactcttagattt

SEQ ID NO: 2509 - DNA, 502 bp, Rattus norvegicus
  Genbank Accession No. AI229337
actttgtaaatttaatttattttcttaatcaaaaagaagtgtattgtgttaaacttagaatgtttagctttccattgctttccagtacttgccggatagaagctaacagcactcaaaactggggagttaacacccaataccacattttctaagacgttcctcaaggcattggtgattgtaatttaaaaataaaggaattttaattagcattggaaatctaaatgacgatgggtttcaagagctaaaaatcagatcttttaaaaaaggctttgttttattttgaaggactcaaacctgaaggacgcctccaatagaatacagtatgtcccaactcccaaattagtaaattcatcatttcaccttagagtaggagaactataaaatggaatctctaaattattacatatataaatacatcattttaacagtcatgtttgctagcagaattatgaaataaaaaccaaatctacattcacggtacaaagaataatgttcttccact

SEQ ID NO: 2510 - DNA, 435 bp, Rattus norvegicus
  Genbank Accession No. AI229405
  misc_feature (1)..(435): n = a or c or g or t
aaaaaaaagtcccaaagtcttctgggcaacactctaaaacacagtaaacactagcgagagtgttagtcacacccctccctggcagtgctcccatcagtgcaaccacaggctctccaaagtttccacacagtcttacactgtgccctgtcttaaaagtccttacgaggcaggtgtgatggcgtgcacctttgatcccagcaccggggaggcagaggcaggcagatctgagtttcaggacaacctgggctacacagtgagttccaggacagccggagctacaatagtgagtccctgtctggaagtaaaaaagtcctccctgagaggacactgangcacagaggtaaagggaccagcatgaggtcagactgcaagagacgcacaggaagggcccagaaacccatccctcctctgaaagggcattctgtagttactgaa

SEQ ID NO: 2511 - DNA, 485 bp, Rattus norvegicus
  Genbank Accession No. AI229413
  misc_feature (1)..(485): n = a or c or g or t
ttatacaccttgagctttatttagattaaaatgtctcgtgtgaccaaggcacagcatgcgttgagagttagttcttgccttccatttcgtccttccactgctctagcaagcctttgagctttgatgctgtctccacaggtgcacacacacaccatggtctgtggcttcacacatgtgatctaggggacaaccctgtgtcatcagggcaagggcttttatgtgctgagaagtcttcccagcccaatttcttctgtagcctaggctgaccttgaacttctgaccttcctgcctctaccttctgggattacagtatgcatcaccatgttacactggggattaaatgtagggcttagtggcaaagcttcagctccagagcatgttatttctgtcacatcaagaacacaggaagcaaacaggagacccagggacccccctccacagagggcagtgtgggaagggcagcanaccatggtcaggctcccttg

SEQ ID NO: 2512 - DNA, 535 bp, Rattus norvegicus
  Genbank Accession No. AI229416
agtcaccataactatttttattacattacaatgattaggagcagtacagttcatgacaaaaatattacaaatttcagatcacttcacagcacgtactcctataaacatttaaaagttaattttaattaagagtggtcacttttaagtttaatgtttgatatgaccaacattccctaggtcagagcaaccaaaggatggaaaacaactggatcacactgcatatgtcccaaacaaacaaacaaacaaacaaacaaacaaaacaagaaagaaaaggaaggaaggaaggaaagcacaatgtacaaaatgtgcatgtttcagtttacactatacaaaaatagttaaaatacattccaggtaaacatgttacattaagaaatagcactagtaagaaattggcactcaaataaaaatgcagacgtgttttcaacattgaagacatgagacagtggaattgggggaccaggagataaaacagcacatagcccactcagctggctggagttgagtctgaaactggcatttctgcagaacttca

SEQ ID NO: 2513 - DNA, 542 bp, Rattus norvegicus
  Genbank Accession No. AI229421
  misc_feature (1)..(542): n = a or c or g or t
gaaaaaacgttaaaaatgtgtttattaatatctgaatataaaacccagcagcactgttgtggctgacaagatctaaggtttcccagccagtgagaaaggccaggatctaggatcatctaggaaggagactgggtgccaggcacttgttaggtcaccaatcaaccactcagcacctggatgttaccctgcgcaggatagggcagagctggctaagtctgggctccgccaaggaaaaccctctctgctccactcaggctacagccaggaccagaccccttgaaggcgtggctcagcagctcttcaccacccaggtctgatccagagtacaggaaaaggtcctgggtcacagggagccaagcactccctttcacaaaagggtagccagtgctagccgcagagacaggctttcctacctgagatctggtgagtaggaagagatgggagcgtttgtcacagggaagttctccagttgagatgagaagttaccttttagatcagggggtaatgacaggatgcttggtgccagngaccctagtgtctct

SEQ ID NO: 2514 - DNA, 557 bp, Rattus norvegicus
  Genbank Accession No. AI229430
aagtttgcgcccgcaatgtttttttttttttttttttttttttggtttagcatctctccccaagggagcagtttatttgatggggaagggatgagaggtacttttgcccatcagcaggaccacaggggaagtgaagcaaagggtgtctctggttaggggtcctagatgtcccctttccttgcagacagactcctggcaaggtcacacaggctttgctagcttcaggtctcatcgaagtctacaccaccagctggtttcttactagaaggcaagagagtatgtaaggcaaagaggaaaaggaagggaccagggtagggaagacaggtggcaagtaccttttgaaaccagggttgacgagagactcccctggacaccgtctcctgaccccagacccagagctgcctctctggtgatcaagttctggtaagaactgagtgcctgctggctgggtgctcttcctggggctaatggcggtctcttctgtggctgccagccgcctctccaggttgcatacatgctctgccaggctgagagtcaaagcctgcagcctgggggct

SEQ ID NO: 2515 - DNA, 560 bp, Rattus norvegicus
  Genbank Accession No. AI229450
cctaccctgccctttttctacctcaatggtgttcctacaggaaatggataaccattttaactgtatttttttcagcccgtaccttcttgggaatacaattgtctaactttttatttttggtctggctgttgtggtgtgcaaaactccgtacattgctattttgccacactgcaacaccttacagatgtggaagatgtgaaatttgtcatcaattatgactaccctaactcctcagaggattatattcatcgaattggaagaactgctcgcagtaccaaaacaggcacagcatacactttctttactcccaataacataaagcaagtgagcgacctcatctctgtgcttcgggaagccaatcaagcaattaatcccaagttgcttcagttggtcgaagacagaggttcaggtcgttccaggggtagaggaggcatgaaggatgatcgtcgtgacagatactctgcagggaaaaggggtggatttaatacctttagagacagggaaaactatgacagaggctactctagtctgcttaagagagattttggggctaaaactca

SEQ ID NO: 2516 - DNA, 444 bp, Rattus norvegicus
  Genbank Accession No. AI229497
gatggccaggcctgtcattttatttcagcagtggatgaaacaagagttctttgtctggtgtcttagacggcagcagtctccttggcagcctttctctcttccagcatcctctgcttctgctttgccaggcacttcctggcagaatagtaggctcccaggtcctggtagcggtcctggtaggctttagacacttgggtgaattgctccaattccttggcacagttctgcagtgcactctctccttccctctgctgacaagccttaagtctctcctggatgatgttgatgatttcttggtccactttgaagtcccttctccactgcatctcagcctcatagatacagatgacatcaccctctttgcattccgtgatgtctggcactcgacggtactgtcggtggtagtagtaggttcggttcttggcgtgctgttgttcaatgaac

SEQ ID NO: 2517 - DNA, 555 bp, Rattus norvegicus
  Genbank Accession No. AI229502
caaaatatattaaaaaaacaaaacaaacaccaaatagactaagaggttatcttacaccacctgcttctcaagtctttatggagctgcacttctaagtcaatgggtgagttcctctctgtgctgtcagccaaaggagccagcctctgctgtcaaactcggagtcccagcagctgatgacatgggagtcggatctagtattgctagaggagcttgcttacaatggcagctggcatgtccgttagacctctttttcagaaccatttgtctcacatacttggggactgctgtgcagggacacccggtgtggcctgacgaggcaacgtgtacatggctcccaaaaactggtcggcaatccttcctgcttctcgaagcccactcagcagagcaccatggaccgtagctgggtagttgcggattgtatgttctccagcaaagaagagtcttggactgcggatgttttccactcaggaagaggcggcacaaactgaacagctggtggctgctgcttcagcactcccaaaggaagggttcagagcactgcgttacactttataa

SEQ ID NO: 2518 - DNA, 536 bp, Rattus norvegicus
  Genbank Accession No. AI229660
tgtcattgctacagaaaatttcacagaaatcatcagggagtgtggggatcaaggtgcctgccctgccgtgaacgctgcctatctggagtcacagaggaggcatttaggggccagcacaggtggccccaatcaaggtcaggatgcagcttcaaccctgctgcgccaaggccccgtggcacagagggcagctgggtcttcaggatcgatgtgcgcgggcacccttgcggctgcgtgtggcccacatgcctcgctttgagtgatagtggtggtagaaatgtcgaagtcgaagcctctccaggcagctgtggtctagatacctgagataagctcaggaaggaggtcacagactgtgtttccactgaggagttcaagtccaccgtgggcaccatgagtccttgtccgtgcaactggccctcctggcctccctggttggtctgtgccctgactgggggccttagttctgtgaccttggggctactggtcctatagccctgggtccgaagtggatgccggggcacccgtagctgtactttggg

SEQ ID NO: 2519 - DNA, 563 bp, Rattus norvegicus
  Genbank Accession No. AI229664
gaagattttacaaacattttatatagaaatattttatgaagattttataacatagtcaatcattatgtcatactgcagaagggtgaagaaaaatattaaatggaaagaaagtgctcctagcaacgcatggcggtctccatgaaagtgcatcaaaagttaaagcaatgtcccatgttggtactgcatattacaaaaagacttgtagaacagtttaaaaaatatttacaaacagttttttgtttattcttttcagagatattgaaaggggaacctttgtgactattcttgctctagaaaaagacagagataataaacacgtcggcccaagtcagtgaaggtaaaatgctctgtacaagctcatcattgatgtgcagtcctttccaagcgtgggctgcttttctgcctgtcaggtgctaggcctagggccagctctttcatataccaggatagttagtgatcactgacaacagtgactctggttacgtgaggtcctccccattagcttccagtttctacaaccacaccaataacgtgctttaagtccttctgtactgcactagaaa

SEQ ID NO: 2520 - DNA, 464 bp, Rattus norvegicus
  Genbank Accession No. AI229695
aaaaacgtccatcagacagaagtcaaagggtgaggtggttatcaggaacagggcgggtggctccagcagccctctgaccctctctcgtgcagtccttgcttagagtcccaggcgatccacaggtccagggtgaacaatgagggtcagaggtggaaggctcagcaggagagtagaggagcatcagcagaggtcgagagaaggccagagtccagggtcaggcagccttctgtttctttatgggaggacccccagcttcagggacactggagctgctgggcggaggggcgtttggaggtgagaggacaccggatgtcatcttcttgggacctttcttgggtgactcagctggaagggggataccggagtcttcgtatacttttctcttcacagtggtctttatctgagccccggcaggggaagagtccgatactggatgcagctgcatcgtcaactccccgagcttc

SEQ ID NO: 2521 - DNA, 487 bp, Rattus norvegicus
  Genbank Accession No. AI229707
ttccttttttttccaattcccatttatttttggctctcggggcaatgtcatcttttcaatatgaaaaaaaaaaaaaaaagccaagtttaacacaaaatagaaaggtagggaatgaccaagccaaggaacaggagggaaatggggcagagatgttacctcccctctggggagtgtgtgaggcacccaggtggaaatggtaattagagtgtttctggacatttagagaacaaggccttgctgccctgcccccacaaatccccatgcaacgtcccttggagaaccaacacagggaagacacctccaatggcagatttggctcaggacagctaggatataaatggtgataatactgttaatacctctcctgaggccgatagatgaagcagggaaaaaagaaagccccatcgactgaaagcctcagcgattcccgtgtctaaatggccctgactggaaaatcccaccccctaagtagcatctcctttaccca

SEQ ID NO: 2522 - DNA, 581 bp, Rattus norvegicus
  Genbank Accession No. AI229708
agttgtcatcaacagcccagtaaggccgaatatttattagacccacttcacagatgagaaaacggaggcaagcaaaaccaaagtcagccctagcaagtcacacaagctggagatggcagagctagtgggaagcctaggtaaatttcagttatgtcctgttggcctctgaacctaaagatgtgtgacccaaggggcccaacaagccacagtaatccattctggtggcatcttcttcagctttaggaccggcgagcatgaggcactggaatatctccttcagcatacagtttgagggaaaaatccagggctggagcagcctgggtcagcattcccaacgagatgacatcaatatttgtcccacagaactgggggaggttgtccagtgtgacacccccactggcttccacagacacgttggggaatttggctttaagtgtagctgctgtggggtgcagctcctcaggcttgaagttgtccagcatgaccaggtcagccccagcctctgctgcctgcaaagcctccttcaggctgctacattccacctttaccttcaggggaaagccagctgcctgccgggcctt

SEQ ID NO: 2523 - DNA, 490 bp, Rattus norvegicus
  Genbank Accession No. AI229793
taagggaggggaggcatttgctctacgctgagattcgggttgcgagagcagatcctaacgcaacaagacgctgctgcagcacacttcttaagaggtcgagtttgacgcctgggatcgggtagggcgagaatctgccttggcggcttcggctacggctgcggccaccgacgggcactcgacgtctgtcggtccgaacgctgggtcgcgctggtggccgaggtcctggctgattcggatcaagtctagtaaccaggaagctgtctccggagaccatcgcccaagccatggccgacgggttgagatctccttgggaggatcggtgggccatcctgttggcttgatcgccggcggacagcgacaccgagttctgggccatcttcaaacaccgactgcagtgtttgctagacgtacgtcgatcaaactgagccctcggcagcaccgcagatcactccagccccgcgtcggacgcaaccgttaccgatcccagcct

SEQ ID NO: 2524 - DNA, 398 bp, Rattus norvegicus
  Genbank Accession No. AI229844
ccaacagtcattggcaacttctaagttcttagcctgtgggagaaaatgtgtttcaaagaattaaaatttttaattctacatgatgccagattcaaagaatattcccacagtttaggggagtcagtcagcaggtctgcatacacagaatctatctacccaacacagatgttcagaaaggctactttcattcagcccattcagagcagttgaacattttgcccatcatcacaacatcatttatggtagtactgttcttttcaaatcttagcagtgaatttcagtattatcatctcacaaggtttcaaagtccacatcttaccagaagatttgtggatttcttcaatttactttaatttagggacccttcttcaattagctttaaaaacctgtaagattgg

SEQ ID NO: 2525 - DNA, 545 bp, Rattus norvegicus
  Genbank Accession No. AI229902
aacggttgggtaaaaatatatttccccgctttaagtcttggcactagtgatatatgcataggtccctggcaccacactacattaacagacaccaagttgctcggcaggatgctgagcccgcacttccatacttgtcggaacagtatgcttcacatcaatacaattattttagttcataaaaaaaagacacgtgtctaacatgcagcttacatacatgacaatctgcattaacactgaaagattacacaacagtttagaaaacattggttatcttcaaacagcaaaaaaaaatgacaattctacaactacagtttaaggcattatcagcatattttaaaatcaagaaatagacaaaagttctaatgctgttcacagcttaattttcaatttatttttaaaaattcccttcatacctacgtacaaactagactctgaaggtcatgattcagctaacgactccataataaatgttctgtcaatagaactaggactttttggaaccggacaactccagacacttgtgaatggcaaaggagagggattca

SEQ ID NO: 2526 - DNA, 471 bp, Rattus norvegicus
  Genbank Accession No. AI229905
aaaatttgaagtgctgactttattgttgaaagacacattaaacttgatttcagaatcagacttgaccatttgatttctgtacaaatgactgaatatataaagtaccaaatataagcagtagtgtagcaagaaaataactggcagaataattattcagccagtaccaatagttaaaacttccaaagatctttttctatgcacaacaagggcggaaacgttgccagaggttcgtctccgtggctactgctatacttctttcttcctcaggatgagaggacccacgttatcgcctgtcaactcattgtgcttattgtgggacccgtcacaggcagggaacgtcttggagcgccaacacctacaataagctgctttcgtaagattcaggtcttcaatgtttatttcgttcaccactttgggattttctttctgtatcttaaggttaatcaagctatccttctgttgcttcttctt

SEQ ID NO: 2527 - DNA, 551 bp, Rattus norvegicus
  Genbank Accession No. AI230004
gataaaaatcagaaagcgacttaaaattgccacattacttttcacagcgggacaggaatctgtacatctcatttttgcagaaaagtagacaggcagaaagaataatacacaaatttccaaaggaaagaaagacatataccatgtgctctcactctgtaaagctcaggtcagtagacacctgctctccggtgcggcatggggctctaggctttaggatggatcagttcttcgcgtcagtgtaaggacaccttggtcctttttctttacattgaaccctgcagcatggaaaaatggttactatgcctttaagttccaggtatgcaggacctggaaccaagtgttaagcaatttgcttaattattgacttctcacaggaaaagtctgggggaagggaacagagatgctcttagcctctccagagtctctgctgtacatttccaccagaggactgtggctgtgtaaaaaggaaggctagcttcgttcagttttcaaggcagaaagtgtgtatttgaagtgagcttcggtttctggttggggacattggatcctcg

SEQ ID NO: 2528 - DNA, 528 bp, Rattus norvegicus
  Genbank Accession No. AI230038
aattgtttcaaaccatgggtttatttgggagggtgacctctctaattactgctaagaagttaaggattgggtacagacataagaaagctctaggtacatctgaaagccgtcgttggatttggagacgaggttggcacaacctacagaggaatggactcctggggagaattcagtgtgattgtcccaactcctggctaacaacagtgggagtgaaggcctaaggctttggtctctcaggagaatggtggggcctgcacagggctgtctgtgcccagatattactgatgggaggtgacagaacgcttattttcggacagggtttccacagcctgcagaaggtttagaggtaggcggagctaagggcccgggccctttctggccactgacaggctgcacaggccctttcttttttgggattaaaatcttgttcttgctcttgaacactttgctggggtccagcttgttcacaaaggtgtcgggctcttctgtgagcaggctcgtgttgtaggtgatgggttgtacatactg

SEQ ID NO: 2529 - DNA, 551 bp, Rattus norvegicus
  Genbank Accession No. AI230110
aacttgcaggcaactgtcaggccagttgtcttcttcacacatcatgtggaaaggagctctctccaccctagttactctgagacatgcagtgctgctctggcagtacccagtcctgagagatggagtcatagtcctgtacccagtttcttggctgctccccagttcttccatttttctctttgtgtcaaaagagtactctcataatggcagggactgctggggagggaggaggcaggcccactgtaggacagcacattccacaggttttagaataatcattcctataatctagagaaataggtgctatgaacaggaaattaagcaaaaaggctggatgctgggaatcttttgtcttaatttttttctattaaactacaagctgtagctgtcttagttctcacagaacttctgtctttttaaactgacttgtgtgtttaaaaccagaacttttgtaggacgtccgtgccgttgccagaccgtctcctgtgatgctttcggttgtcttgagattctctgtttttaaaaatgtagcattttgacttttttgccaa

SEQ ID NO: 2530 - DNA, 480 bp, Rattus norvegicus
  Genbank Accession No. AI230121
tttttttttttttttttatttgggatctttttttatttttatacacatgacaagattttacaccaatagtcagttaaatagtacaaatttacattcaggaggaatgttaaaaaaaaaaattcaactaaaaaaaccacttcttcctgtgacccataatcccaacattttacagtgcaggggagagggaggcttgggggagcatccaaaacaagtctctcaaaagaaataactttaaaatgtcacattccctctccacacaggattcatagtgagagtataattacaattcatccttctctgtaggttccttttctgtttcctgttcttcttcttcttctgcccctgcgtctgtctcttcttcatcctgctcggagtcatctgtggtgtcttctgtggtgtcttcaggctcctcctctggctcttcttcttcctgtgacccataatcccaacattttacagtgcaggggagagggaggcttg

SEQ ID NO: 2531 - DNA, 501 bp, Rattus norvegicus
  Genbank Accession No. AI230125
aatgtttaagaaaatgtagggacaggaggcatggctcactagttaagaccatgtcataccccaggtggtggcatccgctctgcaggcagagaccagtcattgctgagtttcaggacaaccagggctgtatagaggagtctccccaaagtgaaggaatgtgtcctgcgtttgttggaatcagttgaggttcccagtgtgtgtcctggctcacaaccaccgctccttcaggatctgacaccttgaacttttgtgctcatatacttaaaacacatgcatacaattaagaaatacatatgttttaaagatcaaagattaccttttttgccccagtgctcatttctcactgctaggttaaggaaataatagatttagtactctcttctcgagtacttgaactgtataaatcattccaaccctgcatggaaaacttgcattacaaatgcagatttttagcatttgtttacctgggaagattaacttacaaaaattttttactgtctt

SEQ ID NO: 2532 - DNA, 440 bp, Rattus norvegicus
  Genbank Accession No. AI230130
ctaggaaaaatcttttattacaaaagtttttacaagtaggcatggaactgactcccagcctgtaggctctggtgcctgcctttctaaaggcccagacagaaagttcccagggccctgaagatcagaacaaaagtcccactccgaatggacctcaccctgagtcacaggctgagacctgacatcctaggaagagagaggaggattaattgagaactcagggctgcccacgtaggctttctgtgaatgtagatagggaacgttggtttccaggctgcttcagggtcagagatgccctctggaagggagggatagtagggagttgggagaggctcccagttcacccctagagggcgcctggagacttggcagaacgcacctggcgcaggagcaggaccagcgccgccaagatcaggactgtgaagagcagcaggagagcgacc

SEQ ID NO: 2533 - DNA, 614 bp, Rattus norvegicus
  Genbank Accession No. AI230166
cagaggtaaaactttaatctcagagcgcccttcccgatccccatcccactctcccgcacccaagtccagggccagaaaatgaggccccctggcccccccaccttgggtgggagagggccttttaaggcacctgttagggtcgggggacaggaagctggtactgtcctgggtacaggacaagttttgatggacaggctgtcgtgcggtgaaacctataggggcgttagacgcagaggaggactggactgtcccctaggggaccggatgtcaggactcaggcaaaggaaaaaagaaaaaaacaaaaacaaaaacaaaaaaaagattcattaacagccctagtagtgtaagaaatataaggcctccggccaattctgggttagggagggcttggccacactcccaggaggccgggaccaatcggacaagggaactctggaacggaagctggcaactcttcggacactggctgagcagagccagctcccgcagctgggctccgccctggggccgcgagtcaaggctgtgcgggcaaagcttctgttgctaggcaagaaacggagttgaccctctgagagtttagaactagccccgcccaatcggagcgagccaatccc

SEQ ID NO: 2534 - DNA, 590 bp, Rattus norvegicus
  Genbank Accession No. AI230199
agctttctgttctttttacctctttctctgtaacttgtactaactctcagcaacttaacttaaccctttaaatttttgtaactttttcttcatatcctttctttatcttagccagattggtggggcattttttagcccctcagagacccacccttggagcctggcggcagacctggcactccctacctttaggcgtctgaaaagagcaggcagaagtgagggccttccatccatctctggaacactttttctggcctctagtaggattttgtctttcctcggtgataaagaagacctgtaacagttactaacaagcatctcaaatgggatggtgagaaaacaagagaatcttgagaatagaggtccactgaagagggcaaatagcatttagtcacacagctaagccaggaggctttcttgggacaaaaagaccttgtgtctgtgaaacagagaagtgagcagaggggcagtctatctgttacaggttgtctctctggacttagattttcccttaaggagtaccttcctttagtgtcagctcagtggctttatcgctcaagagacccatcctctaaatcggcacgaggcct

SEQ ID NO: 2535 - DNA, 553 bp, Rattus norvegicus
  Genbank Accession No. AI230215
aaaaacgatagcaaactaagatttattgaaaacagcaagctttccataggacgagtcggctgagacgctaactgctcagaaactgatgtgtgtgaccctcagcaaaagaaaacccatctgaagcactcccgtccagaggacagaaataacaacagaacagaacagggagagccagccgtgcgcctagacctgcaaggaccacacaccctatgctggctgcatagcctgcctgggtcccggggcaaaggttacacttgccctccacagtgctccaagcagtgtccagccccggtgggatctcaaaccacggatggttctcagtgactccacaccaagcacacaaagacccccactagccctgtgttccccatctaaattcccactaactacaagtgtgcagcacgacatcacagctgttggagagacgcaaagcaccgctgcaggtgtggcaggtgaggcacccacaggtgtgtgttctgccactgcagtccctgctgccacctgtgtgccttgccgtcctctcatcggcctgtccggatgctgctgcagatct

SEQ ID NO: 2536 - DNA, 626 bp, Rattus norvegicus
  Genbank Accession No. AI230228
caatgttttttttttagatgactcaggactttaatgttcttcatatcgtcaatcgaaaacactaacacatgaacaaccagaaaagacctcagcaaagatctggaatgtacagattgccctggttaaactacaaaaacagccatgcgatcacagtttgggggtgggggtgtaactgagttttgtttaacggcctaaccgaaaagcaaagaaacaaccatttcttctacttgtggcaagaaaagtaaatcatggaactcctagatccttctcatgaagcagctttaaaaggcagtaggtggagggtgccagtgtccacaacagacgacggtcatgcacaaagtcacgggctgaacgaactctgaaaagcctctacagaactgtttcattagaaattcaaaagcatagatataaaccgtatggtgtttaaaaaagttcccaccccataaacacggcctatcatgcctgtctttttatgggaattgcagtacacagatccagaatgctcatcagtcactgctgactttaaccaacagctgcagaacctggccgactcacagctgtccatccagcacataggacctctcaacctccttgggatacgctcctaacgataaagaaccagttgg

SEQ ID NO: 2537 - DNA, 466 bp, Rattus norvegicus
  Genbank Accession No. AI230247
cccagctttttaagttgcatttatttttgataatctgtactgtagccaatcaattctattctccattcttgcttaattgtattagccataaaggagttcaggttcataggactcagtttctctattaaaccgtcattgattatggaaatactgtcttaagcactatgcagattaacaccatacttttcttccattacatctttcaagacagtcactcacaactcagaagactgatacagcattagatgaaaaaaacaagattcacagatatatgtagtgaaactcaaactaggagtcttagagataaaaaagataagtagatatttaaaatgtagtctgttaaagatttaatcggtttaaagtataagattagaaagacaaagtttctattgttttgaaagttttaagtaaagaaaaaaaaaactggaaaaaatgtctttgttgttctttctccgttcttaattac

SEQ ID NO: 2538 - DNA, 418 bp, Rattus norvegicus
  Genbank Accession No. AI230284
atgcaaaaatttatttgaccaaaatgtagaaaaagtgataccattacgtatgatacaatcgcaagaatctaaagaacagagtagattttatcagttgcacagtttgctaaaagttcatctccctggtagtgtgatgcttaataaataggagtgaagggagtgtgtacatggaacagtattaaagctcgatcggaaggcacatgggcagcagtgatcaccccagcattctcacctgggaagctgaagtaaataaatctgttctccacggcggagtgtggaacagactcagtaagatcgggccaatctacttgtgctttatgacttcccatagacgggttttaatttttgctctgggtggaaaatttctacatttttcttgcaacaacccctagccgctccaacatcagaaccttgtgcc

SEQ ID NO: 2539 - DNA, 576 bp, Rattus norvegicus
  Genbank Accession No. AI230360
tgcttttgaaacttgaagttaaggaaacagtgtggtgcaagtactgctgttctagcccccaaggagttttctgtacaaaattttgagaatcaataaagatggaagggagaatttggaatgtttgaaccacagccctcagaactttagtaacagcacaacaaattaaaacaactcatgccacagtacgttgtcttcatgtgtcttgcaatgaactgtttcagtagccaatccttttagtatatgaaaggacagggatcttttttattgttgttgttgttgttgttgttgttgttgttgtttttgttgtttaagtttactggggaaagtgcatctggccaaatgataggatagtcaagcctattgcaacaaaattagaaagtttgttgtataaataagcatgtaaaagtgcacttaaaatgaatctttattattcccgagattttaaatagacaatccaaagtctccccttctcttgccatcatcttgtttaatcaactatttttcaaggcactcgatcagtgttgcagcataatagaaagtccaactactgtgccttgtggtatttatttacacagt

SEQ ID NO: 2540 - DNA, 518 bp, Rattus norvegicus
  Genbank Accession No. AI230370
agattttgattcttttctttatttaacaagatatctatatctttgacatttaagatttactagaataagggataaccaacttcaagcatcacagttactaaccataaagaactttaagcatggaatcttcaggaagaaaaaataaatcttaaaagggtggggggcggctgctgggttttgtgatatatcccaagtccttaaaatcccacgtagaagctgaagaaactaaatgtcaaccaggggcagggtttacctcatggccgtgttcagctgcaacctctgataaatcgtttacagaacactcaagtgttgatatcgacatcacgggcttgtgttttctccacttgaattacacacatctaaggcatagttgtggctgcataatctctgactgatccaagcatggaaacagctgctctgtgtgttcaggtaatacatacacccggacaccagtcacccgccgccaaaggtggccacatactggcccaacttcgcgaaacaaaagccgccagcattag

SEQ ID NO: 2541 - DNA, 536 bp, Rattus norvegicus
  Genbank Accession No. AI230428
aaacccaaaagaattttattgaagtagtatatgacaaatacctaagaaactatttctttacactgctcttgtattcctttcactgtgtacattctcatataactgtaaggtttgttcttagctctgggccctgcagaaaaaccatgttggaggcgtagctttgttctgccctccacaggtcagaagttgttgatcttttgtagcagggtttggcgccgctcctcagggctaatgttcttggcaatagactttaagaagcgctgctcatctaccttctggagcaaggagctgacagaagggttggttttgcttagggtctcatagcaggtaaggatttccaaggccagtacgtagaggggttcacagacctcctgagggagcatggccatgatatgcagaacgtgacagaacatttgggtatagacaaacaaggtttcctgagtaagatccccttcttgtccctgggcccatggacccactgactgaatcaacctgactgcatccaggacactggtcagactgctacacaggaattt

SEQ ID NO: 2542 - DNA, 663 bp, Rattus norvegicus
  Genbank Accession No. AI230431
cttgtccaaaagaataacacagactttattagaaaattatgaagtattaactgtcaactgaaagattacagttagggggtacgcagactcattaactgcatggatcacagcatagccacagcttgctactcagagttctaaagaaactgttcatgttaagaagtagctcttctaaattagaaatacgcagagaacaacaactagcagaaaggcaggagacatacaggctgcaggaagatgcgacagttctgaaatcagaccacttgctcgtgaacatctgtaagcatcacatcggctctctctctgaatttatatacatcaaaaatatactccaagctggtcgcggatggaaaataaagcatacaatttaaaagcaaaatggtgagcatttacaacaaaatgtgaattacctgtacacacgttttaagaggcacaatctgttctatacagtaactgtcatactgaattcatattatacacagtgctatctgataagtggtttgagtgaaaacacagtaccgaaacattgatacaaaataaattacatattacttagtaattttaaagttacagacttcaaaaaaattttttagccaaatgttcaactaaaaacaaattttatgaaaaattatgtcagattttacaaatggcccctttcaggct

SEQ ID NO: 2543 - DNA, 546 bp, Rattus norvegicus
  Genbank Accession No. AI230439
  misc_feature (1)..(546): n = a or c or g or t
ggagtttcaaaagtctgttcagtcccaggtgaacgtacacttgcaaacaagccacaacactgtcctacaggccccgggaacccggggttctcagaagcccgtttcttctgggctcaaaccccaggtggttcaaagcaaggatgaccccaggctggcaaagtcctgattttcaggctcaggctgcaggtgacccttggtgtagctgggttataggggcagccaaggactcaggctggggacccacaagcttgagggctcactccccgttgtgcctggcttttccagtcatccgacggcggcgctgggtcttgctggtacgagtggcacttggaggtttcttggtggagtcctgcgcccgccgagggtgtttcctcttgaccttcttccgactgtgtgcatgcagtgtagctgtgagggaggagatgcgctgagagagcacgggatccttggacttcttgggcaaggcttttgtaggcttttccatggatgacacctnctgctcctgggacccatcctggtccccttgctcaggcaggggtagaccta

SEQ ID NO: 2544 - DNA, 513 bp, Rattus norvegicus
  Genbank Accession No. AI230503
tcaatatttagtctcatttttattaagactgacaattattgaaacttaaaattaccagaggtgcagaaaacagtaacaagcaattaaatcctgcaacgagtgttgctcgaccacgcatttagaaaagctatgtctcagtctcgtgtctgtattatacctggaaggtccccagctttgtccttcttgactgcagtccctgcaaccagttacacccatggaaatggctccaaatttaaactcttagtggtttaaattatgaagtaggacttcataaatttgaaattttgattttcactttgaacctatggtaagtaaacagtaatgggaccatcactactgtgctggttgtgatcaggtaataatctggtgacatttaacagtttcacatttaaaactgagcccaaggtatcagcagcacaaggcatttgcactgctggctctacagcacgttactcttagcaacacatttaagcaaatggcagtgttcaaagtacaaaaattctatccaggaga

SEQ ID NO: 2545 - DNA, 642 bp, Rattus norvegicus
  Genbank Accession No. AI230547
  misc_feature (1)..(642): n = a or c or g or t
agtacttttaatattaaaacaactagttttttaaaaaagagaaaagccgaaggtggcatctacagggaagcccatcctcactgccagacacgtgcacgtgcacacgcgcgcacacacacacacacacacacacacacacacacacaccccgatgaccaacttcagtcacgatgcccagcagtttccagtcacatgcgcatacacacaggccaggagcaagtaccaaactgctttagaaatgactggccagtgcagtccaggcgttagaaaaatactctgcttgaggagaaaggaagtacagtatggagtgcaagagagaggagcctcgcacaccccctccagctgaccttaaagctgggggtgctcagggcccagcatcagtaagacgggtcagtgttaaggggcttggcaagactgcccgacggacagatggtgatcactaaggtgagcaaacccaggctactccagcccgcagggcaggcaggccctttcagtgacagcctgagatgggcttgctggggatctaggagggtaccacgtagaagagggtatggttagttatctatgcccaatgtaggctgctgaagcactagctactaaagcccanagagctccagtctccagctaggctgggtccatagt

SEQ ID NO: 2546 - DNA, 637 bp, Rattus norvegicus
  Genbank Accession No. AI230602
agtctctgtttagttatattgaaaaggagcattattttcctgcataaatgacaatcaatcatttattggttcatttcatctccactaacacatcgtcattcaccatttaaatacctgacttcgtcagaaaccgtttgaacactttttcttcttcctgccataaaaatacagtaatttgccttttaaaaaaaaaaaccaaaacccactctgaccaagcatcctggtccctactctcctcacgcttctgagacagatgtttacagcaggtcagcaggcggaagctgagaagccagtcttctacttgaaagggctgcactctggagtctgttctctacgcccttcctcacggcctaacttatgtacagctgaaactaccaactgcagactactacacagtactcattcctctctgttctgttagtttacgtaaacacaactcacttctaacatagtcagaaaaacacttaagcctcaaggtccccagtgatttggagtactgaactagctctgccctggcacttccgacagaagtagcgctttactcagagagaggtctccgtgagctgctgtgaggacctacgcacacacaacactgataccagtcactgttcacgcggtttactcttcaggccgtcct

SEQ ID NO: 2547 - DNA, 492 bp, Rattus norvegicus
  Genbank Accession No. AI230632
caacaggatctcaacattttaatttaaaattaactaataaatcacaattctatattgctttaaagattatttttgtttaaaaatgacacatctcaacattaaccatttctctttgctattccaggttagtttatccaggtcagaaagaataaaccacagtgcagctcccttaacctcggagtcaggtttgaatgacagagtccgtcgccagcaatggacacgcagataaccatccaagaaagtgaaaatacaaaccccagactgctctgttgcctaaaagcccttgtggagtcacagcacaggaggggcaggggcacgtgtcccctgcgctgtctttgacgtaggatggagcacctccttgagcagtccaagacaagcagtcccactgtgtggctggctttctactgtgtggcagcactgtcaccacaatccacccagacagctgtttacaaacagtgcacacagccagagcatgaggcagcacagcgtccc

SEQ ID NO: 2548 - DNA, 486 bp, Rattus norvegicus
  Genbank Accession No. AI230660
caaaggtttttttccagaagaacctggttttgaacatgcttggagagaattagataaagatgctcctcgggctgatgagattacacgccgactagcagtttgcaacatggactgggataaattaaaggcaaaagatctgctggctctgttcaactcatttaagcccaaaggaggagttgtattttctgtgaagatatatccttcagagtttggaaagcataggatgaaggaagagcaaattcaaggccccgtggagttactgagtattcctgaggatgcccctgaaaaggactgggcctctcgagagaagctaagagactaccagttcaaacgattgaagtactattatgcagtagtggagtgtgattctccggaaacagcgagtaagatttacgaagattgcgatggcctggaatttgaaagcagttgttccttcatagacctaagatttataccagatgatattacctttgatgatgagcccaa

SEQ ID NO: 2549 - DNA, 556 bp, Rattus norvegicus
  Genbank Accession No. AI230668
ggttttgtagataaagacttaaatttttgtgcaaattagtggtggtaaagcacacatccattggactatgcaaattgatttctagtagcagcactgagcaactgggcatttgctagcacacaccctttcctctcacctgtactagaacttgggttgaggaatgaaggagcagccttctgtttactagaaaaatgtttgggttcacatgtggtgctgctgccctgggtacaacccacctatacccagggccagccagtatcaccagacctctgctgggcccagccaccaagcccagtttttaatatgtagaacacatgggctcaagttgaaaccttgtgttttatagaacggatgtgtaggtgaagaaattggattttggttatgtttacagcacttgggattgtgttttcttgtacattttgtattttaaaatcgtttataggagtgcagtgctccttatacaaatacaaagggaagatgagccagcagttcaggctcctcctcagttacagtgctgaaataataaacagtgacagatcaaaaaaaacctcgtgcc

SEQ ID NO: 2550 - DNA, 630 bp, Rattus norvegicus
  Genbank Accession No. AI230702
caaaagttgggtattgtttactttaagcaacagtccaggactaagaagtacagggatgcgactttcttcatggtcaagcaccagcgtcatgcacatggcagagttcttccagcgtcatgcacatggcagacttctttcattaggagtccctgtgggccctacagccccactcggggacggcctcccttgtggcttcaccttgcaattccaggcagcttgcttgtatacctgaagccatcctctgcactggtggctctgcccacggccggccagtcacagtggccattggcttcctctgctttgcaggcagtgggatgtgaggtatggccactttgatcattccatatggcacaggaccatgcactgtgcaaaggacaccgatgtatggtggggcaacagcaaggagagcagagcgctgccctggggacagctgggagcaggggctgcagggcagggcctgtggctgctgtctgccccacagtaagccaagtacagcgtcaaaatccctggtacacaagtctctacacatcaggaaccagatcatctgttcttaagaacaggctactactccggtctactactaaaacacactcatgccgcggcccacagacctaggagtcagacagaccc

SEQ ID NO: 2551 - DNA, 585 bp, Rattus norvegicus
  Genbank Accession No. AI230716
atgcaaaaatttatttgaccaaaatgtagaaaaagtgataccattacgtatgatacaatcgcaagaatctaaagaacagagtagattttatcaattgcacagtttgctaaaagttcatctccctggtagtgtgatgcttaataaataggagtgaggggcagggttcagataagctataagcaggtgactctccgtcagcactgtaaactcgaggtggccccacactgctggggaatgtggaatgtttcagggagatgttaactgaaaaagcaaaactacaatgccaaaaaatatgtgcagcctctagagcgctccacgtccagttcagtcaggagttctcggactgtattagtgtcattcccaaaggaattcaagtctcagcaaactcaagctcccatttcttgatccctgaacaatggatatgaagttaagccaattgctttctctatcactactttgcggctggagagaccctttgttgcctaacccttggcatcaatgttctgatggctggcaacctgcatattatttgagacagagtctcgctgtgtatcgctggtacctggctttgctagcagtcttgat

SEQ ID NO: 2552 - DNA, 729 bp, Rattus norvegicus
  Genbank Accession No. AI230724
agttagaaacattttatttaaatgtgtcaaataaaaacctacatttccagaccataagatgttaatacattcaacaaaaacaatatttactgctgtgaattttacagagtaataatccagatccattttgattagatggttgatgaaccttcctaggttacactttacagacataacaaatcccttataataatgtaaacaaaataacttttccctaacgggtgaacttgagaacttcagtccattctttctggacttgcacttctgtgtggacttcctgatggggaacgacttcttttaggagatggagatctggattttgatcggctgcttcttggtcgtgaaatagacctggatcttgatctcgaccttgagcgggatcttaataaaaaggaaaggggacacaattacaagaatgcctttataactaagcaccttcccagagagtagataggataggaaagagtagaaacaattactgcacaagtcttgcctctcacatggatccaatctaagaaccactatttcagatgcctacctccaccatacacagtatggtcactacgcctacaaagacacaacagtcccactttctaacactaatcaccacaatcaccaagtggttccatccaactgctgagctgactttattcttgttatcataagtgctccgtttgtcaaaccaaattaggctgaccatatcttttgaaaatcttgggaccctttaat

SEQ ID NO: 2553 - DNA, 693 bp, Rattus norvegicus
  Genbank Accession No. AI230737
aattttgagactgggtctctctatgttgtccaggctagtcttgaacttctggattcaagtcatctacttgtgtcagcctcttagctcctaccaccacacttgactttgcttgtaactttgaaaagtccattcaaaattaagctcttaagagactgaatggaaaggcaattttgtctgaaggatatttcctatgtaagggagaatagcatttgcagaatataattctggtgctgctagggaaaaatcagtacgaagttatagttcccagttgcttttaaccaactacaaccttctctcaatataaagtattcaagaataaagagtatggtatctacttatcagaaaggcatgtttcctattgggcaaagttagtgaaaaagtgactttactcatttttgcatttacctcggctgtataagcatttcctagcgcatggatgcttcttccagaaatcaagaaccaggtgaatacaggactaagaccttcctggatgttcttcccacatctagtatgttgaccccaacactgaacttgcaaatcttaagttgaccctgaatactcaggcttcccctatttcctttcagctgataacagattcttttgaaagctctcagcagatctgtatagttgcttacctgatataaatgcatatcaatgcctttaaagtatgaatctatgccaaagatcatcttt

SEQ ID NO: 2554 - DNA, 639 bp, Rattus norvegicus
  Genbank Accession No. AI230753
ggtatgaatctcatttatttaaaacagtatttctcaccattctcaaattgaagactgcaaaaaatagaagcagcgcgttatccttggccttgggagcaggtcgctgccttccccctctgcagccctaagccagtccatcccaccgcaggcagagcacgcactttacaaaacagtcctgaagcttaatcaaataaaactattgtacacgacatttacattagaaaagagctgacgtaggaaaactgggtgtgtggttccctttaggtgaagaccgctccacagttggggcaccttcgcttcctcagcgcgaagcagcagaggaacccgaaaggaaacaggacgatggccaagaagatgcccaggcaggtgaagcagtattccaggacaccaaccctgcagaccgggcagcctccgaccacgacgatggagttggcaggataccgggtgaccgctcgactgtggatgttatagacccgggggtggctggtggggatccctgtgacgaggtaagggtagggcggcggcgggggcgcggtggggatggccccgtagccgtgcgggccgcacgcgtagtcgccctggcctgcctccaggttgtaggcgggcgggcgctcctgcaacaagggcttgtggtccatc

SEQ ID NO: 2555 - DNA, 641 bp, Rattus norvegicus
  Genbank Accession No. AI230758
ctctgaagcaggtaaaatttattaaggcattatctaagggacagtggattctcagctctcactttctcatctgaaacgactgcaacactccagttctccatcctgtcacagttgctggattcttggaccaggtatcagggtctgtcagaaaagctcttgctattctgggccatgaatgcaggaaagaaactggagtggaatgtcactatgcctgatttacttcaagacaaggtcttacgtagtctaggctatcattgaatttgctatgtggcagtcaggctttgaactgaccctcctgcttctacaccacagggctggcccaggatgacaggcttgtgctatcactattcatcatcctcattttttcaggaaaacaattttttccagaacattctagattctagaaaaaatatttttgctttaaaaagactgatgggaaaaggttaaacacgtctcattcagactcagagtaggggaagacctgctgtgcaacaggactgttgggaaaagcagtcaagtcagataggtgttggccctggtccttctccctacttctcttcaggggctttctcagtgattccaggagcaaagtcctcaggtcgtcgaggccaggaaaccttccctaacaagtccctcgtgcc

SEQ ID NO: 2556 - DNA, 663 bp, Rattus norvegicus
  Genbank Accession No. AI230762
tgttttttttttttttttttttttattttatttatttatttatttttttttttttttggtccacacagggaatttcacattatctggcagcgcaggggcccctgtgggtcacatggtcacgtggggcattttcagagacccagggacctagcacagctaattgggcttgctcagggatgcagggaaaactgagaccttcatagaccagagggacgagggagggctggctgcaggtactggggtttgcctcagtttccccactgggcacaggagggtgaagtctgagggtgttgggaaagcaaatttaatccctcggaatgcccgcagtatattaaagcctggtgaacccgatacctttgggagcaaacaaagcacaaaattccttctcttctttcattgaaactgcctgtaggggttggggatttagctcagtggtagagcacttgcctagcaagcgcaaggccctgggttcagtccccagctccgaaaaagaaaaaaaataaaaaaaaaaagaaactgcctgtaatttccttggttcacaaaccacaaaaaccatgttaaagagaggaaaaaaccgaaagctctttgggccggcaccttccaccggccctcccactaggaaatgcactgcctcgctttcccaccaaggaaacccatgttccc

SEQ ID NO: 2557 - DNA, 438 bp, Rattus norvegicus
  Genbank Accession No. AI230884
acatttacaaacattaaatttattataactagaatgaatgtaatggttctcagatttggccaccttatagctccgattaaggaggggattttttttttaaacagaaaaatgcattataacttggtcagattacctgcacattaagaaacaacatctaaggaggaaaacaagaaaagcaacccttcagtttcacataattaaagaacaggagaaagcacacaagcaacatcatagctaaatttaccaaaccaaagccagggcgattttctcttctgattatgtgtcataaaaaggtccgctgtcttatatacacatgtatataatgttacattccagcactgtaaaaagtcccctttgccccctccccccaaacttttcagtctagtcgccgaacttggaaggaggcgctcgctcctgctgccggtgcatttcgttttc

SEQ ID NO: 2558 - DNA, 481 bp, Rattus norvegicus
  Genbank Accession No. AI230939
ctcatactgaatatttcaaatattttatttgatcaaagtaaaatacactttccactgctataaactacagttgttcacacacccacatttttttacgatgtgtcaacaattttgtattctacataaaacatttggtttaaacaaaaaaagaaaaaacccttaaatgctatcttctctcctgtcttctaagctcttcaggcgttttaattgctgtaaggtttgacttcccagatatctagacggtatgagggatggtgggtaatcacatgaactttaaccataacgagggtatcaatgacaaacctgactttggctgactttgttgagaacaacttgggaccaggagcagagatattccaggaggtggcagtgaagctacattcctatttatcaggagcaaacatgaaaggttccatacgtcataaactaggggagataaatgacttcaaacacagccagcaatgaaaagcttgctcatgag

SEQ ID NO: 2559 - DNA, 435 bp, Rattus norvegicus
  Genbank Accession No. AI230945
cactagaacaaaggaatgtttattacagcattgctaagctagcttcctccataaataaacctgtacagagtaggacataggactgtgatatatacagaggggcagaggacacagcattcgagccaggatctgtccccatctccaggctcagtgttctaccattttcaagtatattagcaaggccgctcacatctgataggcatttccaaggagtagaatggattcttgagggcaaagtctgagtaaatttcataaatttttcggagaagagaatctattccagcttgcctaggatctgccaggaccacaaacttgatccctgtcagtgtttggaagcagtgcagtttgaacgtgtctgtttccagcatctcaatgcctgaactgccctgttccggagatagctgggaaccaatggcaaagagcgagcctcgtgcc

SEQ ID NO: 2560 - DNA, 296 bp, Rattus norvegicus
  Genbank Accession No. AI230956
aatgttcattttggtctttttgtgtttgtattccagtaaattatattttcaattaacagcaacaatgatatcataaaaaaatgctctgctttttaaatttttaaacttcaatacaatacaaattgaaacaaaatagtattgtatagtcttttaggaggcaataagccatcattattagtgtggctgaacctccttatcgataaccaggtccaggttgggtatagccctgaccaaaaggaggacggttacgagcttaagggttagccccagtggaaagaggggccatggttcttgca

SEQ ID NO: 2561 - DNA, 596 bp, Rattus norvegicus
  Genbank Accession No. AI230982
gacggaatgaaatgttctattatggagtggtcatttcaaggaggagggacttgcatggtccaggggaggagcatctgcttagcaagacacttccatggtctggtgtctgtccaggacatcaggggactcacaggattcttgagttccatctgactgattgctggtcacagacctgctgaagggactttctccagagccaatgctacttgaggtggagtgggttcgtgatcgggcgagccgggtcatgctggcagatggtatgtagcccattcccttgcaaaaggtacttgaaggcctcggtgagcttcccaggctgaactacttggggcagtcctccacagtctgccatctttagcaaagttgtatttatagggtcgaggcgagaattacattcaaccacagcttccacagcatgtgaattgtcccccaccaccagtaaagtagaacactttaatgttttcaatctgttatcattttggcccagaataggtctttcgatctccaggtctctgcgtccattataggaacccaggaagagctggagattttcttgattgatatcttgagcaatgtgcagtctgcatgtttgaatgagg

SEQ ID NO: 2562 - DNA, 501 bp, Rattus norvegicus
  Genbank Accession No. AI231038
ggtttctgctagcctttatttgtgaaagtttacacaaaaatctcccaacaggtgagcctatataaaccccacatgcctcttcccattaacaaacagaagatggctctgatgggggtagggtggggggtcatgacaatggtacggaacaaggtttattgaaactgtcttattctcaaattattttgaatatgctgaaaatgaaaggaagcaggtaataacctgtttataaagctgatgtgcatttgtgcaagcctactgccaaaggcaaataaatgctcttcaagcacaatgtccaagttggttgtttttggcatgaattaaaacaaacgaaaggacttgaaataatttcagttctacaaagcttatgtttacagatgttcttgtttacaagagcttggaaacaaaaccatgggcaaaatggtctatttttctcctctctgaaacattgacattttccaggacagaaaacagaaaattagtagagtggttgtcattgctcct

SEQ ID NO: 2563 - DNA, 328 bp, Rattus norvegicus
  Genbank Accession No. AI231094
ttaagaagatttattgacagactagtcttgcagtccagaaccgggctgacggaggctcaggaagttgtcatggtacaacccggtgtgggatccactctctacatgggacccctgttccacaaggtggctgctggggggtgggggtggggagatccactccagtgtgaacccctataccctgatggtgatggggctctgaggctggcacagggcccatctctgagaggccatgcatacctgctccagtgcatgctgagctctctaatgtctggtaccaaggacttgaccttgagggggagagaaatgaattcagataactacttgtgcc

SEQ ID NO: 2564 - DNA, 461 bp, Rattus norvegicus
  Genbank Accession No. AI231127
cgtttctttggttttattattacaaatgcgccgtggctccatcacactcaggggaatctgaattctacatgttcgccacaccctttcctttctacctgggcagggccacgtagaagcattcaaaccacgtgtggtcacaagacataattgacagaaacagttcaactcatagcttatagtgatgccatttctccagcggtacaagagctttacaggatggtgccagggctttcctggacgatggactgcttggttcacatttgtaagctccgaggctggagctcccttttcccaaggccttggcaccgttgttgaattccatgctttggaaaggtcctttctggtagtcagcgccaagatacgaccgccagatctgtgtgttcagtggttgaacaaccgtgtttggagggatcgaaagctaaaactgacctctctccccttaacatcccaacccatccaag

SEQ ID NO: 2565 - DNA, 528 bp, Rattus norvegicus
  Genbank Accession No. AI231159
gcatggtcagcatttctactcgggaactggttaactccaaccagaaacgaaatcaggaacatgattgctgactcagaaggaaatacgccaatggaactgagaaggcaaaatttgggagctgggacaggttccgatgggcctcccactcctggaagaggcggatcaggtactcataattccgggcccgcaaggccatgtggtcaatgagcagcagcatgcacagggggtcctcatccggctcaaggctcaggatgagcttgcagtactcgagtgcagtacgtgggcagccacgcttctccaagaagctcatctgcttgtagagggccaggtagaagctcctgttctcaggtctgcggtaatccagcctgcaagtcccactggtgaggctgaacaaggggtggaacacacactccatgctgtacagggctctctcgatcaggtctcgagccatctcctgatcctcctgaaagcggcaggcatcactgagctgaagaagtgagtcgacatgataggggcttgtctggagca

SEQ ID NO: 2566 - DNA, 577 bp, Rattus norvegicus
  Genbank Accession No. AI231217
gtaaaaagttggtttatttgtcatgttttcactgtatctcagttaagccattttggtgtccacagtgacagtcctcttggaagccaggtcatccctactcacccactaacagtgaccatcaaccacaagccaccaggcccggctgacagctacagcagcaagtgagactgtggactcctctaggcctgatgctcctcagcacagcccagagctggggactctgcacccgcttgccagaagctgtggagtccctacggtaggtgggaagccctgctgctctgtggcagtggcagaggaggggcagtgggaagaccctgtggactgggagggcaccaggctcctctgctcaggactgggtctagacaaggccacgtgtgatatggtgtgagtcctgggctatgtgcaagggccctgatgctgacctgtgtcggggcaagtggctaattgtcccttgattgccatttgctggcaagcatagcagcaagagtccctagaagccctgggtcatggaggcatttgctacttccactgaggtgtggcggacccacgtgtcttgctgctggcaggccctcgtgcc

SEQ ID NO: 2567 - DNA, 638 bp, Rattus norvegicus
  Genbank Accession No. AI231219
gtcaagtgtttatttatacctacaaaagaaaacaagatggtatcaaaaggacaatttacaaactaagaatagtagtaacatagctctgagcatcctatgccctaacatcacgcctacaattcaagtctcaatgacaggaatgtgttgagagaccagcaagggcattagcagagcactgatcccaagcaaaagccaccaacctttttagatgagaagtctgcacaatggattgttagggagcagcagcccacagctttatacctaagcccttccccctaagtgagtaaaccacagaaggcaatcaacccagcttcagggtttgcctgcacctgtgctgacaacggactgacaaggaggcagaagtcacttgcgctaagtaggaaaactgctagttttctgctgtacccaggccaaaagagcttatgaaatatgaaatgtgctatttatctggattctgcctctgctggagaggggacagaagcaacctagctactgcttcatccccggaggcagtaatagaaggggtgggtattttgaagagctacagtagcacagaacagcccatggtataatgcttaataaaaaataaatctgaatttggttgtagaaagtatcttttacaggctggtcagtgtcag

SEQ ID NO: 2568 - DNA, 584 bp, Rattus norvegicus
  Genbank Accession No. AI231226
acactgtacattctttattactgtccatacccagtaaagtgactttgtgtgaacattctctcactttttcttcttgcctttcggagtttcaatgggcttcccctcagccaaagccaactgtttctttagatccaagagtttagccacttctgcagcaacctggttcttgtctgccttctgtgctttcagttcccgaactatgtttccctgtttggttacctcatccaccagcacttgtatgtcctgcgaccctgctgtagtaactgcctcaacaactgctggcttgggggaccctttagcctggccccctccaaagcgctgcctcaaattttcaatctggtcattttccaatttctggaacaaaggactgactgtgccaattcggtggcctgctggtaaggtacaaatgaagcttgtggcaaggatgcggcaggctgcctctgggagctggagctgggtctgaatggtggagctgactgtgggcatgtacggctggagcatgacagacagcaaggcagctatgttcactgccattcctgtcaccgtgcctgcccgctgcctgtccatctcatcgcctttaatcc

SEQ ID NO: 2569 - DNA, 591 bp, Rattus norvegicus
  Genbank Accession No. AI231290
cacaaatttcccaaggccactgggtgacatttattgtaaaaagcacatggggtgaggttgggaccaggtagggcaggttctaggaggcagaatcagaggcctctgagctgtctttgacatctgtgctttctgtggtctcactgacctcactgaggtccttgctgtccccaccactatcctcagcagtcaggcccttctcctcacgacaggcctctcctgagctcagaagcacgttgcctttgttctccgccttgttctccatggccgacagcaccatgtgcctgcccttttccttcagctccaggtgccgcctcagctgccgccgggagcccagagggaagcgggtggaaagagacagggcctaagtctccatacaggagacaagaggagccaggccctggggctggctcatcagccatctgcgtgaggtcccgcttcattgcatatgcatcttccccatctgcatagtatttgggctccacttcgctgatctgaaagttgagggtgttggaatagagatgtagggcagcccggttactcttcctgacatgtagggagacatatttggcattgaagttttctatcatggct

SEQ ID NO: 2570 - DNA, 659 bp, Rattus norvegicus
  Genbank Accession No. AI231292
tgttttttttttttttttttttttttttcattttttaaattttttaattgagcaagagcaaggtatgacaggtactgcaaggagaagagaaccaggggacagctgttctgacgtgcagaacctgcctgcagcagcttctttactgtctcctggtgggaacaccccggagatgccctccagagctggagcacccttctcagggataaaacactacagggtaggggaacaagtaagggaccattggcatggtcctatgagactcagctcttaggcatttttgcagctggattttgtcagggtgtgtgtgcctttccagggcacgctgtagatctggaaggagcagagtgccttcctcatcagatggggctggtcgtggaaaggacagttagtcaaatttgtctgggacttggtacatgtagttcggcccatctccacatccaaataatagtttattccagccacaagctgcttacgagctctcaccacctgtatggcgcggctgtggtacgcatcgttgctgcccttgttgtactcgcttacggcgaagtccaacgctcgctgcacgccctcctcgctggcatctgcctcctgcggagctcccaacaatcgcgggggtggcctgtaagttccggcccaggccacggccaggacggccagca

SEQ ID NO: 2571 - DNA, 477 bp, Rattus norvegicus
  Genbank Accession No. AI231305
cgtggcagaatgaattatttatttaaagcagctacatttaaagtctgagaatcggattacattatatctgtcttcattcttcattattatttattttcacaataggatagatagacttttccctcagaaggacggtgtatgcaccgggtaagcgatataccgttgggcttacatcttcagacatggggtgctgccagctcacttcgctctccccgaagcatctcagagagaaggacgaactcagcggcacaatcttctcattctcatttggaaggatggagggtaataagagctggcagacgatgaggctcggccctgtgaggagacagctgaggaccagaaaggcctgggaggtccccatcgctcctgagaacttctcctcctacgtcagtttgctaagaaaatccgatagcccggaggaaaaagtgagccccaagcctccagtcctcgcccacagttcctctgtttgtttcactc

SEQ ID NO: 2572 - DNA, 208 bp, Rattus norvegicus
  Genbank Accession No. AI231356
ctttttttttggttttggtttttttctttggggggggggttttggtttttttttttaattttttttttttgcacttttttgaccgaaagcttctatttacttaaaattttgttttgagggctcttatgctaggttttgcaatgggacaagcaaagttgactaaaacctgacaaagctcatagaaaaaactgcaaataaaaagcgctaa

SEQ ID NO: 2573 - DNA, 568 bp, Rattus norvegicus
  Genbank Accession No. AI231375
cctggccccgacccagacccgcgcgggctcacactcgctgcggtatttcgaaaccgccgtgtcccggcccggcctcggggagccccggtacatggaagtgggctacgtggacgacacgcagttcgtgcgctacgacagcgacgcggagaatccgagatacgagccgcgggcgcggtggatagagcgggaggggccggagtattgggaggagcagacacagaacgccaagggaaacgagcagaattaccgagtgagcctgaggaacctgctccgctactacaaccagagcgagggcggctctcacaccatccagttgatgtatggctgtgacgtggggtcggacgggaggctcctccgcgggtatgagcagtccgcctacgatggccgcgattacatcgccctgaacgaagacctgaaaacgtggatggcggcggacacggcggcacagatgacccggaacaagtgggagcgggctcgttatgcagagagaagcagggcctacgtggagggcacgtgcgtggagtggcttaccagatacctggagcaagggaaggaggcgctgctgcgc

SEQ ID NO: 2574 - DNA, 436 bp, Rattus norvegicus
  Genbank Accession No. AI231379
ggaaaggtggactagagttttattctgaaaatcacttattttacattatgtacaacagcaacaacaaaaaaatacacttagaattatcctggacttttctcacttgattcttttatgtacgtaagtacattgtagctgtcttcagacacaccagaagagggcattggatttcattacagatggttgtgagccacccaccatgtggctgctgggatttgaactcaggacctctggaagagcagtcagtgctcttaaccactaagccatctctccagccctccacttgatttccaatgcacaattacagagtaatctttatgccacacaaaatttcctaaagctgtcagatggtggtggtgcacataaacaggaagatctctgagttcaaggccagcctggtctgagtgtttccggactgccatagctacacagagaa

SEQ ID NO: 2575 - DNA, 542 bp, Rattus norvegicus
  Genbank Accession No. AI231547
cactcaaaattcttcagtttttacaaaactaacagggtggagtagggaagggagcagggaggcagccgcaggggtgggtaggcggagaggcaggctatgcttctgtcttcacctgagcctggttgcctgccacattgttcggctcacccttcatctcagcatcagtgggatggtctcctgcagccacttctgtcttggccttatgttcctcctcagccagcctctcaaacatgttggcatagagcttcttttcccgggcaagctgcctgcgggtccgctgctggcacacagccagctgggtcttggcggctttgttgctgggatagagctgcaggaccttttggaagtcagctcgtgccaggtcaaagtcattcacggccaggtgtgcctctccccggcgaaacaggcccttctcattgttgctgtccagctccaaggccttgttacagctttcgatggcagctgagaaggcctgcagtttcaggtgacacatggccagattgagatgtgaggccagtcggagcgcatggaccttttgcatt

SEQ ID NO: 2576 - DNA, 561 bp, Rattus norvegicus
  Genbank Accession No. AI231566
  misc_feature (1)..(561): n = a or c or g or t
caaggataaaataagtctttatttatattcttatagtaaagggggagccttaacttgcagggagattcttgggcagtatgtacaacatacttttatttccacggaatggaatcaacaccgactgagactacaaagtatacactaaaaatcagcaaatgctggcaacagagtaggaaaaagacaaagaaatgaagcctaaagacgaaaaacccttcactgggatctgctgaccacagtcagagccagggccggatcacacagtggcgacaattccaggacaggaggaaggaaggagggctgggctgtgggtttagtaccaggtaagtcgctcttggtgtttacatataaaaaagttggctctgtttcttagaaatacacacagaagtgaagatttgatcattactttatgaatctgtcgctttacaatatcgacatcatcaaaaataggggcatttcattcagattcaaatttcagtagcaggaaataaatatcaaaacatcatcactggcccttaatacaaaacctntaccccacctacaacttcctcccagcccacccac

SEQ ID NO: 2577 - DNA, 468 bp, Rattus norvegicus
  Genbank Accession No. AI231567
caaaggttgtcaatcagctaaaaggggagtccagaagagtggcacaggactggctgaaggaggcccgaatgaccttagaaactaagcagatagtggagatcctgactacatacgccagcgccgtaggaataggaaccactcaagtgcagcaagagtaaggcctaggaagagttgtgtaatgtcatatttcatatcaaagaaaatcagcattggtatctgcagggtttgcaacaagggtcccagaattgtccagaagtgagcaggttccaagtcctgtgtgagatgttaacacctgttgcatttaccgtccttacactgctatcatgccaatgaactccaggagactttatttgcaacttgtgtaacacttcctgttttttaggttttactgatcaggcttgtgagccactcaaaataatgtttgtgatccctactattgattctgcccttggagcaaaccctcgtgcc

SEQ ID NO: 2578 - DNA, 603 bp, Rattus norvegicus
  Genbank Accession No. AI231606
cccaagtgtccctttatgggcacacactttattgcacatacatttttgtacatccaggtcccaaacgagacaacgctcgctcatctttcagaccctcacagcgcacaaaggccctggcaaagggtaggcactcgataagtacttcttcagagcatgaccattcatgcgcctacgatctttctactgtacagcaggctgacagacagcagctccagtcccgtctgctctgcagaacacgcaatcacacaggctttgtgaatcttgttcactttccagatcaaggtgtccagggtttcacaggcctttgcccgcacactgttttttgccacttcttcactgggtttatccttaacaaaggattaactttagttcacatcaggggtgagaacccggcttttaaccctaggggagcatcccttcagtttctgtcacatataaacgctgtgtgtcgagaccgaaggtcgtctacgatcttctcttctatcaccatgcctcttgctacctcgtcctcagacagcaaaaactttgtctctgagtctttggttacaataatcacaaaggactttattgactccaggatattggccaccactacttgatgct

SEQ ID NO: 2579 - DNA, 553 bp, Rattus norvegicus
  Genbank Accession No. AI231615
ctaaacagtctttacttctgcttccggctgtacaatgcatacagtatcatagaactggccactaggattcaaacccactagaacactttccatgttaagtggcaacagcagcatctcacagaaatctgtacatacatatatacacagtccacattcaaccatttcacatgtttttcagtacacacagttgcagcatcattattagtcacgtgtctaagttgttgctcgataaaaacccaagcccctgcctagacagaactgcagcagttgagccgatagaattacaatgtatcatgtatcgtatatatgtcggttgcagagagatgtacaagcccctaaaaaacagagtccacaaatacttttgtttttttttttttcaatgctaccacagcatcatgttgggcgatatcaaaacctttaccaaccgaatcaggtgattttttttttaatttcaaaaaaaaaatcttctgcttaccagaaatattcttgatgaaaaaaaattacaaaaatgaatgttctctttaaaataattcacactttttaagattccaat

SEQ ID NO: 2580 - DNA, 557 bp, Rattus norvegicus
  Genbank Accession No. AI231716
ctatgttgacattttaatacttgagaaaatataagttaaattgtgtacaaatactgctggcacagaacaataacaattaaaaaaacaacagaatatatacaactccaaagtgacatagaggcggcatgaaactgggatgtaagaatacatcaccacctttattagctccttttaaggaagtaacagattttttaattagagagacattaaaaaaaaaaaaaaggttgcagaagaaattattttctccaaaccattcctttatccattgagaactacaagttcaagctggatgtggtgactgaaacctgcagacacagcactcaggagctaaggcaggaggattgctatgagctcaaggccagcctgggctaccttagagaaggccaggcaagctgcggttgcacaggaagaccttgtggagatggcaggccaaggtcactaacacttaagcattcagaaggcactctcctcatacccctcacgggaagcccagcccatgatatgtcagaagcaaggtcacctcgcttccccgtctggcttcatctaatcactcatta

SEQ ID NO: 2581 - DNA, 731 bp, Rattus norvegicus
  Genbank Accession No. AI231773
cctttcacattggcttatttattttcacaatgccacagagaagtcccaaatctttacaattctttacctgcttctcattttttaaaaaagaaaagccctagaatatcaaatcatgtttaaaaaatttttaactgaattatttaagttatgacaatgatagaacgtgccaagtcaatcaaaattctaaactattaaccctttgaagtaagaatgaaccatgactgatctcaccccatttcacagctcttcaggctgagcaaccatcactaatgctagtctacagccaaagtcactcacatctgacacgctgagggttaaagccatgttttaccaatgttttaactgtgcaaaaaccttccacaatggcaactgtgctgaacactccagtacagtagccagcctgttgatacgtcctcggccttctggttaatagagcatagacatgttgtaattatacagtttataagcaattaatacattttgaaatgttagtaatataataaagttataaatagtttaccttctccttttccttatatatttttatattcatgcatctcatttatctgtctagtagactattacattctggatttaaatatgactaagcataaaataaaagagatgagtgtgaatgtctaagccagtaaaagctattaacttagagacaaactcaaccctaaggcaaacatggacaaagttggatttgacattgggttcttcatagtttg

SEQ ID NO: 2582 - DNA, 659 bp, Rattus norvegicus
  Genbank Accession No. AI231776
aagacttttcagagtttaatgagaaacttaaaaaaaaaataatacaaataagaaattcactttttttaatgtacaaaaaaaaaatgtatgagaaccaaaagttaatgaacactgtcacatgtttataccactatctagttcatattaattttactcttcaaacaggaaggtggtggcaatttagggaacaagagaaaaccaaaacttgttctacagttattcttctacatgtgtaagctgtgctcacagagacggcttcttttacttctgtgtacaggagaagttcagttgtatataaaattaaacctgctcagcagctgaggaagactagaaatgatgggtccgtatcccggagcattgtcgtacagttcaaacaacggtgcagctaccagcttgtaattcttagggaccgcaaacaaggctttctcttgaagctgaaccagaaacaacttcttatgttccttgggctttgttatatgtgcaggaatatacgggtactgaggaggttcaaaatttggtctccaccagttcccaatgcagtcatcgatgacccagtcttgcaggactccatcttgacgacccagtatctctgtcattaagcgttttagtccttcaacttcatcttctcctgggttaagttcaccgccaggtaatttgaa

SEQ ID NO: 2583 - DNA, 658 bp, Rattus norvegicus
  Genbank Accession No. AI231785
gcaaccaagtattggctttaatgaaaactaccaaagaacaagagctaaccgcaaagcagcagccagtcagagctaagtttctgcgcagaccttccctcaggccgtctctggaccatggagagttagtcactgctgttgaagcgttgggcagaggctaccatggagactcatcggatcgataagcagggtgcttgggactcaggaggcacttagatacagaagaggtaatactcccggccagccagaagattctgggaagccatccttcacagtggattgacaggttatctgacatcctcaagcatccctgcctcatcttgcctggacctgccgacgtaatccaacagcaaacagccatggacactaatctaatctctccagtctcccctttccctcccgaagcctccacaaaggctatctcagggggccatggctctggctctcaagagtagtagggctgcaggtatgtttttggaggctgaaaggcataaaacagcattcttgaagttctgttcgtcttatggcaccgactcaatttcaggtctgatttctcttccttcccctccctccgcccatggcctctcaccctgcacagacacagggcaccaagcagcctagcctttgatctctactgggatctcccagcagaagaggttat

SEQ ID NO: 2584 - DNA, 678 bp, Rattus norvegicus
  Genbank Accession No. AI231789
gagcagtgtaaactttaggctttattatatcgagttgaaacccatgaaaacagttattttcttatgcacaacatctgaaaatgtaaaatatagaaccaagtttcctcttatggacagtgtaacagaacagagtacatgaaaagaaaatgtccagtagaatcccaagcccatgtcacattcagcaaggctgtcttcctgcctggtccccaagggcctgagagctgcagggacagtggggcacagctcggctcctccagccccgagtcccacagctcaaaggatgggagcgggaggtggggcaaggccagtcccgtggctggaaggcagcattggcaggcacagctctcactgggtcagtccagttatcagaaggatgtggggtcttcgcacattaggaaggcgggtgatcctccccccgaatgctccgatacttggccatgtcttctggaaacactttagaaagttcctgaatcagtaggcttttaaatttcttcattgtgtcgatcttccccttgacttgttcgtttttagcaagagccctctccaggcattctttggtgtagagctggggatttcgaccttgatcaatgtattcaaaaacttccagaggcaccgtgatatcatgtagctgctgtctgcatttatctatgtcctgtaagcccgtaacaatgaagttca

SEQ ID NO: 2585 - DNA, 651 bp, Rattus norvegicus
  Genbank Accession No. AI231798
ggccatttcgggagtttatttccagacggaggaatcggcgaggggccgcctgaaaatcacaatctgtcatctgccccattattcattggcagatgtgtcaaggctttagggtctccccaccaaaggggagattctgacacagtcaaagacacttgtccatcaaatgactcacaggacctctctgccaatcctggcagttagactggggtgcccttggctctccctttagtctcctgttttgcagggtagtcccaggggcgcattcgagtcctctccaggttcaggagcggctcctcgacgctggtatccccgtttttctgtcgctcagcgaggatcatggcccgcagcagaggtgggtaggggacaaggttcaatctgtcctctgctttcccagtgaacgcagtgaaagcctcctcctcgtgcttgggtaccaaccgccaatcgtggtacatgacttgctcgatttcccgagccgtttcctcactcttccctttgaaagtcaggataccccaggccctcccgtggtccaagttctgcgccgtgtagtcaggcctcacacgcgtgaggcgccagtagcatggctcgtcgtgctgccacagccaggacttgcgggtaaccagacgacccaggccaaacaaggggaagcgggcg

SEQ ID NO: 2586 - DNA, 574 bp, Rattus norvegicus
  Genbank Accession No. AI231808
aacaagctcttattagaaacgctttggtatcaacacaataaaaatatactggttcccctgaccccactgagtcatgtcaagtaactggaaaagttagcatttgtcgtcctcagcttttttggggtggggattttctccccacaaataatgactactatttatttatgtggcttactacgggtataattatatagttttggactttaagaacaagaaatcaaagtattcagaagagacgttttcaggcatttcttggcttcttcttcagaggttactctggtgggcacaatggctctcagatcacctttttccccagcttggccattcttatccttaaagctgttaaagaaggatcctcagtcccatctccagctcctggaacacccaggggagagtgccgggcagggctgcctaagcgctcttcttgctctttcagagatatggaatttttgtggggagatttatggtttgtgttttcatgagggctaacttccgatctcttcctaggaagtggggttggtttagctggctggtaaacctgactacagggagctacgggatggtaggatggctt

SEQ ID NO: 2587 - DNA, 607 bp, Rattus norvegicus
  Genbank Accession No. AI231834
aaaaaaatgacaatacaaaagtacctttacacaattataaaagcataatcgatgataagtggctcactctctttaaagcaagtagaggagtcttacagtcaagtggcacggaacaccacctggatgctaattccccagtgctgcctgccccggcctctagtttacagagaaaaggcccttattacaggccttggtgtttctctttttaataacctttaaaaacttgacattttttacttctcttgaaaaataatgaaataaccctcccaaaccaccgaaatattcattaaaatatgacgttttcaacacaatacaagctgatcaataacaaagatacaaagattgtgattatgtctagtagtatcagcagctggaaattctgaggtcaacgtaatatgcatggctcgtttgaggagcgggaagactgccatcacagcctctgggaatgtgttggcacacaacacaagactaactttgggctttgaagaggtcttgaagcaagggtaacagtgttcatcgcacatggccaagtttcatgccccacactgcaatgtaataggtagtctcaagatgagcatgtagcgttccaaaaaatgtgatggatggt

SEQ ID NO: 2588 - DNA, 578 bp, Rattus norvegicus
  Genbank Accession No. AI232006
gcggagtctcagtctttaatctcagcagtgctcacacacatgaaaccacacactctcggactttcagatcttgttgaaggctgcaatgtcgacactctgcacatgctcctcaaacttggtgatctcctcttcctcatcactgccgaacaggtcaatgtcattgtcctcgtcgtcctctgctggtgtggctcctttcttggctgggggctccacttgacgcataggagagacatgttgggtctgtggggctgtagctcggtgagtaggtgaactcttctccagagtgctcagccggacctccaacttggaaatggcctgctgcaaatcttgcaccacgcctcgaaagttctggttctctacttccagactggcaatccgcacaatgaggtcactgtggtctccaccaggtccactggaggctccagggcctgaacttccagccaaggatttctggatgttctctctggctcttgcaatgtctcggaggatcacgctggcgccattctcctgccgagagccaacggtcacaggcccattcatctgctcgtagaaatccctttctggatcggcatatttaa

SEQ ID NO: 2589 - DNA, 560 bp, Rattus norvegicus
  Genbank Accession No. AI232047
aaaacaaaactccatttccatgcttctcaggttgtaccatcattgggcataaaaatcagtcaacatttgcaaggcagtgtcactcacagaatcacccagtgctattttacagtggtcattctctttacaacaatcaggcattgctttgtacaatgggcaaacgctataacaaacgccttccataaacagttagccctttagctattgggaaggtcaagagtcgcttgaagcagtcactggtcgcactaaacaaagtaccaggtggcagctatcaagcccctaaaaagtgtttttaaaaaacagatttacatcccatagtaagtcttagaaacctcaaagatagggcctatcatttcaaaacactacggatatctacggataaaaatctgcattcaactgtgcagcgttttcttctagatctggattaaaacctttattatttaccccaattagttcctctattaattctgctactctcggttttaaaaaggccatggttgccagttgatcttccacagaagaaaacactgcagcccgttccctgtgcttactttcctgtg

SEQ ID NO: 2590 - DNA, 586 bp, Rattus norvegicus
  Genbank Accession No. AI232065
  misc_feature (1)..(586): n = a or c or g or t
agaaaaagtcatttaattatgctccaaaaatactcattttctaaaataataataataattaacaactgtggaagccacaaaaaaaatctataattttaaggcttgagggtgtcactttgtaataattgggtacggctgaatagttaagaaacctgttgcttttatttacactcttgatccagcaagaatgatgacatggcctcggggtagtcatctacactggctttgattttatgacccattcagcatttgggttcagatggtacaagtccttcatgtatgtatcgtcatcaaggcaacgttccccaatatttcctccaatctcatacaggaaaacttctcctttcttgagtgtctgggcaaccccactttcttggctcagaaacctggcaagtacgtcgctggcttttagttcttcagttagctgtattgccatggaaacttttgaaagatggggagcttgcactcgaatcactccctgaggaacgtcagcaccatttgcagctctgncttgcttttcgtgtttttcccggtcatacgccattttcttcagcaatttcttcatggctctccttttcctcttctg

SEQ ID NO: 2591 - DNA, 496 bp, Rattus norvegicus
  Genbank Accession No. AI232066
cagaaactgtttaatgttagaattacaggcttttggcaagtatatggcaagcccatctgtccgttcccatgtccactgagaacacagcagagggggcatgccccaagctctggcctcagtccagacttcagcttgggtttgtccagcgagatgtctccagtccatgaaagcccatctggctacagcttgagttcactgggcattggctcccctcttaggccagccagcaagttgttagccgccagcaaggacatggtgttgcgagttttgtaggtggcactgcctgaggcctgggctggcgccccgtgtagagaaatctctggacaccaaatggtttcagtcgtcgagcaatggcctgacctatgcgccccagccccacaatgccaacagtgctctcggagagtccataaccgcacatccacaagccggtgttaaggagcaggacactacaatgaagtctgactcggcagccagctgagcaataggccctcgtgcc

SEQ ID NO: 2592 - DNA, 582 bp, Rattus norvegicus
  Genbank Accession No. AI232087
gggtagcataaattttctcaaactttaatcttcacaattattttcactctatacactttattgaaaaggtctagatttatttgacaaaatgattatgaccagaataaagatatcttctttttcatatatcagtaagtggctggaatagttaatttagtcatgtatcctggaaaatgagtttcaaaatcttcctctttttttttgaggtcagctactgtcaataatggacattaggcaatagatcataacacttcagtaacatgctgtgtcagaaccttgcataattcacacattcatttgctctctgctacattatgacttcatggattaaagtttattaaattccaaatatttcttgcaggagggaatgagtaaaacatcaggataatgctgtcttcatttttaaatatatattgttgttttaattgatacatagtaattgcacataattatggcacagtatgacgtttcaataatgtatagtgtacataataatcaaatgaaggtaattggcatgtcacaccagatgtaactatttcctttctttctgggacatggctattggacatagtcaattaattg

SEQ ID NO: 2593 - DNA, 539 bp, Rattus norvegicus
  Genbank Accession No. AI232103
gaaatggcttcagatcacacattgtcacagaaccagccccattggattgtcccaatccttggacgcagagcccgaggcaggcacagtggctttgattgaccacttgtggccctgagcacacaagtccctccacaggacaagtgcctttgcgcggctgctgagagatttgcggacttcagactgaagagcgaggacaaggctcttcttgggcttggctggggttgggttctgctctggatgggatctcaggggtcaccagagaagccactctgagtgacaagccccatgtcgtgtatggccctcaggaaaaaaaatgagcaccaggctgaatctggccacattcctggtctctgcccacggtgacaggaaacagggtcagatatggggtcactgtgaacttggaaacctgctctggcaggaagtgggggagttgggagagttgggtcccactcctcaagcatgaggagagccagttaccacatggatgagcaggtgcccgcctgtacaactggccacagtcactggacggtgaaagggga

SEQ ID NO: 2594 - DNA, 597 bp, Rattus norvegicus
  Genbank Accession No. AI232128
caaaatggaaaatgattttattggtcactacccataagtcaagtaaacacaaggataattagagagtggggaattcgggggccataaatccgcggcgccttctccaccggcgtcggaagctttatggcttgttgagttttattttgagagaaacgaatacatagttttggtggaagcgggactacccaccaagcgccgcgcgggcagacagacgcgcgcagcgaattcgcccgggactctggccacaattaaggatctctttgtcctagaaagaggggccttccccccgccgggaccttctctccatcgtgggatccgtgctctacccgactcggaaagtcacattcttcctcacccaaactacgacggagatagacacttggtgtgcgtgggggtcccgaagtttttaaacgagagattcattccactcgcagcttccaaacgtccacccggcgctgtacgcttggaaaccttttgttctaacttaaggggtgggaaggatggaacaaaagaaaaacaacccaccttactttgcaatcttccgcaaagagacttgggagtacttttcattccacaggggtttttaccccaccagcc

SEQ ID NO: 2595 - DNA, 548 bp, Rattus norvegicus
  Genbank Accession No. AI232131
agagaaaatgccacatagatctttattgaacaccagtgccagcaccagcctcctcctctctagtcacaggagcacatgggccaggggctttctccccctgcagggaggcagtggaagcctaacccgggaactgctctcttaaggcctcctgggtgctcagtactgctggctcaagtatgctcaaactcctgctcacagtagcccacgctgatgggctgggcctggattcctctcctcagcagctcacagcggaaatgggacagacgtttaaaggcaaagtccatattagtcgtcaggttactgctccacagtctttcggcaatggcacctgctctgggccagagcctggggacaaggtttgtgctgtccacatactctccccacatacaggcttcccctccaatgaccagagccttttgtgcaggtgtaccacgaaatgccaggggctccactttgtacatttccttccagtcagggccatacttcacccggttcaggtaccagggagcagacagcagggcccggaagccagcctgggtgatggcctc

SEQ ID NO: 2596 - DNA, 574 bp, Rattus norvegicus
  Genbank Accession No. AI232135
aataaaaacaaactgtgacaaaaatggattccggcttcccctccccatccacccttctgggataaacttttccaccgttgccaagagttttcacacattaagtaacagcatataatgaagctaagcagttgtagaatagcgtaagtagaatctgattaccaagcccactcaaagctgcactgtcctaccaaggctgaatgagtaagacaatgaggagggaagaaacactaaagtccatgcgcaaagacagacatttgtttgatctgctggctcagggccaaacactggatttgcttcttcaaagtcattatgaatctttagtgtaattctgggaagtttgtgtcactagcctaaaaaccaccaatagggagggcacagcaacatcacccttcccagcaagaacttatcccacagaagccaagataacatccacaggtgttttctctctgcttctcacagtcacctgcatggtcacgccatctgctagggccagcctggaccgcaccagtaagtcatagccacctctgtaaactcctgctagatagagggaatgggaattcttattctcgggtac

SEQ ID NO: 2597 - DNA, 505 bp, Rattus norvegicus
  Genbank Accession No. AI232157
ggccgccaaactttttttttttttttttttttttttgcagtgaaaatatttatttgtgggtagtcatagaatgcaccagaccagcacacaacagacacaggtgcacagtgctcatgtccacaatcactggcaggggacagcacacatgggctgggggaggggaggactcattggtgtaatgtacttcacatccactggggtacattcagaaagctttgcatgactcatcacaactagtcctttagtttctaaatagatagcataagaatccaggtataattatggagaaacaaggttataggggagaagatatgtgaggggcagaaagcactctttatttcatatggtaagattctgtcctatttacgcggacgtatggatcttaggaatgttgaaagtcatggtaaaggaggatcacgggctgtgtatcagccctcaggagtccctactgtaagggcagtttggacaggaaagcctgtgaactgcgaagtaggaagaaagtcct

SEQ ID NO: 2598 - DNA, 375 bp, Rattus norvegicus
  Genbank Accession No. AI232163
aaaatacaacaaaatgtttaatgagcaaattcgtattagcaaatatgaaactgccacagagaggaggagcaggactgagaccacgggttgagggtcaggaagactaagaagaaccaactacttaagaaaccagggtggagaacagggaggaccaaagccagaggacgggagctgtggtcctgcaaagggagaaggcagggcactgagggccagacaacaaaattcaaaatagtttggccataaaatataaacacgctatgttcctaccatggggtaagagaggaggaaaggggtgtaagggttaagaggctgtttgggaaggggctgtggggggtcctacccgccctgttgtgcacacagacaccatcccacccc

SEQ ID NO: 2599 - DNA, 506 bp, Rattus norvegicus
  Genbank Accession No. AI232174
caaactttttttttttttttttttttttttttgccatttggatttttttttattctctttttaaatactggacagtgaaaaataaatacgccttctcatccaccagacaaggttatttcccaactccctgggagaccttgtcaacccccttcatacacacccctggttctattccaaaaccttccccatgcctcccacccacaaataccctcactatccccgtcttccacagtgatgaggccccagaaatagggggtacaggatgggaggagggatagcaggggagcccccctgaactgtcaaatctgggtgggtcaaggagcacccccaccaacaggcggagaatgggggtgttcagaggttggggcattagaggataaaggcacatccagtctgatagggaaggggaggctcccctcaccctgggggtagggtggacaagagggagggggtatgaccctgtttcacacccctccattagctcctggaggttgggggggacccaa

SEQ ID NO: 2600 - DNA, 454 bp, Rattus norvegicus
  Genbank Accession No. AI232230
aatggaggcacttaaaagttttatttgctgaaaatgttataacatttaactaaaaattaaacatgtttcatatctcctttcatgaaacagcagcagcaagagatggcaaatgttcgaaagtctcttcaatccatgttattctgatgagtctttgaagaaagaacttgaacctgttcaggtgcttgttgatatgaagtcttgaagatacttatatgaaggtgtcttgaaatttgcaggcacaaagaaactaaagtatatcatcatatcaaatgaagtaatgaccattgctatccatagaacaacatattcctctataaaattattaaagaattggtctaaaaataaaagacctggcccaataaaaacagagtcttgaagatatagttcactttttgtcatgtgagctatcaccaagtttttgtgcaactttagcaaagacacatccaaacattaa

SEQ ID NO: 2601 - DNA, 564 bp, Rattus norvegicus
  Genbank Accession No. AI232266
aaagctttaagctgaagtggctttattgcaatctttcaaaattagcattacagtaaatatttttatctgtaaagcttggcttaatctacagttcagttactttagaagtagttaaattcagttaacaattaaaaagataacacaaacctaaagcaatctatgaaacaaattatttacaattaaacacttagggtcctgattcacaaaaattagtgcatttcatgattgatttgtaagttttatacagaaagcaagcaggatgcagactattcccctgggaaaatctggaatgaaatgaatggctgttagaagacagtctgccaatctgctacagcaaacttgagagagggcggaaacctggtggctgcactgacgactgttctcagcagaggtcagacaggtggtaatggagagcagacatttgacagagctcttggtgtacatagaaggaaaaggttttccttttcagatgaaactaaatattctctgagtctgtatattcagacgaatctaggatttgtagtttcttttctaatagctggcagagttcaattccgtggcagg

SEQ ID NO: 2602 - DNA, 667 bp, Rattus norvegicus
  Genbank Accession No. AI232268
ccagtgacagatttatataatttcaatgtaaacttttgctgcagcatggagaccggtcatatctcattggtagatgtacccaaagccctcaaccagggcggtgacagctacacttgcttgaaagaaaattagtccttgccagccgcagcaggatcagatcggtatttctccttgccactgtggacagccacaccagtatgacaagttgacagttcccagtgtcttcaagagcctctctaggctactgccagtggcttctggtctcagagctcattgtgccgagcccttgagaccctgctggacaggtcctgcagatgcttcttcaccttgtagcccagctcctttgtcttctcctccagcaggacgtacttctccttgttgcggctgatgtgctcggggtcaccgatgctctccacgtgcttcagcttctggtgggaaatctccagctgcttctggtagtggttgtgcttttcgattttggcctcgaagtgcttaagctcctccctgaacgactccagttccttctcggtgaagttggcagactgagccaggtcccacagatctatcactcggggctcttcaaactcagtggcggggccgtagccctggtggctgaccttcctcaagcggtctaggccctggttgatactacgcaatctgtccttta

SEQ ID NO: 2603 - DNA, 438 bp, Rattus norvegicus
  Genbank Accession No. AI232274
atgtccaagccttcttgttcacctgtgattgagtttattggggagaaaagtaacagaaattggttgcataaaaaaaggagttggacgtacaaacaatgtgggctcaagccttagcagcccagccatgggtctgcacggttctttcgcatcaagaagttaatctttcgagccatttccatgttgtagatcctccggcatgtttcatagctctccctctggcggcggcggcaaggcttctcatagtatcgtcgtcactttatgacatcaataagcccgtcggcggtgaggattctgttcagggccctggaggcaccttccacgttcccctcctgaaccatcacagtcctggcaatgaacttcagatgtttagccatgaccttgaatttaaatcttcattcttcaggacctatagacagcggcctccgaattcggactccg

SEQ ID NO: 2604 - DNA, 540 bp, Rattus norvegicus
  Genbank Accession No. AI232280
gcactgccgaaggcgtttattaagactataccaatgataacacaatgtggtacaatggcagaaactaaatgacacaactgtattaaatgccaatggcaactaaaatggacataaacattaaataatgcaaatattatgatagaaatactgtgataccaaatgatacagtgatgaaactgacacagtcacattgatgcagatacacataaatgaaaccatgatgcacaggctaaatgacagatgctagatgataccatgattaatactcaacatctgtttatatgtggaatatcttgaccctaaacctgcctggattcaggcagccaatggttgatacagggtctaccctcttctcagttcacaaggaggcttacaaggagcagcctcccagcagggaaacaggacagagccttggtagacaaggtaacaagaccaggtctgtcatcagccccaagcatggcaacacagggctctgtggctgtctgacagacagggtcttaccgtgtcattaaggctgccaaacctcgtgcccctcgtgcc

SEQ ID NO: 2605 - DNA, 554 bp, Rattus norvegicus
  Genbank Accession No. AI232288
gggcactggcattaacagtttattgtttccttacaaataccactttctaatgataaaagtttgcacagacgttggaattggtaactaagttttttttcagtttcatgaaaatagttgtctggtaacataaatggattctgcatcagttccacaaacaagacagggccctaaaacatctaaactgtttacagacagagtcctgctgggaagcaggcttgtgatttcaattcggtctttggcaggatctgtgctaagccaggaacttactagggacaggtgaacgctggcctggttactgctatgtgacaggaaagtacttcttcctccttggtgaaagagagaagacttttcaggtgcatttgtggaggcatcccaatgccagagggatccatcttcagaacaagtaaacaggtgatctgggttggatgggtggaagcgaacttcccacatttcagcctcgtgagccttcagtaatgacacaggcatggtaccttgtctgacatcccaaatactcaacattccatcctggccaccaatagctacaacatgctgct

SEQ ID NO: 2606 - DNA, 614 bp, Rattus norvegicus
  Genbank Accession No. AI232303
catccacaaaaacaattttattaattcaagaaccaagaagtgaagaccatgtccctatggcttctagccccctcaaaaggataaggctgggttcatgaacctggggtagaaatgtcccctatccctcatcctcagcttattagactggaaaagtttgtgcaaagagatcaccagaggtgccaaatatgggggttgggtcaggccagggcagcagatgaaggaaaaggtgaggggtctgtggagggccccggaaagaccaggggagcaggagctagggagccaaaggaggtgggaagagtagggctagagcctaggagtggggtccattctgaagcaggttggtctcttggctcccgatggacaggctgtttacagatagggcaggtcttgcgggtctgagtgagccaggggtccacacagcgactgtggtaagcatgagcacagggaagtatccgaagcttgtccccgtcctcatactcatccagacagatggcacagacatcatactcatctcctttttgataatcatgagtaggaatctgtttcagttgctctttggtaagtctgttccgttgaagccgcttccggtgctggatgcaacgaactatcaatac

SEQ ID NO: 2607 - DNA, 561 bp, Rattus norvegicus
  Genbank Accession No. AI232307
ttgctcatgtatttattccgcagtcaagtaaatcataacgtcaagccgcagcatgattaaaggagaattactggtacagctgtctaaagtgcaacactgacaggtgttctttcccatgatgaaacaaagacacacttccctaaggtctgggagaggcaaacaaccctttgaaacaaactgcccaacaattagaggcagactgcaaataatttctactagcatttttctgcaaggtggagcaaccccccgggtggctaactcaagccctcatgtcacccacctgtgccctggctttggtctccttcctcaatcacacctacacccaaaaggcttctctgcttcacacttagacaccccccgagtcccggaggccctgagcactgctggccatgagtgagtttgtgaacaactttcacccagaatctcgtgggagaccaggagcacgatggctcagcgatggcttggtgtcatttccttaaacaatagttctaactgttaaacaagctgacatttgacaggccatttgcacgccataaacaaaccagtgtattcttatctttt

SEQ ID NO: 2608 - DNA, 533 bp, Rattus norvegicus
  Genbank Accession No. AI232320
ccttctttccttttaatcgccatattaaaagtttagatccaaaattttagaaattctcgggaaactttaagaaacgagcatgaactatgatagcccacagtctgataataagctgcaacaaacgggcggttgccaggctggggggaaggtctgtatccctgcaggtcagcggctcccctttctttctccctttccacaggggggctctggtccacagcaaaacctggggggctcactgcttcagggagggtcacccaggatccacagagggaggcccttcaccgcagagcagatcctatggggtcgctgggtctattcaccgttcactgctgtgggtggaattttaaggggaagccgtttgggtaacggctctgctcacattttttccccggggaatggttgaatggattggcctccttagacgggacgccgggcatattttctgcggggcatctaatccactcgttcaaggtaccaagggcctgggaagaggttgcttgtgtcaccagggggagagaagttcaccttgtggt

SEQ ID NO: 2609 - DNA, 590 bp, Rattus norvegicus
  Genbank Accession No. AI232321
agatttggcttttgttttattttgttttgttatgtttgaggtaaggtctctatagtcctggctggcctccaactcggagatcttcctatctctgcattccaagttctaggattagaggagtgtgcccccatgcatagctgatttggcttcattttgatacttatttcaatattatctacatgattaacaggtaatcaaattttcctccagacccaaccaagagtaatgttccattcagttgtttcagtctggacaaaaaatttgttaccaaattcaattcaattacacacagtagaaatttgcctctcccaagagtgataaaaatatttcttttttaaaacaaaacagagccttgaagaatgaaactaccacacagacctcctatgcaagacacaaccaagtcgggggagcatttatcaaagcagataaatgccatcctgataacagactagaccggagttgtaagtgccatttgtcattaacccgtcttccattaacccgaagcctttggtttatttcttgtagcaaaccactcgtcacttttgtctgctgccattgcatcatccaacaatttgcttccttttggatcc

SEQ ID NO: 2610 - DNA, 558 bp, Rattus norvegicus
  Genbank Accession No. AI232326
cagtgtaaatatattggctttatttgtgtccattcggacgcctcacagacaacatccaggtaaaaagaccattaaataaaacgccttcagcgattgcaatgcaaaaataaatatcaatcctcggctgcagcggcagccgcgcagcgccccaagtcccctcggtcagctcaacaattataaaagtgttcagtgagagtgtcggcgtgagtgtgaaccggtatgcgctgggggtggggtatgcacagtggagcggtgtgcagaatcggagttgcgagccaaaggcctttgcagcggcgaccccgggcgagccgactcagcgcgggccgccttccgcgcacgctcaccgcagagttcgtactgggaaagagttaaaaaataaacatttacaagggcaaagaaagcggcttcccctccctggcgtccccggacgcgctccggggtcccggctgatccgcagccgggctacagtcccagagagtgaggggagctgatcccgggtagtcgtggccgcctggggcgcgggtcccctccggatgcttccgctgatgctcggcgctt

SEQ ID NO: 2611 - DNA, 562 bp, Rattus norvegicus
  Genbank Accession No. AI232332
ccaaaagctttgagctttattttacacagaaaataaaacacaggtactattcggttgtactgtaaacctgagttacattttaaacaagcctatttatcaaaaagttacctaaaatattttttgttgatatgaatagctgtaacggcatctgtcctgaccctatgaagtgtagattttaaaagttaacaaccatattaccaagtgataggccaaataaaatgcttgtgtacaagattacatatatataaagtgttgtatatacaacacgcacattctcaatgaggaaacttttcacccccaagggaatgaacattggctattttttatgtgcaaaataagacatagatacagtacataaaatagacaaagtatatcggtgagggtgcaggggaaacctgttctctctggtatttaagttacataggaattctggaaatgtagctcagttttacaacatttgtggactgtgactacacccagtatggcccacaaggcaagtatccttaagagtgccaatagttgaacaaagctaacccccacttcaaaataaaattctttacaa

SEQ ID NO: 2612 - DNA, 572 bp, Rattus norvegicus
  Genbank Accession No. AI232341
agattcccacaacatggtcctctttattttcagtctccctacctttgcgccatggaagaaacaggctgagggcatgggcagaactgtgaactggcccagaagcttcttgctgacatgacagaaaagaggggtgtaaaggaacccccatcttctaatctagttgggggaacaaacatggagtagatctgtgggaggtgggtggagcaacagaggagggcttcctaaagcacaatgggccctgggaatcagtcctctgtcttcctaccagaccctgcccttgaaggcctcttataaactctcagactgtgagctatgccatcactgaggatgaaaaaccaggaggtggacatccatgacattggttcccgtcaaccctgtatgcagcaaatgtgttccaccctggaagctgcaaaagaacgtgtacgagtcattgttgtcgaggaaggtggcaaaatccaggttttcagcagaagcctggctaacaaggtcagacatgacccaggccccggccacctttgtaggcccgtcctgcccatcagtgcctccactcaagaacagcacatcaacaggcc

SEQ ID NO: 2613 - DNA, 579 bp, Rattus norvegicus
  Genbank Accession No. AI232346
caaattacaaatctgttccaaaatatacttacattaaataaaatacgcatttcagtaagatctacagtgaatgactatgcattctgggaagcttcacatctaggtagggtcagcattcgtggaagaagctaagagaatgtgcatccaatcacagtttatagcgggtttcttattgccaatctgccagtcacacggaacatgtcattacatcacttgtgcaggataccgattgttgggggaagggcagcaagcgctacatcctcagtggtgagttccttacaacttcggaggaattccaccagacagcctagacagtagtttcagtaaacatgttaagggaagtagacaactctctcgaggcccagacacactttcttgctgtattgtgttgttctccacctacagtgggtagtcaggagggtcttcttcaggacagcatggtcgcaggactgggacaatcccaaggggctgacagggagtatgaggatggggaagagggataccttgagctgtttcacatcagagacaactgtgacaaagtccttagacctgccatctctccttctatcatctggcata

SEQ ID NO: 2614 - DNA, 615 bp, Rattus norvegicus
  Genbank Accession No. AI232350
ttgggatacacaggcacaggcacagtcactcgggggactggcgtgccccacggaaccaaggatgggcttttataggattttggggagcagaagcaagcatacacaagcagatgcatggttacagggatataattggtggattctaatatggcaagggtttagcccgggggcaagtttcctagctaccttcctgaaacataacgactgactcggcccccccaagggttcagcctgggggcaagtttcctagctacctttctggaacataacgactgactcggccccccaagggttcagcccgggggcaagtttcttagctacctttttggaacataacggctgactcggccccccaccagggtgtgggacctctcccggggcttttctcattgtcaggtgctcaactgcagtcgtcctgttgccaggccttcaaccaaacacatcttgcttggcagccgctgtgtactcagtgttctaacctttctctgaaccagtcatcttaagtacagccttgcaaaatggcgttactgctgctaagctggggtctttcattcccccattttttttttttttgctaactttgagtgaaatctttcactcgacttggtcaaaaaa

SEQ ID NO: 2615 - DNA, 459 bp, Rattus norvegicus
  Genbank Accession No. AI232397
atcatgcatatatttaatagtaaaatggtcattaacaataaaaattagaaaatttggtgagacctcagttctgtgaaagaaaatgagacaagtaaaaaagacaggtgtcccaggaggtgaagcaggcaaggagtgaagcagaggcagactgggctgacagggttacagattctaaggtgtgggtaaaaaggtccctacttatctgagtcttggtagcaggcattcttactgtaggccacacagaatgaaggcagttacagtgaggcaggacagaagagcaatgagaacccaggtaaggagatggggaaaaccaggatacagttacacagagacaactccaaggccttttgtttcttctaaagtcttaagttttaaagcatgtcacttaaattccagatggtgagttacacagggcacagtaacggaatggtggtatggactaaggtgacaggggacctg

SEQ ID NO: 2616 - DNA, 506 bp, Rattus norvegicus
  Genbank Accession No. AI232408
cccagtgaagtcatctttattgcatattgctatttaaaaaaatgtacagtctcatagcacacacgacacctttttttcccttggttctgtaacaacagtcttgcatctaaagactaaatgggtccaactactaagctagtaagatacgagacattgattaagtttagaaattataatgcttttctttttttggcattatttaaaaaaatctttaaaatacatactcaagagagaaaagtgactacttacaccagcaccagtctaaaaagtccatttttttttttttttgtaacaatggcacatgaagttacctgcacagtctttaggaaaataaaccggaagctgggaagggcaaaggtggcctaccaggagggctacatggaagtgaggaggattctaagaaaggcaaggggacatgcgacacagacttgctctctggtgtgagtctctttccacagttccaaaactgagctggaccaaacttttcctgctatcaatagaaaaga

SEQ ID NO: 2617 - DNA, 359 bp, Rattus norvegicus
  Genbank Accession No. AI232419
acattgggaaacttttattaacttaaactggcattcttaattttgcccaagttcttaataagtgtctttttttaaatcaatctgcaggtgtttttaccaccacagaatcatgacgacttgcagttatcattgtcctgtaatgattaaaacaatggtcaaataatcagcaaggtacttctctaaaatacttaaaagatattctgaggagtgcagggcagggacataagctcacccagaaacacacaattcactctgcatggccaactagaccccaaaggtggctgagctgagctgagcactgctttgtcccatgctcctgttgtacatccacagcaggaggagatggcaaagcagctgcc

SEQ ID NO: 2618 - DNA, 484 bp, Rattus norvegicus
  Genbank Accession No. AI232431
ccaaacttttatttgtgcacattcaatttaaaaagataacgtttacaggttctttggtgcctatattcagcatacaaaaatgtaaaagactattcacaaatcaaacacattagctccaactggaaaaataatgacatcaataaaacaactgtaaggtagtgcacactgcgacagctctgcctgtggggacatgagatcactgcgaaaataaatagaacgtccttttgtaaaagcagcaatgtcatgtcttgtaaacttcctttttatattacagcaaaggttgaagtaaaatccaaagagactggagcttacactgtagccgtgagtacgagtctctgtcctcagtcactgttggtccagttttccttgtgtttcgagtccaatgtgcagcaggtttcaaatggtgctcagttagagactctaaccaacgaagtctgagttacaaaatctccttcctgctttcaaacacgaatgggtagatctg

SEQ ID NO: 2619 - DNA, 436 bp, Rattus norvegicus
  Genbank Accession No. AI232489
gacctgattttattaacagtcatccagctgtcttctatccagctctgatctcagggggcccctatgacagttcagccacagtgtgtcacacattccattcccaggaggctgggtagaaaggtctctggtaactagcagcaatccatttcttatgatgggttgcttgactgccatttggtctcatgctccagaagaatcttctctgtgaatagtcctctccagctggaccgggaggagggacgaagcctctctggtaaacactctgattttgtgaccattttctgaatgagtacgctgagctctgggtctgaacatgctgggacgattccagatgaccaccacgtcggcttttcttaggtcctttgttcacaggtttgttagtggtgtggacttgttctgtaagatgtgctgagtcttcaagaccacctgatctaaa

SEQ ID NO: 2620 - DNA, 370 bp, Rattus norvegicus
  Genbank Accession No. AI232506
cacagcttggggatttaatcttcactctcctgcataaagtcagggtggggatgttgcgtccagccctagctgggtatattgactgggatctatgctcctgacagccttttgaggtgacttgcgggtttaagatccatccctcagctccatctttcttctggacttggatacagccgggtgtcacggatgggaaggaactcaatgctggggaggggactggtaaagatagcccatgttccccttccatcccccttgccaacagtcccaattcaaggagctcaccggggtgggcagttcataccattgagctggaggagccttgaagcctctggaacagtgcgctcaggaaggggatgtaaaatgccttgcc

SEQ ID NO: 2621 - DNA, 513 bp, Rattus norvegicus
  Genbank Accession No. AI232524
tttttttttggttctgttttgttttatttttaaaatttttttaatttttatttatatgagtacactatagctgtcttcagacacactagaagaaggcatcagatccattatagatggttgtgagccaccatgtggttgctgggaattgaactcaggacctctggaagagcagccagtgctcttaaccactgagccacttaatctccagccctgcacagctggttttaaggcttcttttggtccagtattttctatgttctcccttttggcatagcactgtatattctgtgacattgtatgttgtaagtatccgacatggttttttattttgattttacagtgagcctcagaagagactttgaattttggacttttaagcagtcttgagcctgtgagagactatggaaaattttgaagttggactaaatgcattttgcattatgatatggctaccagcctatgaggccagggggcagaatgtggtggtttgaataggaatgcccccccaacata

SEQ ID NO: 2622 - DNA, 535 bp, Rattus norvegicus
  Genbank Accession No. AI232534
gaaatttaacacataaatatattttctaccacatgcttcctcattcctttaaagttcccctcgcctctatcgagcagcttctttgagactgttaggtcctgggttttgaagactgtgctgacaagactgagcccatccttgaggggttgctttcacctccaggatgctctgggcttcttgggctgactcaagacttcataggcagcctggatctctaggaagtgcctctgggcctcctccgtctggtgccggttgtggtctgggtgccagaccttcaccaggtctcggtaactccgatgtatttcttcattggtggctccttctggaatgcccagaacctggtgagccagctgacgtttctcatcctgaaaactgtcaacaaattcatagagcttttcccattcctggaactggctgctattgaagccaggagccccaaccagtagccaccagatccggcaaggcagaagcaagacagactccacgagacgaccgagaagtgggaaaaagttgaaccaactcaagaaagaaccaa

SEQ ID NO: 2623 - DNA, 510 bp, Rattus norvegicus
  Genbank Accession No. AI232552
ccattcgttcattttatttttcagtgcggggaactaaactcagggcttcgtacatgctatagtagtctcattgaccacattcccagtcctgctgttgccgtcgtcgtcgtggttgttggtgagacagggtttctctctgtgtagcactggatgtcccaaaactcactctgcagctcaacgtccagtaggaatacattccctaggtcaaggacacagggacagcaactcctacaggattccagaacaccagtgtaaagagaaaatcctctgagacactgaccctcacctgagcagggtaggcggcctgagccagccctccacccttcagctgggacagggccttgcggatcgtgttcagctcctggattgtggctcctcgggccgccagcagcttggtgagcgtctgtttctcctctagtgtgacaggtgggataggagcgggcagcagggctgagcccccacctgagatgagcacaagcagcaggtcgtcggcagtgagcctctttgcca

SEQ ID NO: 2624 - DNA, 370 bp, Rattus norvegicus
  Genbank Accession No. AI232611
actttactcattgtatctcatatagctgaatctgtggcaagcacatgttgatagtagggtaaccattgattaataaccattaatgccccgaacatgaatttcatgtcatccagcagaaaactgatttcacatagtcactggacattaaaatttgaccttgaatctgccatgtctgttacaggcaaacgcactacaatctgcaggaggctctgttgtgagtactgtccaggtgtttgccaaagaaggatagaatttgcttccatgcatctatctgggcttttgagtgagccctgacctcccctccccagaccacagctttgttcactattttgtgcagggaagctgggcacatggggaagtaaggtggctc

SEQ ID NO: 2625 - DNA, 522 bp, Rattus norvegicus
  Genbank Accession No. AI232613
ataaattaagggtttattacaaaataaaaagtgttaagtttctccttgtcagtgattcaagaaaacaaagccagaagccttttgtggagccgaagccaggacctctgtgtgcaggctggtggtcaaaagccaggctcatgagcgggcagacagacactgattaacgacctctagcaggtgggtattctccagggcagctgccactcgctccttatctgcaagttgtttgttcactgcatgctctgaggcgtgggtgcccggcgtaatgtgcacatccatcttgaaccgctggggaagggatcgcagaagcttgactttgatagaaaggcctataagtgtggccatgctgcagtgagggatggtgggtgtgaaggccactgctactgtgctctccgggtcgctaacctgaattcgaacctgctctactacgttcaattcctccagtgtcagtggatgctccgggtcattaatggagcgaataagatcgaagatctcccgggcatcgatgctgtccggcacttc

SEQ ID NO: 2626 - DNA, 605 bp, Rattus norvegicus
  Genbank Accession No. AI232643
  misc_feature (1)..(605): n = a or c or g or t
ggctttaaaaatagttttatttttcccttcacagacacacaggcctctgaccataattcatggcaccccaaattaaatatagacttaagagtatatttgtctgacatgattcaagaaagtggattttaaatgtgaatgggtgccaaccatggggactggaggagggtggtaccagcaaagaggggcgtacatcattcttacagcgactcttagacttggaatcaatatgtgctcatcatatacatatttagcccaaatcagtatgctcaggagtagaatttcttctgtctctataataaaaaggccaaagcacttccttaacattcgaaatgtttccctagtagacttggtatagtaagagaatgattgctaaacatcctcaatgtggttttcattatgaaaaaacatgtttcacataaaatcttcataatataatccagaggccaaatttgtgcatgtttaaaatttgagtccaggctagatatttggattttcccccccttccagtgtttttcatttttataaatacatacctagncttctactactttaaacatactcggaactcttttagaaaccatggctgcctttcagtagcatcagtg

SEQ ID NO: 2627 - DNA, 422 bp, Rattus norvegicus
  Genbank Accession No. AI232666
tctttagaattttattgattttagtgtgatgggcgtggcccttgtgcgctacacgcatgcctatgaagccacactacactggctgctttcacagaggacccaggtccaattcccaacacccacgtggtggttcacaactgtctttagctctagtcccagaggacctaatgcccccttctgggctctgtgggtaccaggcaagcatgtagtacacagacatatatgtaggccagagaccatgcatacatataaaataataaaatacatcttaaaaagatcatttttgtttatattttttatatcatcagaagaaatctctcttccttgaaatataaacaaaacctggcccaaggcgggctgtgtcaagggccactggtgatgtgaattcatattatgggtccttggggaggaactgtttccat

SEQ ID NO: 2628 - DNA, 648 bp, Rattus norvegicus
  Genbank Accession No. AI232694
cagagtacatgaagtaatttattgatattggttaagatccattatatacaggtagaaaccatcaaaattgtacaaagaaccattaagaatatagataccattttatagacaaaacaactggaaaatattttaaacagacaatatataattatgaaaaaaggagaacacaaattgttctaccagacagatttcaggcttttttaaaagtctgctgttgcagaacttaagttgaaaaaaaaatctgtttaatgtagtcacggggttttaaaaacattaggtgtaagataaaaatgaaggcttttcctctcacagtaaaagagaaaggagccaagataattttaccatgaatctatacagtttgaaaaataatttatatatcaagcacaaagaaaattgaggctgcaaatggttctgtaaactatgtatttatgaaatgcaaattgtgtcagctttagaaattagaagttggacagcaaatagtgttccctttacagtacactacccctccacgggctaccactgagcaccaaagctgacggtctgggtgctgtccaggcaagctatcctgaaagtaatcgagaaattaaaactagcctactatcatcagaaaattaggcaccaagtcggagactgtctcctcaaggatgc

SEQ ID NO: 2629 - DNA, 561 bp, Rattus norvegicus
  Genbank Accession No. AI232734
gtataaatagactttattgaagtcagtgcctctgtgtggagacagaagattgtgtctacagaagcacaagttgtaacatttcacaacttctaaaaggaatgtcaacaattacaacgatcatgcataccatggtcgataatcacattttagaagcattttcaaccatttctaaagaaatgcttataacattgttatatatagaactactttcaataaactgcaaaacattgatcgacttttccagtatgagctacagtgtcaacacaaaagggaggcataaatgtttaatttatgaaatcagaatggaatatttactgtaaagaaaaattaaaaagctttcaaataaaggccattattgaaccaacatgaagagcacaacttgaacttgacttcattcatctttaaagctgtcctctgaggagcttcagttctaagcagtgcactcagtactgtgaatattccttggactgaagtttggcaatattgcggtccaactgtctctttgcttcacactgtgggaaattgctcatgtcataattttgaggggcaattttaaccaac

SEQ ID NO: 2630 - DNA, 434 bp, Rattus norvegicus
  Genbank Accession No. AI232793
gaagtctttattgaaccaattgcatgttaggttacaaagctatttcacttttccaaaatgctgtttctctttgtagaccaatctggccacaaaaggctacctggctaagtattagccagaaacttctaaatcccagtgtgatcttcttggggcatttttctgaaaatgaagtacaaacctgtattagttccatcctcagactcagttcccacctcccgtttctcctagcaactggtctcagtcccatatccgcatttctcatccatagatgtccactgataatgggtttcatcacagaccattgtctgagcttcccccctccttacagtctcccgctggattactggacggtgctaatggtcttcaatgggcaagccatctttgtcccaaatgttaacagcaccatacaggccaaactgaggtgctggctagcc

SEQ ID NO: 2631 - DNA, 573 bp, Rattus norvegicus
  Genbank Accession No. AI232815
ggaaccaataaagttttactggagttatgcaggaacatgggtgagggattattcagggaaatgactcagacacatgcataaccaaagctgactcggtgacagaattcctaaccactgagctctccctccagttctctagtttttgtccttgtagccctggttggcctggaacttggcacatacaccaggctggccttaaacacatacacacagatccacctgcctctgcactaggattaaaggcctgtgccacaccacacctggcccattttggtttttggagacaggatctagtgtaagtcagcatggcttccaataccttatgtagccaaggttagccttgcatttgtgacctcccacctctacctcccaaagctggccttaccattttgcacaccatgatgctcagcttccgtcaaatgactttaaaaatgtatgtcctaagaaagctagatgtatgcatactctacatggaacgaaaccactcccaactgcacaccctgagtgctgtgtaagctcatgtggatgactagaccctaacaggcggtaagtcaacacacagaggtaaccggg

SEQ ID NO: 2632 - DNA, 371 bp, Rattus norvegicus
  Genbank Accession No. AI232903
cagcgtaagctttataagaaccaaaagaacacatttccccacattgtctccagtccagtaggttctggtgggcttgttcagtcctcagtggagacacttcatgctttgccacttagcacattctccatggctttggtcacctcagcagcactcagattgttcagagacacattcttctcttggccaaaagcataacgggcccagagcttgggctgcacctctgaacattcgcggattaaaatgggcaggtcggggtgcgccttcttcagctccacgtaccgttgctggatgaaatctctcacaccctggctgcctggggaacgctggcataagtgaatgcgaatctcacgcagtacctgctttgcaccgac

SEQ ID NO: 2633 - DNA, 476 bp, Rattus norvegicus
  Genbank Accession No. AI232924
cttcctccctttcttagatgaagtcttattctgtaccaaggctggcctttaatctgtatcaatcttcttgtcttggtttctcaagtactggtattctgggcctacattaccatgcctgtctccaacaatctagtttttaaaaaaaatatggaaataccctctaatagcatatatgtcatacataacatttcagatcaaatgaccagtagaatttaactcacatttaattaaaacaaagatgccatgagtaacacgagctttggctaagcattaaaattctcttttacacttaggaggagtatacacacaaataaatgatctgagaaatagaaaaagaaatctgattagaatttggagactaatgcaaggagaagaggatattaatacaaacccctgctcgagtgcttgtctggcatggacaagaccttgggtttgttgcccaacaccaacaccatcacacaaaaggaaaaagtctg

SEQ ID NO: 2634 - DNA, 450 bp, Rattus norvegicus
  Genbank Accession No. AI232948
ctgtattggcaatttatttaaaaaaaaaacaacactccagccaccacattttcttctctgtccatcatttcccttttagaggaagttacaaaagcatcagggggctttgccattgttataacccaaaccacgtacaagatcaggactgactcccgaagctggcagagtaaagtcaacgtaagaacgattgggttacagcaatacaggatcacgacgttgatttacagtgcatcggtggtgagttcaccagaggggattctgagccaaagactaaagtaaaagcaccctgcccgcttgcaggccaggagacccagtgcaagcgccacagcaacaggacaccaccacgcagtgaggcttttctggccctgacgacggggagggcgctctgcccgcccggcgaggacccggggccctcacttggagtcttggtccttctcatctatcagggca

SEQ ID NO: 2635 - DNA, 521 bp, Rattus norvegicus
  Genbank Accession No. AI232970
ctggaaaaaacacactttattgggtagacaagtggcctgacagaaggcctcagattcacagttgactgagcaaacataggttaaggtgttggaatctgtctgcatcccgccccagcctcctgggaaacagctctgaattgagtcatgcgtgggagggttccgacccagttgggatcgatgacagggctcccccacttcacctttcccaatggctctgaccttcattgataagactgaattcttaaaggctaggagcggagaggggcctggcactccgatgtgttagtttaatagcaagctggccagagacaccgtgtgccagttgctgccacacgcgaaatggagacccctggtggagggagaaacctctcagctcccggagactatttatagctagggctccaggctgctgatctgtgacattctcctgctgccaccaaaccttggaaaggggccagtacaaggcatactcccatccccctgctgctttccctcaccccagggcaggctcttttcaatgg

SEQ ID NO: 2636 - DNA, 410 bp, Rattus norvegicus
  Genbank Accession No. AI232984
cttagaaaggacatttaattggggggagggtatacagattcagaggttcagtctattatcaaggtggaaggaatctcagtgtccaagcagacatggtgctggagagagttctacatcttgatcagaaggcagccagaagactcttctgccctgggtagagtttaagcatggggtctcaaagccaaccaccaccaccccctcccccacagggacacacatcctcaaaggccacatttactccaaaagggccatacctcataacaatgccacttgccatgggccaagtatattttaaccaccatacctttgaatatcacagtaaaggctttactgcattggttacattcatagggttactctttagtatgtatgtgttcttttatgtagttggagttggcttgattgtgaaa

SEQ ID NO: 2637 - DNA, 484 bp, Rattus norvegicus
  Genbank Accession No. AI233031
  misc_feature (1)..(484): n = a or c or g or t
taaaaatcactacaaaaaccttacaaaagagtcttgggagctaaaggggcccttccctgcctcagcccctgagcttcctggcagaggaggacgagaggaagatggaggaaggctcctggcagtgctggcatctccaaaaaccagaggggtggcttgggtggcaggacacaggttggggacctgaatgtcttcagcaaggcacatcagagtcagggtaggtccgcctccacccatggagtagaacaccaaggccggtctaagctcaggagaccaacacttgtctttttcccacccgggcatctggggatatgtctaaagagggcctctctagcctctgcttacaaatgtggagggactctaagttagggactagcccaacctacctcttgccaaaactatccacgagtgccagcccacaaaaggtcacctcctgggccccttgggaagcaatgaagactccctgggcctgcctnctcccaggccc

SEQ ID NO: 2638 - DNA, 445 bp, Rattus norvegicus
  Genbank Accession No. AI233054
agtagtttattgtcttcaagactacagtgtggattcctctcccggagcagggtctttcaaaggcaggggactgtcatccaggtgcaggctgctcacttgtcattctcgtacttagctggattcttccgtttggactgcgcaaactcctggttgccccatgtgtagatcagatagaacagtacaaatggcggcgccacgcgcaggatgcgctcgcgagtgcggcgcagcacgttggggatgcctttgctgaaatagtgcgggaaggcgcgctgctcaaagggcgacaagctgtaggagatcacatgccgtatccgcgtcaggttcccaaactcgcggcccatggtggcggcggccctgaggacagaagataggtgcgtggctcagtctcgcaaaaaactcccactgcccacgaccacgaccctctatacccagtcaccctcgtgcc

SEQ ID NO: 2639 - DNA, 388 bp, Rattus norvegicus
  Genbank Accession No. AI233081
gaacagacaatggtttaattttatttgcataaagtggtcatgaaaggttaacccattcaaagacatttttgatattccaacatcctctgccatgagtctattacaaatagatccctgcctgccacagagcagaagttagactgtcagcccagcatggtaagtaattttaatatctttccaaaggcagcttatgaacaattccacacagctagttaccagttaatggtgcatagaaatacatctgtggtggtcatggacaaccagatctagatatagtaaggatgagagtggcatttttttttccctatcaaggtattttaagccttttaggggaatttctatagtgtagaatttaactttcatattaaggggtatcttaaatatatcc

SEQ ID NO: 2640 - DNA, 354 bp, Rattus norvegicus
  Genbank Accession No. AI233114
agtttgaatggtttattcatacaaagaacaaaatgacagcaaaatgtaaagctaacatttcaacacaagtactgtcaaaatcagacaaaacaggatggtggccaagggcgaaggggacagaaggtcacagcttattgggagagtttcagttgagcacaacagtgacatctcagaggtgggcggaggtaatgatgatcaaatgtcaatgctgggaacccttaatttaccaccaactgcttcaattccacgggtgatcttgaaagatgaagctcctttggtagtcaaagtagatgcaagacgtagtaaatgagaggttcccaagtagttgtagttctcatatctactgcctgcttt

SEQ ID NO: 2641 - DNA, 526 bp, Rattus norvegicus
  Genbank Accession No. AI233163
tttctgagaaaactttattggcctttggataaagtttatttgccaggaaggatgatgccatcatacttctgctggaaccagcgcatggcctcctctttgctgattctgtgtttggccccaatgcagcctgttctgcgcttcttgtctgcgatgctgaaacctggcctacccagcaccacatagaaatccaggccatagatgccaatgcttgggtcatatttgatgcctaggtcaatgtgttcctgaatcccaaagccaaagttgccggtatctgagaagttattcttccgtaattcgtactctcgcaccttcaggcctttctccagaatctcctctgccttggctccacggacagtgcagtgaacagcgattttctcatttctccggatgccaaaggacctgacggtgtatctagctttggaaaacacaggggtctggcctgtgagctgctccaacaccttggctgctcgggtcagtctgtctccactctcccccacgcagatattgaggcagagcttgcggatac

SEQ ID NO: 2642 - DNA, 566 bp, Rattus norvegicus
  Genbank Accession No. AI233164
ctgtctctctgcatcttcttctacagctattaggtgctgtccacttttctgcacagaccctgaaccatgcatcaacttacaataactctctcagcgacttagcttaacccttcaagtttctgtaactttctcttcatatcttttccttatcttagccagattggtggggcattttccagcccctaggagaccgacccttggagcctgggggcagacctggcactccctaccttcaggcgtctgaagagagcaggcagaagtgagggccttctatccgtgtctggaacatttttttctggtctccagtaggattccgtctttcatcggtggtaaagaagacctgtaacagttactaacaagcatatcaaatgggatggtgagaaaacaagagaatcttgagaatagagtctaccgaagagggcaaacagcatttagtcacacagctaaaccaggaggcctttcttggaacaaaaaggccattgtcagtgtcagctccatggctttgcctctcaagagaaccagcctccaaatgacactaggctttctagtaacaactaataacaaaa

SEQ ID NO: 2643 - DNA, 539 bp, Rattus norvegicus
  Genbank Accession No. AI233182
cttagaaagttactttattagaattttaaacagtttaggcaatgaaaccgttctaacagcaaatgcacttcctgcttacaatgaaatctatttcaattctgataatgacatgacaggtccatccaagtttcttccaacagaaaagcccacagctcaaaagttacggggggaaacatgactaagccaaaggacttcacatgtttaccacagaagtgatacacattaaaataccacataatactttctaagagaatcaagccacttgtgaaaccattagcaagcatggagactgaaacaactgcttaggcacaggactaactcaggcaccataaaaccctctgtcttctcacttaacaaataagattccctagagacaattatttgggtgcctgcttgtaaaaataaggtacttaatgacggaacggtttcttgatcatgatcatacttgggtaatctcaaggaatgaagatgaggattattagacatgattacattaacatgaaattctttatctatacactctgatttccatgtcctga

SEQ ID NO: 2644 - DNA, 701 bp, Rattus norvegicus
  Genbank Accession No. AI233194
gcctgacactgaactttaatatatttttggtttaaaagtttaaattgattaatatacaaaaggctcttgtgccagtgaaaatgactgctaaatattccagagcttgttagtaaaacaagaggatcaccatatacatacacatatgtatatatgtatcaaaatagtatcagtacagttccattctccagaccgtgaagcactagggcagttttgattacaaacacaataacaaaagccttccactttcccaagacctcttaacactgtttaccacttaactgaaacgcagtactaaaataaatattttctattgtagaaccactctccaaatttttgtaggactaccttaaaacagcaggctaatgacttttttcttgttcaaatggtatctgcttgtaaaacagtaaaaacattcaaaaccagtttacccaacaaatacctcacattaggtttccttttccctcaaaattctcaaaatgacagatgctgacaagacacacacatataaacaacctcccgagactctccaaagtaaacttgatggaaacccttcctgctcaagggttatacatcttaggataaagctacccagcattttgttttgggtgtgaaaatgccataaaatgtccaaggattgtttttgtgttcaagcctatacatctacaatgtagataccccccagaaaagaattactcctacaa

SEQ ID NO: 2645 - DNA, 637 bp, Rattus norvegicus
  Genbank Accession No. AI233204
ttattcagaaaagtgattcaactgcaggagcatgatcttttcagaggaaatccaaaatctttttgtcagcaatcctgttgattccaacttttatcatcctgatgatattctcttgtctgaagctcttcatgcattcaggtacttggcatgatgcctgatgtggtcagtgatgaaggttgcaatgaagtagtagctatgatcataaccctcttgtagcctaaaaacaacagggattttcttttctgtgcaggcagcgatgaagttgtcagggagtaactggccattcgagaggaactcgtcatctttcccctgatcaattagtatgtcaatctgtggacccgagtaggacttcacgagacaggtcgcatcgtacgccttccatttactttgatctggtcccaaatatccattaaaagcttttttgccccaaggacagagcacagggttgcaaattggagcaaatgcagatacagatctgtattttccaggatttttcaaagcgcaaatcagagctccgtgacctcccatggagtgaccaaaaatagatatcctctgtgggtccactgggaaattggcatttatgagttgtggaagctcctctgttacgtaagagtacattctgtagttagtgttccaa

SEQ ID NO: 2646 - DNA, 404 bp, Rattus norvegicus
  Genbank Accession No. AI233222
ccagcactaagtcaggttctttacttctcagaagtgactgctaaaaggagagacagcaagaagagacagacagagccagagagagcaaggtgatgggaagaaagggcacagtaaaccgctggtctagtaagtctcaggaggcaagtgctcaaggtaaaaaagagtcctggagaatggtctgcggccacgggaagcgcctgggtttccttctgtgtatcagtcctccaggaaggctgctgccgttaccgcattaaatattatgtacatctcggagtcccaggtagtgagcacccgggggggtcatttcaccaggggccgagttttatcatcatcaccgcactggtgggctttgtactttttcacttctgccatgtacttggcccaccctcgtgccgcctcgtgcc

SEQ ID NO: 2647 - DNA, 563 bp, Rattus norvegicus
  Genbank Accession No. AI233224
tttttttcatttttagaaaagcttttatttcaaattccattttgcatattgattttttttttttggaagaagacaagtgcattttccttgagcaaaagaattgagttatgatttagggacaggatcttcattcagcactcttaagcaaagtcaaggttagggatgtgatcttgcaggtgaataaatgcttgcttctcccagaaaccgcagcagcggtggttttgttaggatcaaacttgagcttcaggatcttgctgttggggtgccatgggcaggctaacattacaggaagcttacaaggtcagggcccagtgtcccagctgactctattttgggccagagggtgcaagggccttgtcacagcctgccatgcatgcttcaatttcttccacagtccggggtacacatgtcagcagctccatgccactgtcggtcacgacaacgtcttcctcaatacggaccccaccaaagttgcgaaaacgctgtaggacctcttggttaaagaagcaggcttgggccgggtctgccagggcctggtccaggaggtggtcaatcctcgtgcc

SEQ ID NO: 2648 - DNA, 550 bp, Rattus norvegicus
  Genbank Accession No. AI233226
caccatacaatataaaatttattataaaatttcggcaaatataaatatctgtgttcctactgggaaggccctaggtgggaaaagcagagataagcaccaatactgagggagaggggtagagaggttggaggtggccctgggcttttcctttgaaggccattggccttggctgtcagctcagaaccagtcaaactcatgggatgcattttaaaaccactcagcacacaaaccacagcctcgggcttaacactatcaatgctttggccacttgattgaattcgattcccggggaccctcactttccagggacacctagattttactgtaacgtgcctttccgatccctcatttaaaacataacagcattgagaaaacatttgagacaggaacttcctgtaaaaagctgaggcggagacaaagtatcgaagttgctcctccagcccagggactggaagtagagaaagcaccttagcaggagtgttgtttatccatttccaagtttgcaaagccctatatcagagctccctacccatacccactcccaggtaca

SEQ ID NO: 2649 - DNA, 661 bp, Rattus norvegicus
  Genbank Accession No. AI233232
acataatacaaattcttagatattttaattggatatttgtgcaaagtttggataattaatgcaaataggtattacctacagaataaaatataccagtcggcgaacccctctgatggtattcagagtcaagttgaggttgtatgtacctcaaagattcattatatccccaacacagcctacagtcacccttcggcccctttgaagacggattccagggctaactggtcttgaatagcatgtagagcagcggcaatgtggccataaaagtcacacaggtgaccagcgtgctagagatggcattcctgttggcctgggcttctagcctctgctccatctctgacagcgccaacatcgtactcccatgttccagcaaagagctgggcagggccccatccagtggctccaccatgcctggatgtgccgggacctttgcaagtcgaaccaccccagccatttggctgcaagtcttttccaggctgtcaagctgctctcgtaaaccctctaggcaggaatagacctgccgggaatgattgagctgctctttcatggcagctgaaaggccatctatgtcttttcctcggggagaagaaggacctgttggtgacccagagccctggtcctgcccaacgtgcaccaggcccctcagatccaccctcgtgcc

SEQ ID NO: 2650 - DNA, 633 bp, Rattus norvegicus
  Genbank Accession No. AI233246
cctgttgtaataagaattttatttgttttgtttaaagctctgcatgctttttctgtaaataaacaataaacttttgtagatagtcttatgtgttatctttgatttctctgtaaaatcagctggctgtaataaagtgttagtgtgttaggttcaaaggaatatgtcatgcaggagtggggttacagctgtcagctgtctgatagcgcgtcagctacagaggctaatgtattcgcaggtttatagctgagcaccttcaccttttttcactggcatttcgtgtatggcatcaaccactgtaattttggccgacgctgaagcctgtccttgggaattggacgcgtggcactcgtattctccagtgtcttccttacttagaggagataccagcacccagccagttacttcatgcttttctggaccaccccgggtctgaatggccaggttttcccggtcaccaggcaagagttctgtcctttgaactccagagtgatccctttttaccttgttccagatgaggacggtggttgggattccgatgacttcgcagctcaagtacaccttggcgccagtgatgttccagatgtccttggggggcgtcactatggaaggaccttgctcgcaggtgcctttgct

SEQ ID NO: 2651 - DNA, 596 bp, Rattus norvegicus
  Genbank Accession No. AI233262
agtgtccaagcagaagacaagctgcctttattatagttgatgtcacagctctgcttgtaatagattcagccccagaaacaccccggttaaaacagcacggttgacttcaatggatagagtctttggtaaggtgaaccagaccagggctgaccgacaatcttcgggcccctggcccaggggtagcctgtagtcttacgtgaggcccagcatggcctgaagttcccgagctttatcatctggcagagagcccagggctgtgtggaagctgtcgctgtgctgcttggccaggaacgtcagtagtagtagcagtgcggccttggtgtctggggggatcctgttgtctggcaggatcaggctgcagatgcgcaggagctctgaagccacacccacaacctggtcagggttgttctggtgcaggaagctgaagaggtgacctatagtgacccattcctccatgtcttccttcaggggcagggcatgtagcagggtagctagcacctggggctctgtttttcctgccggactggccatcagcagacgggcaagagccccacagatgttatcacggactcgatcaggccggtccccctcgtgcc

SEQ ID NO: 2652 - DNA, 474 bp, Rattus norvegicus
  Genbank Accession No. AI233300
tccttggtattttttttttcaagcaagaccatgttttcctaaggggctacaatttcagtgagtctcttcttccggccccaacaaacacccctggctgctaacgttacagacttgttccagcttattggtgctgatgtccaatagccttgggggacctgccttcggctctccacaaggctattttgtttcacaaagtaactcttcaacttacgctttactataaagaaaatgtatccgattctaggctaagtttccaagcgatcctggctcctaggagccaccaacaggagtacccgggaaggccacgcagcagaacttcctcaggcattttcacagccatttagaaagatgtcttcagcgaactcgtccaaattagctacaaacgcttggcaggatggacacgttgtgtctgtgggccaatattcaatccaggtggaggaatctagagggtatatatacttgaaactgaaattg

SEQ ID NO: 2653 - DNA, 436 bp, Rattus norvegicus
  Genbank Accession No. AI233308
catagctttattcatctacttaaatctaacctttcacggagcttcggcaaactgagtgtgcaaaatgcatttctaaaacgtaatgcaagcaaagcttttcacatttacactggcaggaaatacagaaactaacaagtcacattagggagagttcagatctgtctttgttttttttttttttaatgacaagaattgcacagtttattattttgagacaagtgttgtagacatgaatatttaaaatccctaagcaaggtgcttcaacaataaaatctgttggaatgagccagtaacttggaataaagctcacaaagaatcccaaattaacgtggacagccatcatttcctgtattttttgcaaacaatgcttttaataataccttttataacactaaaggagacagcaagctgaaattttttcaaagcacacaaagaa

SEQ ID NO: 2654 - DNA, 562 bp, Rattus norvegicus
  Genbank Accession No. AI233350
acaaaagtttattgtttatttacagaaaaagcatgcagagctttaaacaaaacaaataaaattcttattacaacaggaaattttgtcatttttttttttaaaaacgacagtcaccgaaacaagatactgctgctcacagtatcggaccatgaacttctgaccactaaacactcatcatccgtggtgcgatgctcatggacatgagctcctggaacaacagcttgcacgcatacggcattcgcaccaaggagatctgggtcttattgcggcatcccctgcattcgtatgtgtgagtcctggtgttagcaattgccattattccacaaagattacaaacgtgaacctgatagggatctgatgcttcaaacagcctttctcttaagaactgtgctgcaccatgtgcgatctgacagtctcgctccatttctccaaagcgcaggccaccatcacgcgatctgccctccatgggctgtctgttaagaatctgaatgggcccccgagcacgagaatgaattttgtcatccaccatatgcttcaaacgctggtagtaagtggggccaat

SEQ ID NO: 2655 - DNA, 435 bp, Rattus norvegicus
  Genbank Accession No. AI233374
ataatacaaaggcatttattggatttgcttacatgatagggactaagtggtgtcacagcgccagagagctctgttcaagtcaccagcctgttgtttggagcatgtgggaaggcttgattggagctttccagtgcaggcactggataggcgttcctgcaggctgttccttccatccgggctcccatgttgccttcggtcaggtggtcgttacccatccactactcctgcatcactcctctgcgagtgccgctgcgtacccagagctgaggtccactagtccggttgacagacagctaagattctgttgttttccacagggtctatgtaactcaaacggctcggaaattccctgtacaccaggctggcctggaactcagagctccgacggccctgcctcctgagcactgggattaaaggcatgcaccaccacgcccc

SEQ ID NO: 2656 - DNA, 531 bp, Rattus norvegicus
  Genbank Accession No. AI233383
ttttttttttgtgaagaatatttttgttttattaaataccatgtcatctttttgtcccattacaaatctgtagacactacatgaatgatacataatttatactctgtggtttgtcaggatgacatatttacacatgcagttggtatcaatcatgctacatttccttaggagatgcccatgttaaacaaaggaggccgcttattttctacaggaaatacttctgggggtagggggtgcataccaacttgcacctgcagccattttagtactaaaatattatatttaacttagacttgcgggtcatgttcccattgctttttaacaatacacataatttgagcaaaaaaaaaaagttttacacccttttctccatcaccttctttttttggtacttaagaaagtacacagacataccaggataaactggtcaataataaaggaccacagccttaaaacagaaatagcatttaacagtgatgccacctaaaaaagcagaacaaagttgtttggaagccaaacagaaatcaaagt

SEQ ID NO: 2657 - DNA, 424 bp, Rattus norvegicus
  Genbank Accession No. AI233407
gagttctgaagatgctttatttagaaaaataccaatactgacttaaagatttttaattttttaaaatagcgccctaatcagacagctaattctgtatactaaaagtatttacacatggaatacgaaataaatacacagtaactaaaagagatagttatccatggattcatttggcaccccctctgctcatcttctgctgcagtttccgatgccttttgtaaatccttctctttctcgctttcagatccacttttggctctggtttcacccattgtacttctattggtttctcctctgctggtgtaacaaacacatctgcagtgggatcgtgtggaagaatagtctttggttctttcttccttaatttctgaacatctttgacttgctgtttctctctgtacttggcagctgtgatggaccttac

SEQ ID NO: 2658 - DNA, 489 bp, Rattus norvegicus
  Genbank Accession No. AI233446
aaggagaagggctgtgaatatatttgctcaaagttataaaacagcattcattctaacgggctatttacagtggagaatgggtagatacagttgagactgtacagtaggaggtgggccacggctggaaacccctggtttgacagcagaattagaaagatgtctacatttcatggccaaggcctttgctgctcagtcaggggcaagtgtaaacagaaaggcagcaggaacagaacagccagtccccctcacaggtaaagtggcataggctggttcaagaccttccctggcctttgcctgggcaggttgggtctcttggtaatgctggtctgaaaggcatcacagtctgctgaagccagtccctccacaaaggcccatgggtggattacaccttctaaaatgttccttggaatcagaatatgatacgtttcccatctgctgggttctgctccatgggacaatagggacactttagctttcctccattgatga

SEQ ID NO: 2659 - DNA, 475 bp, Rattus norvegicus
  Genbank Accession No. AI233468
gatattctaaagcctttatttagcatcataacacttgttaactccaagacaattaacataacttactggaagctccctaaggccctttagggcaagtacgtcagtcgggttaggttactatgagatcaccccaattaatggggaaaagctactgtacagcaggtctccagtaccttgcaaactcagaatgcacaaggccttctcttacctataatacatgagtgcagcttaatttctctgtggcatttgccactggaagttgaggctaaaggtttgtcattagatagtgatattgattaaaatctattttagggcatttttgtgattttatgtttgaactgaaaaagtctaatgactgatcacaaatgtgaacgtaaatcacaaatgtgaacgtaaatccagagtgctaagagaagtaaatacctgctctggtttagaattttcggatcaggaattctgcccccacccttgtgcc

SEQ ID NO: 2660 - DNA, 401 bp, Rattus norvegicus
  Genbank Accession No. AI233480
  misc_feature (1)..(401): n = a or c or g or t
cagtaaaaacagggttttattcttgaaaacaaaaataaaatttgagttgaaagtacaatatatccacaattctacatatctgaccggaacacagaacacaatgactgcatttttatgttagagacacagtttgggaaatccaacccaacctgtttaactgggaatgggggaactttgcttgaagtccaccagatccaggaggaaaaagctgttcctttcctctccagtgtgaaccttgggttcatgtttgatattacgtgaagcataagcatgtatgaggtacaggtcataaaacgctggggacctttgggagcaggaccttatggggaggggaagggacagagtatcagaacagtcactcatacatgaagcaaaatccaactganggttaatgggggaga

SEQ ID NO: 2661 - DNA, 501 bp, Rattus norvegicus
  Genbank Accession No. AI233570
aaaaattatttaatccatggccaacattttttaaaaactgagacacatggtgcttcactggaaaacaatccccttgcccagtaccaaaaggcacccacagctggctagaagagcacctagtcagggcctgtgctctcctgcgggccactgggcagctatgctgaaaacccagagcagtgacaactgggaggaaacactcacccagaaggcccataggcccccaaactcccaaattcttatctccaccatcccactggggagactagggcccataggaggttaatctgcctttattgagggccagcccgtgctaagactgctggaccagccatgcccaccaccttggccgaggctcagacaatcatctccagctgccgggcatactcgatgacctgcctggccagctcagtggaggggatggtgctgtcttctggcttctgctgctggctggcaaacctgtattagttgttagggcccatcagccaaccttgttttttggca

SEQ ID NO: 2662 - DNA, 431 bp, Rattus norvegicus
  Genbank Accession No. AI233576
caaacttttttttgaaaagctagtagtttatatagatcgatatatagatatatagatattgatatatattgtgtttacatagtccacaagttaaatgcaggtatccataagaagagagcattaacaataaaaatacaatctgtgtgtagccaagtacagagacttaaaatggtaaaacagcaaaaaggatctcacaaaagtacaaatatacagtacaaattgatttatttaaaacagttacaaaaaagcacaacaaaatagagattatccttagaattattaatgctttgttaaagatcaggtaggattagagggtaagaaacggtattgggtgggaggagcacctgactagttctaaggctttagatacaatgcagtcgattacatattaaattcagccattacatactggggatagtggttggggggac

SEQ ID NO: 2663 - DNA, 345 bp, Rattus norvegicus
  Genbank Accession No. AI233583
tttttagtggggggtttttttttcgtctttgataatatgatttattgtccattgacagagcaaacgcataaaaataaaaagaaaggctgacacagagcaatcaggcgcactcggcttgttgactttcaacaactctcatgtacgaatcgccggcggcgtggggcgtgggatgagggggttggggtgcattacaccagctacggctgtacacaggagcatccgtcacatgttcaccttcagcactttcccagtctgccgatctttctccacacagtatcagctgtcatagaactctgtgaaagtggttgctagctcataaatggaatcacacagagtgtggagaaa

SEQ ID NO: 2664 - DNA, 351 bp, Rattus norvegicus
  Genbank Accession No. AI233688
acatacacagcatttttattaaatatacttcatgagaaaagaacaccttaaagtgctaaattccatgtaaatcagatgattttagtaagtatgacagtggaaaaaaatcaagagaggcgcaatttaaatcatctcaggaaaagagcagaagcatacttatatcttcacataagaaaacaatcatcaaaatataaaaggcaaagaaatttcatgtagaagaatatatttcagaatcccacctgttagttcatttaaaaaagtctagcctaagcacacagacactcttgctcccgatgtatgttggtcagtggacaaggaggaggtaggtgctcattcacacagagaagtgac

SEQ ID NO: 2665 - DNA, 557 bp, Rattus norvegicus
  Genbank Accession No. AI233696
gccatttcgcctatgtttattttatgtgtatgaacaataattttatcatatgtgcaccgtgtacatatctggtgtctgtggaggtcagaggaggatgtcaatccccaggaaccagagttgcggatggttgtgagccaccatgtgagtcctctagagtctagaacaattactctaacctgctgagttatctctccacccctcagccagtaattctaaaagtaatctttagtattacagttaaaaacatagaatttgtccagtttattgttacacaatgtaaaaagcagacactttttaaaattaatctgttaatgggcaggttgaacctcgaactttacactccacctctgactgcacttttggaccacatacttgagagtattacattttattagaggcaggggaaaggctagggcagaggggctatgcagatgttattagttgtaaagagggtttcccaagggcagtcctttaatcccaacactgcagaaaggcagacctttctgagttctaggactgtcaaggctgaatagtgaaaccctgtctcaaacaaacca

SEQ ID NO: 2666 - DNA, 639 bp, Rattus norvegicus
  Genbank Accession No. AI233698
ctactatgcgtattaataaatactctttattttaaattttgcacattgcctttaacattttgtccagacgctttgcaagtggatgtctactgtaaaccatatatccagctcactgtcatttctgtacagaagtgtaagtacaacattacttttgccactaagttgctttagtaagtctcacaggaagagaaacgtttaatgaagagatggcttaaatcataggcagacctgcgtagccacgcaactaaagacacaagcctgaagaaagaacaaacgaatgaggttacctccaccgtctcccaaaacaaggaatcacattgatttaagatttaaggtaaaattttgccagaagtcactaaattaggagtttttaaaagagaaggcgcagtagtcatcttgagtgtttcattgaaagacagagctattttatttatttaatttgctccagccgttgtcagccagccactacaaacgggcctcttgtggtcatttaagcggcagtatttattaaatttctccttcagatgctgtcggtattgttctctattgctgtagaaagactggttattagccataaatgactgtatttcatcttgtgagataaagatttcctcatctgaagttcattcagactcatcc

SEQ ID NO: 2667 - DNA, 589 bp, Rattus norvegicus
  Genbank Accession No. AI233704
actggttcaccatttattgctctctcaataccttacttgccacacttcccaacatctacacagcaatttcaccaagaggaataccaagtagcctgctacactgaggtgacagagctcggctggaaacccagctcttgagtctctgttctttgctgacccagaagaactctccatctgtgtttctgagtctcctagaaatatccatgatggggaatcacagaaccatgggccgtgccaggggttcaggaaagcgttgtacacctccccctgggcagcactccatgcagggtgagtcaggcacccagcaggctagcatcctggccaggtgttcacagagtagccacactatggtgcagacttctggacatgcaggaaccggggtctcccgcagaagtcttcacggacacccacaagactaaggtgcaggtcaggctggctctgaagccaactgctgacaagctctgggtgtcttgggtccacttctaaaaagatgcttccagaggcattcaagagccagggtgccaaggtcaagatgtgggtgatgatgtccatgccttcgtcaccaccatccagtgccaccagatcttcg

SEQ ID NO: 2668 - DNA, 603 bp, Rattus norvegicus
  Genbank Accession No. AI233714
actggaaacaactgttttataaatatgtggctgtatttttcttcacatccagcaaatgtattgaataggattcagatatattcttcccagactcacagagttccaagattttctaacacaaatttacatcagtaccaaaatgggcaagaaaatgaaggcacaggctcactctgtatcaataaaggaagtcaaacacagttgtgaggcactaatgacataagcatagaaggtcaatcaaaaataagcaagtagtcagagtcttcagggactttcctccctcttacatttggcaaaattcagtcttgatatttttaatacctcagagagaaaaaaataaataaataggagatggtgcattaaaaggtcaagttacctgtaattagtctttagaaataaaagagatgaaactgaaacacagacttctacagtcttagattacccttcctttgtaaggatcttgtgtgtctgtgtagaaatgccagctataactgaagatctaagatatttgctgacatggtccctcagtccttctaaaagattgtttcacaaaaacaactatcttggtttccactgtaagtcaaatttgattatgtaaaagtgatc

SEQ ID NO: 2669 - DNA, 556 bp, Rattus norvegicus
  Genbank Accession No. AI233717
ttttttttgtatttcaatatattttattaatatattttatatattaaatatatatatttccagctataggagaaatgactgagcacttaagagcatgaactgtttttccagaggactgactggagtttggtttctgacacccaaatcaggtggccgacaacctcttgtaactctagctccaaggaccccacccccacccccatttgtggttgccatggtcatctgtatatgtggcccatacacaaatacctaagtaaaactaaaatttaaaaagattatttctctgtgggtgcatgtgcatttgcacacatgcacatgcaaatatgtgtggctgccaggggaaaccagaagttcacaagtgctctcaactgctaaaccatctctctgtccccacttaggagactttacacgtctggtatttctgggatagtttcagaactaaaacattctcttcagattttaagcacagggttgggagtgtggaccagcagttgaatattcagtttgtatgaagtctggatttgatttccaggaccacaaaacagaccctcgtgcc

SEQ ID NO: 2670 - DNA, 526 bp, Rattus norvegicus
  Genbank Accession No. AI233746
caaggaagggaatgcctttactgagtcacaaaatttggcaaatcaatatagtacccattaatacaatagaatactatttttgctggagtcatatatcaccttagtgctaattttcactccaaaaatatcatttaagaaccaaatccaaacactggtttccagcagggcaggttattttatacaaattaatgtcacttaaaattttacaatttctgtttgtaaagtgagttcctcatgcagtcggttctggttcacagcagcgggcagctgtgtggacaggagggcggctgggctctgttctgcttggtccgcagccaggtagtgttccagtatgaggagctttaaaagactccagatcaacaccgacttcttctaagtacttaaagaacaacaaacccgttagctgttcacatgaacacagcctctcccagtcagtcctctcagtcctagcctcagaggatccctttgatttagaaactctggatcttttgttttgatccaaagtcacagctttaccccagctcat

SEQ ID NO: 2671 - DNA, 667 bp, Rattus norvegicus
  Genbank Accession No. AI233750
aatattcagatggttttattaacaagtatataatacatatattgcataatgtatatagtatatgaggactgtacagtacaaatttatgttcacagtttgacatgacaaaatgtcattactgaattcccattggactacagggtagaaacagagaaggtacattaaacattcacatctttagtaagaaagattaccaaaatgtttcagtatttgcaagtatactaagcatgctaaaaacctttacccattcagtcttattagcttataaaatatattacactttattaaaaatttctgcatagtttatacaagtattaaagtactgtaaatgcagtaagcctgctatgcttgcaggtagggtttaagagatgccaagcagaaaggttattctgaccctctaacactaggtacataacaggaaaaaaaagtgctagtatttgtaaaacacattgtagccctcttttaatgcatgtaaaatggctttgtaaatgtattacttaagtgaatttgcaatcatttagaaactgttaaccttgaccaggaagagaataaaggaaactcaagtgacttcatgtacgttagcaactccttcaagacaattctagtttcaaaccaaatgacttaaaaacctctgatctgagattgtctttgtaacaatctaaggaat

SEQ ID NO: 2672 - DNA, 578 bp, Rattus norvegicus
  Genbank Accession No. AI233753
caagttatagaaacaattttaatgcaaatactcaatagggcatcttttgcattgctcccaaaatttcatctctttctgctgctgtaggcatagatggctgaactccattttgtcttctttggatcatgacagaattccagaatcgccggcagtttttgtacttcaagaagtaactggaacacctttccctgtcatagttattttcatccatacatctggtagaagcatcagattccgataagcaaggatttatgtcagggtctctcagccgccgtgtgaccatgggcatcttgtcttacttcttacaaaggagttcctgatttcccactctcctcgtagctttgatccgtagtgggggaagggcacgttactgaacaagtctaggcccccaggcttctcagtctggtctgtgagtgttaaatccggaagcagaaattcaccacgccgtaaacctgcatggggtcaccttccgctgccccgaccggacgaatcgagtggcgtgagcagcggcaggagcatgccgcggagggtttggcgccacgaactggtggggtctgccctcagcggaatgttgtcgt

SEQ ID NO: 2673 - DNA, 534 bp, Rattus norvegicus
  Genbank Accession No. AI233767
ggacacagtatttattcaatgatgttccatacttagtcaccacatggctctctacctgcatcgcagctccccaccttggattgtgagggccacaaggccagcccccagctgtgatttacaacaatgaacacagggtcacaatgaaagagctctgagatgtttgtgaacagaaagaatgaagatgacattgtgggtcctgagtaagggcccagacaggctgcccaacccacagaacccaaggcctgaacaaggcctcagagggtccatctaagggagaatctaaggcactgtagtgaaggacatgattggcccaccaagtgtggtctcctggtctcatggcacgtcccttgccggaaccggtacaacaaacattccatttagaaggtcttcctgaacgtctgcaagcagcatttgctaatgaaaaatgaagacaaggccattcttggaagagtgtgccccagaagacacactctgtcacaagaccaaccaggtccctttctaaggtccctgagaatagcagcctggcctcgttcc

SEQ ID NO: 2674 - DNA, 570 bp, Rattus norvegicus
  Genbank Accession No. AI233769
agtttgttcaacatcataattttactttattcaaatgaaatttattttaatatatgacaatttaactttgtacatgaatttatgtggtatcatgtgatattctgaaacacatacacagttttcttaaaataaatgtaagcatatatttccacaaaaaaaaatttaaaaaacaacaaaaaaagaaaagccaaactatttttattccaagaacttaaaggatgcttctgtagaagaaacgaaagctcttactgggctcaggatattcatggagtacttgtgtacaaagtcaagctatgaggattactggtcaagtgagggatctgactttcttgcatgtgattgatgagcaggatgtgaacattaataaaagctggatattggtgttagaagcaaggtagacctattttatatagtctctccaagtttcatctaaatctaaccactgttctgcatgttatgagtagagttccagagtatctatttatttttaaacttttgcccaagaggtcatgcaggggctcaggtcttgtagaattgaaacttttagaaattacttctatcagagttgca

SEQ ID NO: 2675 - DNA, 610 bp, Rattus norvegicus
  Genbank Accession No. AI233829
aatagaaaactttattttcaccgataatgttgccgtaacataatttcatagcagacctgtgcaaaagatcccacatcacaaatgtcaccaagagatttcacaacttcccggcaggacgtgtagctctgggcccccagtgttgacacccaacattttacccctttatgtagtagtacagagagtcgagacatcatgacacaagaacaagccgcatgaaggcagtgtgagctctgaggtcagacactcgccgtctctgaacggtcactatagtaaccacgtcttcgcctccatgtgctcagtgtaggtctttgctgttcttatctcttcagcgtggtaatgtggaggactggagagtgtcaactcatcatgagcccacgcaggactatggctactacggatggggtgaactcaacatactaagtccaagtttggcaaccatcagcaaactggctcccgcgatcaaacctgcaggcataaatttcccagagttgtagaatctcatccccataatgccagccaaagtcccagacgtagctaggaaaacccacacgttcctggggtcctgagacagctggtaggcacccaggcctgccaggcccccaaagaagaa

SEQ ID NO: 2676 - DNA, 511 bp, Rattus norvegicus
  Genbank Accession No. AI233870
gagaaacttaagtcttgggtacatcaaaaccaatttctgggagaggggaaaaaaaaacagaactcataatagaaaaaaaagttaccatcatctgggccacaacagaacccagagaatatattcttataattgaaaaattctaggtgcttcataattgaccttttgatacaaaatgacctgttgaatttgtaacttggttcttgaaagaggtccacagacaaactaggaagtcttcagacctcagctgaatgccgtgaggggttatttggcttttgactcttctggtttaagaggtagcagcagcaacagtgcccaccttctgggcagcttctttcttggcatgatgagcctgcaggactgccacagcttcatccaccttggaacggagggactcgggggactccagcatgtggagcagctcagagttgtcgatttctagcagcatccctgtaatttttccagccaggtttgaatgcattgtttggataagtgggaacaaacgctcccccag

SEQ ID NO: 2677 - DNA, 554 bp, Rattus norvegicus
  Genbank Accession No. AI233885
cagaaatttacttgctcagcagaggttggcttaggagacaaatacagaactgcctttgggttctctgaaacttcccattggaccccagtgactcagctgtattgcacatctgggatactcgagtccagaggggaggcccagaagcatcggtctttgtttccccagatgcctcaaatgtgcagccaggctgcaggccacactgcagctcttccagaggctgctgcatgaaagcacaggacagttgcaggctagaagctctgctgctccaaagctccagaagaaaagggtcattttagaacagggcccggctgcccttcctctggcacacaggctgctgtttggaggtgctgaccgtcagaggttatctggagcgctggttgtaaagaagaaagtccttgtcttggcagagcagacagagtttcaggcttcggcggctgcctccagcaacacagaatgcccagatgcccatgagcaccatgattatatatgctgtcaccagattcacttcatagtgaggacttagtaaagtctgggtggacaccagcaggtgggtc

SEQ ID NO: 2678 - DNA, 319 bp, Rattus norvegicus
  Genbank Accession No. AI234079
gaggccaacgaatatttgatttatgagctcaccagtcattacacaatgtacagacatgatccactgaatagtttatgctccacacaaatggttaaacaatgatttatgaaatactaaacaaaaagcttctataagcagagtatcgtttcctgccccctcccccaaaaaaatcagcttcaggcatacatttgtgtttatgtctattccttgagaatgttacgttagcagtgcataaagtttattccataaaaagagctacaagagaattcgattttcaagagactcgatgcattgtgctttcagataaaaatcccaagag

SEQ ID NO: 2679 - DNA, 475 bp, Rattus norvegicus
  Genbank Accession No. AI234091
gaatggaatggcttccaggctatgaccaggcctgggagtagagtggggggtattaggcagaaagaatacaatcatgaaggtctaagcaggatgtggccttgaaggacagacaggctttttcctgtaaagaggaacgagggagagaggccaggcaagagcagctgttccaaaccccaggagagggatggaaggtggggggcagagaaatgtctttagggagcagccttcaggtcacctacctgagaaaactccccaaatgaaaaatctgactctttatatcctgttaggaaatttaatatcacgtgacttatttcaacacagcaggcatgaccaagcacatggaggagccaggaccataaatcatgaaatgggccttagcaaagacagcttaactatgctcaagcgtaacctcatctcttcaggttatgggaatcggcctccggggtaagtcccctgttctaacgcgtacctgtgt

SEQ ID NO: 2680 - DNA, 610 bp, Rattus norvegicus
  Genbank Accession No. AI234107
tagaatttattgaacacagcagtaaatttaatacactggaaggtctttttgttgttgtttttcttgtcagaattggcacatgataaaaagatcttaacttactgctaaattaacactccaaaaatttaagttttaaatcatgttccataaaaattctaatagtgttataaaaatattaatttatactaacttacctagaaaagtgttagaaaaagaatctcatattcaaaccaatcatctaagaagtaatacaatacaattatgcattcttaaaaaggtactaatttgaatacaatgtagaagggagaaaagtggacaaaagctactgaatttacactcactgtcctatggggaagttgcagacaaaccagatgtacactaggcattttttaatgtatattttaaaggaataggaaagctgtttatagtatttttactgtctagtcaaacctactatgtggtgaactgatcattcactacaaccttgagttgatccaacctacctttctcatttatagaaaactacaaaagcttctttaactagtgtactcttcccatcaggagtacacctgccatctctgaagggtcactgacaggaatcaaagggagt

SEQ ID NO: 2681 - DNA, 556 bp, Rattus norvegicus
  Genbank Accession No. AI234128
gggaaaaatttaataagcatcaaatccactatacatcgataatgcaatactgaaattgtgaaattttaaatattgttttctcaaaacttggtgatttctttttcctgggacatgtggagacagaactaagcattcatgtggccagtccagatttagctgacactcatgtctaaagagctgttcacatttcatctctacagtaaggtagaccgggaactgcttgtatctgactctcaacacagatttcatgagacaacttataggaatgtggaatatttgaggtgcaaactcagaagctctacactgggatcctgttttgttcagctttaactcagtgcattgatcttgaggatgcagcgagtatgttctttcctaattcctttgaaaaatatttccgtggtaaaattggtttcttctttaactctaactgggtgtttctaagaaagattatcagctttgtggttggttttccacttggtaaaaatctatcaaaaacatcctatcataatttgtaaggaagaagaattgtttgttaaaggctgcagggtcaggaaag

SEQ ID NO: 2682 - DNA, 549 bp, Rattus norvegicus
  Genbank Accession No. AI234147
ggatccaggtagcttttattgggggatttgttgatactgagggtgacccacagataggatcttaagtttgtaccacagcagatttacacaggactccattcagaacttcctgaggaagtatgaacccgcgggctttgggatgatcaaggtggaatgatctccaaggaccaggcctgaccaaaggacatggatggcatggctctgtggagccagctggtagcggaggagtgtgtcagtccctgttgcagagattagactggcagcaaacgatggaaacatgagggcccaagcccaagctggggacatcaggacaggtattgtagcacatcttcgtcaccagaggcaggtctgtaaagctgatgggagaccgggtggcaatgatgacacagtgggtggtgttccctgggcagcggaaaggatgagagcatcctccgaatcctttgcacaggtggcaaaacatgccctgtgttacagctgtctacctgcctcttcctgtcctctctgcatctttctccctctctcttctttaagctttcttccttggattct

SEQ ID NO: 2683 - DNA, 507 bp, Rattus norvegicus
  Genbank Accession No. AI234152
tgaagacttctgcatggtacacttggccttacaaatgttaatggctagttaatgtttgtgccacacctagcgcatcatagattctgctgaccagtaacagcttctctgacatggttaacacccaaattgtgaatcatggaacttttacttagtgcacacacaatctactgcaaactgaaatactaatctataacatctagctgaattattggatccatttcaggattgtgcttattatctcagaagataggaactagcaaaaatacacattccttttgcatattcccacccctgtattacgctgtaaaagaaatattgttcagtgcaccccctaagaaataaacttccttataggatttctctctttctctctctatatatatctatctccaaacagaggaagagcacaatgcaacttttaagattaccacttaaagcaagagaggtaagaacactcaggtactgcagtcgctcctgactggaaggttcggtttttgatcatcactg

SEQ ID NO: 2684 - DNA, 512 bp, Rattus norvegicus
  Genbank Accession No. AI234162
acataactttactaggaagtaagggaaatgacataatggcttatttacttagactgaaaatgacactaacatttgttggttgggtctttattcttcaatgtaacatcacactattgttcagccctgccctgaggtaaccaaagcactggagaacaaaggcaaatgaaaacaagcctcttggggccatccttggtgctgagttcaggtgccagtgctgaggaagcccctcccaagccacagtctttgccagtccacatagacacagcagccaaggtctcaaggcctcagtgtccacgaaacaatgatggggacccctctctctgcttgcagtccactgttaatgccaatggtgggaaccagcacttggatccccacaacacctaagagtgtacctacctcctgggaacattacaccgcactagctccatgacctagaaaaggggcagagtggacaccaatcccagaaggagaaaagccaacttctgaagcagcacaggcttacctcagggcca

SEQ ID NO: 2685 - DNA, 365 bp, Rattus norvegicus
  Genbank Accession No. AI234219
gaaacttaaaacacatgttagacattgcataggtttcttggaaataagtcattctagggataagacactggaaaaactcttattaccaagtatcctgggcatgaccagagcaaaaatgctctgcatgtccccaagtgattatacacacacacacacacacatatatatatatatatatacacatatatatatatatatatatatatatatacatgtacactcaatgacaaaaaagggacatggatttgaaagaaagcaaggaaggatatatggaatggtttggaggaataaaaagaaagaggggagtgataaaattgtaatctcaaaactacaataaataattttttaaaaactcagaaagaaaa

SEQ ID NO: 2686 - DNA, 431 bp, Rattus norvegicus
  Genbank Accession No. AI234251
ctttagttttgcttttaatgaagaaaagatcacgacatggaagagggccaataaataaagtaatagtagactaactaattaattaaacaaacaaacaaaccagctgtaaaagaacatcaccaaagcaaggattgcaggcccatcacccgtgagtatggagtagagttcattcctggtggaaacccttcacgggcctcccagcttcgatcagcaggcagcaggtaggggtgctgctgggggcacgtcctgatttttctgtgtctgtgtcattttcgatcaactgtgtcatggggcttcctgtttcagctcccagttattcagggagaagctgatagacggtctgccttcccagccactgtgctgtgaagatcccaagatatgctcagcttgcctggaaagtcactttgaaacttagaaagcagccactgtaa

SEQ ID NO: 2687 - DNA, 425 bp, Rattus norvegicus
  Genbank Accession No. AI234292
acgataaaaccagacacttttatttgttcagaatgcttgtttttagttagctgaggtaaaaagtggtttgtattacaattactctgtcaccatccaaaagctcaaactccatattcagaccttacaaagcacccttgtatgtaaccacaccacccatgacagctgcctccatggttttctcagaccatggtctcccaagaaagcgagcatgtgaaaagtaacaatgttattctcattttttgtagtttatgctttagtttacaaaattcttagaattttatgctattcaaactattctcaaattatgcatgcaaattttaaatgttttcttgttcatgtctgataacagacttttctctaaaactttacaacttaaaaatcttttctttgaatcgtgagaaagacatggaaccttctaggttaca

SEQ ID NO: 2688 - DNA, 501 bp, Rattus norvegicus
  Genbank Accession No. AI234496
gaaggaagtgatcagactttggtttattgtaaaacttagcaaagtgtttcatataatccctgacccctcactctgaaaacaaaagcagaaacaattattgcttattttccccctctactttgtctgtgctactgtaagagaagggagaaagattattacaataaataaaaatagagatgtaacagagaaaaataaatcagtctagatgagaagtattaggagcaacagaaatttcattaagcagtttaaaaataagcttctttaaaaaggttgccttattaaaataaatcacaccaaaaatatagcagcagagaagaaggatacatacaagttaattgcacatcagtcccatgcaaaaacgtggatcattagccaaagcagtagtactcagaatccagcttgggatgcttgtgcagagcttgagagtcctctatgatagagctgtcactgaactgatccaagtctgaaggggtctgatggcctggtacatcatctgccaaa

SEQ ID NO: 2689 - DNA, 437 bp, Rattus norvegicus
  Genbank Accession No. AI234527
aacagtttttcactctatttaattggcatttgtcattgtggacagagtggtttcgttctttgaagacctttactcctgagagctctatcttgcctttggaatgctctgtagctgctgctgtgattggacccttgcaccatccactttaaagcacgctgtcactagaacttcaggacggtcctgaccacgtcaacatagtggccatccgggggtggcttcctttgacttccaggttgccggaacttcttaattgtaggaatgttgctgattcttgtcttaaatgcccgcagcagagggaagtccgacaacacaggagcactgacttcttccaccatcaaaatggcttctagtagctgtatgtctgcccaactgagttggttgccaacaagaaatgcctctccatggtcttttaaaatcttttcctcgagccgaattct

SEQ ID NO: 2690 - DNA, 449 bp, Rattus norvegicus
  Genbank Accession No. AI234620
ggccgcttccattttttttttttttttttttttttttgagttagaatcaagccaccagatttttattttcatgccataaataaagttccctatcactcccattttcttacaaatacatgaaatacagagaagcagaaattcatttggtgaacaatcagcttttgtatatctaagtgccaatgagataatgaagacctgtgaggcactgaaagtaagactagcacaccatccagtaccaagctcttttcatttcagagctagcagacagttgttggtgcctgtctttctggcacatcctggctagttattctagcaccacgagccaggcattgtggattctggacacatgttctagtgtagagcccagtctgttcaatgagaagaatcactactgagcaagcactgctgatagttggatcccagtcaggaaaatggaatggcaagaagga

SEQ ID NO: 2691 - DNA, 559 bp, Rattus norvegicus
  Genbank Accession No. AI234678
cagtaacattgtaaggcaacaattaaccttcaacaagtcaataaagaagtggaaaagagatggacagacatgttcttccaacagcttcctgagtcacctaggctggcttgtggtctaacctccttcacagcaagacagggtgggggatcttagacatttagttatagctgctaaactggaaatgctgtatagaacagtcttccttaaaaaattaagaactgtaaagtcagttctttatgcttcttcctaatgtgctgcttgagtttatactcattgggggatgcattacttagacctggaactgtcttttgagaagagaacgacacaagtggtcaggtaatcttcaaaagggaaaggagctactgataacgacagtgtgctttttaaaagccatgaatactgtatgtaattacttgaccatttctggccttaaagcatgccctgaaactgaaccttttgttagtggctgcataataatcttaagagaaaatcaaaatcctttgcatagagaaacaacccaaagacagacagaaaaccatgattgattatactggaaaag

SEQ ID NO: 2692 - DNA, 620 bp, Rattus norvegicus
  Genbank Accession No. AI234819
gaaggtggaaaacaatatattaatttattcccaagggaaaaaaaaaacagaaaacatccgcaaaaccaaactggacacagtagatacgggtactttccctgccagctcaaatgctgttctctttccaatagtatttacagtaaggaggtgaccgacaatgggcgtgtaaacttctccagaaaaatcgtctcattctccatgagcgatccagtgtaaaacattagtcttcaggtgctctcatccgaataacaaaggagaaagcggttttagatttcaccttgactaagtacttcttatatctcaaccctttcctacccgatacaaccctattttatttttcagtagaagaaacaagaaagtttacacgaagtaattccctttaaaggtatgtaacattcagcaggtacaattacagcacaagaatgaaactgtggtaagtgacgtcattaaagcaaatgggtttttcccctgttagattaaataaatatttctaaatgcgatagagcgagcaaagacaaatcacattttgaaaattatagttattcatttgtgtgtatgcgtatggggtgggaggagcggcagatgtccgagtgcaaggacaagtgtgtggaggttggaaa

SEQ ID NO: 2693 - DNA, 681 bp, Rattus norvegicus
  Genbank Accession No. AI234830
ttgctgtcgtttactttttttttgagtaggatcaatacacaaatttcaattttttaaaaaaaagttttacgtaataaataatgttatagaaatatacagtgtgctggctctgatggtatatcacagcacttgggaggctggggccagcctgggctacagtgtgaaattttgtcacaccctcaccccatccaaataagccacaaagtcttatcagaaaaccaaacagcctcaagcagaaaaattctctttagtaaacgacacaagaaggtgatgctgtctgtcagtcaggttcactaacttttcttaattctctttgatttcttcccctggtcttctactccattctctgcaggccgcttcttcaaccccttcactttcctcgtctgtagtttgcttaggtcttgcttctgcatatgaatccttccaaacgttgtaccaaaagtatcctgagagatattcttcctcttcttcggcttgagagctttgggcactttcatggacagtttataaaggtcgtctgatgctaagtgtgtcctcctcacaaccagatccaacgacggccccatctcttctagctcgattctcggtgttctgcacccagatttcttcagcagcagcttatagcttccaaagtaaaccttcccattcagtgccgtgaagtgcagaacatactctaatcca

SEQ ID NO: 2694 - DNA, 669 bp, Rattus norvegicus
  Genbank Accession No. AI234858
gctggacaccttaaaaactagttttatatatccaggagggttcagagggcagggctgagccacactgcaacaccttagcctgtctccctccgccttacaaagcaacattgtacaaaactgtatttacaggaaaacaaaatgagaattaagaatgtgtacaaaagtagacaagagccagaaatcacacatgcaggggcggctttgggaataaggaatacggagttccacgccgaagcgcagggccacacactatgtgaaggagcagaccccagtgccaactgaggggaccaggcgttcagctgcagtcttaaacgctacaccactttctcctgctgtgtggcaagagccagacaccagtgatggaaacaagaggggctctctggcgagccccccgacaacgatggattcagaaagcatagcgggtccgaatatcctcaagcttcttggacacttcaggtggggttcggtccagctcttcagagacatttttctgcttgttgggctccatggagttgaactgctcacaaaggtctccatcaatcacattcttaacagggaaataataagaacgaaagctgaagtggtcacgaataataccactgtgctttaaaactaacaaaggcagccaagtgtggttgcgtacacctttaatcccaacactccaggggt

SEQ ID NO: 2695 - DNA, 268 bp, Rattus norvegicus
  Genbank Accession No. AI234919
ggggcataaaaatagctgtttattttgtgacctttttagaagttttaaaaaatgaaaaaaaaaaaccggatctgagatcttaatatcattgggtttaaaaaaaggacgggagaggcttctgtttcaaaatgatctgaagtgtaagtaaactgatctggtttaatgtgcagcattgcaacattttccaagatgaccttctcaaaatcttccttttccttttctggggttgggtcatcaaatctcatgatcaggttgcctttaaagttaa

SEQ ID NO: 2696 - DNA, 537 bp, Rattus norvegicus
  Genbank Accession No. AI234943
ggccgctcacttttttttttttttttttggtggaaaactttgataattatacatcttacttttattgagtttgctgatcaatttaacctgtttgaacacaaacatatctacagcagtttaaaacaattattttaatgcatatataaagcaaaatgacagcacagtttagtcttcagaagtgatgggttcctgggttgctaatccggaatacgtacactttcgtgcctttgtctccatcagcagttctgacttcaagcagcagaatagaagcctagaaaattatctctttaccattagtaacactttggaaagatatttatattcaaaacattacctgttgcaagctgttaaaatcctgactatagtaactgactaacataggttcttcatacagtgatctaaacagttgtaacttagaaaatctgattataaaaaaatattcctacaatcatattttcacgtcacattactaaaaagggcttcattctttttaaagttttttccttgacccaatatataattctatttcttagaaag

SEQ ID NO: 2697 - DNA, 349 bp, Rattus norvegicus
  Genbank Accession No. AI234956
aaaagctcagtagtttaaggaaatttttggtcccagaaatactacacacaaccaggtaaatcaaaacaaaactgattatcagttaattttaagtgttcttagcaaaaatgttattttgaactggcacagaaaagcaaactattgggacacacaagactaatcatgcaaacagctgcaagtgacaaccgcttaaacactaagctcacgactgacattctcagtttaaaaggacgagaggaagggtcccattatgtgggaagtagccttactcataataatgaaccacccttactttttccgtgtaatggactcctctctttccaactaagaaaaacaaaaccctcgtgcc

SEQ ID NO: 2698 - DNA, 597 bp, Rattus norvegicus
  Genbank Accession No. AI235047
  misc_feature (1)..(597): n = a or c or g or t
ggccgctcacttttttttttttttttttttttaaaaaacacaactgcagtttattccagccatgtttcccaggagcagagaaaagctacgctccccggggatagcctgtcggttgtatctactattttgcaagcctgaccttgcatttcgaacacctcaaacctcttgttctgtgcactaaggagaaaaagtatcaaatcgtaatttctctcgtaattggaagtagnnntttaagccgaaaggaggccggttttgccgtacagtcaccataacatcactgtcatcgagtaacacttgcccttcagggcaactaaaggtcggtcagctcatgttcctcacactcctcccccatttcctttaggaagtgaaaggctactacaggaaagcaaacattcaaaccatcaaaattcagacaagttatttcaagataataaaaaggggaaaacgtgactgttaggcctgcagagcacagaactgctggaacacagccaggatgtgaggatctaactctgccgtgaagagcaggttctccagggtcaccatgtactgctggattatctggtgatgctgtaggaagatctgctgcagcctctcgat

SEQ ID NO: 2699 - DNA, 434 bp, Rattus norvegicus
  Genbank Accession No. AI235049
cctactgagaacttatttacaaggatgattgacaagacaaaatacatttaacatttggtagtgataaacagtaataaatgtaatagtggtacttcctatattttcatattgtagaaataggtattatcctttatccattaatccatttctccatttgtttcaccacatattatcattaatgaggcatccatatggacttcaggcttttctcctgcaaaaaggcttgaccattgggaccattaccatgaactttcccaaagagtcatctttattctatggaggagtttgttacagtaattttaacagtgcttatctccagtttccacctgaaaatattcttttattttctgaacattccccatgactacatacgtacaccattatccataaagttaatgatgggtgattaaatattaaaaatggttgcttttaaa

SEQ ID NO: 2700 - DNA, 478 bp, Rattus norvegicus
  Genbank Accession No. AI235054
  misc_feature (1)..(478): n = a or c or g or t
gccattcaaaggccttttattcatatacattacagagactatgtaatcatttttttaaaatccctagcttggatttggataatccctttgggtccctggtgttttccagactaggtggcccagggtatcagtccttggcctttagcacgcagttactatctacgaggaggatgtgtggttgccctcgttnggnngnnggnngggnggggatgttggctgtttatttagacacagctgtgtttgaatggagagtggaaaggctcatttttatgcttgctggctggttcaacaccctcaagactcagttcggccatcggctactgtaggttcctagtatagctgccaggactcttaaaagtcatcgtcatcacagatgtcaaggtacacgtcaaaggcctctctgttgcagtttccatcaggagtgaagacatatttgtggaaggtcccatctacgcagatggcgattacagaattgacg

SEQ ID NO: 2701 - DNA, 516 bp, Rattus norvegicus
  Genbank Accession No. AI235059
  misc_feature (1)..(516): n = a or c or g or t
aacactggcacctccacttagatcgggaggcgccgctacccaggagagttttatctaaggaatgaacatgggacagagaatatggcaagaatagaacctgggagttttaagctgacaaaccacttaggaaaagagtggngcgccncttggggcnnantangaattttnntggtttggtttcccctttggcttctccagttcggaagtcacgaacgcttccaagggcccacgctgaacacgcacagacccgtatggctgtcaggctactcagtctttagttggccattagggaatcacactcacgattttcaaaatactaaaattaggttaactaccacgatgccacccaggaaaccaaacacacggaagctacgcgcgctgcgtggcctctctcgtgtgaagaaagtagcagtttctagtaacaaaagccaatactggcgggtgacagggagggctgacgtcggtccactttctaggcaactttaaaaatccatcaaaatcttacgaaaataaata

SEQ ID NO: 2702 - DNA, 583 bp, Rattus norvegicus
  Genbank Accession No. AI235223
aataatttttttagatttattttttatacatatacactactgtcttcagaaacaccagaagagggaatcagatctccttacagatggttgtgagccaccatgtggttgctgggaattgaacgcaggacctctggaagagcagtcagtgctctaaccactgagccacctctccagcccaagtggaaacttctggtttctttggaaagtcagttgagtcggatgatgtcttgctgaagcaaacacagatgaaaggatgtcatgataaggtagacacgtgagaggacacatgacaggagaacttctcttggcttccctgctggtcctgctcagtcctgctgactcatgccgatttggtggaagcctggcagtttctgctggcttgtggcaccgatgatgattcctgtttgcaatcctgatgctactgacctggatggctgctgtactgtcaattagagattggagttgcccccaggaactactacacagcaaacagctcagcctccttgcttcttctgaactgaccagccattgctgattcctgtgaactgagctgcagattaatttgccccagagaaccatttcc

SEQ ID NO: 2703 - DNA, 486 bp, Rattus norvegicus
  Genbank Accession No. AI235224
caccatttaagagaaagaaagatggaggaaaggtaaacagtgttcaggcttcagcttttgccaggggaaggcttcgggtcatcgagaccccaaggtattgccaggtgcacaaatctggattccgtggcaggcaggcaaagtgatcgctctggtagcccttctcagagcccatgaggatctgatctgtccacagaggctctccatggctggggtgtaggcgaaccggaaacctgtggcatttcccacagcgtcgaatcctttgagcatcttagtcatcttgatctcataacgctggtataaggtggtctcgatgatttctggggaacccatgaatttagcccttataaccaggtccgagttgcagaaagctgtctgtgggtgggttggggcacagctacaggctttactggaagctatcaatgatagcaacaagaggatgccagaggccagagatgcaaagggcgccatcgtggtatctctagcgtg

SEQ ID NO: 2704 - DNA, 499 bp, Rattus norvegicus
  Genbank Accession No. AI235232
ggtatacaaaaggtataaataggattcatgtaaaacctgcacactcaagctgagagtccgtgaaatgggagtatacagctctttaaagctggccagaggtcagagccggtgacccatagccccaccctctttaagtggggacaattgagcaactttcagctcaacaaaggtggcggggaaagtgggtagcagaggtgtgtcaggttccagagcacatttatgaagaaggcacttaatgggaagcatgcctgaggcagaaactgacatctgaagggacaggcaagacactgggacagcacaggtctcacctcccagatctcacgccagcatcacaccggacgctgagccgggagtcacaggacgcaggcatgaagggacctcctccgcctccatatgggcaaaaccatggagtatgacccttcacccacgctgggaagcagtttgcgagtctgggaccactgaatgtagacacagggtttttgaattctcacctcgtgcc

SEQ ID NO: 2705 - DNA, 442 bp, Rattus norvegicus
  Genbank Accession No. AI235277
gacagtggtggtgagagatttgattgagatgccttatggagtagtcgcattctgaataaagcaccacactgtgtcagtccgttcccacactgctgctaacacagctggtttgcttagggagtgcccaacttagccagatcaagggaaccccaagagagcaggggcaaatcctgcctctggtgccaagcctcagggcaggcaatcctggagaacactgccagccttgggaagcttgggagacctctaggctgttttcccttcttttcaaatcccacaatttcctgacggggagaagctgtaattagcccagaccaggcaacagatctcagctagaggtacagctgcagggaaaaccccatggaatcttgggaaccagtgtttttccaattacaaggaccgaggaataaactttttctgtgggttctattgaaaccctcgtgcc

SEQ ID NO: 2706 - DNA, 441 bp, Rattus norvegicus
  Genbank Accession No. AI235320
agatttggatctttttttttttcttaaaagaacaagtttctctaaaatccttcagccaccagtgaaatgattaggcagaataaaaacttctgtagagggagtgctgtcatcaaaaataaatacagttgcatgggttgctcaaagacaaaccaaactgaacaggaaggcggggctgggacatcatcttaagtgccctccatcatcttaagtgccctccatgttggttcactcagtgggctgaggatagggagggcaagaaacaggtctggtcaccatcttagagcaggtcatatcggatgtactcactgggctcaaagtggctcatggccaccttggcccgttggcacagggcagaggccacatggtactgccgcacacccagggccttctgcagccgggtgaccagtaggctgtaaggcgccattttgtgcactgacaaag

SEQ ID NO: 2707 - DNA, 477 bp, Rattus norvegicus
  Genbank Accession No. AI235338
ccaggattgcagctttcttgaaaaagtattttattcatactcttggatgtacaaatggaaaataaatacgtgattctacttggttggctgagtctgtgctcagggactaccttggtgcttgggatggagacctgggcagtagctgagggggcaggggtgctcagtgcacagcagtgcctgagtcgttcactcagaaggaacctccatacaggtggaggctgaggcaaaacctggtgtctgctcacactggccatgtgtgaagtgatctcagaagtcagtcaccccaacacctcaggagcccgcatccacgcctgtacgggttgccacacactggccattctcaacttgctcaggaaggcggttgaaaggcttgtgccggagctgacaaatgttctcccatttctggacttgcacgcatgtgacatctgtgatggggacatgggttctcatgtactgagagaagacacatttgtgaat

SEQ ID NO: 2708 - DNA, 503 bp, Rattus norvegicus
  Genbank Accession No. AI235359
gtattttatttacaacactcagtgcatctacatgacacattttcatttcccaagtcttttgaaagcaattccaattccagtttgtgcaatgagtttacagaaaaactttaaaatagccattagaccttaaacttaaatcctaaattttgacatttcatactatattaatagaggactgcttttaattaagaaaaactaaactctgtaattaattactaccctctgggatctttaactcaaatacaaactggattagcctatgaaataataccattagttttagataaattattccaacctcccctccccaataaaatgcatgcacaaattaaacaaggtaaattacattaatgatattttatttcaactttctttttggactctctcaactgtttctcaatttagggtataagatagggacaatgcagttggagaactctgacatgcccatgccccgccccacaacagaaaggcttttcagagagccttttggggaaaaaggt

SEQ ID NO: 2709 - DNA, 416 bp, Rattus norvegicus
  Genbank Accession No. AI235365
  misc_feature (1)..(416): n = a or c or g or t
gaaaaataaaataaaaatcacttgaaagagcgtatgatggaaattgtacttaacaggaagaggggttggaatacagccctggggtgggagggtgaggctgactacaatacgaaggggtgggggagagacaaaggtgaggcagtgtgaagaaataacggtacctggtaaaaattctacagctaacctttcagcatcccgggagctgtagactctgctttagcaatgatcccagtttgaactttgggggtctgggggcctgcaggagttttcactgaaggtgttttctgagctgtgggagtttggggggtggtgggggtggcangagctgctggttgatccacagctgcttttgggattgtggacaccacaggagctgctggctctgttggagccgaaggcacttggggcctcctgcc

SEQ ID NO: 2710 - DNA, 432 bp, Rattus norvegicus
  Genbank Accession No. AI235403
  misc_feature (1)..(432): n = a or c or g or t
gactctttaatgggtcattgtgacactgatcgtcagcagcgtgatatatctctcttcacatgggaatgtcgacagcaaatcaatcatggaacatcatagagccggaaggtcacgtggggtcggtaagagtactctacatgctaaagtgacagttatcctcaaaggaacgccagaatgtgtgtagaccaccgtcacctctgaggagggctcagctgtgcgcagctacccagttataggaagtgtccaggatggggtctcttcaccttgtccaggaacagctgggggagcgctgaatgttcccaggatgccaccctccaccgcaaggcacccagccctccacagctgcagggacaagcccatgatgtgtagtgacanactgaggggcatacattggactcctccactgacccccacaacagaacctcaagacag

SEQ ID NO: 2711 - DNA, 615 bp, Rattus norvegicus
  Genbank Accession No. AI235455
gtagtgcaaagctttttcgttgagtttttttaagctgctcacataagagatgtcagtattcagtgtttgattcagatatagaaagattcaatcaataaaaagatagtttatttaaaaaataggggggcgagatattaatttacatgatttcagaatcaacatgattagagctgtagtgctgtagacttctgtcacttttccattttattctcgtagttacaatatccagtaaagagaggttgtgcagctattccgcggctgaccattctacagcggtgcactgccagtcgtctgtaggcgttttccaggttggtgataattctagggctccagagcctctcaccaacagcgcttgcccgaggccatagtcttggaataaggttagttgcatccacatattctccccataggcaagcctctccaccaataacaagttgtttctgcttctccgaaccttcaaagttaaggggctccgctttatagtagtttctccagtcttgcccgtagctgatcaggtctaagtaccaaggagcagaaaggatggcagggaagccggatgctgtgacttgtgctaattcatttaagtaattttcacttttccacacttcaactacc

SEQ ID NO: 2712 - DNA, 526 bp, Rattus norvegicus
  Genbank Accession No. AI235500
  misc_feature (1)..(526): n = a or c or g or t
acgaacacctttaatcccggcactcaggaggcagagacaggctgatccagttcaagcccagcctgacctacagagaaaccctgtttaaaaaacaaaaaaagaattcccttcacccttgctatcaaaagagaacagtcccttcctgcaaccctcccaaaattggggccaggtaaggaattgggctctcctgccctaaagtaccagcttttccagcccttaggccagaatccatagaatccaagctaaaggctcagtcagggctctagctggggaaacagtaggtggggcaagacacctgggtctgaagtcccagactccacctgctgacccaccctaaatggactccagccccaagtacaggaggccaaaggctcaatttaccagctcgtagcaccactgaacctggcaaaagggtaagccaacaccagagggagagatctaagggaaccttaaaactcaatagatcaccggagtgaactgtatttagcccacaggtanaaaggggctcagggcacctcactgtcca

SEQ ID NO: 2713 - DNA, 487 bp, Rattus norvegicus
  Genbank Accession No. AI235528
aaatcaaaagttatgatgactttattttaaatcttaatacaccaaaaatatttttcaatgttgtgagataagcacttgaaaataagaattccaacactgctgtgattcgctgtgaggcttgagagtgaattttccctctggatatgaatctagggcctaagaagcagaatgccagtcattttcagagtagcagtgagcaaagcccagcccgatcatgctcagacccacacttaactgaaacacattcacactagtaggaggcaccgccaggcgacatcttgatcattgtcaaccaggagaaccaaaggcttgagcgccatcaagcactggggaaataatattgttcagatgctagtgagtcaggctctttctaacgagtcctaactgggttgcaaacgtggttgcaatctgatccaacagaccaatcagctaagtatactccaggaaaactcgactataataatgctgttgttttgtgggtgggcat

SEQ ID NO: 2714 - DNA, 514 bp, Rattus norvegicus
  Genbank Accession No. AI235559
ttggctttttcaaaacagggttcctctgtgtagccctggctatactagaacgccctttgtagaccaagctggcctcaaactcacagatatccaccaacctcttcttcctgaatactgggattaaaggcgtacaccaccactgcctggcttccaattgcattctaaagctcccaagaagggcagcctgactgaactaatgaagataaaatgtatcccctgataaatgtctgtagcaaaaactagaacttcaaacaacaaacaaaatgagtttcctggtgggtatcatagtatttacactcccttaacttaagacctggaaacccaatgtcaaattgactggtcatagaaactgcatagaaacgtacaaatgaatttcacggacaacaaattgggcacttttatatccccacccacctttgccacagcactagaaaagaccaaaaccacctgacacagaggaatgcccacggtggagaaggtggggacggtaaggcacagaagacactgcctgcca

SEQ ID NO: 2715 - DNA, 600 bp, Rattus norvegicus
  Genbank Accession No. AI235560
gataaaataaattatctgtattataactttgaaatgccgtacatgaaaaaattgaaagtgataatgctttttcactcccctctcagaaagaaaacaaatgataaaatgttggcattaggacaattacactgcttctactaaacaggaggtttacatcacaacctttggtcatgagttcactaagatttgttcacccatcccttatgaaacattctactttgcaagcatttactgcatttcatttcaggcctgcatttactggtatgggcagttggaatgaagtctaaatcgagatgtgctataatgtaaaatatactctaaagacttagttcacagtttcactttccattttaaactgactaaaaattaaaattcactgtgcatacttcttgtcattctgtctggagctcaggtgtcttcagattacctgcctctttctcccacacagatcaccagaagcacccagtgcagacgccacacatgtctccatggacagctcgatctccagagggacacctgaaaaactgctagcagctttcatttacagaaatcatatacatttctgatctacttgtacaaatgggattataaaataaacta

SEQ ID NO: 2716 - DNA, 401 bp, Rattus norvegicus
  Genbank Accession No. AI235563
aaaaattaatttaatgcttggctaaagcttaattacatatatatttatcaaacaatagtcctgaatttccaaaaagttcctcttctgaaaatcacagaatcagaaagcattaaccttaaaacaagtttctctgagtatttacagtgtattataaacattacagaataccatagatagtaaactgcctgggcgtgtctaatcagcaaggcatgttctttattgcatatagaactcacatatgtgggattcaaaacaggatagatagactatagaaatgcatgtacctataggccgggcagggagggaaataacaaggacagtcaggctaagctgtgcagttagtctgtgggcttactgtcaaagactaaactgacatcctgccccaaactattcctcgtgcc

SEQ ID NO: 2717 - DNA, 529 bp, Rattus norvegicus
  Genbank Accession No. AI235566
ttcaaattttcctttcctttattttagaaaactaaatgctactgtaacatctactataaaggagcaggtataaatacaaatccttactgaaaaaaggctgcaaaaacctctaagtataagcaaaacgcaagattttctatatatggacactttcttatttatatttaaaactttctatggatattttatttgtttttaaaatctacaatgaaatttatatgttgtctctactgccttaatgaactaaaactataaattaacattagctgtaaataactaagcaggccttttagacttgctcccacccttaaggccgtagtagtcttccagatgaactcagcgacaggaagtaatgaaaactgaagagcatgtgcacgcagtgtgctggctacaagcaggtagtgttccttacccactagcctctggggggaatctgactgtcacctttcccatctctgcacccggaagctcgacgaatttcccaatatcttgttttctgtcaggtgcccctgtagctttgtttgctgaa

SEQ ID NO: 2718 - DNA, 527 bp, Rattus norvegicus
  Genbank Accession No. AI235630
gggatctttattagcagctagagctatgagctacaaataaatcaaaaacattgacactgaagttgctggaaacaggtctgtacagaaatattacaaaaatctcatcttccaatcccacagctaacctcttggggaagggcagccttggccagggcaaagcagcacagaagttatcctaagaaagtctcatccaccaggaaagcagtgaactacagctacatggcactaaaactcaagatagcagtttgtaaagagtcccttaatcataaaagttttcgaatgaaaacacgtgcccctcctgtcccgggggcttccagatctctacccaagagacttgagtacttctattaaggcaactggaagcccagcacgtccttcctaacatgctatggggaaaaaacaaatgtccaaagtgctgctctttcctagaaaggaaacagcactcaaaataaaggaaaaggccacagagggctccctgagaatccagtaaaaccaagaacttttccaaacacactttgcaactggat

SEQ ID NO: 2719 - DNA, 494 bp, Rattus norvegicus
  Genbank Accession No. AI235675
cagaactgaatttgttattcatacatttgcaatgatttaaatacaatacatacaatttctacagtgcattagaagaacagggcagcagcgctcaccaaccagcttctgttcctagacataggggacaggccttaggctggcagagggacggctgttctgaagtacctggcactctgggctcctggcactcccaagtccacattcaaggcaacttgagtacaggcttcaagggagggaagcagggaaggccgcctgtacccttgcccaccgggcctggcactggctccctcttccattggacccaatttcctcctgatggcagacctgatctggagcaggacaggacacaagagtctcgtgcagcactaagttctctccagcactccagccaacaggctgatgtgaagataactgtgaggaccctggacccctggacccctgctggctcctgtgaggaggaggcagggattctctcaaacgtgggtctgaggcca

SEQ ID NO: 2720 - DNA, 587 bp, Rattus norvegicus
  Genbank Accession No. AI235692
cctttattacataaagccagcactgctactaagttcaactgactgtgcacctctacagtgttcagtgtcatgcctgtgatggtaaccatcatttccaagtgttgttgggcagtcccctgtgtcatccatggtactgcttctgtctcacacacagctggtaaactgctctaggcatttgcaccctaccaggccccagaggaaacataatcaacactctttccagtctactgtaccagacacagcagttttgaagaagagattacagatcgaaagcaccttggcttatcagtacactgccttgtcatttttcattaataaagtagattacaatgaagccctaatttgcaatgtaattagttgttacaagacacggagcattctcctgaggatcaccatgatttctaagacagaaagttgctctacgccatctcccagcccagcgagcctcttgcggcaggtacagggcactgactgcactccagcacggtgctctggcgctttgcaagatgagcgtgaactttaagcagacgcgagtctgaaacagtctcatgacacatctgatagaattaagactgcctggcttagtc

SEQ ID NO: 2721 - DNA, 505 bp, Rattus norvegicus
  Genbank Accession No. AI235736
cacccatcatgtttattcagaagaaaatacacccagtcctcttatctctggaaagttttgttcctagccatcattaaaatcagtacccctgttctcccctttggaaaaataagagaaagggccctgggtcaaccccagaagaggaagcttacagtctttgtagatatccgaaagctctgatcacaaaggggtataaaatggtgaaggggtttggaataggaaaggcacagacaggaatctgccaggggactgaagccacagctcccccaggagtcagagggagggggaagtcatgtagtttagagaaggccaggggcctcagagcaagaggattcctctgaagagctcaggtcaggaggtttagctcagcttgggctggtagttcaagcctgtaatccaagctacttggaagcctaaagcaagagtttaagtttaagacctgcctggactatatagtttaaagcaagcctgatcagatatatgagaccttgtctcacaataaaaa

SEQ ID NO: 2722 - DNA, 537 bp, Rattus norvegicus
  Genbank Accession No. AI235748
aaatcaaaagcgttaaaaaattttaatagtgatctattcatctcatcattcaaattcatgagtcacatccatattatgattctggtaccagttctgaaaacgcacagcataaagcggagaaagaccacgtccattagaggatctacccacacagccttgctttctactcccaaacagaaccacctggcacaggggcttctgggagtcaatcatcaattcgagggctttgcttgatgacgattctcacagtcagaaccacacaccaggaaatctggggagaggcacacagccaggacagagctttcctccctcagcggagagatcagtgccttggcacgagatggggagagcattcagccaatgtccttatacattcactcatggaaacctttaagtgtcactggtgcctggaaccaaatgtaatcctcggaagccatggctgggacggaaggtctaccacaggacagtgtcacggggagtttgtgaccttgctgtgtcctctgcctggggagaagatttctgggagaagtgctttaa

SEQ ID NO: 2723 - DNA, 198 bp, Rattus norvegicus
  Genbank Accession No. AI235806
catatggaaaaagtatttattttgacaaaaataaaactggggactgaaaacaaatggttttcatgctttattgcaccatgattgcaaatgaaccggaacctttttaacaaattaacagcccaaagcaaactgcatgttttttccttggggaagctggcgtgcccacaattcattaaaacacacttgcataaataaaaa

SEQ ID NO: 2724 - DNA, 471 bp, Rattus norvegicus
  Genbank Accession No. AI235842
tgtgcatgcctggggttgctgaccacagcctttttggtaataaaaggcaattaaacacaaacaaactattcagtaatatccaactgataaaacattacatagtcagtaaagaaaacaaggaagatggtgagacgaaatgtgaaaaggcaaattcacaaaggcatttcaacagtgcacagctctacacccaaatgctgcacaggaatacaatcaaaaacactgtgtgccctctcaaggaaaggggtgtccttctattgattaacaatacaaaggccctcttgtgagtataagttcttgagactgcagaaaaaatgaaaatacatgtctctgaaaactgatgttctcaagacaccctactgacctcactcagaaacccgtttgcctctactgaaaaaggtgccacctcacccagggtccagttctcctgagatacacaattaatggtgctgaatggcttccctgaatgccctg

SEQ ID NO: 2725 - DNA, 456 bp, Rattus norvegicus
  Genbank Accession No. AI235912
aacttgtctgaggactttaatttgcagagatctcatgtctcacaggcagaaccagaggaagaccccagtagttcacagtttccccatggctggagcacaaggctgtgcacttcagccagcactacccacagctcagcctcctagcagcagcggtcaggactaaacgacgacactagcatgcactcagcaattctcaaacagagagtcatcgaaatgaggtatgtccaatgtgtcatttgttaacgaattcaatgctgaagtaggaaaaaaatcatcaaaaatgtcagtcttcatgggactccccaagttcaaggctcttacacaggcactgtcgatgactgaatgcagatcaaccttacactggcttttctcagggctgcagtaattatgctcctggttcagacatgtgttctgggaaacagcactgaattcgctaggtgctggtgttggggtgct

SEQ ID NO: 2726 - DNA, 538 bp, Rattus norvegicus
  Genbank Accession No. AI235935
ccagttcaaagacaaaaactggcttggcagcacagtgctggacagtgcaatccgaggcctggcctcccatccccaacacaggtgagggaagggagagctaaaaagctgaaagaggaaaccccacagaaggaaacattagtttttagttcacactcctgcaatcccctagcctccataaaataaactttctaaagtaaaagcagcagaaatggtgtaaacgctatcggaaccgagagtaactttgctccttccagatgtggtgcaggtccctctgttgaacaccgcttggctggaagcagaattcatcttgcatgaggaaagcagtctttggcctgtctcaggatttctccagcattgcataacaagcagatttcaaaattcattttcttctccaactgcagcaaaaaaggcaaggagagacctttttgtttgaagactctggcccagtcctgtgagagttcgattccattagaacaagcctttaacttgctctgtttctgtgtcaaggtctatatcgtaaaagcagggtcgggtgggc

SEQ ID NO: 2727 - DNA, 673 bp, Rattus norvegicus
  Genbank Accession No. AI235950
cactgtcaccatttattaaagttttataaaaactcaggccacatgggagaaaaaaggtacatcccacaatatgaacaacactgtctagtgacttctcccccttgctctgtggcactatggtaaagcagctcctcacttcctacctgtcagacagcatggacatgttcctaaactggggcaggttgccttttctcctgagaaatcttagcagggtaaaagttacttgccagccagtctctctgtgtgagaaagttccttctaaatttcatcaactgagtagtaaggtttcttgaccaggcccagagacagctacagccctgctttttatctggtgtgcaacggccatgggcatgtgaggctttcagaatgtgcttgaccctttcctatgtatccatctcacttcatatctgctatctttcctgtgtccagacagcatgcagcccagtttaggaagacttgggtgggaagaggggttagaggcaaggaaacaatccttgtctcaagtctggtgcacttcatggaacatgagctcacgggggatggctgtttctgggccaaacttggttgctgcccggcgctcaaaggcagcaacgttctgctttacaacctcatcaaaaaacatggtcgccagcttggagtggagcagaaaacgaaattcaaaggaaatcgagaa

SEQ ID NO: 2728 - DNA, 506 bp, Rattus norvegicus
  Genbank Accession No. AI236021
  misc_feature (1)..(506): n = a or c or g or t
aaatcattcaacggggatgctgcgttgcttttttaattgcatgggtagttttaaataaatggagaaagcaccttctagaagctacactagcaagaagattccatcaagcatttacacagtaaatttccaataattttacaaagattcttgatcttcacttgaactggacataaggaaggacaggcccctcaggttgctgtttctctgcttgtagaaggaaacaaaagaaacctgtggggcggggaggagagaaagaactggtgactctcatgtctacttcaggacatgtgaagaggccggtgtggagctgcacacctggtaaagtccagcacttgggagtggggtcaagagggtcacaagtttcagcttagcctcggctacatagccaggctgaacgataactgtcagatgactttccctatgatttagagcatgctaccacctttaagataatgagaatctcanaagctgtagtattggaatacctttgaagacctcagacagct

SEQ ID NO: 2729 - DNA, 147 bp, Rattus norvegicus
  Genbank Accession No. AI236030
cagcagggtaagcccctttattaaccatccttacttctccaagggggcttgagtaaaaaagaaccagcaagaaactggaaacagagggcaaaggaaagggaggaaggggggccggaggtaaacccaaacctggacagtaccgaaatg

SEQ ID NO: 2730 - DNA, 182 bp, Rattus norvegicus
  Genbank Accession No. AI236039
gaatgtaaacagttttattcaaaaacagacaggtacctgtttgcattacagaatttaaaacttggtttacactctttaaaaaaagaacaaatcctcaaattcaagagagcttaacattcacagggcacactctatagacatgaaaccactgctcactgcctcaaacttgattcctcgtgcca

SEQ ID NO: 2731 - DNA, 555 bp, Rattus norvegicus
  Genbank Accession No. AI236053
aatgatcacatagtaatttatttcatctaaaaatatactgttaaagtataatgactgagcagacgtttcagaagccagcttctggatccttagtggccattttagtattatcagtagagatcagtacttctactatggactcactagtctagaacaaggaaagtcactacacattagacaaaggaattgtaccaaaggatacttctaagtaacttcaaagaagttataacctaaaagtttttttaaaaaaatcttggccagacatggagatgtcttctgtaatcctagcacttcagagacaggagcagaggtcaggggttcaaggccagctagactacatagcaagttcaagaccagcctgggctacatagcaagattcccacctctaaaaaaaccaaaatcaaaaagccaacaataaaatcttccacagaacttctatgatagaataattaaaaacacatggccagctcagtgagtctgtattaaaatgacctttgaagtttcaaaaggaaatgtcttttttctctttctacttacttctgacccttgaatttg

SEQ ID NO: 2732 - DNA, 687 bp, Rattus norvegicus
  Genbank Accession No. AI236072
tatttcaaaacagctttttattaacctttcttttccacttcctctcatgggctagaggggaggctgaaatatttaagaacccttattaaagtaggttttgaaaaatctaagcctacaatacgtaatttgaaacttgttattaaagaaagaaactcagccccctctccatcaagtacatttcatgtcagaatcaccatttaaaaaaatggctcaaacaaatatgggataatagaagtgttaaaatgttgagtctgttaactttaaagcacaaacatttacattaagattgaggagattctctgaaagtcacagcttaactaggacaataaaacaataaattggtgttaaaataagtaaaaaaacaagtatgtatagcgtacatcctgggcaaggtcctgggatcagccttagtaaagatcagtaaacagaccaagtcacttgctttagttttcttgatcctattagttgctccaagacttctcgtgaatgatctgttatcagggggcagccatggaaaagaagtatacatatttgaggacaggcagtcagggcagcttcaacagccttatcagttagatttatacagtaacccatgttaatctcctctaattgtttggcacacggtccactaacaagtgcaaccacaccattgtcagagacctgagtagttgaaaagtcaacacactg

SEQ ID NO: 2733 - DNA, 687 bp, Rattus norvegicus
  Genbank Accession No. AI236084
attagcatcagaagagacttggacggggtgcgtgctcaaatgccatctaggatggttttaagaacaggggggtggggtaacttgtgctactccctaggagggtgggggtcttagtgcttctcggtttcctgagggtccccacatctcctaggatggcacattacagctcgtagcttcctcctcctccttcttcttcctctggaaaccggcagctacaagcatcttcctcttgagcagttctaaccgccttcttaaatggttgcttgaatatgtgggggaacttcttcctgagccatttgggcacagagaaccagagaatgatgaagatcaggaacaggagcagcgctaatgtcagcgccaggaacaaggtaagaacctgcaaggggcgctctcctgattctctctctggagtagtcacagcactaggagtggtactgggagagaggctgaccacagggggtccacagaccacgtctttctccttggtcccattcttaagcacagaccttccgtctagagagcagttcgtccagggtcggcagacgccggcgccgtcctggtcattaaacgttcccaagccacagtttttacaaccctgctccgttagttcctggccgggcctgcagtccttctcacacctggtacactttggccccaagcagtggaatcccttcacgcacttacact

SEQ ID NO: 2734 - DNA, 548 bp, Rattus norvegicus
  Genbank Accession No. AI236106
tttgaaacaaccacactctgctttattgggtgttccgtggtcatataacacagacttcttaaggaataataaacacgagacttgtattttaccataattatcttgccattaagacagtggttacaaaatataaaacaaaaatttgaaaaagaaaaaagaaagaagtacctttctggctacacacatgatcagctttagcactgaaaggtccccccttgtgggtcacaatcacaggttcaagggttaaaaccatctagcagtaaattctacaatgatgtagagcatcaagtcactgcagtcactcagttctgagacgctgttgccttaggttagcatttacacatgacattcatttcacagacacagaaagcaaaccaacaggtaaacatgcttacacggactgcggaaatcttccggtttaaaactgttgtgtttgtcttgtttctttttttttaagaaaatgctcgaaaacaaccaagaggcccgcggccccgtacaagaaacatcgggagtgaatactgaagagctgcaagtttctccctcgtgcc

SEQ ID NO: 2735 - DNA, 612 bp, Rattus norvegicus
  Genbank Accession No. AI236146
atttaaatcagttttatttaagaatttccaagagtgacaactcttataaaaagcatccaagcacaggacacagaactgcagcaaacagcattcttatgaatagctaacagacatgagaacttccacccttctttgagacacctgagctcactggtgaactctgcttccaagttctcctgcaaagcacaccacaagctcagtccatgttcgcagcccatcagcttcagttcacgttcccacacttccagatcagtaacagaggagaacacacaccatacagcattcacagcagttgacagaggggagggaagtacaagtatttcacttaacacattcagctactgtgggtttcctaagaacaaaactcaaagtcttccaacagacgtggatgtcctctgatgcagaaacactcgtacgttagttatctgctatcattgctctctgcacactctcgcaccaaagccacaggattgagggacacatctctccaagttaaaaaatatccattttccaccaccaagtctttgcacgcgctctctccttttctcgctcatactagcctttcatgcctcggcaccaccatcaatcccacacaaggtttcaaaagttcaa

SEQ ID NO: 2736 - DNA, 554 bp, Rattus norvegicus
  Genbank Accession No. AI236164
ataaaaaaataaggcacatttatttttgatatggtaatttaaaaatagaaaaccccacctcggaacacctgtattcaaatgagctgtatagaaagacaccttgtagtacctaaaatggaattgcttcttctgctttagtgacaagggaataaattgcacccaccccacgttgtcaagtaatgaaaatacacctctttttctactggtgagcggctaaaataatcacttagtttttaaacgtgtgggtaggaaagagtagtcgagaggttcaccggggagagcatgacaaccaactacatttagcggaaggacggagggattgcacgtttccacatattttaacacaaaaaaatattcaatttgtaccaatgattaatgattacaactattttggccattaagctgttatctgtaccaacttctgattttgctttctctttaggtcaaataggtaatttttttttttaataaaacatgatcagagataggaatacttctagagaattctctttgcagccctcaatgcaaacctacgtagttagcatttaacctga

SEQ ID NO: 2737 - DNA, 534 bp, Rattus norvegicus
  Genbank Accession No. AI236168
ggtaacaaaatactttattggtaccacttaatgtaaaaaatatagtaatgctttcaaatcttagctcccatcttcaaataaaagctagttttaaaaaaataggagttaaagtaaaaatcatttgattatctcaaaaccaagctgaaaccacctttataaatcactaagtaccctaactttaaataccatggtcactgctctttacaataaataagtgtgtacaaaggagacattggctctgcttattctgcagagagcactttatacatcttaaaacacctcgcactcccggagccctcagcagttagctaccattggagtggactcaccttagcacctagagatttggcatttgtcacgtctgaggtggctgatttactgaaccaaacagtgactttccgagttcgcatgggctatatacaaatagccctgtaagagtcaagggctatgaaagcaagcccgccctcgccgtagtgccagttcctgatcaagtgatggccggatgataaaatatccatgtgtgataaatattat

SEQ ID NO: 2738 - DNA, 485 bp, Rattus norvegicus
  Genbank Accession No. AI236200
gcaacatggcaaaacattacagctcgaagcagacagcatctcctcatagaggaggaagaagttttgcagtcaaatcaaatcataatcaagaggtcactggtagacggttctattatgaaaatgatgccgtgacttcatgaatttttagaaacaatagattctttaagaaaaagaaaaagacaggcagaatctgcggatctactagctgaataatgaaacaaggaactgatgtccacttaggctcatgatactaaacataaaagactgcaaaacaattttagaacttaggagaatcatagacttctgccaatcaataagagttcatcatattaccaggaaaggaattattaaggtatgcagtgagggaacgaagcagagtaaaataggaaatgtctttcatttctcctggacatcaacttctttcttctggtcacggagtatagggaaaggatgagcctcggtgttgaagatccagtcctcgtgcc

SEQ ID NO: 2739 - DNA, 343 bp, Rattus norvegicus
  Genbank Accession No. AI236203
aacatttcatttcaattgctttattttaaagtaataaatctatcacatgttacaaagcattttgggaaaaataattttattttccaaaaattaaccaaaaaaaagctcattggtttatattttatttaagtgtgtgtgtgtgtgtttgtctgtgtgtctgggtgtctgggtgtatatgcctgaatgggtgtaaatgagtagtgcaggggcccatggaactcccttggagctggagttacaggccaatgtgagctaggaatcaaactcaggctgttttcaaaagccccacacacccttaaccactggggcatttttcctgcctctgtcgaatgctttttgaaaa

SEQ ID NO: 2740 - DNA, 508 bp, Rattus norvegicus
  Genbank Accession No. AI236262
gggatttaaacccaatgcactttaccactgagctgtaatcctaagcctttattatctcagtgctgtttcctcctagaacaaagctaagcactctcccaataacatttagtcaagtcttctgacaattttactgacatttcttctaataacccctatgatctgctcccatcacccttccctgtgcttgtgataagctggtaattttgtttacagttgagtaaaaagcaattctaaattacagtaaatttgctggctctgcgacatagtctggcctctgctgaagaaagaaaagggaggtggaggcatgaaggactattggtaaaggtcaggcactaccagaagcccagcttatgtgtcaaaagcaggctttgggactcatgtccggcagatgaatcttcaaggcttggagaagaggaaggctacttcacaaataccacagagtttggatttctagaggccacccaggccaagaatacatccctgcagtgcttcaccacaccctcgtgcc

SEQ ID NO: 2741 - DNA, 320 bp, Rattus norvegicus
  Genbank Accession No. AI236342
aatcaatggtataaaagttattattaaataatttaaaaagtaaatgatgtcctatagaacaaaatcagtggtattctcaaatattaggattgtgtaacttcatttttttcttggtcttgaaaaaatagttttcagatggctaggagaagtggataccttctgcattaaatccgtgtagcaacctgataaaatcatctatgtccatagaacgtgcccgtttgtcactaaaacctgtgttggttaggatctgctgtattttatcggctatactgaaatcttctggtattacagtattctgtactgaacagtgaattctgtag

SEQ ID NO: 2742 - DNA, 500 bp, Rattus norvegicus
  Genbank Accession No. AI236366
gacggacgcaagatggcgacggcaactatagctctccaggtcaatggccaacaaggaggggggtcggagccagcagcagcggctgcagcggcggcggcggcagtggtggcagcaggagacaaatggaaacctccacagggcacagaatccatcaagatggaaaatgggcaaagcacaggcaccaagctggggctgcctcccctgacgcccgagcagcaggaggccctccagaaggccaagaaatatgcaatggagcagagcatcaagagtgtgctggtgaagcagaccatcgcccaccagcagcagcagctcaccaacctgcagatggcagctacgggcagcgggcactggctatcatgtgccgggtgtatgtgggttccatctactatgagctgggagaagacactattcgccaggcctttgctccctttggccccatcaagagcattgatatgtcctgggactccgttaccatgaagcataagggctttgccttcgtg

SEQ ID NO: 2743 - DNA, 460 bp, Rattus norvegicus
  Genbank Accession No. AI236402
  misc_feature (1)..(460): n = a or c or g or t
atagcacagtgaatattgttacctttatttttttttttaaagaagaaggtacaaatggctagggacatattacagggggaggaaagatggtgttatctctgcagaatacactttcatgctccacgggaaagggaggaggaacctcaggaccaatctagagacgtgtaagcaacatctctgtggcttctggggatatggccgaacaccagatgtgtctcaaactgtggataacccaagatcccttcttcccttgccactcctgtctacccaggttcccaatctgagtcctatccacttttctttctttctctgtttctgncttgagactgattcccacaagttttcctggccctcatattcattctcattgttgggtctactgacatatgtctttgaatcaaggaatttctttcagcctaaaatctttcagctaggtcctaaaacccccctcccactcccc

SEQ ID NO: 2744 - DNA, 321 bp, Rattus norvegicus
  Genbank Accession No. AI236473
atgctacgttcaaaagtatttttttttgagaatacaaaaagtaatccttggaaatgagaatatataacagaaaagagcacaataacttaagtgttaaacatctgtatgaaataacttgcaaagtttgacaactatgcacacatagaacatgcgggtgtttaaaaaacagaacaaacaaaaacaccacccgattctgtagaaccagcatcatttcaccagcgggagagcaccaagcaaggcaccattggaaagacaacacacttggaaagtctctataaataaagcaaatgctaatctggtcgaaaaatcggtgtctttggt

SEQ ID NO: 2745 - DNA, 453 bp, Rattus norvegicus
  Genbank Accession No. AI236520
atcttgttttattattgatgtaagcatgtgtgccaaagtaatgaaggcaagtttacaatgtcaggattttcttagttcttacgcttatcatcgaccttgacgctaaacagcatttcaaacgactaactttcaaatgaatgtgtgcgaagcaggcctcggctaatgatgggtgctgttaatctgcattgagacatttcactgaaatcttcaaaagacaaggatagaagatttatgaaaaagcttcatagcctgtctcctggtcataagcctgagagagagaagaccaacagatcgttttataaaccaaacgggtttatatgtagttttcacagatgtggctgcagacctcttaataatgcatgagccatcctggctgtggttgtattaactatgcttaaagccctatctggtttcaaaggtggaagaagatacacattggcatggtagctggca

SEQ ID NO: 2746 - DNA, 439 bp, Rattus norvegicus
  Genbank Accession No. AI236566
caactcccacattttattgggacaaagagggaaagaggcagaccattggcacaggcttacccaccaggggtgtccaggcttccatccagtacttaacacagcaggagcacatcttaaatacagcagcaagggctagagacagaccacagtgaggagaccgcaggtcctgagggttggggcaaaggcatgtgtactatactggcacagtccacttgggtgaaggtagaggtgggatagatactgatttgcagataggaaggacagtgttctcttgtgcagatggagaaagaggaatcctgtggacaggaagtcctttttacatatttgcaagagcagatttcacctcaaaggtgggtgttgagggaagaaggaaagtttattttaactgtccacagaaatagatatgggaaagaaatgtggggtttgcagaaaggaaaaa

SEQ ID NO: 2747 - DNA, 406 bp, Rattus norvegicus
  Genbank Accession No. AI236576
cccttggcttattcaagggccagtggaaatttattttttcatccttttccatcttctcccaagtggcttttccttgcaaaatgcctgacatgacaccagaggggaaaagggaaaagagaaacccagtgcagcatacatgggggtgagtgacagacagcggagccctcattacagagaaaggtgcgtggtgggcatcttttcaaggtacctagaggctgctcctggccccatccgttttttggtctctgcagccattgtcatgaatgcctgttcaacattggtggcattcttggcacttgtctccaggaaggggacacccagagagtctgcaaattccttggcgtgtggtattgtccacgaaccttcttggttggtgaggtcaactccttgtttgcctaccaaccag

SEQ ID NO: 2748 - DNA, 646 bp, Rattus norvegicus
  Genbank Accession No. AI236597
aataaagacaagtgttcagatttatttggaaattcacagtttctaatggtactacagctctgtagttacatatttaaaaccctcttttcacaacacatagtgacttcccactctggctctgctggcatctggacttcaagggcctgctgtaccatcaggccctattgctctgaatggctaattgtgcagactggaaggggtaaaattcatttcctaaaacgtactgttcacctaaagcagcaacttaaagaaaaaggccttaaataaatcacattacaaacaacaccaaaaaaggtattagacaaatttaaaaacaattattaacaaaagtgctcaataagttataacttaaattttacaacacaaaatggtcaattctctcaaaaacacatttcactttcactcatccctgtacaatccacacatcaagaactcaatttactcagacagacactgccaattacttaagggggggggtggggggacaaaaagtaaatgaagacaaacgctgacaaccacatacacacatatctgcacattgtagccaacaaaagcaaacacaaaggaatcataatcctactagacttcaccaattagactgaatcaggcctgacgtgctcactggctggctgtgactatgtacaaa

SEQ ID NO: 2749 - DNA, 400 bp, Rattus norvegicus
  Genbank Accession No. AI236603
caaacaaacatttattctgttcctactcggagggaggtggcatcccccagatgatagcccagaggccctgaaggccaggccaaggggctggcttggctctgaggttggggagtcctgggtgggctggggtgagttctggaagctaccccccaagtgggcagggtgaacatccaggcccatgggactgaccatgtgggttgaccctcacctgaggaggtgtgcaggtcagcaggtttaaattaaaaattaataaaaataacattctaaagtaaaaaaagacaacccgtctcaaaccatgagggcttgtcctgtcgcctgcgttatatacaaaggagcggaaggcataacccactgtcgggagcggtgggctgggggttaagggtaggggtgcctgacaggg

SEQ ID NO: 2750 - DNA, 598 bp, Rattus norvegicus
  Genbank Accession No. AI236608
gtaaaaatgtttattcacaatccttgaaaggttaccattccttcagaaaattctttatgaacaaaaagccaagaaaattacaacagtagcttatgccaaaccaaaaatatacatctgatgtaatataaaccttagaaagcatgaacacaggcaatgtgaacagagtgcctttaaattatttccatgacacacctacaatttaaatcttaagatagatataaataatagcataacctaatgcatatttacatatcaaagtatatttatttgtatgagatttaaaaatgacaaaattatagatgtcatcgtatagcagttcaaatattgaaagggccacataagttttcacgcacagcaagaacttgactatttctacctgaccgccctgtactgctgaaagcatgcaccatcgctgctgaggagaggaaaacagcaagggagacagaatgccgtgtgcttcccaaagtgacactcagtcctcagccaaagcaaggaacgcagttaggaaacacttcccagccctggccttctctacagattcagacatgggtctttaatacgccgccattttagttccatcccacacagcgccttgcac

SEQ ID NO: 2751 - DNA, 467 bp, Rattus norvegicus
  Genbank Accession No. AI236610
aatccacagtatgtgtttattgtgtaatattcaaatggacacacatgaacttgccatatcagttgaaaatacacacgtctttgtatataaaaaggtcttttagccagcagtaatcatttagcatcttggttattggcagcaacacagttaccatagggtacaaaatatgagatgttaactaacaacaaaagtgtaatttccctcactgctttcagctgacagagaagacccaattgagcaaactggcagacaggtgaaagccattgcacacaggcaggatcagtcagcaggtaaggaagcttctcatctcttagtagacgcagtgaagtcacaagaaaacccaggaccgaatactgactttggcaacttctattttccctttaacgtacatgttaatgactttgggagcctactgaaggacaagtgatccttttttccccctcccccacacaggtacaagtgctcac

SEQ ID NO: 2752 - DNA, 587 bp, Rattus norvegicus
  Genbank Accession No. AI236611
tcaataaatacttgctacatagtcatatccccaatgataaatcaactgttctgagttaccaagaaatcagatttataaaatttttgtaagaaaaaaattattatgcaccatttaagaataaagctgtctgaagagctcaaattttacacacctgtggaaagttttaaagattagtgaaaacacatatcagtatatgcctattctataacatcaaatcttagcatgtgcctattccgaacatcgctcattgccactccctcccacttccacctctaaattaagccctgattatggtgcagtgagcccattatgggacccttggcatcacccagtaaaattctggttgttgctgggcatgtggtacacatctttaatcccagcacttaacagatagatgggtctctaagttctgaggctagcctgatctacagactgcgttctagaatatccagggctacacagggaaagaaaccctgtctcaaaacacccctcccacttccctagtttttcttgtatttggctgtcttaacaaaggggtgtaaatgctactaatcattcaacacaggccagacccaaagacaagccag

SEQ ID NO: 2753 - DNA, 458 bp, Rattus norvegicus
  Genbank Accession No. AI236635
acccatagttcggttttattcggagtaatggggggaaaaaggaaacttctgctcatagaagaaactcagccacaggtctgatctgtactggaactacacatgcagtgaggacaaggctgtgtttgtctactgatctctaatattaacaattataaacagagcagtgcaactagcatttggaacaacccttctagtgttacagtgacaggcacagttcacttctcttcacaccactggttctctttgcgtacctgggcctcctcctcttcagtaaagtcatttttgatattgaaggttttacgaatctcctcaggcgttttccccttaatcatattagccacagtcttgcaggtgacatcaagcaaacctttgatgtctaagtagtttgcagccagaataagttcaaaaagtgttccttggtcaactttcaggaattcttggtcccaaacagggaatat

SEQ ID NO: 2754 - DNA, 503 bp, Rattus norvegicus
  Genbank Accession No. AI236664
gcagcaaaatatattgccaccaaataactcattacaaaggtactattcttctaaataaataataaaggggcataaatcactaatacatagtaacaaaatagttcccaagaatactataaagagcaagataaataactatctcttagacaacagaacaaagaaaattgcatttaaattattccataaacagaggctacaacagtattgcacaactaatgaaaagcactgagacaccttaccaagcgacaggaacttacgtaaacacagtaactctggatatactgctcaactctttcttggacaactgacccacctaggaatcagctcccatattttaaattataaaatggaaaactccaatatcaactgggagatgttcttgtcagtatttctttgtaattaaaaaaaaaaagatgagtaattttattttgctcagctaaagaaaccagtttattttttaattcttaaatcacgcacaggaaagaaaaagaggaagaggggga

SEQ ID NO: 2755 - DNA, 471 bp, Rattus norvegicus
  Genbank Accession No. AI236681
tttatcaaaacctgtcacagttgggaacccagaggaagtaaaaaaaaaaaaattcccacaaatatttcttctggttcctgagtcctccctcaactcgcttcccagggcttgaagccatctctgggtacacatgatcatctccccccaccctcagccttcttcccagcaataaatacaggtgaccgtgattcagtgaaaccacaacttatttctctatcttgagtgtcccaaggggaccagaggggcaaaagaagtttaataaccatcccctcttaattgtgtggaagcttctccctctaagaatgggagaaacacagcagctctggaaagaaacaggaagaaaaggttgagatgagaaggaagaggacattctctaggaacctcaatcttgatccattgtcccttaccaggtaaggggtggtcccagtgtatcagtggaacagagaaggggacttcaggggaagggatgaa

SEQ ID NO: 2756 - DNA, 571 bp, Rattus norvegicus
  Genbank Accession No. AI236719
ggggagggagtaaagtgcatttattttctcatgtgtttttaaaaaagagaaatctcccaacactcagtgttggctgaatgggaagaggggcagcccctagaaggtataggaatagaaggcaatggcattgacgctgtagtccatgggaaggtggtgtccaatgtgcctggcccccaggctggcccctcccagtgcagaagagtgcctcaacttcatcagggtgaaactggagaaggagttctgtgcctgttgctctcggccctgcgtcagtgccaggagaaagccttccttcagtagctcccagctcttccacactgagcccacacacagaatggggaggccaagctccccttggaacaaaactgggtcaatctctggcaatactgccacaacgtgtctgcccagcatctccccagcctttctgaagatgaacctggaaagagggtctccctgctgtgcaccttctgcaattttctgacaaaatccagcaaacttggacttatcaaagtccctatacaagtgagtgaggattcctagccgatctggcacctggaagtaattgaacatggcc

SEQ ID NO: 2757 - DNA, 678 bp, Rattus norvegicus
  Genbank Accession No. AI236741
tgccaccgagactaccgaagaattcgcagcccttttttttttttttttttttttttaaaagaaggttttgtttattttttaatatgtgtattacaggaaacaaaacacaagagggcaagaacaaagtcacccagtcacaagcagctcagctcggtgtgtcgttctagatcttgcaggtgtacatacacttgggtaatggagattatacagtatgtaccatgcttccccacattgtgaatattcaccaactaaaaaccacgtgccacacgaggatttgatagccaagaatacaccatgccatctcaatctgtcagacaaaattgtaatcttgtcttccttggcaaaagaaacttcatagaagacaaaaacggcagcaggcctctagatagacgtactggcaaagttacaactgaattctgcattcgctcagtgctcagctcacaaggaaacacaaagcaacagaccacactaagtctagcattcctaagctcatcatcagatctagacactaacatatgcagaaggggtgttccccgatcaagaaatgtattcccatggagcagctgggagatgcacccacagtggggggctctcaggatgtctccacacagctgcagacctcaccccgagagcctctctgcccctccagtcatcctagcaacatgaatttccccactg

SEQ ID NO: 2758 - DNA, 165 bp, Rattus norvegicus
  Genbank Accession No. AI236748
aaacattcactcccacaaaaggggagtggacagatttattgaattcaaactgggaaaggaccccctggatggctggactttgggcccacccccaggcccctttgcccaggatgggggcctgcaaaggatgaggcacaaaggcctgcagctacccaaattggaggg

SEQ ID NO: 2759 - DNA, 420 bp, Rattus norvegicus
  Genbank Accession No. AI236761
gctgtctagcatgatctgcatggcctgtaatctttgaaccactttcgtacctcatgtttttatccagcactcttattgtactgtgtactagtctgtgaacaatgtcaaataaaaaagagcgaacaggtcgtatggtggagctgagctagtgtacaatgcaccagttgtacagaaacaaaaatgaagtgagccatcttttgttcatttaaaatggtgttttgaatttcatatgcagaaaacgttttgttacattgcagattttaatgtatttaataaatgcaacatgcagattaagtgcagtgtatactgagtatttaaattaaaatgtacatttcataaatacagtttcaagagaaagcatcattttgtgtatactaacacattaagtgtatgtcagaaattgatgtacaaatatatatt

SEQ ID NO: 2760 - DNA, 655 bp, Rattus norvegicus
  Genbank Accession No. AI236772
gaaagtgaaagaggctttattttcaatatcatataagtcattccatttaatatttatagtgcatagttatgtatgaaagcatacacggaaaacattaaaaaatacccaaggatgcgcgtgcacaggcaaagaagacagcctttgtgtctatagcaagctcagaggtagcacaagagagtatccatctggtaacattggaaatcatgcaaacaactgagtcaaggcatggcattaaggtgacatcagcatgagttataattccctgggtacaaaacctatatattctttgggtttcaaaaaaattaaatgaatggcctacttttatcttctggacaaaaaaacaaaaaaaaaaaaatctctaagagcaaagtgcacatattgtcctaaccacatacatataaaatattcaaggccacagatggaggtcgctagatgacaaaagaggatactgagaggtaaagtaaccagagagagatgcaggagggaaaggcccctctgcctccatgggggatgcaaaggcttaggcactggaacacccaacgtggaccacactgcctgccacaaggaactcctcactgagctgacgtcaccatcatcaaaccgctcgacaggcggttgtaacttcctttacatttcccatgggggacaagcatgg

SEQ ID NO: 2761 - DNA, 642 bp, Rattus norvegicus
  Genbank Accession No. AI236778
ggagaaagatcactttaatttctttgaaaatggaattatataactaaatatacatttctaaaattaaaaacaaaagccagtgtaatactattaacactttgttaatccagtaatgctaatgaactaagttaattcaaagaaaacagaattttattaattagtacattctttcaaaaacaatgtgttatggcccaagaactagtgcacatttagctgacgtttcaggactctgctgtactaatcatacatacccaaatactgaacatctcgacattacatttctgccttagccatttaagtctaaaatatgcaaaacctcaataaaggggttctaactggctagcagataaaagcgatgatgatggccttcacagttcagcaaaaaacgactcctataatgactatcagggacatgaagctttttagaggccgttagatccaaggtagttaaaacttgacaatttttgtctataaaccatttgcacatatacaggttaaatccctgataaagatctgaaatgcttgggactagaagggtttggatttcagaatacatcagattttagaatttttatgtagcactcatcagctgaatatccctaattttgaaaatcagaaatctatccttttttaagatttatt

SEQ ID NO: 2762 - DNA, 585 bp, Rattus norvegicus
  Genbank Accession No. AI236786
atcagttttccaacaataattccactgaatgagtgcacagcatttgcatgaactacctcagggcaatatcagtacaaaacagttcaaatttgtaaaaaggtcatttcaaaaggaaacctcctgattacttcagggtgagtgccaacaccactgggaaccgaggacataaggcaggaacatggctaccacatggtgtgggaatgggctggcctgaataacagtattgctcttctacagcaggagaccccaaattaccctccaagacacaaatgggtggcagaaaatgtcaccttcatttgttgggataacacatacactttagtcacagtaaaattttctgttggctgaccagtgagacccagccatcagtcctacatgtatctatccaaagaaatacagagtagagagagagagaaagagccctatgggatagtgtccgaaagataaggaagagccaaacagataagcctatgtagcaactgcaggtgaaaccctctacttgggagctaagacagcttccatttggtctgtgtttttcctgtccaagagactcctgttaacctttaagtgacagacactacaatt

SEQ ID NO: 2763 - DNA, 348 bp, Rattus norvegicus
  Genbank Accession No. AI236794
aaccatttggctagaaattttatttcagaaataagcattcagggtactttaaagggattaaaagttatttatggattactggaataaatacttctcaaaaatagttactctgtaaatacacatacaaacttcagtgaaaaactccttgccacaaacaagtgatctggatcaaaatctgatgtcacagggaagctgaacgggggcatattccctgctgggtgttaaaagccattggttctttgggatggaattcttcacaagtggaaaggccttggggatgaaagtgggctggaaaaccctggaaggtagtgtccggagacacacaagcctttttcagttcctcgtgcc

SEQ ID NO: 2764 - DNA, 428 bp, Rattus norvegicus
  Genbank Accession No. AI236795
attttgcatacttttaatttcagaacaaaataaaacaaacaaaaaaacacaatacacaacacccaaccctgctattctgtgggaggggatcttcctgccttaaggcacaaggacaggatagaagagattcttgtagacatgagcagagagccaggtgggtcagggccagtcaaggctgttgggggagccacagggatactatacagagggcgggggcttcccaggagcctttaatccacttcttccatgcgagaggcatcctctcctctaagtactctgtctggtcttctttgaggtgaaggatcactttggtaccccggccaatgggctcaccgtggtctgcacggacagtgaaggatccaccagcagaagactcccaggcatactgctcatcatcgatgtgcttcgtgagtgtttcttcaccacct

SEQ ID NO: 2765 - DNA, 527 bp, Rattus norvegicus
  Genbank Accession No. AI236834
aggaagcaaagatctttattttttttttaaaaatttatttattaaaaacagcaatttctagctaaataatataaagcatttaaattaattatttcaaagtatgtacactctgtataagtaaacccgtgagactgtacagatttaaacaaatattcactcagcagacaaagtgggtcagtaccgccctcccagcacttggtaaggtgtgtgagtgttttcagaaacaaaaaatcaaagcacaagagcccgaacaagtcctgctgtgagcgtgagactgctgagccacagtgtgtgccacggttgcgtcctcatttctttggaaaggctatctgaaccccaatgcacatatgatacacagaactggatatcacagtttatcaataagacatgtatttaaaatagtacaatcttccaaactcattcacttcatagcaaagaaaaatatggcccctcttacctttgagtttcccaaaatatagagtaatatgctctaccaagcaacagccaccaccaacttaagctgggct

SEQ ID NO: 2766 - DNA, 458 bp, Rattus norvegicus
  Genbank Accession No. AI236856
aaaccagatttaagattttttttttttaattcaaatcgacccaaagcaaaacttacattacaaagaaagaacagaatatattatgatacaacacactgggagttacatggaagctaaatttgtgggcaaacggtcttgtcccaaccccatcctgggctaatgggtgattcagggggaagttagaaactctttcgcacggtccactctggtgattaagctacgcttttctggtgtcttacgaggggggagtctgacaggtcatgctagcctcccccatgctccagaagtgactcctgccactgccggaatgctgacttctccagcagaaacgtcggtccaagcatgactgataatgaattaaaaacaaaacaaaaccaaacaatcaagtcatccaaactaatgagcagggttattctgtagtaaatagtttagaaatatgggaattaaataatctaaaa

SEQ ID NO: 2767 - DNA, 647 bp, Rattus norvegicus
  Genbank Accession No. AI236912
aacaaaaaggaccacaaaatttctcaaaatagattatggaacacaggaaacagttcatgagagtacaggggcactagccagcactgtggctaagattagaactaaacactctatttaaatggtattgcactagctctacacacagtggatagtgagaccacagtaatcaacctcacagtagcaacagaggcacgtggtccctaagatacttcttcagtgggcaagaatctatggtccaatagaaacatttaggaaggaaaaagccttgtaatagtagaaacgctgtttactggtgtttttactgtaaaactcttacagatcaaattgaaatgtgattatctatgagacagtgcttagagcttacggtgcagacatttcatcgaacatctggccaacagatttcagtataacagattaggaactcatatctatgacagcatgatctaaaacagaactaaaaacacacacacgccatgtcaattcaccaacatcatcatctttatcacatttagggttaacttactatgccttaatttgtttaacacattctgaaatatcaatgtttaagtcaaggctttacacagtaacccatttatttcaagtcctctgtccaacttctgttaaatcttgagcagctgtcataaatg

SEQ ID NO: 2768 - DNA, 636 bp, Rattus norvegicus
  Genbank Accession No. AI236937
ccacagctgccgccggaactctgggcaaatcccagtggacggagtccagtcctcccactcccggttccggagagttgctgcagacaatgaggcccgcggcgacagctctcaggacaagttcctcgcagcctcccgccgagtctccagcgcccacccgggagtagagaggctggcgtctagctggcgtgatgagcagtgggacagatgcccgctaagtaacatgcacacagtgataggtcattcaatgtcaaaaggcataaaaaagatgagcaaaatcttcacaggctggtgcttgctgttgcctttaattatattaattaaactttgaaattttcatgcaaagagagttgctggcttgtgacgctgaagagccctcggagactggaaggaaggagaaaaccctgagcggaagctttgtggatacagcttccttaaattaaaagccaaacaaacacctaggtgttttgtttacagatactaatgctttacgcacggctaaacacccaaacgctgagaagggggatctacacaggctggggacaaggtcttgaatcacaagtccttatgctgtgtgctccaggtctatggttagaggcggtcttcctgttgaattaacgctctattaattctcttgtc

SEQ ID NO: 2769 - DNA, 469 bp, Rattus norvegicus
  Genbank Accession No. AI237002
taaatacacgtgtttttttgttgggtcacagggcataggtggtgctgtacagagctggtataggcgtggggtggtgttacagtggcactggattcagcttatgtcattcagggcctgtgtcagctgctgcacgggctcccggaagttggtgctcgggtttttgctacacagcatgaagccgatctggccactgggataggtgggaatggtacagtaggcatagctcaccacagggaagagagacttgcagaaatgcctcatctccttgatgaggtccaggtgcagccactggcactcgccctggcaacagaggatgccatcttctttgagggctgtcttcatgagctggtaataggactccttgaagaggctctcagcagggcccatggggtctgaggagtcggtgatgatgacatcaaaggcatcttggttctgcttcatgaactcaaagccatcgcccacgtggaga

SEQ ID NO: 2770 - DNA, 430 bp, Rattus norvegicus
  Genbank Accession No. AI237132
caaggatggagttttctttattgtaactgtcaggacagccacagcagaagtccttccccagttaatattctttcctattaaaaatatgcttttaagattgacaaatgacacagtctttacctcatggtacataactggccaccccctgctgggaataacaaggtaagacttgttcaacaaagcgttaaagagaggttgaggtctcaggccaagtggtgtgtggtagcatttctcaccaccctggcagtctggagacgaaggcaggagcattgcctggtgtacaaggtccaggccagccaaggctgcatatcaagaccctaactcaaaaagactggagtattttaaatccgtgttgggcacctaggataacccaacactggaggcgggggagggagggctgcaagtccaagaccagcctgggcctcgtgcc

SEQ ID NO: 2771 - DNA, 451 bp, Rattus norvegicus
  Genbank Accession No. AI237159
gagatcgggtcttccgcaggaagtcaggatggcctgggtggacttacaggtatatgccattatgcctggaccagacatcagacatttcagaccaggtgctggtttgcatgcacaggaatcctgacaggatggcaccgctctcacaccaaccggaagtgaaatcttaacattccaatgatctggaaggtcttggctaaactttagaaacttttgtttttcttttagccactagatttttcaggaaaaattcacctgctttatatgaagatcgcaccaaagggccacttgcagtgtagtgaaatccaagttcatttcctacttcttcccagtatttgaacttctcaggagtaacgtactcttcaaccttaaggtggcgcttggtcggctgcatatactgcccgagagttaaacagtccacatcggctgcacggagagcttcctcgtgccgcct

SEQ ID NO: 2772 - DNA, 503 bp, Rattus norvegicus
  Genbank Accession No. AI237193
  misc_feature (1)..(503): n = a or c or g or t
aatcaacacattacatttaaagccttgatttctgaatgaatctttttctatgcaacatgatggagttaactgctggagacctcttgacagctacaaggaaacacttgatttaaactatgatcaagatgagactgtatcagaagcactaagacactagtgggtggacaggtacgagacttttcatcagtggccattcataattttgcttttagaaacttggaagaaattgtcatctttgagtttcaaatgttctggtaaatccagttgttttttagcttcttcaatatcaccttgaatcgcagaaataagtgactctaaagaatcaaagttcttttcaggtctgaggtagccaacaatggccacattgagaatctccccataaaagtcctctttgaaggtatggatgatatgggtttccatggacttcttcactcccaacgctggnccagccgtaatagatgccagtggacacatcagctggaagattgtctactacttgttca

SEQ ID NO: 2773 - DNA, 269 bp, Rattus norvegicus
  Genbank Accession No. AI237251
gccatttcacaccagcatttttatttacataaaacataccggggtcttataaattatctccatgtttcaaaacacagtttagtgtaaaagcccacaaaggaagctttcatttccctacctttcttgcttgtttttctttggacaaagggtgtagggctaacaagtccattatcatagcacgtttttaaagctaacatcttccttttaaaatctatttgaaatgttggataaaggggcattctttctctttacaaattcaaaaggctaca

SEQ ID NO: 2774 - DNA, 425 bp, Rattus norvegicus
  Genbank Accession No. AI237286
cacagactggaaacaagccatcacatagggatcaaccaagcaaaggaatcgagaagctccttactggctgggatccacttttggcacttgtcacagaagtaagacagctgctcctccatccatgatatatctccttcatcgctgttgagggaatccccactctggtcgtgagataagtccactgatgcctgatcctctgattccacaattaggagagtctctgtatgagaggcacctaccagccacagctgggaatgcccaaaaccatcttacctcttgcatgagaacaaagaatactgcctaccatacccaatgaaatccatgagacatgacaacaaagaggacactagagagcagcacatgctttcctatctatcacctcaagaaacatgagaaaagagtggcttgtatattaaccaaacaca

SEQ ID NO: 2775 - DNA, 499 bp, Rattus norvegicus
  Genbank Accession No. AI237311
aggagaaccgcttctttttattgtagttcaggacagggcgcggtcacccccggtcccctccaggggttgggcagcagttttgcagggccagggatgacgtctcgccagggtaacagtcccaaaggacaccagatgagtggaacagatggactgaggagtctttaaataaggaggggaatggggagagtcggactgcgctctagcgcaccatgtattccttgcgcttattgagacgaacttggcagaaggagaagcccccgaggaggaggtagaggcccgcggcgattaaacagttgtagctgacttgctcgtacaggttgtatatgttctgagggccgttctcaaaatctttctctgtgaaggggacatcctcaattaacacagcagaatggacattgaaaaatatcccgagcattatcaacatgatcactccccaggcgctgaggacgattccacaggcggccagcttaggcccacagcacaggagcgcctcgtgcca

SEQ ID NO: 2776 - DNA, 411 bp, Rattus norvegicus
  Genbank Accession No. AI237314
gtctgttgtttatttgtacctgtctgctcctttgagggttgaagtagaaggatgaagacccagaggcaagcaggtgaagaccagtttgatcaaaagggctacagacctggccttgtagcctcagcctccaactgtcttggccaaggggatcttagtgtctcaggaatgagggagaggagtaaagccctcaagccttcccaccttctctccctatgactccaggtcctaagctggcccaaacatgagcaagggctcaggaaggacctacacggatgtgagggttcatgagcgggtccagattgggatcactgtctgctgcagcccggccgagtcgagacataagggcgaggagcgccaggaagcccagcatccccaacaggagcagcagtcctgcccgctggagcagagtca

SEQ ID NO: 2777 - DNA, 605 bp, Rattus norvegicus
  Genbank Accession No. AI237372
agggtttagacaactatttatttcaatattaatactgaatattaatattataatattcaccaagtctatcttgggagatattcaacagacttaacatgatgaggcattctcagccacggaaagaaccaaacttcatctccaaagcgagtcaagtcctgtaacgcctgacgtcttactcactgtgctgcatatatggagtaagttagcacaacaaggaggtagagcgtcagtgaacaccctagaggtgtggatttgccatcccaactccttcacactcgatgatgtaagtgtccttagaggcatcttcctcctcttctgatttcttcacagtaaatttggcctttgctagctgttcagcaaaatgtatagcggtctgcgtgtggagtgtgactggtcccgtctttatcctggaaattccactggctagcgccatgaaaataattagctggtcttgtagatactcgtccacagtgccaccatgtctaagatttgctaacagcatttcagcagcttcaattccaaccttgtctgcattcacacctcttttgccaagtgatgatccagcaaacaagcagccagtggatgtctcaacaacaatgatgatt

SEQ ID NO: 2778 - DNA, 555 bp, Rattus norvegicus
  Genbank Accession No. AI237388
acacgcatccattctaggcagctttgcctaccctaatgccacagtggccaggtgccagacctgaaaggaagcacccagggggcaaggtctaaaagacacaagggacagccctttctcaccctcaccacgaggaccagcacacatttggtttcacctgagacaggacaggaagaggcctcagccacatggctgagtgcacgtacaaagggcttgagtcgtaagtgtcctgatccctcgacccttccacatttggctatttttggtttcattattaaaaaaataaagtgacaattactggcagggaccagttcttgcactgtcttctgttaaaaatatggtaggggtatgggtagccttctcgttggccaatctacttcacaagatatccgcccgcttgtcccttgcacgactcccggccttggtccgggctttgaaggccgcagcattgtacaggtgcttttcaaaacgtgaaatcttgcaggccttcagggcagcagcatccagcaccagcacagggcccatgccgaatatgtcaacggagaaattcattattct

SEQ ID NO: 2779 - DNA, 658 bp, Rattus norvegicus
  Genbank Accession No. AI237399
tcaatataaagtcatttatttttaaattagcaataaaatagacaagtttacatttaaaaatttacaaacaacaaaagcccttcacatgtagcatttcaaacttttagcccctgacctgaaggaggaaagaaaaggcctttactaagggttgtttcctctcctagctcgagccagtcctgccagacatcacagccatagggaggagggcatccctacggctccatcttgagtgccggttgactgaagaggcgcctttacaaaggaagctcataggcagtgcccagactagagtactcatcccacaaaacacgttaaattaggagtttaaataccccaaatcagggatactggcagggatcaccaaaggtctaaggcttaccactgcaatcactagcaaagatttccaggttattgcctccatgataggaaatacaggggacaaaagaaagcagaagagctgttctacagactcccgagtctcctgccagagaagagagaaagatcacacggacagtgtaaataatatcagacagttgggagatgttctctggccaaagctcttgtaagcagcagatagaggtaaataatattacacactcactatctgctgtgcagaaaaattcaatgggaatcactttagtccttactgcaaagatct

SEQ ID NO: 2780 - DNA, 581 bp, Rattus norvegicus
  Genbank Accession No. AI237403
taggaaaaatatttccctttgcaagatatagaaactacaatctttggaaaatacataacgccccataattgttacaatacatagccttgtataccacttgaacattgtttaaaaattataccctgtaaaggttggtataagaaacattgtcagtcacatatcctgacattcaagtacttaagacacagttgaaataaaatgaacttccagagaggttcatcttccactgtcccagaaactcctattgtgtaagttaggcagtggctccaggagtgggactaaatgagaggaggctgctatagaaaccggttactgcaggcctccctcccatcatcccccaaacccctctgagttctaaaggtctgatgactgtattttctaggatgctggtagaatggcaccattgacggatatctctgcggggtcaagcgcgacagtgactaagctaaataaatgtttaggatgtcaggtggcaaatatgatttaaaaccaccaaagttcctcttaggagctactggagaagaccctttcatagctgaattaagaccccagactccagcccctttcttcagaaaaactgt

SEQ ID NO: 2781 - DNA, 472 bp, Rattus norvegicus
  Genbank Accession No. AI237535
aaggcaaggtctctgtcattagggctgggagagatggtacagatcaagccaaacagtgaaaaataaggcaaactgtagcttcgggttttgagcctggcaccaggaaggcctcttcttgaggaagagggggcaggcagtggcaaatcagcagacgagatgcaaatggagtaacaatcacagttagtggggtaacgagatcaggcggtaaacccttaaagcaacacccaaggtccacgtctttgcatgtgcagggcacaactccagcagcagtttctgggtttgggggtttgttacttttccgactttccccaccccctaaaagacacgaagacgagctcatgaagagatcaaggaagggacgtcttctggctgcgctgggcaagggttgggtgacttccgggagcacttgtctaccttccctgtggctggccgagtcctacaaacgtttgtaggtgcccaggagcgctttgca

SEQ ID NO: 2782 - DNA, 427 bp, Rattus norvegicus
  Genbank Accession No. AI237543
gcacatgaataaaaataagtctttaatgctgggcatagtaacacacaccttagataccactactcaggaaacacaggcagggtgagtttcaggctagtgagggccacatggttgcctgaagaagaaaaaaaccctctacatttcattacaattttttttatatgggcccactacacagtgaagcgttcaggtgacaagttgcaggaatcagtctcctcccccaccacgtggttcctggggactgaattcaggtgggtgggtgtaagcactttgagccagtgagctcttgcaggctccatcttcatcctctgaaggagataaatgaggtggctctgcagaaactttgaatgggagtataatataaaatgaaaccagagccaccaggggtcagtacatgtcctatccctgtaaatgagattctgaggaa

SEQ ID NO: 2783 - DNA, 518 bp, Rattus norvegicus
  Genbank Accession No. AI237585
ttatttttaagatgacaaataagtttcaagtttatttcctttttttgtttgctatttaaatacaaagctaagccacaaacaggtacaaccaagacattttatctcacagttacaccctcctgtcggatcctcctccaagtctgaccactgactgggctagcaaagggtgcggggaagactttcttaggtagcaccatcatgaggctgggagatggaggtactggggacaagggtaggctcttatacctggctcctgaaccccaggccccctggactgaaggtgaatggttagtcctccccaaggagggagaaggaagcctactcttgctatcacaggttacaactgaaggatcctcctgatctctggctgctaagccttgcgggctgccaggtaccctagggccaaacacatctggtgtctgatgcccacaggactgacggcatcttcacgggagaccaggggttctgccttgacagcaggtagagaacttcccacgtagcagaattggggttgggga

SEQ ID NO: 2784 - DNA, 496 bp, Rattus norvegicus
  Genbank Accession No. AI237606
ttccctttgtttcccttttttcgacttttccatgttttattcttatattttatacagatacagctatattttacaacgcactaatgcagtttagacacagccaaaccctgtctccggagtaattataacaagcatgacgcagaatgtgggaggagtcaaacattcccaaagagagtttagttagtgacaacttcaagtccctgtgtctgcctacacttcaaaaagggatggcccacacccgtccatcattgaaaacttccgtgtaaaaaggcaccgtgaggacacgtttacaggtatgtacaaagtgaaaaccagaacaaaagtatacatttctccttctgcagcttttttttgttcttttttgtttttaatacacactttgtaaattgtaaaccttcacttgcaaaaaaatacaaatacacggaggcattttagacaaaatattttcttacttatacagacataatacttaaaatagtctcttaagtgctctttc

SEQ ID NO: 2785 - DNA, 655 bp, Rattus norvegicus
  Genbank Accession No. AI237620
caagcaagataaaaaaaatgaatcatagccaattttattcaaatttccaaaatttttagcaaacatgttaattgcttctaaaaatgtatgtcgtcttttatacataatggttactgtgtcttccactgattcctttttcttctttataatcctttaatagaagccagaatcttgggttgcccagttgggagcctctgatctactgttctgattaagtttcttttcgatattcatggccaacatttggcttctaaaagaaagacttttagtcttttcaatcacttgctggtagggtgagactgcattgttgcccattaccacatgacctagtttagaatcaatcttggcatccaacctcgcatttctaatcaaattcacaatccatctttcagcttcttctggagtcatattcagtttatctgctagcatattaatgctgatacactggtggatacgacagaaagtctcaaatatgaagagacgggcattctcaatgaagtcctcaagacatgctaccaggaagaagtcattcacaagcactgattcacattctcttagctttttctgagctccatcaaaatcaaagttaacatataggcattcaacaaattctgtaattgggtctttatatgtgtaagactcctgttgaataact

SEQ ID NO: 2786 - DNA, 604 bp, Rattus norvegicus
  Genbank Accession No. AI237636
ggccgcgagatttttttttttttttttttacatcaagagtaactttatttaaagggaactcacacgagacaatgtatttaatataaacttaagtatttagtaagttatgcacatactgtgctgtcctccagaagacaactgctcacaatttccacccagctgctaacttaccttacatcacctctaagaaaatcagcctagagagccctcttgaagatggctttctaatatgaaatgaaaagggcaaggcacgtaaaaggcagcccaacatcagtgaggccctgggcctattctggaaaagctaacaaagcgctgtctaaagtgaacactcgtaaatatcccgcaggtgatttacagggttaatggtctcagacaaatcaatcttctacagaagatgaggtgactaggccagtacaaaaaccattcctgaatatatgcatgagagaaattgtgtgtcaatgcacaagatggccatgtgcatacaaattacagagacatgaaggtcacttctgtgatttttattttagatgttctttaagagtgaacggcatttgttgaaatcgaggcacaacaggaaaaaataaacatttgagtacaaaccctc

SEQ ID NO: 2787 - DNA, 497 bp, Rattus norvegicus
  Genbank Accession No. AI237638
caggggcagcaatttattcaaatatccaggacccttccaaaccccaacctcactggaaagctttggacagtccattccccccttattcaaaagctcaggccactgtatcccatcctattggggggattttttacccactgattatgaatcagtagtcccatcctcctgtcccatccgacttctctgggtttgataccactgacaactaaccgtaagtgacaactttgcccatgggtttgaaaagggggtagcccttcgcagggtccgacccacccagagggtccatgacgatgtctactcctttgggggagatctttttgatctcatccacatagtcagtcgtgtggtagtcgatggggtgtgtgaccccgttctccttcagcacctaatgcttgctggctgaggccgttccaaacactgtcacgttctccacggtgcggcataactgcagggctgccatgccaacaccacctgcagccatgtgtaccaagacgctg

SEQ ID NO: 2788 - DNA, 589 bp, Rattus norvegicus
  Genbank Accession No. AI237646
aaaaatataaaatttattcatagtcactttcacacagggttactctcgagctagcatcctcaagagctcacagcagtaatagatcgctatcaaatatagctcatgctattggacttggagaacgctcgtttcccctttaaaaatgttaaggctcagtttccaaaaggtagttattaccatttagttttctgctgccaaggctggggagtttggggctaaacggcttacagtgaggttgcgggtagggcggcaggaggcaagctccacatagctcactctcgcatcgtgcagagagtgccgttctttttcttaaaggttccttcccttggaaaaagtcattttgttacaaagacaaacaaaacaagcaaaagtaacaatcataaggcaaaagaaatctttagcacacaaacaaggaaagctaacagtgctttttccattgcgtctggatgaaatgtgttgtgggaacaaacgccgctcctcgcggttcttaaatgaatctgaccaatcagcaccacttcccgcggttcttaaatgaatctgaccaatcagcaccacttcccgcggttcttaaatgaacctgaccaatcag

SEQ ID NO: 2789 - DNA, 689 bp, Rattus norvegicus
  Genbank Accession No. AI237654
tttttttgtaaagatataaaaagggaacactgattttaaaaaacaaaaacactcctcgctttcaaaatattggccatgatttctctttttctagtatgtgacattggctctgttgccccatggcacagaagttcatggtctgttcttttaattcccttcaaaacaaaacaccttggaaagaccatgcctgaaggtcacttagaccccgactcaaaaaaaataacaacttcttcatttccaacatctgggaaagtgggccaggtctgaatgttttgagcgttccgacattcacccagcaaacactcctatatcacggtgcgggcactggtctgcaccccttgaggctggagacttgcctactgattgccacccatctgtggagtcagaggcgggggtgtacccactccccactggagagactgagtctctgaaacattggagttcaagcagagaggcagaaagcgttgagtagtacagatgagtcgtccctgaaggctcactgcacgttgttgttgttgttgttaaggacgcagggatccacctcagtgtaagtgggcggaggcatgaactggaactcgggggcgtacataaagatagggctgtcttgagaatcatccacatcatctagcaggggggtggtggggctctccaatctgtgatcttcaggaatcacgtccatataacaaggt

SEQ ID NO: 2790 - DNA, 568 bp, Rattus norvegicus
  Genbank Accession No. AI237683
cccaccatcataagagatacacttgttctttgtgatcagaggaaaaaacattttggaatggacaatctgattctactattcattaaagaaaaattgaagtcaaaacaatccagtgcaacaattttcagtagtacaatccagtgcaacaattttcagtagtacaatccagtgcaacaattttcagcagtcctatctccagtgtaacccagcaaaatattcacatgttaagaaattctaaatcccaagctgcaaatttatcattttttcatttatgttcgagccaaggagcctaaagcaacagtgatcactgcctttcagaaccttggacctcatgactgacaacagaattaattgagtagctaagtcgctggatcagccactgtctggcagggacaacttccattccatcatgctagctttgggcttctcagttcttaaaactgaacagatcacttactggagtgattagggctttgatttttttgaatgcaatcatttttataaaaaattaaatgtcaacatatgccatgtggtatcactatctgagatgcaactgtaaagagataaa

SEQ ID NO: 2791 - DNA, 503 bp, Rattus norvegicus
  Genbank Accession No. AI237684
aagctacaaagcccctgcgtcatttattgtccccaaatcagcaagaaggtgcccagagcgattccaaggtccacctgctccatcacaccttgtaacagggtggtggtgttccttatgggaggcaggctgacgaagcagcccgaatcagcctggccttgggagtcataagtctgtgggctagtctcaacgaagtctcagtgctgtcctggcccatgcagcctcctagggcctgtgcacttcctccagtcaggttgacatcagagctcacagaaccatatgttctctcttgtccttgcagcctgtcatcaccatctcaacatcatctcaggttcctggtttcaaagacagtctcttcctcgctgtcctgagaggccatctcttcatgctcctctgtgttggtcaggagcccataccttcttcgctgtggcttctttagtctaaaggcccggatgaggaagtaaagcgaaaccaggccgcagagcccagtaattacgtagaacaag

SEQ ID NO: 2792 - DNA, 302 bp, Rattus norvegicus
  Genbank Accession No. AI237691
aatatgcaaatttaagcaactgccccacaatgacttctgctaaagcattcatcagtaggctctttgacaaagtttagctttcacaagtaaattcagaggactacatttaatgtttgatgatctttggcacatttgtcaattgaaaaatctcaaaaggcaataaaaaattttcaatgttttacacattcttttaaacctaacatcaaaacttaaggccgcaaaaaggctagctgaaattttagggtttgtgaaaaatttttaataaagttttacatacagtaccttacatatagaacagggtg

SEQ ID NO: 2793 - DNA, 511 bp, Rattus norvegicus
  Genbank Accession No. AI237813
caactattaaacttgtttagtaaagacaattttgttcatacaaaacaacagtttacaacagtctgagtgttgaacacaccatcaaagacatgggaggagctgcagacatctgggccctgccccaggcccagagatgcccaggagcccctcctccaccaacccctgagggagacacccctcctccagcaggaggggcatggtgtgcagtggagtctgagggaccttcgtagattgcatgatccacgggtggttcatgaattctgtgatggtcattctctgggtgggctctgttttcagcagattccgaataagcatcttcacttcttctgatacttctgaccattctgggttaggaaattcatactggcccattcgaatgcgagtcttccccacctgctcctcctcaatcctggggagcccccacccaggttgagtagttagagggtaaggtggctggtgctggaaatcgagaagaccacacgtggtcctgcccttgccaaagggaggttgg

SEQ ID NO: 2794 - DNA, 487 bp, Rattus norvegicus
  Genbank Accession No. AI237820
acaaagcatatacattttaatcacctatgactctcttaattcccaaagactattaagaaagactattaagattggttacaagttagttatatgaacagaaatgtattctacaatgtgcataaccaagtattttaaaaattcacgattgcaaacttttaatggcagagtaacagcatcctgagatatcttttttgtgtatacatctatatttctgaatgtgtgcatatgtgtgtgtggatgtggaagccagatgtcagtcttggctgtcattcctcaggagccatccaccttgctttttttgatacaggattgagcccttggatctggggctcgctagttaggctgagttggctaccttgtaaatccagagaacaacttgtctccaagttcaaactcaggtcctaaggctggtgtgactccattactgagttttgtcctaggctcctgaggtattctttatggtgaaatgatacactagtgtttttgt

SEQ ID NO: 2795 - DNA, 526 bp, Rattus norvegicus
  Genbank Accession No. AI237822
  misc_feature (1)..(526): n = a or c or g or t
aaacactgattgtaaacgcagggtgtggcagacccgtcatctctggactccagaggcttagacaaggagcctgagagcccaagtttagcctgatctatagagtgaaactctgtctcaaaacaaagaaaggggggaaaggggaagttgatctagcctaatttaagcagaacaggatagatgagaaatacgagggagttgttggaaaatcattgtcttgtcaacaattgaatgtcttagtttcttaaaaggaataaagaataagttgtatgtggaataaatcccatacagaaaggataaaaaaaaaccctatgactcagggctggcactatggttcagaggtgaaggcccttgccaccaagcctgacaaactgagttggatcctcgggattcacgaagagagaactgattcccacaggttgtcctctgacctccatcatgtaatgcacatacaagggcacgtgcacatacccgtncacatacacacacatagtatacacactcgcacactaaatgtatgtctttattt

SEQ ID NO: 2796 - DNA, 333 bp, Rattus norvegicus
  Genbank Accession No. AI638949
ttcagtattcacaggcctttaatgcacaacttcctggtcatactccatccctgccccaagctggcagggaaggatgaaaacccatgtaggccacaggatacactcaaggagggactggagtcaaactgaaccctgggcagggaggtcctggccccaggaaataagggagttgctggcttgggcaagctcagtgatggacacccggccccgctgtcggatgaaactggccacagcagccagttcctctggggttatgtaaatgaacttgccccggtcgtcaatcacacctgttagagtcccctccgtcagcaggtcctggatgcggtttatggc

SEQ ID NO: 2797 - DNA, 558 bp, Rattus norvegicus
  Genbank Accession No. AI638950
ttctggtttacatttgatcttttattgctgaacatcacattctgacaattataaaatcaaattaaagccttaaaaaggattacagctcaatcaaaagagttgttgaaaaaactatctgtgtggatgctcaataaataccaaggacacaactatgacagaaagccacatcactatgaagcatatggctacaattcgctgttagcagacaatgacctacacgtttttatcaaaaaagtcaagtttaactgtatgtctcttcaaattgagatgttaaaaataatatgtacattttttacactcatggatgattaaaataaaaaccttaagaatgtaaacaatgcagaatagggacactgagcataaagttttactgtggaacaaagagacaacccacaaagttacttcttcaaatcaccaacataattattttttccaatataattcatttttctaatggctctacagagaacaaaatgaatttttttccataaagatgataatacagcagggacataagacattctgagcttactatgtccacgtatatttacagtaaat

SEQ ID NO: 2798 - DNA, 584 bp, Rattus norvegicus
  Genbank Accession No. AI638960
ttgactcagaagcagacgtttatttacttaaaacatttcacaattatattgacaattatttatttaaaataatattctaaatacttacaaaaataaatcaagtattgcttctagttttcaagtgtgacagcatttgccatagaaaatagaagggaccttttgaataaactaaacgctacactgaaacttcctcaagtttaataactacacactatttcctctgatgacttgtgctttataaatgtccaaactatttctgtgcaacaaacaggatcacagtaagactgaatgtataacaagccatatacattcatttttacacaaaatgtcagtactctggcccaaaccaccatcatccccaaaatgccagatacaccattatacagaagtacatgtggttgtgaagtttttaacatccagtcatcaaagaccagatatttattattaaagtatactcagctaaaggttgctaggcaagacattttttacttacattaaatcattagtcaaatcattaaaaaaatagaataaacttcaaatatgtctcaatacattaagttaatcccaagataaacatcagtgtc

SEQ ID NO: 2799 - DNA, 504 bp, Rattus norvegicus
  Genbank Accession No. AI638973
ttaaatatagaaaaaggacttttaatactttccaataactactatagcacactggtatgtcactggcttatattgttagcctgtttccttctccaaacggttgttttaagttgctgacttgagttacagttttaaaaaccaattaaatgaattaggactaggataatgtttctaacaatttctgaaatagccctagtttgccccattttgttttctgtatttatacaaaatcgttcagcattgacagttaagaaatcaaaatagcaagcaactctgaaaagtacttaaaactgttggttaacatttaaatttttatgttaaataagcagagatcagaggtgagcttgagggagcttcagagcaagccaatgccaagtgcacaccacactcaagacacatgacagacatacatgcacacaagcaagccagtgccatgtgctgtgcacacccacactcaagacacagggacagacatatgtgtacacaagctaagaactgtaaaac

SEQ ID NO: 2800 - DNA, 328 bp, Rattus norvegicus
  Genbank Accession No. AI638977
ttctcggttagggtttctattgctgtgataaacaccttgagcaaaatcccttagggaggaaagggtctatttaagcttacaacttgtagttcttcattcagggaagtcagggtaggaactcaaggcaggaacccggaggctagcactggtgtagatccacagaggagtgctgcttactggctcacttctatgacttgctcagcctgctttcttgctggctcccagggctcccaggccagggttggtactgcccatgagagtgtttcccacattgatcatcgatgatgatggcggtgatgatgatgatggtggtggtggtggtggtggt

SEQ ID NO: 2801 - DNA, 582 bp, Rattus norvegicus
  Genbank Accession No. AI638987
ttaagagaaagcatgttgatgaacctgtaaaaatattgtgctgtaagccacagatgtctcctatgcctcaaacatctctaatgtgtgaggaacaggtctattttcccctctgtgctaattattcttacaaacagttatttgagaaagggcatgggcagaattatacagacagattgccataaactaggcagattgagttagaagcttataagtactttctgcttgttactatcatatcttttgaaacaaagtaagtgtcatggtctttaagagtagaaaaagaaaaatggtggctgcagagatggctccatgggtaagagcactggctgctcttccagaggacccaggttcaattcctagcacccatatgtgagctcacaactgtaactccaattccaggaaatctgaaaccctcacacatacacacatgagcaggcaggacacagcgttcataaaataaaaataaatgtaataaaaggaaataaaaataaaaagaaagatgtgataagtgtactgagaagtagaagtaaaaagtgcttcagagagtgaggacatgactatgtggaaagatgtgaagtttga

SEQ ID NO: 2802 - DNA, 426 bp, Rattus norvegicus
  Genbank Accession No. AI638989
ttctctcaagacttggtagttcaggggaagatccatccccagtggctcttcgcttctttctaatactggggccatcgttttgctcagtaccagaggtacaactgctgtcagtggctgcatcagctaagctggagactgcatgacctgaagatgatgcagttgatgaaagtgggtttccttctccagtgctctcctgggtgtggtgctctgatagtggggtagtcctctcctggctatgcaggtctctggctgaatgcatgaaaggcattatgtgatcagatggtaactgtgcgctatgtcgccgctgggtaggaccggtgccaaccctttcacctgttctgacagagggagacagaggtgccacttccggttcaagatacatggctgccttctgagatgcagtactaggtgaaggactctgctggg

SEQ ID NO: 2803 - DNA, 600 bp, Rattus norvegicus
  Genbank Accession No. AI638991
ttgttttttaaaaaagaaaatttggagataaattaaaaggagtttggcaacagcactacataccagcaagctagctctgggacgtggttacaaaggtgggacacagttagctgcagaaacgcgttcttataaaattaagccttttataccaaaacaccgacctagaactttatggacagaataagagagccaaggatctggtatgctacaaaatgtcattttggtccattacgttggacctctgtactccgagatcgacacttggataagctgagaaggaagtctgtgtccgcttgctcccactttaaggactaacctctttgggttgcccgggagctgattccagattctgggtagtactgcttcctcagcagctgactgggatggacgctgaccttcggcctgccaggactccagaaggcgtctatgctgatctgtttgttttttaaacaaccactcttcccatttcattaaaatgggtttccatggcattgataatgacagagcaccattaagacaggaaaaacaactcgtaaaaaaaagctttctggactaaaggatacttaattgattacttaatggtcggaaaagagaggattt

SEQ ID NO: 2804 - DNA, 419 bp, Rattus norvegicus
  Genbank Accession No. AI639002
ttggaaaaggggagtttaaaaacttttttttaaaaccccaaaggggaagaactttgcagagggggggcccctgattcccaaaaaggcccgggccataagggtggaaaaaaaaaaacttgaaaaaaggacccctgcaaaaaaaaagggttaagggtttttgttgaagggaaccttttggttttttaatttaaagccccccccaattttgcctttggttggggaaccgccttttttgttaaatttggccaaaatttccattttggccggaaaagtaaaaaaatggttttttgaacgttaaaatttttcccaaaaaaaaaatttggaagcccccattgggaaacaaggttccaaaagttcttgggccttgcccctaagtttataaacacaaaaaggggaaatgttaaaaggttcgccccttt

SEQ ID NO: 2805 - DNA, 402 bp, Rattus norvegicus
  Genbank Accession No. AI639008
ttatattgctgaccttcatttttatttaaatatattcatcttgagaggaaactacacaggaaatattttatataaatgtaaacatgcatgtctacatcagaattaagcaaaataaattttgagtcacaagattttaaatatcattaaaggacaccaggaattgaagacggaagtgacaggaaacaagaacacagatcctaacccttgagttggtcttccaagctactgggtaaggcctgagtttcaaaaagtttatgttccttgccaagtggaaatatccagtttggctgttcttaatacatatctacaaaacaaacaattctcttttaaaataattaataaatatgacacacacacatacacacgcacacacacatacacatacacacatacacacaaact

SEQ ID NO: 2806 - DNA, 498 bp, Rattus norvegicus
  Genbank Accession No. AI639012
ttcttttacaaaaaaaaatataataacttagtttgcattttacaacatttccaatgggtcagggcatccttgaatgggacctaaggggtcagagcagcatgtacctcccttcccagttcaagcaccaggcggggctcatgccaccagtctgcaatctctatcgggatttgatagagcaactgagccatggctcatctgaaggacagcagtacggtgtcaccctgcaagtcactccatatttatttcacaagggtttatgcccctttcttctgctttcctgtacatcttttgaaagtcactaaagcgtggggcacatccaagttgtgcctccccaaagtgcacatgtccagtgaagaggaattctccatgccctggtcgtactccacactgcaacagtgttgtgacatggcccagccagtggccactgtcctcaggagctggctggaaaaccctgctcttctgcctgtggagcctgctcacccgtaggtgaatgactga

SEQ ID NO: 2807 - DNA, 358 bp, Rattus norvegicus
  Genbank Accession No. AI639017
ttgtttattaccaaacccaacatttattgagagcacagaaaatcagttggcagaggcccaacttcaatgagcgaactgaggccaggctcagtggggtaggccagccctgaagtcactcactcccagtgagaaaccagctctgggagaggggctgtaaaccttccaggccttactggggtcctccgatgggggaatgtctgaggggcagtgccccggcctggattttaacagtcctcaggtgttgatggggggcagggagctgaggtcagggagcagctccgggtgggggtccagacgggccaggcggctctgctccagggcgatggcctcagctgaatgcttgcacttctcagagcca

SEQ ID NO: 2808 - DNA, 240 bp, Rattus norvegicus
  Genbank Accession No. AI639023
ttaaatgaaaaggaatcatttattgggctggggagtgggaaggcaagtggggaggggcatgacacaaagtctttgttggggggagggttgacatgcggcagcttctgcgtgggtggttcatgcaccctgggtgggcgtgggggaggcttgggggaggagcctgccgactccttactccctgcctgcgggtgggccaggaagacccgccattagcaccagagttgcagacctcccctcccc

SEQ ID NO: 2809 - DNA, 448 bp, Rattus norvegicus
  Genbank Accession No. AI639029
  misc_feature (1)..(448): n = a or c or g or t
ttacaaaaacaaactttattttgctatctcacaagtcagccaggagattgccatggtatatgtccctgcttctggtaacttttaccagacacaaacaggatcccttcacgtcctcacgggagctcaggctgcctctgccatgctgggggcttcccaaagcagccagagagatttctctgcaccacctcagcctctacagaagttctggctggggaaagactcgctgagcctccgtggctaaccaggctttctgacccaagatcaggcacggtggccctcggctgggcttgctgaccgaacatccagacagaggtttctcctttggcagggcctgcctcagagccaggtcccatttgctgcacagtccaagaagccatcatctcaggagccttccccagacttcactgaaggctgtacagccacctnctcgatctgccagcgacacatg

SEQ ID NO: 2810 - DNA, 370 bp, Rattus norvegicus
  Genbank Accession No. AI639036
ttaagaggcccaaactttattggacaaaaaaaaaaagggcattgggactttgcatacttcagcccaggggcccctggtttattggtccctgggagggggtaagcttggctgaaaggaggggggggaatgcggggatgcagggctgaactttgaacatgctacttttttttctaataaccattgtgatcatcaccaccatcattatcctcattatcatcaccattatcaccattataaccacttccaccataataatttttggaataattttcataataattggaataataatccccactgccctaaccatggggtttggaattttccttataattataatcttcctcctaataataatttttggaatctt

SEQ ID NO: 2811 - DNA, 392 bp, Rattus norvegicus
  Genbank Accession No. AI639042
ttgacaattactgtatgtataatatattacaacatacatattacagtttaattatatgtacacatacagagcatcaaaatacttttgctactttgacaactaaattgagattaaaaatacacaagttcaaacatttctacatacaacatttttaggttttcatttaccaaaaacaaaatagtacaagttttgctgccctgatatatacatcaaaataaatacttttaattgtggaaaatagaaatcaaatttcttaacattataacaacaaatagtttaccctgaatttgtagtatctttttgttaaaaaataaatttacttaatcttaaatttaagtcaatgtactttaatgctttttaaaaagagacaaaatactaaaggacaggtttac

SEQ ID NO: 2812 - DNA, 336 bp, Rattus norvegicus
  Genbank Accession No. AI639043
ttaagtatgagtgtggttcatgcattattagggatatacttatgttacaaagtatctgaggtggacgtctgaagttacaatttcagcggatgtttttatgttcattgctaactacagtcctgcaagggaaggctctctcccactgtcttccttgctctgcctccagcctccaagtcacaatgctgacaaagccaaatgcttggatgagtgggttccttcagcttttcactcctttattcagccaaccacttactttacgcaccagtggggtccctcaaaaaccacggcagacaggcagtccaaaggaggaagcagtggccatgacagatacttaca

SEQ ID NO: 2813 - DNA, 508 bp, Rattus norvegicus
  Genbank Accession No. AI639044
ttgtttttcaaagtgtttattgagtcgctcgtagccatcaccatgtgtggtcctgagaggcaagcgagagagagagacagagaggattcttggacccatttcagaggctgtgacactgaggccaaggtgagctccaggcaggttcaaggtcatggtgaatatggagtggtctgagacagcaggctccagttggcctttactgcctcgatgtcactcacgaggttctgggccaagcagatgccacatatctggaggagggcaatggccaccaagaccccggccaccacaatcaggttatcttggagccacttctcaaactggcccacgcagcctttggtgtagatggagccttgctgctccagctccagtttgagtcggatgtcatagccacactgggtattgaggacgtcttccgcagggtccctaacacagcaggagaagggcaccccacagcgctcgcggctagggttcaagtcagtgcagttgaagtagatgttgaggttccagt

SEQ ID NO: 2814 - DNA, 520 bp, Rattus norvegicus
  Genbank Accession No. AI639045
ttaacttttaaacctttatttcatgtaagcaagcttaacaaaaagttctttaagataccattttaaaaagttagaagaaacaaactaagttttattttccaattctaattttaatacagactgaacaaacaaacaagcagaagtgggaaaactaggtgtataagcagacacagatgtaccaaatgtaaaacaatgagttattaacacaactatttacatgcacatttacaacaacccttttatataggtttacttttagttagttggaaaagatttgacattagataaaaacattacttaaacagggctgaggtggtacattatagtaaaagtattagaaaagtgaccctcacggtataccaatattaagcagatggaaacttgaatgacaaatacctagtaaaattctctagtaaaaagtcaatgcaccatgcaatgaaataaaaatgagtaagccatatgaagaaagcagaataatactgtaggatggcgggtaatgaaattagtcaagtgaagcaaa

SEQ ID NO: 2815 - DNA, 278 bp, Rattus norvegicus
  Genbank Accession No. AI639058
ttgcaagctttctgagcttctgcattcagaccacacagaacatgtaaatatttatacacagaccggagaactagcacacgccttacagcctgtgtgtcccctgccttcctctctcttctctcttaagaagtgcggagtgtttttttttcttttttgcggatttgcctagaggtgccccaggcccccgctcctagagagggtgacctttctgtttctccttctccttgttctccagaggggcaatgtgagggtgatggagccgggtcccttctggtgcc

SEQ ID NO: 2816 - DNA, 416 bp, Rattus norvegicus
  Genbank Accession No. AI639093
ttgaagtttaaaattttttattttaaaaatagattcataaagtgcaagaaatgttttctttcccgtgctttatatccatcttcgacaagctgagcacaggctgttagcgaagacaaaactattttctttctgaggtctggaagcaagccacgttcctgcaagccgtgcaaggacgagccgggactcagggcgtgtagtcgcgcagctccccggatacgggctgcacgaggcttggagaagaacccaacgtgctcaggccaagtccagctttttctgagtcgtcgccagcttgtcctgcagcctccgcttcctccagtccaggtaacgcctccgcaaccgattcgcttgccagccaaggaccactccagaggcgaaagccactagcacggacacttgcagcgtcctctctcgtgccg

SEQ ID NO: 2817 - DNA, 508 bp, Rattus norvegicus
  Genbank Accession No. AI639102
  misc_feature (1)..(508): n = a or c or g or t
ttaatcattccttaaagcacacgctgagttattactaactaggagggatatttgaattatattcnnnnnaaggaaagctactaacctggctgagaaaacgtcaaagaccttacattgacttgaagctgtatggagccaaccacagcggatgccaaaggagtttgctttgctgtctgcaaattaagatcttttttctaaaacatctgagacttccaattaaatgtcagccaaaataaattcccagatgtacaaaatgtgtgatttgtccttaaaaaaaaaaactggatgtcagctcaccgtcgttttggtcaacagtcaataaagtgctttacagacactttggactacgtcgaaagacattatccttgctcacctgatatagatcagtttaaaataaaaaacactagagtggtaggttgttacaaatgagatacaattttgtggggattaataaaatctaaaatgagaaaattatgtaaagactgcttattaaaaaaagctactttta

SEQ ID NO: 2818 - DNA, 413 bp, Rattus norvegicus
  Genbank Accession No. AI639108
ttattaaaaaaaaaagttttattttggtttacgtttccagagggatgaatccatcaaggcagggaggcgggacagcagggggcaggcacagaagcaacaggaagttgaaaattcacatcttcaaacacaagaaggaagcagaaagggggggtgaggagaaagcagtgtttgatatttcctacacacacatgtcaacattcaccgttcttagaccactgagtcaggctctgacatccttctgagcctcacaagggaatggttttgccattcccatgaggccatgcactgaggtactaaacatggctgtggccatgtcaacaacatagccccactctggacctcactctagacactgtaaagaggacaggaggaccccatgcatgtaactatggggaaagctatcattcgcgctg

SEQ ID NO: 2819 - DNA, 398 bp, Rattus norvegicus
  Genbank Accession No. AI639117
ttggattggagctgctttaatctgccctcaccctcccagcaggaagctccttataagaaacccaagtcctcgtctttgagcttctcctttagccagggcagcacctggaagagattgatgtggaagtcccgggcataggagggcaccaactgttgccgcctcgggtctttgcagacatccactactccccagctgatcacaccaacttgaatgaagcggcttctcttgtgaacaatgagagggcccccggagtctcctttgcatgtgttggggtcagcatagggatctacccctccggtgcacaggaacctgggggtgaccacctcagaggcaactttgaccttctcatagccttgggcctttgtagcatctctctcacaactggctttcttttcccc

SEQ ID NO: 2820 - DNA, 351 bp, Rattus norvegicus
  Genbank Accession No. AI639123
ttaaagctttctggtttatttgaagaggcaaattagcataagtaaatcacgagttaagatgacaagctaaacctttgtttctactcattagatgaaaccacaggagtttgcagttaagcctctgtgggaaccggggatgtgagtaggaagcagagaccacagctccagtttctgtaaacagaatcagagccaatgatgatactgggtttgagccaaggcaacttttcatcccaaccggaagccacataattctactgtattctcgttaaaaagtcaagacccgtatctcacggcggcaacaacaagcaaggccacagcccctctctactgctttaaaatggacacagcttg

SEQ ID NO: 2821 - DNA, 559 bp, Rattus norvegicus
  Genbank Accession No. AI639136
ttaagaccctagaaaaggaaaattcaagttttgggggggtggttattactgagacaaaagattcacatttggagagtggcagattccttctagcctgagtgtattgctgaggttaagtcctggattctgggccttggggttcaaacctcagctctgcacacatttgtgtgtatgaatgtataggcactcctgacattctctgtgcctcagggccctctatctgtgaagaaagaatgtcaagttcctccctctcagagacaccgaggagaactgaatgaggccccgagagagtctagcacacaagatgtgctccactctaccaagcaggtactgaagatgagaattcagggctcagaaagatctcgtgtgctcaaatcctttgtgctcaaacatctcactgtggaggtaacagtattcatgggaaggagaccactatggtactgacatgattgccagtcagtcattgaacctttatcaggacaccagcactagggaaggacttctccagggactcctagatcctggattgaaatgtcggttatcccagccccggatgggt

SEQ ID NO: 2822 - DNA, 394 bp, Rattus norvegicus
  Genbank Accession No. AI639137
ttcttaaatggaatttttaattttaaaggaaaggtggcccccttaagaccggatttggttccaaaatttcctttgggggtgggctttttaaagggaaaggccttaaaaaaaccggaaagaaccgaaaagctgggtcatttaattaaaagggccttaccttttaaaaaagcctaaaacaaaatttctatggtgaaatctacttttctatttaggaagcaattctttttaaaaaaattaatatcctttcggtttttaataacggaccttggtttttggttgaactttaaaccttggattggcctttggaataatttgggacaagggattgaagggagtttaaggggggcccaaatgcctttaggacccaaagaaggctttgagaacctggaccctt

SEQ ID NO: 2823 - DNA, 548 bp, Rattus norvegicus
  Genbank Accession No. AI639157
ttagtggtactgactgtgtattaagtccttcctccccaggcaggtccatctgtcacctgagaagatgtgggctgacactagatccagtttcttggctgtcagtgtctctccagggccttgaccagaaggtcattcaggcggcctaccatggcccggggatcatcaacgagtcctgctgctatcatggcgttctcatagatctgatccactagcagctgggctagctccggctcacgctccctcagctggttgagtttctttattagtgtgtgcctggggttgatctccagtgtgggctgtagcaactgagcacgctcctcctgggtcttggccagctgctgcatgcgcaggaaatgtcgagcagcccccatctctagcacggtcaccatggcagggtgggtgtccaggcggaaagtcaccttcacattggtgacacgggaccccagtgcatttctcatccatgccattagctcttctgtttctttctcagagaggcgctcaccagctggagatgtgtcctcaaacttttcctccttgtagtgatcaac

SEQ ID NO: 2824 - DNA, 447 bp, Rattus norvegicus
  Genbank Accession No. AI639158
ttagtggtgacacttaaagtttaattaccagcagcagaaggccttggaacaaacattgatctcctaagagttaagaggcagattccatgcatttctgtttcttggctgctggctcctcagtcttgggtgagtctaaagcactcgcacaggacttgagactggggtctactcgatggctgtccgagacaacagtgaagcctgacagaaggtaccctccacctccactcatcaacaatttgggatgactccgatctggcagaacctggtaatttctgagccaggtttcagacagtctcaggttaatgactcctcctctctcccgcagttttgtgtagcattccaacaaaggctctttatactgacaatagaccacaaacggccttgatggggctacaaagtccagcaaagacagcagcaggggtgtgggggtggaaacgactggccaca

SEQ ID NO: 2825 - DNA, 555 bp, Rattus norvegicus
  Genbank Accession No. AI639161
ttgaaattaccagtaaaaatatattttaataagcatgacacatgtttaatagcaacaatatgattttatagaaaacctttaaaacattggcatgtatgaaccacttggtttgatcaaatgtaaatttaatattttaggattaaagaagttgatttcaaaaatactttttagcagccattattttccttccagttaaaacagaataaagtgttaaaagtaaaatgtccactaaaagccccaaattagagaatttaagatactatactattctagcaataacaacctttgatgtgatatagtctgaataagactgtggaagccactactaaatgatcagacacacacatgggcacaaggttcactgaaatacttaggtagcaaaatatatgaaaaatagaaaagtaaaaagataaaattaaaaaaatattgcacagccacattacctagaaagtaaagttgatgtttaaaaagctctacacatggatgatataaattatcttccatataaaaaggtataaatatgtcataaacttagcatctacacaactataatac

SEQ ID NO: 2826 - DNA, 393 bp, Rattus norvegicus
  Genbank Accession No. AI639167
ttgatgctgggaattgaacacagggttgtaacgctctatgacagctacagcaagcacgtctcatcctcagctgttcaacttaactgcaaggccagtatgttcctgtcgtctcaaagctgcacctggggaagcatgagcgatggcctcagcctgcagcaagtggtggtcatgcctgtgcacaacaagctggagcggagattggtggggcttgcacacccctttcatccgcattgctttaaatactggacacagcctttgcacagtggcccctgtggccacctatgaacactgcaagtgtagtaaccggatgtgtgtgggcaaacaccttctaaaccacaccagtgtacccgatagccagagcctaggatcacagtatagagaggtgactcaggg

SEQ ID NO: 2827 - DNA, 372 bp, Rattus norvegicus
  Genbank Accession No. AI639170
ttgtcagctgatcaaaaatcccacgtgcaacatgggggaagggcatatggagacagtattaattgtcacacaggtagaaaaggagcaagtcattaagtgaaggtaagctctgacctgtccccagtataattttgtggagtaaatataaaagatagaaatactgcatagaaactcacttggtcatcttcctcttcaatgtcatctcgaatacccctggaaaaacaagcggagaaacaaacttccctgcaaatgttccacatacccagctccatgcttatagcagcttagtgttgaatcccatacggtgtaggaactctcaacacttacggtaacaaagcaataagtacactgtacatgatccacccgcaatat

SEQ ID NO: 2828 - DNA, 368 bp, Rattus norvegicus
  Genbank Accession No. AI639186
  misc_feature (1)..(368): n = a or c or g or t
ttctgatcaaggcaacaattttatttttctccaaggctgaatttataccataacaggggtaacagagggagggcttcaagggcatcactcccaacatctcccccttcctcatagtcaaatgaaaaggtagccaaatggctgtgcttgtcctggaaatgagcccctcaggaactgcgtctgtcttaggttggagtgatatttatcacatggccaagagaatcttgtggccagggtctgtcatgggataaggcagcagctaatggtggccctcctgtcttaggccctttattcatgaatatatcactctcttacttgtcattgactgtccagctcagcacacaggggtgacaattcattgattntttttt

SEQ ID NO: 2829 - DNA, 430 bp, Rattus norvegicus
  Genbank Accession No. AI639187
ttaactcagtaccaggggccatttattagacaggtgttagttgccctggaacatggctccatcacaggctcagaagacaagctttacaagagttccttccctggcagagactgttgtgaaaccaataccagagtttggaagagctgaggggttattttagagctgtcagcgtccatcgcggggtggtatgggttcactggcttttggacagcatcttgtcctcacccatttaccatgcccaaccggttggtctgcttcaacccttgcccaagaacagaggacttcagagagctttcattagtgttttcaatagtgtgggtgtaagcttaaggtggaaaggctggccccagaatacacccaggcttggggcagagtcctagtttatgttacaaagctgttggctgtgcttgctgtccctgtcacacatcct

SEQ ID NO: 2830 - DNA, 357 bp, Rattus norvegicus
  Genbank Accession No. AI639197
ttaattttaataatttatttttttaataaaaacgaaaatgatataaaacccaccccccctacttcaaaggaatggaagggcgggaagaaggacccaaaaaaaaacactttcgaaaaaaacacctcgcaggagatgggcctcaaaaagtcttacggacccccccccaaaaaaaaagtcaccccaagggggggggggttcttttgaacaaaaaaaacatgtggactcaggtttttaccaaaaaaaaccccccatctattgaaattaccaaggaagagcttaatttggtcggtagaacccacccccacagaccttggcccctggggggttctgcacaaaaaaaaaacccttgaggaaggg

SEQ ID NO: 2831 - DNA, 432 bp, Rattus norvegicus
  Genbank Accession No. AI639209
ttgtacttagaagaaaaaaatcaaatagtaaccatacacttgaggaataaaatgttacacaaaaagactttcctcagtcttatttgtgagaggaaaatggaaacaattgtcctgtcaaatgatgacacattaaggtaaaacattgtagcatttttgtaaagaagaattcaatctggtaaaaggtgagaggcttgacaaccatacatttgtgccttggtttttgagaaggatttgctatagtctaggctggacagacaactcaatcctggatcactggagttatgaagtttgtgcctctgtgtttttctggtgctgagactcacatatgctctacacaaagctttacttcgataacattagttttaaaggctagaacatgaacaacataaatgctatgtttcccaacatttaaggaatatataaaaattactt

SEQ ID NO: 2832 - DNA, 568 bp, Rattus norvegicus
  Genbank Accession No. AI639231
ttcggagaggtgacctttattcgccaataacatgcaagtgaaggctcgagaaagcacaggagaatcacattccgacggacaggcacttacactcccctgctggcgcacacagtgaccgctgagacctcttaacctggccctttctgtctcatggtttcaaagtgctacctctccaaactgatgcggcaagggtctctcgtacctcactgacctgggcaggaaccactctgaggctattacttggactttttgcaatccttagtgactttgattcctttggatcgccaggactggcagctgcttccactagaggactcaggctcttctaacagggaaggttgtagccagttggtccaggaagagcctggattctcttacaggctggtggcccttaggaaaggctcgtgggggcagaaggtgctgctgcaacagggggtgtcacccaagttttcagatacagaatcctcggttgaagcaagcagacactcattacactcccatttcttgctgttgggtctaagagaggagcagtcccagtgggttccgtgggatccacatgtcgcacaca

SEQ ID NO: 2833 - DNA, 525 bp, Rattus norvegicus
  Genbank Accession No. AI639238
  misc_feature (1)..(525): n = a or c or g or t
ttnnnnnnnccaaacatgggcttttattaatgtttgtttatagttttaaagctgaaaactatagagacatatatattataagtactttactgaaactataaacgcgattttaaagcttgtttctttttaacaaggcgttttgactaaacaaggccacctgaatgacaacgtctgaaatggtaagcccaccgttttataggaataatatgttaatttcaaagcctaattattaatataaaagggagaaatggtttggtaagagtgctttcggacagcccttggatgaggcctaaagagtgaaaacaggataatcaaataagaatgcaggctcgacttgtgagtcgcctgctaaataatgtccctttcactttgcatattacacagcgaaaataaaaggggtcttaagagcacttcagtcccacaatgtangatttacgcttgtacgcaaagttgtaaatggcccacagtgacataatgctgacatacattcgaccaaagtacatctattctcttacaagcaagaaa

SEQ ID NO: 2834 - DNA, 334 bp, Rattus norvegicus
  Genbank Accession No. AI639248
ttccacggggaggaggagccattttactggcccacaattttatttgctgggcattaattttaatgtcttcacaaaggcctttgacacaaatttacaaaaaataatttattaataaactatagctgatcattttgcgttttccaatgtttaaggcccctccttttaagtatttttgggttccactgggccttttttgtcgacctcccatgattaatcctgaacatccgttttttttgccaaagatgtatcaccctgtaactaatacccactttttttggacgggtcttgtttaaatatatttctaagccacaggggccaccttaaccagataatt

SEQ ID NO: 2835 - DNA, 487 bp, Rattus norvegicus
  Genbank Accession No. AI639255
ttgattgattgattgatttatttatttatttatttatttatttatttatttatttatttatgagacttggtctcactgtgtccatctggctgtcctggagctcgctctgtcgaccaggctggcctccgagagctaggactaaaggtgggtgccagcttcccacttgcttgccgtctgtattccatctttagtattcgttaaggtcgtgagttgtatgaaaaaatatataatttaattctcaaaccatagctttgtttttctttttcctaaaatacactgtaaaaagaatcaaaagcatatattttgtagcacacagaggacgaatgttctggagcgaaggcagagtattacccttgtataaaaatcacctataaaaaaaaataaaaaaaaataaatcaccttatcccagagaagagaaaggagacagtgagagcaagcgtataggaaaccagcaaaacgttctgggagaactgcttccgctctgggg

SEQ ID NO: 2836 - DNA, 481 bp, Rattus norvegicus
  Genbank Accession No. AI639256
ttccaaggcaagtaaagttgattttaatattgttctcttacaggcagattaaacaaacaggcaaagtacatacatagtacatggcagtcttaagtgacctcaaggtgtattattaactcagactgtgctagcaaaaattccagtctcttaggatgtaagatatttttatcacaatgcattgccacagttcctcctttttgttttattaaaaaaaccatgtgggtggagggggtcactggtgaagaactaagaactgatcaagcatggtactgtagggatagcctgaatgcaccacttcattctaggtgatccttctgaaaagttggcaaaggcataacaggacttgagaaggaaaacagaatgcattacctgtagaagatcacacttaagatttattccctgtactaacttaaagaatgaattcatcttctccaaccttcccctcccaagaagattcactggaatgacttacaggctgcag

SEQ ID NO: 2837 - DNA, 481 bp, Rattus norvegicus
  Genbank Accession No. AI639257
ttcacttagatactgatttaattcatggatcaaggccatattttcaaagtattttaaggatgccagtacactgcaaaagctggagaagagttgagaaacagtatatgcttactaaacaagaactatctttatttatctagtgaatacctagagtaataaatttttacttcatgatagcaatcaggctcgcaaacacccagaaatagaatttaagggttttaaatgtagttataaaggtcataaaaagtctgattagactgaggtacatttactcaaaatgttgagattcattaagtggtagaaacaaaataatccctcaaaccaacccatattctcagtgtacatataattggaaaggagggggtgcattaattggtgagattcaccaagctgcatatcaatattttgttacatcaagtagtttgaagacaagggaaatgttctaatatataattttagattatgtattgtttggctaaaa

SEQ ID NO: 2838 - DNA, 343 bp, Rattus norvegicus
  Genbank Accession No. AI639264
ttaatggggaaataatggacctttaattgattactaaataaaacctattgcctgtaagttttaaaatttttttattttttaatgactaacttttggcaaatggaccctcccctggattttgctcgttaaatccagttggtggttttgaacaattcgggatgccagtaatttttgaagccccatggaactttttgccagcctgcccaaatcttgtttgttggaccttgggtttgaggacctgaaaaatggggcggactacagtttgatgctgtaggaaatccgatttcagtttcagtgtcttgggaaagtgcaaaagcaaggcaaaaggtcttatccaggtaag

SEQ ID NO: 2839 - DNA, 492 bp, Rattus norvegicus
  Genbank Accession No. AI639291
ttgaacaggaccagtgcttgaattttaggtgttcatggttccaagtcaagcctccggggtcttgtcactggtcagttgttccctgtctgtcatttcatcctgaggaggtcttgctctatcaaagaatccacactagtagagagaaaaacaagcttccataaagctaaagttaagatggccagaaccagcaagccaagaaggatcgctagtattatgacccacagtggaattgagaaggagacatttggagtggcccaaataaccgatgtcttaatcgctgtgctcccggctggcagttttgctggctgctctttataaggtatcttcttgacttcaaaggacaccagggatgcaagagcataagggtcgttctttctctggaggaatgtgtgcgcccacaatctcgatctgaccttcagaactgcactttctcctcctcccaggcgacccactgcacacgagatttgcaagcagtcaatgttggtacagttc

SEQ ID NO: 2840 - DNA, 224 bp, Rattus norvegicus
  Genbank Accession No. AI639304
ttgtttttttgaacggaacccaaaaaattttattttccattcttgctcaatggaaaaacccataaaggagttcaagttcataggactaaaggactctattaaacccccctggaaaagggaaaacctgttttaggccctatgcacaccaacgccatactaaacccccatcacatcttggacgagagggactaacaacttataagagggccacacctttggctgaa

SEQ ID NO: 2841 - DNA, 557 bp, Rattus norvegicus
  Genbank Accession No. AI639312
ttaggtctaactcggtcccgaaacaagcttaagacgaacacgtctatctggccggaactccaggctttcttttaaatcacgcctctgtgaaaagtcccagttcaggatgacccgagtttaatgttggacctaaagaacagacagagcctcagctcactgccccgcccaggggaagcagccgctgtcaggatgcttaactgactagtatgaaaaaaacgtgtctctcaggcctcagttcacagactccactaaaggtcccagatattcacttatccatgaagacacccaagaagcccagacaggcccagaagttagaagttaggaagaaggaattgttaaactgggagtgttgcagagcctaattctctcttcatggcttctgctgctctttaactggtctcctggttcccaacaggagctacaccatggaaggaaaaaagacgaaggtactgagaggggttgggggatccagaagtcagaacgagacagggctcttttttctctctttctgccagcctttccagcttagaacactttacagagtatagaacttacat

SEQ ID NO: 2842 - DNA, 513 bp, Rattus norvegicus
  Genbank Accession No. AI639324
ttaaagtttttactaaatgtttattttatgttcaagataaagcctatacacaattgaatgtggaaataaataactagaaatgctctggaaactctatttgcccttcaaattcatttttttaaggtcatgaatttttatttaaatcaatatgccaaatataaacactaagaaaagaagaactacatcttagtacagaaacgtaatcttctctgactaagggtttagctggcattatgataacgaaaacacacaagatacaacactttagcaggctgactcagacggctctgctggagaagaaaaaggcacagactgaaggacaatggtgaagagcagaggacatgggctcagtcacctgacacagagaactcagtcaggacaagtgaacacaatcagtgctaaatgacttctttaaattaagatgtataaacataggctataaaggcattacttttggaagcatctttgcatatttcttctatatataaatctttgtatacaatttccatgttc

SEQ ID NO: 2843 - DNA, 500 bp, Rattus norvegicus
  Genbank Accession No. AI639342
  misc_feature (1)..(500): n = a or c or g or t
ttaaaaaagacttttatacatacattcacataaacacattaatacagagatacattaggaatgaactgtctgctaggttttgcaatctaattttaaactccatgcctttacaagagcttgcttgtcatttctgatgagggacgtggggatgagactgtaatgggtgtgactagtattcaacttattcatgttggcgcctatacaatacagttttaatattaagtagaattctgcaaaagaattggggagccattttaatatttacagggaacgaatcagcagaacaagattctatcaaataggctgtgtacagtagctgcagcttacaaaacacaccagtaatctgtgcctggtgtataaagagaaccaaggacacagatggctttacaaccaagtgagtacacagcatcaacaaattagaggacaaaagaattcacattttctacattaaaaaaattacagatctcacaaatgtctttgaagacacagaanattccaag

SEQ ID NO: 2844 - DNA, 301 bp, Rattus norvegicus
  Genbank Accession No. AI639347
ttgtctttttgttctttcttgctttgtgatacgaagacaagaagttttgccccacccccgacactgaacaaggaggcgggctgaaaaaaaggaggggggggggctctaagaagcttataaaaacgtaaaaagagcccgcccgccatctaggagggtccccccgagaattgttcacaccacccacggtgctgggggggggcttcaaaaggaaaaaaaataccgagagaagaaccgagacggagctgaaggattttaaaaaagacgtactgccccggggggttttgttcccggggcccaatgc

SEQ ID NO: 2845 - DNA, 491 bp, Rattus norvegicus
  Genbank Accession No. AI639352
ttagcaacatttgacaggcggtataattcaggtgccaatgagacccatgctttacacaagagggagctctcgttcattgtttctccaagggaaatgttttgggaacgtttcaaccaataaggcgcggaggacttagaacaaaaccctaaaccccggggaaaaaaatgtcaagggggctcttttttaagtttttcccaaccccttgcccaaataaactgtttttgcgcttttttaaaaagaaacttttctaagcacaaggggatttggttcttttttacaatttcccaaaaattggcaatttttcgccaagaaaaacaaattccctttgtctttgaaagacaattttagaggacgggtggaaccccaaaacaagtttccaatttttataaaaaagtggggacccaatttcttttttttcccaaaacttttttaatttttttgaaccccccatttttttggttaagggggggaaaaagccccccccaaaataa

SEQ ID NO: 2846 - DNA, 361 bp, Rattus norvegicus
  Genbank Accession No. AI639354
  misc_feature (1)..(361): n = a or c or g or t
ttcttcccnccccccggcagaaaatcaagaaactttattgaatcatctattctttgtagtagagaccttgcgaaacccaagaatagaaagaacagggcccggaggaagaggcttccaaacaagagagatgggggagggctcacccctaggggggacaagcagaactggagttcacaaccctacaactcctcccgacccaaaagggcccaccctgttttctcccttaaagacaagggaagcgccccccccgcgcgcgttaattttttttcccaaacaccagcgtaaaaaaaaatttcacgaaaccctcccctgtggacaaccttcccctctttagccctcgaaaacacaaccctctcgggcg

SEQ ID NO: 2847 - DNA, 452 bp, Rattus norvegicus
  Genbank Accession No. AI639356
ttaacttgggaagagccggccacccagcttcccagcccaattttttgtctatgaccaggatagcgctacccactgaacttcccagccccgttctttgcttttaaggcaagaagcaccagccactgagcctcccagcccaattttgtgtctatgacctggagagtgctccccattgaactttccagcccctttctttgtttataacttaagaagaaccgcccacccagttgaccagtccaatttttgtctatgacatggactgcgctacccagtgaacttcccagccccctctttttttttaacgggggaagcaccagccactcaggttcccagcccaattttgtgtctatgacgtggacagcgctacccactgaacttcccagcccctatctttgtttttagcttgggaagtgccgcccaccaagcagcccagccgaattttgtgtctatga

SEQ ID NO: 2848 - DNA, 468 bp, Rattus norvegicus
  Genbank Accession No. AI639387
  misc_feature (1)..(468): n = a or c or g or t
ttgataaaaccatgtttattactctgctctgtgttccacacaggtttacaagacaaccgagtgtgaatgacaaacattttgttcttcgaaactctgcagtgggactgtgaacaccagccccaccgcaccctgacaatcacacagtgagggtgaaatatcagcaggggtgacagagcaggtctcggccagcagtccccatctgcagcaaaatggtcacgggctaaagcatcctagacaaacctatcagcacccatggtgcacttagaattgaacatagccacatctggtgaatcttctcacttcttccttctctttgntgaatacagtttttcttcaagagggactgggactatgccgtcacactcttttacttcctgggtcaagaggtgtttcacaatatttggtctaaccacatcagtgtctcgtgccaagtgttccagcatgctttccacaagcattgttggggca

SEQ ID NO: 2849 - DNA, 374 bp, Rattus norvegicus
  Genbank Accession No. AI639409
  misc_feature (1)..(374): n = a or c or g or t
ttgtccctgggtattaagagtggtttatttaagtcctttcatgctttttgttcatctgataaaccgcnnnaaaaaattcaactccattttgcttgatgacctaacagaactccaagagaagaaagtatcctgtgtctccagcccaaagccctcagaagggcagcgtctgagcagtttgacgtttggatgcttcttgtcccgagcaaagagtccgccttgtgcagtaaggtccgaggaagcgagcaagatggcctcaagcgaacctgagttcgccgaagcaagatgcgtagaaggtacttagagcgacagcagtctacatcctgtgctagtttccttccaaggccactcctcgctgcaggacttgagctagtgcc

SEQ ID NO: 2850 - DNA, 477 bp, Rattus norvegicus
  Genbank Accession No. AI639417
ttattttgatcttcagtttacctttatttaatctcttttaagttatttatttatttattttgtgtgcgtgatgacatacatgttaatgacagtgaacaatatggacaaattggttctttgcttccatcatgttgcattacagggatggaactcaaattgtcagtgtgctgacaagctcctttacgcaccaggcaatcctgctagctccaagctttgtttactctttaaaaaatctagataattctctaattctccaggaaataagcagcttataaaatgaccatgcaatagtttacagatcaaaagaagtaaggctatcaattttcctcaaatataggaaaaaattaatgggatgtttctattcatttttgatgtgagaagaatacatataaagatataaacagtgtaaccaaatctaattaatcatgtctagcactggaaaagtagtaaagtctttgaaatatctaatagtacttt

SEQ ID NO: 2851 - DNA, 483 bp, Rattus norvegicus
  Genbank Accession No. AI639422
ttctgccccagatttctttattaaggccttgcatttgacccaaatacattaacaggagatggctaagatatagcccctaacacagtacctcccttcctcctagccagggtcaggacagtcggaaaggtttaagatttgagtaatgggagactgtaccgatggaagggacagagaagagtttgcaaatcgttaagtatggggagtggtagaagagaaacagtagatacagataaggtacgggataagaaacaagtcagatgagagaactgggctggtatcggagataaagcagctccttttctccagcgagggagaccaggatctcgagcaccctgcatgtagaccacagttggccctatagtagagaatgacctagtgtcccaaggagctcggggcagtgcatgggcggtaggaaggtacatgtaaagagcaaggggggctggtaaggagttgccatagcaactagtcatcatcgtcgtcgtc

SEQ ID NO: 2852 - DNA, 454 bp, Rattus norvegicus
  Genbank Accession No. AI639425
ttgagttctttagactttaccaaatgtattttccatttgttagtttttaaagtagcttcaactgatgttgcacacaccatagctctgtacacttatgcagttagcctgtctcagaaagcgaataaaccgcaggtaacatctcccccagaactcctcgggaaacataattaggctgtacaaacacatcacaaattcaacagcacacggtgcacccgaaaccttttctatgaacctcaaaagttctttggacgtaatcactgaacattggtgtcgagcaaagatcagatttcgagcctccaattttgtgctgtgttgtgtcagcgacaagagcgccatccaagtcctttaagcaacgaagacatgcgcagaaccagttcagaaatcgtcaaatttgacgacaaaacagaaggatggctgcctactcccttcctcagcacgaaccctgttacgttct

SEQ ID NO: 2853 - DNA, 418 bp, Rattus norvegicus
  Genbank Accession No. AI639447
ttacattaaaattgagaaattgatttttcatgaaatagtaggcagaatttttcatgaaacagcagaattaaagtacagaaatatacatcttaagacaattgaaatgatacgaggatctgaatgacaattacacattgtgaccaaacgaaaaatgaatagtttaaacaatgaattcactttaaagtttttgctcaataattcacctgaaatgaaacatacgaggaaaacagatttgggcacctcgtcaaatgaaataatgccgcttcatccttgtcagaggaactgaccctagtaaaaccgtggttcggatcctatcacaaagccctgtgtctactccattcacaactgtgtaaactatcagtcctttcaaaattttaaggacgccaattcaaaaaatactttttttaggcaccaagca

SEQ ID NO: 2854 - DNA, 467 bp, Rattus norvegicus
  Genbank Accession No. AI639455
ttgcattgcctgaactcttaatgcgctgtaatcaacctctttttgttcaaattctttccactcattttcatccttcgttatggccttgccgccggggcccgcgctcccgccgtctcccgacctcgaggtcccgccgtctcccgacctggcaccggagcccaagctcccgccgtctcccgacctggcaccagagcccgagctcccgccgtctcccgacctggcaccggagcccaagctcccgccgtcgcccggcctggagcccgccgccgcgctgctcccgcccgcgccgctcgccgcgttggccgcccgactgctccgctccttcttcttcttcttgtccctcttggcgaagaagttgtccaggctccgctcctcggtctcggccatggccgctgcccggatgggtggggccggcggagggcgcggcgctcgcggttcggagctctgggtcaaggccggctcgtgcc

SEQ ID NO: 2855 - DNA, 603 bp, Rattus norvegicus
  Genbank Accession No. AI639456
ttatatcccaaccacagtttcctctcctgtctctctagcccctccctcacctcccatctgccccctcaatccactcctcttctacatctcttcagaatttggcaggcttccctcggatatcaaccaaccatggcatatcaagttgcagtgagactagaggccctcgtattgaagctggaagagaaaacccagtaggtgggaaagggttctcaaatcaggcaaaagagtcagagacagcccctgctcccactgttgggagtcccacaagaagagcaagttacacagctgtaacatgtatacagggtccaaggtcagtcccatgcaggctccccgactgtcagctcagtctctaagctttaagggtctagctttgaaacactgttccaggtggtttgtgcgctttaacaggtcagaatcttagatatcacgtggaaaatcaaactgtggtaacagaccaggcaagtgatcttcttggtggcagttagatgcataaaaggatgggttagtagctgagccatctcttagcctatcttccagatttataagcactttgggctgcatattctagtcagtcagacccaaagttaacacaaggcagtgtca

SEQ ID NO: 2856 - DNA, 409 bp, Rattus norvegicus
  Genbank Accession No. AI639461
ttaaatgggagctttgtgcaccccccacacacacataggactccacatactatgagtggatggtagcctatgcaaatgagaaccggaacataatcaaatctgacttgtaaatcagcaaaggaaacgtgtttctccagaagtcaagatgtcaaagatacattttaccggttctgtatacactccgccttaagggtccatccgctttgaatgttctagacgcacacctctgaggaaatctagtgtgttttgaggcaggagacatcaggcagatccaaattctcgtcttgggaaggtcttcagaccctgcgcatggagacgcagcttggcattgtctttagcaggagcgatcttttcagtgtgagcctgcatttcctttggagcttgactccaattcacagaacacgtcccg

SEQ ID NO: 2857 - DNA, 518 bp, Rattus norvegicus
  Genbank Accession No. AI639462
ttactttcatttatgcttttattagataaaattaacatcatataataaaataaaccatttcccaatttacacacataaataagcaagttaatataaaactcaagtaaacattaaaagggtcagattttacaattaagtattaaaagaagaaataaggatattgttcttttctacattctaaacaattcgatggattaatccaaaaaatcaaaacccttataaaaatctgattctaattcatgcattacacatattatacatctttaagtttactggattctaacatttcagatttacaaaagaatgggatcatttgttgagatttacttgggatcattggaattctagctgggtttccagtcagacagcagaggtaaaggacactcaggaaagaggctctgaaggcattctctaacagtcactagcaatgttgggaatatagcactccgttggtatttgtgtggaactggctttagggggcacagggaaaaaaggggtgaatatgcttagggtccttt

SEQ ID NO: 2858 - DNA, 343 bp, Rattus norvegicus
  Genbank Accession No. AI639478
ttgtttttttctgggacagcatgtttattcatagggcacagctccctcctgcacctgagtgaggacaccactttttggaatacagtgtcccaatggctacagctcctccttgggacccaagggggaattgggttgtgcttctggggcaaagactgcaggctccttggatttttcctcaggcagggcacctcctttgtccaggaacttggagaatgtctctaggcccctggggcttttggattctataatctttcggtcaggtcctgcagggaagaacttgagagtgggatagccatgcacagagaaggcctccagctcgttagctggagcatccatctcagca

SEQ ID NO: 2859 - DNA, 446 bp, Rattus norvegicus
  Genbank Accession No. AI639479
ttatttctgaagagaaaattttatatttcagagtatcatcaaaattattttccttttctttgcatccattagctggagcttcagctgaatgtgagttgctgagccgtccagattgatctgaaacaatatgtccatccagcagcatctaggctacatcatcagcatcactgtccacacacagggatggcaggtagaaatcataactagctccccatgttaatattcctctgaaaatggatattctgggtgaccagcaagaaactctgctgaaagatatcgaaaatttttgttcaggccatctagtgtttttatgtcctcaggagacaactgaaagtcaaaaacctgcaaattctctctcatctcattttctttgaaactgggcgaggggcaccaccccacgctgaaccaggtattgaagggcaatcaaggcaaggcttcgcttgttc

SEQ ID NO: 2860 - DNA, 401 bp, Rattus norvegicus
  Genbank Accession No. AI639488
ttagactaagacaatgctccggctttaatgtatgaaaataatacccatgttgtctaatttgggggtcatacattagaagtgtaaaggtctgcgtctgcccgccgtctagttgaagtacgtgagcacaatcatttggatcggctgtctgcacacggggcagggcttattcctcttctttagcttctttgcacacgtgaaacatgacatcaggtgtccggttttgccgtgaacaatgcaaccatttttaggccgcccctggcaaatcacacatggctcgatggcgttcagagagaagctggattccatactttcctctttgtcttgtgtgtcctccttcaactctttgccactttcttggctgctgtaaacaatgctactggaagtcgacggctgggaatagt

SEQ ID NO: 2861 - DNA, 403 bp, Rattus norvegicus
  Genbank Accession No. AI639494
ttgacggaggccggttgcatttagaaccactcaattaacacagctggaccacatagctggtccctgataaaggggctggaggtacaactcagagctctcaaatctaaatgaagtgattccatggacttggggatctcccttcccttcaccagggcagggaaatttcatcatgaagagaccaaggggactcactactgtactcacaccccggtaccacataacctcgggtcagtgacagatgcgttcacaccacgccttgaaaagttgactgcagagcccaaatgaaggcactgactagggttgtgatgactctactccagaaaggtgcatgaagaggtctcctagctacgctacatccacatgatacaggctggggacttgccgggtttatcggttctcgata

SEQ ID NO: 2862 - DNA, 543 bp, Rattus norvegicus
  Genbank Accession No. AI639504
ttagagagcatcagccgttctatttcttgcatgatcattggcatgaaggaaaagtccaaaacaggggctttgcattctggggattgcgggccaagtgttataagctcctcatagcactttgcctgggttcatgagacctcggggatccagtgtgtctttgagttgcctcatggtctccacacccacaggacccacttcctcttgaagcagctgcctcttgcccagaccgatgccatgttctccagtacatgtcccatggagtgccagggcacgcctgcccagattttctgcaaaggccttgaccctcctctgctcctccacatcatctgggttgaccaacaggatgcagtgaaagttgccgtcacccacatgcccaacaatgactcctgtgagttttgaggccttaagctcctccttggtctctaccaagatctctggcaaccgggagatgggcacacacacgtccgtggaataggccttacttcctggacgcagggccaaagctgcataccaagcattgtgccgtgcagcccaaagttcatt

SEQ ID NO: 2863 - DNA, 445 bp, Rattus norvegicus
  Genbank Accession No. AI639506
  misc_feature (1)..(445): n = a or c or g or t
ttctgaatatttgaagtttattcaaacaatattccaaattcaaacttataagtgaggtatattttcttttcaaacattagatacctagaaaatatgaaataccatgaaaaatgtcaagttaaattcacagacttgctttcttttaactttaatctgtcatataatacactgtgccatgactcttcagatatggtatttaatgaaaaaaagaactgtgtgaccatttttttgcagacgagttgtaagaacagaaaataaagtatctttgtgagttgttttaaaacatgaagtcattattgtgcctttatgtgagtactgtatttcacttgtgatcaataattataaaagtgccaggaaaacctcataataatcttatggcagngtttcaacaactgaatgtactgtgtgaaaaatctatgcaacaaaaaatttgaatcaaagtttt

SEQ ID NO: 2864 - DNA, 410 bp, Rattus norvegicus
  Genbank Accession No. AI639510
ttattacattaaagatttaataattttatttaagttacaataatcacaaacatctcaattgctttaaaaagaagtctaattacttaaatagtttatacccactacttcaggccccacatccctccatgtcagtgctgccatggaagaataattctgaacagatctaatacatacatcactgtgacttcaacacaatcataaaagccatctctaaaagcgacagcacctagtctctaatgaaattgacaacaggttcattgtatggacagctactcaatggctcatcaaaggagacaagttctgtcaacattgttaatactggagtgcaaattcacgcagaaaacttccccatgaaacgtattcttcaaaaaaaaaaattcttagctaacttatacttgtaaggatttttt

SEQ ID NO: 2865 - DNA, 437 bp, Rattus norvegicus
  Genbank Accession No. AI639518
ttgggagaagagtctgaaaaagtaaactttaattaaaaaaaaataataataatacaacttcaggttcgtgctaggctctcccacttggccttttacagactggtcggttttccactgaattcggagaagctgaagatgtaccacagaggacacagagcaccatcacttctacaggcaaacagctcgtgcacaggcttgaccaatgtccgtggctcgagtgactaagcggcaaggctggtttcccggaagttcaaaacgccagcttcttcatcagcaggtagactcgggagtccacctcaaatccatgcaggttgttggcgtccccctgaagcctcatgaggaggccgccataggacacatacgcagagagacgtgtggctgcttccgttgaggtctcgtccccttcgatcctgtacactttcccatacattacatac

SEQ ID NO: 2866 - DNA, 465 bp, Rattus norvegicus
  Genbank Accession No. AI639524
ttacggtcctttctttttaataaaaatttacaaaatgtagtgcagcctgcttgtgtatgcccctggagtagaacccgtttcagcaggtgaccaaagaagctcatccagctgtcttcccaggacacccagtgtgttctccttcccaccctcctactcagagtaaagcttgtccctgaggctgttgatggcaggatctaacacagagacaggttaactccccaggaaacagcacaggggtgggggcaggaggcgcagggcatgttcctgccagtgatcagtagctaccttctgacttctgaaactcatgggtccaactgtgagcctgcaggtaggggtcaacaggcacctggtgccagcctacggtgtccccggaaattccatgggggctggctctgcacaaagacattccttctgtgcaccctatcagatctgagtgcatgtgtttgacaggtcctagctggtgcc

SEQ ID NO: 2867 - DNA, 453 bp, Rattus norvegicus
  Genbank Accession No. AI639534
ttctaaaaaggctggtttattgaggtttagaaggtcagggggtcaaaatggaggcaagggattttagggtttcttctcttctggatctctgcaggaaggcacatgtagacatggccgtttctcttccaccaccagcttctgcccctgtagcacctcacacagtggccgtgggatcccccagaaggtaacattcttctcaccctgaccttcaaccatggaaactgtaggcgagtacttggggagcaaaggtgtgcaaagtcgctgacggacacgggtggggttgggtccacatggtggtgtgcacagaccccaggtactccactgtgaccatgaacctttcaagacacagttatggatgtcatagcagtgtcgaatatcttggagtttcccagtacatggctgcccatcaaatttgcggccaccacagctccttgaacgtgactgctggcctgg

SEQ ID NO: 2868 - DNA, 2002 bp, Rattus norvegicus
  Genbank Accession No. AJ000347
taggggacgccaggctgactgttgatcatggcttccagccacaatgtgttgatgcggctggtagcctccgcatactctatcgctcagaaggcaggaaccatcgtcaggtgtgtcatcgctgaaggagacctgggcatcgtgcagaagacctcagccactgacctgcagaccaaagcagaccgcatggtacagatgagcatatgctcttccctgtcccggaaattcccgaagctgacgatcatcggggaagaggacctgcctcctggagaagtggatcaagaactgattgaagacgggcagtcggaggagatcctgaagcagccgtgcccatcgcagtacagtgcaatcaaggaggaagaccttgtggtttgggttgaccccgtagatggtaccaaggaatacactgaaggtcttcttgacaatgtaacagtgctcattgggattgcttatgaaggaaaggccatcgcaggcatcatcaaccagccatattacaactaccaggcaggaccggacgccgtgctgggcaggaccatctggggagtcctgggtttgggtgcctttgggtttcagctgaaagaagcccctgctgggaagcacatcatcaccaccaccagatcccatagcaacaagctggtcacagactgcattgcagccatgaaccctgacaacgtgctgcgagtgggaggagcaggaaacaagattatccagctgattgaaggcaaagcctctgcttatgtatttgcaagtcctggatgtaagaaatgggatacttgtgccccagaagttatcttacatgctgtaggagggaagttgacagacatccacgggaatcccctgcagtacgacaaggaggtgaaacacatgaactctgctggagttctggctgcactgcggaattatgagtactatgcaagccgcgtaccagagtctgtcaaaagtgcactcattccctgaaggggtctcacttacttacccaggggcctcggttcaaagtaacatatcttagaactgattaactgattgaacaattagaactccacttgcattcatcattgatcaatgatttattagtaggtagggatagaagatggaattaaagaattgtcttaggtatataacacaattgtcatttctcctgcctaaaaaaaaaaaaattagccaagtggtagcacttatgacagtcatggccattccagtggctgagctaggagggttgcttgagcccagggccccgagactagcctccttcacatagcaagacatagcccaaaaacaaagaagaaaaacaaaaaaggaatttacacttgatcttagccaaaaggccgagaagcgatcaaaaaaggaatttagttttaccaattagctaactagacctgttttgttgttgatgttgttgttgtttggttttttgagacagggtttctctgtgcagtcctggctgtactgaaatttacttagtagacaaagctggccttgagctcagtgattcccctgcttctgcctcctgagggcagggattaagggcttgccccaccatacctggcagaaatgttactgtttttaagtgaagaaatgaaaaagggttagttctgaatgacagtccaggtcatttgtggaatcaacattcctgctggtaaccagatttcttcagggcacagttactccagaatttcagtttgttttcttttcatggtaatgttttaaatttctgattccaaatgagaatgcatataatattatttatgttgatagatttatggggaaagtttgtccaagatacttagtcctatctctttatgttatatatcagatttttttcaaaagtatttgaaaattataaatactgtgaggattaatttattctcttgccattaaaagctatcatcagaaaaaaaaaaaaaaaaaattcctgcggccgcgaattcttccctttagagcacactggcggccgctctagaactagtggatcccccgggctgcaggaattcgatatcaagcttat

SEQ ID NO: 2869 - DNA, 2597 bp, Rattus norvegicus
  Genbank Accession No. AJ000556
cattctccaaagaagcagaaaaatggctatgagaagaaaagggttccagaagcaaccccactccttgatgccagttcactggagtatctgtttgcgcagggacagtatgatttgatcaaatgcctggctcccattcgggaccccaagacagagcaagatggacatgatattgagaatgagtgcctgggcatggctgtcctggccatctcacactatgccatgatgaagaagatgcagttgccagagcttcccaaagacatcagctacaagcgatatattccagaaacattgaataaatccatcagacagaggaatcttcttaccaggatgcgaataaataatgttttcaaggatttcttgaaggaatttaacaacaagaccatctgtgacagcagtgtgtctacacacgacctgaaggtgaagtacctggctaccttggaaaccttaaccaagcattatggagccgagatatttgagacttctatgctcctgatttcatcagaaaatgagccgagtcggtgccattccaacgacagtggcaatgttctctatgaagtcatggtaacaggaaatctcgggatccagtggcggcagaaaccaaatgttcttcctgttgaaaaggaaaaaaataaactgaagcggaaaaaactggactatattaaacacaagaaggaggatgccagaaacaaactccgggaagagtggaacagtttttcctatttccccgagattacccacattgttatcaaggagtctgtggtcagcattaacaaacaggacaacaagaacatggaactaaagctctcttctcatgagggagccttgtccttcgtgtccctggtagatggctacttccggctcactgcagatgctcaccattacctctgtactgatgtggctcccccgctgattgtccacaacatacagaatggctgtcacggtccaatctgcacagatattgcattcaataagctgcggcaggaggggagtgaggaggggatgtacgtgctgaggtggagctgcaccgactttgacaacattcttattgctgtcagctgcttcgaaaagtccgaggtattgggtaatcagaagcagttcaagaactttcagattgaggtgcagaagggccgctacagcctgcatggctctgttgaccactttcccagcctgagagacctcatgaaccacctcaagaagcagatcctgcgcacggacaatataagctttgtgctgaaacgctgctgtcagtctaagcctcgagaaatctccaacctactagtagccactaagaaagcccaggagtggcagcctgtctactctatgagccagctgagtttcgatcggatccttaagaaagatattatccaaggtgagcaccttggcagaggcacaagaacacatatctattctgggaccctgctggattacaaggacgatgaaggaattgctgaagaaaagaagataaaagtgattctcaaagtcctagaccctagccaccgggacatttcactggccttctttgaggcagccagcatgatgagacaggtttcccacaaacacatcgtgtacctctacggcgtctgtgtccgagatgtagaaaatatcatggtggaagagtttgtggagggggggccattggatctcttcatgcaccggaaaagtgatgcacttactaccccttggaagtttaaagttgccaaacagctggccagcgccctgagttacttggaagataaagacctcgttcatggaaatgtgtgcactaaaaacctcctcctggcccgtgagggcattgacagtgacattggcccgttcatcaagcttagtgaccttggcatcccagtctctgtgctgaccaggcaagagtgcatagagcgaaatccctggatcgctcctgagtgtgttgaagactccaagaacctgagtgtggctgctgacaagtggagctttggaaccacactctgggaaatccgctacgatggcgagatcccactcaaggacaagaccctcattgagaaagagaggttttatgaaagccgctgcaggccagtgacaccatcttgcaaggagctagctgacctcatgactcgctgcatgaactatgatcccaaccagagacctttcttccgagccatcatgagggacattaacaagctggaggagcagaatccagacattgtttcagaaaagcacccaataacagaggtggatcccactcattttgaaaagcgtttcctaaagaggattcgtgacttgggagagggtcactttgggaaggttgagctctgcagatatgatcctgagggagacaacacaggggaacaggtagctgtcaagtccctgaagcctgagagtggaggtaaccacatagctgatctgaagaaggagatagagatcttacggaacctctaccacgagaacattgtgaagtataaaggaatctgcatggaagacggggggaatggtatcaagctcatcatggagtttctgccttcgggaagcctaaaggaatatctgccaaagaataagaacaaaatcaacctcaaacagcagctaaaatatgccatccagatttgtaaggggatggactatctggg

SEQ ID NO: 2870 - DNA, 1524 bp, Rattus norvegicus
  Genbank Accession No. AJ001044
aagcttggtaccgagctcggatccactagtaacggccgccagtgtggtggaattccagcgcgactgtccctggagccgtcccgcgcctcagacccgcgagtccccgccgctccgcgcgcagtatggcgccccccaaggccctcgcgttcgggctcctgctcgcggtggtcacggcgacgctggccgcagctcagaaagactgtgtctgtaacaactacaagctgacgtcacggtgctatgagaatgagaatggtgaatgccagtgtacttcctatgggacacaaaatactgtcatttgctccaaactggcatccaagtgcttggtgatgaaggcggagatgactcacagcaagtctgggaggaggatgaaacccgagggggcgatccagaacaacgacggtctgtatgatcccgagtgtgacgagcaagggctcttcaaagccaagcagtgcaacggcaccgccacgtgctggtgcgtgaacaccgcgggtgtccggagaaccgacaaggacacggagatcacgtgctccgagagagtgaggacctactggatcatcattgagctcaaacacaaagaaagagcacagccttataacttcgagagtttgcatactgcacttcaggacacatttgcatctcgatacatgctgaatccgaaatttatcaaaagtattatgtatgagaataatgttatcactattgatttgatgcaaaactcttctcagaagactcaagatgatgtggacatagctgatgtggcttactattttgagaaagatgtaaagggggagtccttgttccattcatctaagagcatggacctgagggtgaacggggagctcctcgatctggaccccgggcagactctgatttactacgtcgatgaaaaggccccggagttttccatgcagggcctcacggctgggatcatcgccgtcattgtcgtggtggtgttagcagtcattgcggggattgttgtcctggttatatctacaaggaagagatcagcaaaatatgagaaggctgagataaaggagatgggtgagatacacagagagctcaatgcctaaccaaccatgccgtgtgctgcactgaggagggagccaccggacggaaatggcgaagaactcaggttgcaaacggatagacctggggaggatggagacctttcgagggtcactgctttgttagctaagctcacacatttgtaacagtgaaatttgtactcataaatacaagcagcttgacattggcattaacaatcttaaaattagacgagtgtcttacacatgcaggtctggcgtggaactcagaacttagcctgccaagataggagagcttatgcttattgttgaagtgtgtgtgtgtgtgtgtgtgtgtgtgtgtgtgtgtcataaacagcccacagtagaatacgatgactactctcatttttgtgattaaagctgcccttctacacactgagtcttgtacataataaacgtttttaatgaaataaaacatttttaaactgaaaaaaaaaaa

SEQ ID NO: 2871 - DNA, 1214 bp, Rattus norvegicus
  Genbank Accession No. AJ001290
aagtattaaaaagctggacacttctgtcattcggacatttttactcacaagttcccagaatgagggctgcgctggagacagcagacattgccatagtggccctgtattttgtcctggtcgtgtgcattggtttctttgccatgtggaaatctaatagaagcactgtgagtggatacttcctggccgggcgctctatgacctgggtggccattggtgcctctctgtttgtgagcaatattgggagtgaacacttcattgggctggtagggactggagctgcaagtggatttgcagtgggcgcatgggagttcaatgccttgctgctcttgcaacttctgggatgggttttcatccctatttacatccgctcaggggtgtacaccatgcctgaatatttgtccaagaggttcggtggccataggattcaggtctattttgcggccttgtccctgctcctctatatcttcaccaagctctcggtggatctgtactcaggggccctctttatccaggagtccttgggttggaacctttatgtgtctgtcatcctgctcattggcatgactgctctgctgaccgtcactggaggccttgttgcagtgatctacacagacactctccaggctctgctcatgatcattggggcactgacacttatggttattagcatgatgaaggttggagggtttgaggaagttaagagaaggtacatgttggcctcacccaatgttgcttccattttgttgacacacaacctttccaacacaaattcttgtatggtgcatcctaagcaagatgccctaaagatgttgagagatccaacagatgaagacgtcccatggcctggattcattcttgggcagaccccagcctcggtatggtactggtgtgctgaccaggtcatcgtgcagagggttctagcagccaaaaacattgctcatgccaaaggttctactctgatggctggcttcttgaagctcctaccaatgtttatcatagtcgtacccggaatgatttccaggatactgtttgttgatgatatagcttgcatcaacccagaacactgcatgcaagtgtgtggaagcagagctgggtgctccaatattgcttacccacgcctggtgatggagttggttcccgtgggccttcggggcctgatgatggcagtgatgattgcagctctgatgagcgacttggcctccatcttcaacagt

SEQ ID NO: 2872 - DNA, 3166 bp, Rattus norvegicus
  Genbank Accession No. AJ001929
tagaattcagcggccgctaaattctaggtggccacggaatcctgcggcgtggagctccggggaaaactcagtcaaccatggacctgcgtcagtttcttatgtgcctgtccctgtgcacggcctttgctttgagcaagcctacagaaaagaaggaccgagtacaccatgaacctcagctcagcgacaaagttcacaacgatgctcagaatttcgactatgaccatgatgccttcttgggagcagaagaggcaaagagttttggtcagctgacaccagaagagagcaaggaaaagcttggaatgattgtagataaaatagacaccgataaagatgggtttgtgaccgagggcgagctgaagagccggatcaagcacgcccagaagaaatacatatatgacaatgttgaaaaccagtggcaggagtttgatatgaatcaagacggcttaatctcctgggatgagtacagaaacgtgacttatggcacttacctggatgatccagaccctgatgatggatttaattataaaccgattatggttagagatgagcggaggttcaaaatggccgaccaagatggagaccttattgccacaaaggaggagtttaccgcttttctgcaccctgaggaatatgactacatgaaagacatagtcctgcaggaaaccatggaggatatagaccagaatgctgatggttttattgatctagaagagtatattggtgacatgtacagtcatgatgggaatgctgatgaaccccagtgggttaagacagagcgggagcagttcgttgagtttcgagataagaaccgggatggaaagatggacaaggaagagaccaaagactggatcctcccttcagactatgaccatgcagaggccgaagccaggcatctcgtctatgagtccgaccaagacaaggatggcaagctcaccaaggaggagattgtcgacaagtatgatttatttgtgggcagccaggccacagatttcggggaggccttagtacgacacgatgagttctaagctgcaaacagaggagccttcatttcttcaaaagtaatttatttttacaggtctggtttcacataaaattgtttgcgctactgagactgttattacaaactttttaagacgtgaaaaggcatatcgagatagtgaaatcacccgcccccattcctcctccctctgaggggctggaaggaacccatgcttctgaggaacaactctgattagtacacttgtgtctgtaggtttacactttgtataatgtataacatggtgtgtttatttttgtattgttctctagttgggagtataatatgaaggatggagatcctcaacccacacttgtaggcatacattagccatttacactttctcaatcccttaccacattttttttttaataattctcacttaactaattttttaaagcctaagatcaataagaaatgttcaggagagaaaaagcagaaggaaagcatgtacttcgtgatttacgttcagagagagaatgcttcatcttgcttgttgagaagtctcatttcatgagtagctgttcagttgtcacaggcccagccacggagcctgccattgtctgggcaaggacagagtcctccgctgtaagacagcgtcacgcagctccacttcactcttcccctcaggactagctgtttgctaattttgtcaagcacagctgtggtaggaagaattagggcccagtgtcttgaaaaatcaaccaagtagtgtgtatgatgtcttcacagggctatttctagctctttctagagctgtttctaaccagaaacagctggaaaacaaaaagaacaaagtgtatgcagggcatgcatctcattcttagtgaaatcactacaaggacccatcccagcccctttctaagtcttaaccttgggttttactgcagtttaaattgattcttttcccatcatgacattgaaagttgccctttaacaggaaaaatggtcaccgaatgagaattgggactcaagaataacgaatttggggcgcccttacgttgaaagcatttgaacctccctgataccgaaggggattcccctccccgcctttttctcttgtaaacaggaagtaaatagcattattagttaaagcttggttgcagtgttcttatcttgtgggctggtttctaaaacctcatgctgctgatttgaccagggcatcctcatacctcagatgcaaaccactcttctaccgggcctctgtttaccggagctttgcctcaaggatagaaggctgtacagaggggctctttggtttgaggaccactgctcacccttcctgtcattaacctgtcacaccccattttatcatctccctttctctctgacacacaaaggtggggtacgtgggagggtcgtggattattcttattaaaaaacaaaatcatctgttgccaaccccatttacccatctttggtctcttactgatgggcctcttaagaattattgtattccaagtctttaaccctcatgttactaatgtaaatatacatctgggcagtctttattacttcctgtatctctgagtaatacatcaagctggtgctgggtgatggtcatatctgaacctagacctccccgtgggtcttccacaatcctgttgatgtgggctgcttggtgtggtaaaaagcccagtcgtggtgtaacttaaccttggcgattgcatcaagcttcttgatagcagatacactctaaggttttagccccagtagaggtgaaatgaacatccctcactgccttccccagatcctcaactctccattgttaaggagaccagagataattaatgccaccaaccctggcttagaaagggtacgtcatacactgtgtagcaagagggcattacagagcctaacgctggcgtgaaaatcatgtacttagccagcaagtgagtctgcgagggtggcgtagtctggacagggtgttcagcatcgggaactgtgctctcaggtccataagctccacatagtgttggggtttgggtttgggtttctggttgaatttgagtatttgttctttttttatagagtgtaaaccaagttttatattctgtaatgcaaacaggtacctgtcgttttttgaataaaactgtttacatccaaaaaaaaaaaaaaaaaaaaaaaaaa

SEQ ID NO: 2873 - DNA, 1342 bp, Rattus norvegicus
  Genbank Accession No. AJ005424
ccgacaataccaaagcagccctcaaagctgctctgctcaagtccctgaggagccggcttcgagatgggcccagtgcacccttggaggcccctgaacctcgaaagcctgtgacagctcaggaacgtcagcgagagcgagaagagaagcgcaggaggcgacaagagagagccaaggagagggagaagcgacgacaagagcgggagcgcaaggagaggggggctggcaccttggggggcccctctactgaccctttggctggattggtgctcagtgacaatgaccgaagcctgctagagcggtggactcgcatggctaggcctcctgtccctgcaccagcaccagcaccagcaccagcaccaacaccaacaccaacaccaacaccaacaccaacacagtcctctgctcaacccactagtcctcccaatggccctgtatctcagactactgctcctctacagcctgcaggctctattcctggtcctgcctcccagcctgcttgcccaccccctgggcctgttccccagcctgctggccctgtccctgcccctctccagactgccccttccactagccttttggcctcccagtcacttgtgccacctagtgggttgcctggttctggtgccccagaagttctgccttacttcccatctggcccaccacctccagatcctgggctcacccctcagccttctacatcagagtcacctgatgtcaacctggtgacccagcaactgtccaagtctcaggtggaggaccccctgcctcccgtgttctcaggcactccaaagggcagtggggctggctacggtgttggctttgacctggaggaattcttaaaccaatcttttgacatgggtgtggctgatgggccacaggatagccaggcagactcagcctcactctcagcctccctccttgctgactggcttgagggccacggcatgaaccccgctgacattgagtctctgcagcgtgagatccagatggactccccaatgttgctgtctgacctgcctgacctccaagaaccctgagacccacagcttgtgccttgctgccaggacgggcccagcttcaaggtccaggggtgcagtccagagggctgcagccttgagcctggcaggtgaggctcagcttgagttactctgcaggttcatctcagacccaccgttcagccttaagcagccgcctgagccaccaccgagccataacaggatgggaggctctactccttcctgcgcagtcttctccagtgttgtatttttattactgttgtaatatgcatttgttttgccatcgaaatgaggcctgtgaaatacaaggtttcctttaaaaaaaa

SEQ ID NO: 2874 - DNA, 601 bp, Rattus norvegicus
  Genbank Accession No. AJ011115
cgctaccagcctgatccatggaaaggaagtgcagcaaaaggcacaggcatcaccaggaagaagacttttaaggaagtagccaatgcagtgaagatctctgcctcactcatgggcacggtgatggcgaagcgtgtgaaggcgactatcctgtatggctctgagactggccgcgcccagagctacgcacagcagctggggaggctctttcggaaggcgtttgacccccgggtcctgtgcatggatgaatacgatgtggtatccctagagcatgaggccttggtattggtggtgaccagcacatttggcaatggggatcccccggagaatggagagagctttgcagcagcgctgatggaaatgtcgggcccctacaacagttcccttcggcctgagcagcacaagagttacaaaatccgattcaacagtgtctcctgctcggacccactggtatcctcttggcggcgcaaaaggaaggaatccagtaacacagacagtgcaggggccctgggcaccctcaggttctgtgtgtttgggctgggctccagagcatacccgcacttctgtgcctttgctcgagcggtggacacaaggctggaggaat

SEQ ID NO: 2875 - DNA, 1247 bp, Rattus norvegicus
  Genbank Accession No. AJ011608
cttacttcatggagctatttgatccggcggagctgccggagctactcaagctttattaccgaagactctttccttacgcccagtactatcgttggctcaactatggcggagtgacaaagaattactttcaacaccgtgaattctcattcacactgaaagatgatatttacattcgctaccagtccttcaacaaccagagtgatctggaaaaggagatgcagaaaatgaatccatataagattgatataggtgcagtatattctcacagacccagccaacacaacacagtgaagctgggggctttccaggctcaggagaaagaactggtctttgacattgacatgacagactatgacgacgtaaggagatgctgcagttccgcagacatatgctccaagtgctggactctcatgacaatggccatgcgcatcatagatcgggcattgaaggaggactttggatttaagcaccgcctctgggtgtattcaggaaggagaggtgtacattgttgggtctgtgatgagtctgttcgaaagctgtcctctgctgttcgctccgggatcgtggagtacttgagtcttataaagggtggtcacgatgttaaaaagaaggttcacctaaatgagaaagttcacccttttgtcagaaaatctataaacataattaaaaagtactttgaagaatatgccttagttgaccaagatattcttgaaaataaagaaaactgggataagattttagcccttgttcctgagacagttcatgatgagctgcaaaaagggtttcagagatttcacagttcacctcagcgctgggaatacctgaggaaagtggccagtgcaccacagaataccaagaatgataagtgtggcccctggctagaatgggagattatgctccagtactgtttcccacgcctggatatcaacgtcagcaaaggagtcaaccatttactgaagagcccttttagtgttcaccctaagacaggtcgcatttctgtgcctatcgattttcagaaagtggatcagtttgatccatttgttgttccaactataagtgctatctgccgggaattggatgtggtttccaccaatgagaaggagaaggaggaaaatgaaactgacagcagacacagagtcagagattataaaaggaccagcctagcaccatacgtgaaagtatttgaacagtttctcgaaaacctggataaatctcggaaaggggcacttctcaagaagagcgattta

SEQ ID NO: 2876 - DNA, 327 bp, Rattus norvegicus
  Genbank Accession No. C06598
  misc_feature (1)..(327): n = a or c or g or t
gggctgcaggtttgacagcagcctaccacagaaccagccctttgttttctcccttggcactggccaggtcatcaagggctgggaccaggggctactggggatgtgtgaaggggaaaagcggaagctagtgatcccgtctgagctggggtatgganagcggggagcccccccaaanataccaggtggagcaaccctggtgtttgaggtggaactgctcaanattganagacgttcanaactgtancaggctgcaaaggggtaggaggcccctatcagggaccanactgtttaaaaacaaacaaaaaaacctttaaaaccccaaaaaaa

SEQ ID NO: 2877 - DNA, 1370 bp, Rattus norvegicus
  Genbank Accession No. D00092
gggcctgaggcttttaaaaattatacattggattcagcaacagctgccacacaggcagccccagccccagctgcagctccagctgctgccccagctgcaccttctgcaagtgctccaggtagctcctatcccgttcacatgcagattgttcttcctgccctctccccaaccatgaccatgggcaccgtccagaggtgggaaaagaaagtgggagagaagctgagtgaaggagacttgctggcagagatagagaccgacaaggccaccataggctttgaagtacaagaagaaggttatctggcaaaaatcctggtccctgaaggcacaagggatgttcctctgggaaccccgctatgtatcatagtagaaaaacaggaagatatagcagcatttgcagactacaggccaacagaagtgaccagcttaaagccacaggcaccaccacctgtcccacccccagtggcagctgttcctcccatcccccagcctttagcacctaccccctcagccgctcctgctggaccaaagggaagggtgttcgttagccctcttgcaaagaaattggcagcagagaaagggattgacctcacccaagttaaagggacgggaccagaaggcagaatcatcaagaaggacattgactcttttgtgcctactaaggctgctcctgccgctgcagcagctgctcccccgggtccaagagtggcaccaactcctgcaggtgtcttcatagacatccccatcagcaacattcgtcgagtgattgcgcagaggctcatgcagtcgaagcagactatacctcattattacctttctgttgatgtaaatatgggagaggtgctgttggtgcggaaggaacttaataagatgcttgaaggtaaaggaaaaatctccgtcaatgacttcatcataaaagcttcagctttggcctgcctgaaagttcctgaagcaaactcatcttggatggacacagttatacgacaaaatcatgtggttgatgtcagcgttgctgtcagtacccctgcaggacttatcacccctattgtgtttaatgcacacataaaaggactggaaaccattgctagtgatgttgtttctttagcctccaaagcaagagagggtaaacttcagcctcacgagttccagggtgggacatttacaatctccaacttagggatgttcggaattaagaatttctctgcgattattaacccacctcaggcatgtattttggcaattggtgcttccgaggataaactgatccctgcagataatgagaaaggctttgacgtggctagtgtgatgtctgtcacacactcagctgtgatcatcgagttgtggatggagcagttggagcccagtggcttgct

SEQ ID NO: 2878 - DNA, 1442 bp, Rattus norvegicus
  Genbank Accession No. D00362
aattccctggggcgccctcttttaaaaatggagtcccaaatacagagaagatttcatcaccatggtctccctgtgtcaaagagctcttgttcttccgccatgtggctctgtgctctggtctgggcttctcttgctgtttgcccaatttggggacacccatcctcaccaccagtggtggacaccacaaaaggcaaagtcctggggaagtatgtcagcttagaaggatttacacagcctgtggccgtcttcctgggagtcccttttgccaagcctcctcttggatctctgaggtttgctccaccagagcctgcagagccctggagcttcgtgaagaacaccaccacctacccgcctatgtgctcccaagatggagttgtgggaaagttactcgcagatatgttgagcaccggaaaagagagtatacctctcgagttttccgaagactgtctctacctgaatatttacagtcctgctgacttgacaaaaaacagccgattgcccgtgatggtgtggatccatggaggtggactaataataggcggagcatcaccctatagtggactagctctctctgcccacgaaaacgtggtggtggtaaccattcaataccgcctgggtatttggggattgtttagcaccggtgatgaacacagccgggggaactgggctcacttggaccagctggctgcactacgctgggtccaggataacattgcaaactttggagggaacccggattcagtgaccatctttggagagtcagcaggaggtgtcagtgtctctgctcttgtcttatctcctctggccaagaacctcttccacagagccatttctgagagtggtgtgctcctcactacaaacctggacaagaagaatactcaggctgtggctcaaatgattgctactctttctgggtgtaataacacctcatcagccgccatggttcagtgcttgcgccagaagacagaggctgagctcttggagcttacagtgaaactggacaatacctccatgtccactgtgattgatggagtggtactgccaaagacaccggaagagatcctgactgagaagagtttcaacacggtcccctacatagtgggcttcaacaagcaagagtttggctggatcattccaacgatgatgggaaatctactctctgaaggcagaatgaatgagaaaatggccagttctttcttgaagaggttcagccctaaccttaacatctctgagagtgtgattccagcaatcattgagaagtacttaagaggaacagatgaccctgccaaaaagaacgaacttctcctggacatgttttcagatgtctttttcggtatcccagctgtactcatgtcccgtagcctcagagatgccggagcgcccacctacatgtatgagtttcagtatcgcccaagcttcgtgtctgaccagagaccccagac

SEQ ID NO: 2879 - DNA, 2513 bp, Rattus norvegicus
  Genbank Accession No. D00688
gaattcctgacggatctggagaagcccaatctcgcaggccacatgttcgacgtaggtctgattggaggcggcatctcaggattggctgctgccaaactgttgtctgaatacaaaattaatgtcttggttttggaagcccgggatagagttggaggaagaacatatactgtgaggaatgagcatgtcaaatgggtagatgttggtggagcctatgtgggaccaacccagaacagaatcttacgcttgtctaaggagctaggcatagagacctataaagtgaatgtcaatgagcgtctagttcaatatgtcaaggggaaaacttacccattccgtggtgcattcccacctgtgtggaaccccttggcatatttggattacaacaacctatggagaacaatggatgaaatgggaaaagagatccccgttgatgcaccgtggcaagcaagacacgctcaggaatgggacaagatgaccatgaaagatctcattgataaaatctgttggacaaaaactgctcgggaatttgcgtatctttttgtgaacattaatgtgacttctgagcctcatgaggtatctgccctgtggttcctgtggtatgtgaggcagtgtgggggcactgctcggatattctcagttaccaatggcggccaggaacggaaatttgtaggtggatctggccaagtaagtgaacagataatgggtctccttggagataaagtgaagctgagctctcctgttacttatattgaccaaacagatgacaacatcattgtagaaacactgaatcatgaacactatgagtgcaaatacgtaattagtgccatcccaccgattttgactgccaagatccactttaaaccagagcttccacctgagagaaaccaattaattcagcgtcttccaatgggggctgttatcaagtgcatggtgtattacaaggaagccttctggaagaaaaaggactattgtggctgcatgatcattgaagatgaggaggctccaatcgccatcactctggatgacactaaaccagatgggtcactgcctgccatcatgggcttcatacttgcccggaaagctgatcgacaagctaaactacataaagacataaggaagaggaaaatctgtgagctgtatgccaaagttctgggatctcaagaagcattatatccagtccattatgaagagaagaactggtgtgaggagcagtactccgggggctgctacacagcctacttccctcctggtatcatgacccagtatggaagggtgattcgccagccagtaggtaggatttactttgcaggcacagagacagcaacacagtggagtggctacatggaaggagcagttgaagctggagaacgagcagctagagaggtgttgaatgctctaggaaaagtcgcgaagaaggatatatgggttgaagaacccgagtccaaggatgttccagccattgaaattacccacaccttcttagagaggaacctgccttccgtgcctggtctgctcaagatcactggtgtttccacttctgtggctcttctctgctttgtattgtacaagattaagaagctcccatgctgaagtttcaccctcaggcctcctgcacgatcatcgcatgtgaaagaaagtgtggataaattacagcctatggtttgggccatttaagtgcacttgatttaaccctcatcagtttaatttcagtctttgtaaagtgataacaatccaaagaatcacctagctaatttccataagaacaagtttcatcctgtttgttagactaatttgtgtgggttgagagaataaaatgttgagtgcttaatttcaaaaagtgaagtgcttctgaggaataatttctgggttcttttgttttctttttgcctttaatgcaaaatagctaattcagaaataaaacacttgacttactgtgacttttgtgtagcgtccaaggtgtacagaggaaaatagtggctgaagtgttccctaggtatcctcactgactagctccatgtgatacacactacccttggcactttcttttctggactgtatctagacatgcattgacccttgtcagtaacattctgtgctgatttaaggaaattagcattattttaatatagtccatagttatctgatcagaggattagatctctaagtctacctgtgtcttcaagatggttatatttttctgttggttgatagtataccattttttctcaattaccaaaggacatatgaaatgttctctattgttatttgttgatacagtcaaatacagaaattaaatttgggctctgtgtgataacatgacttgcttgaattattaggttttatagcagacattaaattggatgattttatatacccaaactatggtctctatcttaggagtgttgtgggtccagaatgatgtctgtcttttctctttcccatctgaaaaattgtcaattaaaaaaacttttcaaaggtttcaaccacaaagcacttctttttctaaaaaaaaaaaa

SEQ ID NO: 2880 - DNA, 1083 bp, Rattus norvegicus
  Genbank Accession No. D00729
acacaactctcaatcatccagtgaactgggctgactgtggcaggacctgggcggtgaggaaacccttggggacaccgatgtggcttgagcctgctcctcttcttggcgctggcctctcccgtcgcgttctgctgcaggccggatcccgcctcgccgcaggggggcctggacgagcccgtcgcttctctaacaaggcggtgttggtggagaaggagggcgaggcaggaatcgcagtgatgaagttcaagaaccctccagtgaattcctcagcttggagtttccgacagagttttcgtcatcagcctgagaagctggaaaatgaaaagagcatccgaggtgtcatcctcacttcggagcgcccgggaacctccccgccgccccacgacatgaagaagaaggacgaccagcccactatgctgagtactggaaggctcgtgccaggagctgtggctgaggctctacttgtccaacctgacttgatatctgccatcaatggcgcctttccagctggaggctgcctcatggctctcacctgtgactacaggataatggcggacaactccaagtataccataggattgaatgagagcctgctgggcattgttgcccccttctggttaaaagacaactacgtgaacacatcgggcaccgagcagccgagcgtgcccttcaactggggacgttttcccactaacatgacagcagctgctctactgacgcttcacagaagcctcaatgaggtggtacctgaggatcaggtacacagcaaggctcgctcagtgatggccaagtggtttaccattccggaccattctcggttgctgacgaagagcatgatgcgcaaggccacggcggacaacctgatcaagcagcgagaggctgacatccagaacttcaccagtttcacctccagagactccatccagaagtccctgcacgtgtacttggaaaagctcaagcaaaagaagggctgacctaagggtgccacacggtgtttagttacacgtgccttctagggacccatggtcccaaggattatcaataaggtatttttcaatttaaaaaaaaaaaaaaaggaattcc

SEQ ID NO: 2881 - DNA, 2266 bp, Rattus norvegicus
  Genbank Accession No. D10655
cctacaatgcaggcaggcaccatagcccgctgggaaaaaaaagaaggggaaaaaatcagtgagggtgatctaattgcagaggttgaaactgataaagccactgttggatttgagagcttggaggagtgctatatggcaaagatccttgttcctgaggggaccagagatgttccgataggatgtatcatttgtatcacagttgaaaagcctcaggatattgaggcctttaaaaattatacattggattcagcaacagctgccacacaggcagccccagccccagctgcagctccagctgctgccccagctgcaccttctgcaagtgctccaggtagctcctatcccgttcacatgcagattgttcttcctgccctctccccaaccatgaccatgggcaccgtccagaggtgggaaaagaaagtgggagagaagctgagtgaaggagacttgctggcagagatagagaccgacaaggccaccataggctttgaagtacaagaagaaggttatctggcaaaaatcctggtccctgaaggcacaagggatgttcctctgggaaccccgctatgtatcatagtagaaaaacaggaagatatagcagcatttgcagactacaggccaacagaagtgaccagcttaaagccacaggcaccaccacctgtcccacccccagtggcagctgttcctcccatcccccagcctttagcacctaccccctcagccgctcctgctggaccaaagggaagggtgttcgttagccctcttgcaaagaaattggcagcagagaaagggattgacctcacccaagttaaagggacgggaccagaaggcagaatcatcaagaaggacattgactcttttgtgcctactaaggctgctcctgccgctgcagcagctgctcccccgggtccaagagtggcaccaactcctgcaggtgtcttcatagacatccccatcagcaacattcgtcgagtgattgcgcagaggctcatgcagtcgaagcagactatacctcattattacctttctgttgatgtaaatatgggagaggtgctgttggtgcggaaggaacttaataagatgcttgaaggtaaaggaaaaatctccgtcaatgacttcatcataaaagcttcagctttggcctgcctgaaagttcctgaagcaaactcatcttggatggacacagttatacgacaaaatcatgtggttgatgtcagcgttgctgtcagtacccctgcaggacttatcacccctattgtgtttaatgcacacataaaaggactggaaaccattgctagtgatgttgtttctttagcctccaaagcaagagagggtaaacttcagcctcacgagttccagggtgggacatttacaatctccaacttagggatgttcggaattaagaatttctctgcgattattaacccacctcaggcatgtattttggcaattggtgcttccgaggataaactgatccctgcagataatgagaaaggctttgacgtggctagtgtgatgtctgtcacactcagctgtgatcatcgagttgtggatggagcagttggagcccagtggcttgctgaattcaaaaagtaccttgaaaagcctgtaactatgttgttataatttccctgcgaacttctattcttcctctgctgacattatatttatatgttattaaacaggtggttcttttaaagtttcactagttaattttattattgagtcagtccagataaattatttgtaacagacataaatgaatcttttgtaaatgccagttacacccaaatgttttacccctttaataattacacatcggtttaaagctgtgtactcctagtgaaggggacatgtgggcctaactctttggtagaaggagccttcctgggagtgatagatggcaggattgtggcttcctgcagacaagtcactaaaagtacctggatgagatacttggagttagattaatgatcacttatttaagtgtgagggaacagtcgtgaaaattacgtcttatggaggagtttgaatttacgttggaatctaacagttaaagtctcctgtcacatgaccttagtttatcactcagtaagtgaaacttttaagagtcagcattttcttagacctcttcaaaccaactattatttttatatgaatctctaaataaaatagctttccccacaagataaagatataaaccagcttcttggtataaatgaaattttatgtatttatttataaacaatttcaatgtataacttga

SEQ ID NO: 2882 - DNA, 1122 bp, Rattus norvegicus
  Genbank Accession No. D10770
gggacggccccggtcccctcccctccgtcactcctgcttacggactcccgggtcatggggaacacggcgatcgccaagaaaggcagcgaagtggagagcgtgaaagaattcctagccaaagccaaagaagactttctgaggaaatgggagaaccctcccccgagtaatgctgggcttgaggattttgaaaggaaaaaaacccttggaacgggttccttcggaagagtcatgctggtaaagcataaagccactgagcagtactacgccatgaagatcttagacaagcagaaggtcgttaagctaaagcaaatagagcacactctgaatgagaagagaatcctgcaggcagtggagttcccgttccttgttcggctggagtattcttttaaggataattctaatttatacatggttatggaatacgttcctgggggggaaatgttttcacatctaagaagaattggaaggttcagtgaaccccatgctcgtttctatgcagctcagatcgtgctaacatttgagtacctccattccctcgacctcatctacagagatctcaagccggaaaacctcttaattgaccaccagggttacatccaggtcacagattttgggttcgccaagagagtcaagggcaggacttggacattgtgtggcaccccagagtacctggccccagagatcatcctcagcaagggttacaataaggcagtggactggtgggcattgggtgtactgatctacgagatggctgctggctaccccccgttctttgctgaccagccaattcagatttatgagaagattgtttccggaaaggtccgcttcccgtcgcacttcagttccgatctcaaggaccttctgcggaatctgctgcaggtggatctgacaaagcggtttgggaacctgaagaatggcgtgagtgacatcaagacccacaagtggtttgctacgaccgactggatcgcgatttaccagagaaaggttgaggctccattcataccaaaattcagaggctctggcgataccagcaacttcgatgactatgaagaagaagaaatccgagtgtctataacagaaaaatgtggaaaggagttttgtgaattttagggaggagaagga

SEQ ID NO: 2883 - DNA, 1196 bp, Rattus norvegicus
  Genbank Accession No. D12770
ggtgcggtgcctggccgggcgtaggcaagagcaaaagagcggctccttgcagactgtgcgcgcccgcgtttcagcatgggggatcaggctttgagcttccttaaggacttcctggcaggtggcatcgccgccgccgtctccaagaccgcggtcgccccgatcgagagggtcaaactgctgctgcaggtccagcatgccagcaaacagatcagtgcagagaaacagtacaaaggcatcattgattgtgtcgtgagaatccccaaggagcagggctttctctccttctggaggggtaacctggccaacgtgatccggtacttccccacccaagctctcaacttcgccttcaaggacaagtacaagcagatcttcctgggaggtgtggatcgtcataagcagttctggcgctacttcgctggtaacctggcctctggtggggcagctggggctacctccctctgcttcgtctacccactggactttgctaggaccaggctggctgccgacgtgggcaagggatcttcccagcgtgagttcaatgggctgggtgactgtctcaccaagatcttcaagtctgatggcctgaagggtctctaccagggtttcagtgtctctgtgcagggcatcatcatctacagagctgcctacttcggagtctatgacactgccaaggggatgctgccagaccccaagaatgtgcacattattgtgagctggatgattgcccagagtgtgacagccgtggcggggctggtgtcctatccatttgacactgtccgtcgtaggatgatgatgcagtctggccggaaaggggctgatattatgtacacggggacagttgactgctggaggaagattgcaaaagatgaaggacgcaaagctttcttcaaaggtgcttggtccaacgtactgagaggcatggggggtgcttttgtattggtattgtatgatgagatcaaaaaatatgtgtaatgctcaagttcacaggttcacagatccattgtgtggtttaacagactattcttaaggaaataaaaaaagacagatcatggataaaaccagaccataaggaatacctcagaaaaatgcttcattgagtattcatttaaccacaaaagtattttgtatttattttacatttagattcccacagcaaacagaagatagcttatcatacttgttcaattaattaactg

SEQ ID NO: 2884 - DNA, 1338 bp, Rattus norvegicus
  Genbank Accession No. D13556
aagctttggaattactgaggttagactaatgcaagtgctgggtaatcgtacttatacacaagtctaaggttctgcaggaaagaaattgtctttggtatctgcatcaggctagtattattaacatttggattttgctttgggatagagcttgtatgaccctagaaccaaacccccctccccaatcaactgagattaaaaagatccatgtaaaaatttccttcatttgcaacccccaacccacccgccccggataaaaagtcacaggcatctacctagcacaaaggttacgaaatacaatgcatagtcgacagtggtgctgcaaaaggaaacaaaactagaaacaagataaagacaaatctgatcattgttctgcatgtttcctcacaaacaggacagccacttccaagcagttctggtaacagaaaagagaaagaaggctcagaagggcccttgggttgagaccccgccccaaaggtgaaagcacccagcagagtagccaatcctgtgccagcatcttcagcttcccactctgtggagtccatggccacaccgtagcagtgcccagctctaaggccctgcgctaagctctggtgctctggtggtgaccctggctgctgtcataaagtctgtggtggtgatgggattttggcttttgttttgaaaaatctgatgttcccatttccttgatgcatgctctgcttacaagtcagtcagcaagggtcaaagctcccgagcgtgcatctgaatgaatccctcaacttagaaaaagacttgctgcccttctgagctggccagaggtgtcgacacctacccttggcatgcctccaagtgccaggatgccacagactggattgaggctgaagacttcccttttctttggtttttttgtttgttttgagtttatacaagcattaagaaatctttggttttggctggaaatggaaaaacaaaacaaagaaaccaccctcccctggcttatagcagcagtataatgacctgacttggctaagctttttcttcccccaactttggggttgggaactgcaagttaagaactacattcaaagaaaatgttgaaagggctggagaagcagcttccagaaagcccgtcggatataagattgtcaaataataattattattacaatattaataataaacttaaatatttggaaattttttggtcatgtcacacaggaaacaagtgaaatgtgtagcttaagtcagtgtaaatgaacctttggtgtcctttctaccaagtcctggcaatgagcagaatcccatggcctcaggggggaacggcgagtcagaagctgatggatagccagcagttagaaa

SEQ ID NO: 2885 - DNA, 2842 bp, Rattus norvegicus
  Genbank Accession No. D13623
tcgcggaaggtgacgtggacacggaagtggtcgtcgtcgcggcggcaccggtgggagcggggccctgcacttggagtgcggcgggcaagcggacgggtggcggaggcctctcagcggcggcggcggcgacttaaggcgcaggcgtggtccgttgggtgcgaatccgctgagcccacgagcggcctcttagccctctctcctgcccgtcggaaaccgggagcagggacccgcttagccggcgtcatcatgaccaagaccggtagcaagggcgggaacctccgcgacaagctggacggcaatgagctggacctgagtctcagcgacctgaatgaggtccccgtcaaggagctggctgcacttccaaaggccaccgtgttggatctgtcctgcaataaactgagcactcttccgtcggatttctgtggcctcacgcacctggtaaagctggacctcagcaagaacaagctgcagcagctgcccgcagactttggtcgcctggttaaccttcagcatttggatctcctcaacaacaggctggtcaccctgcctgtcagctttgctcagctcaagaatctgaagtggctggatctgaaggacaatcccttggatcctgtcctggccaaggtggcaggtgattgcttggatgagaagcaatgtaagcagtgtgcaaacaaggtgttacagcacatgaaggccgtgcaggcagatcaggaacgagagcggcagcgccggctggaagtggagcgagaggcagagaagaagcgtgaggccaagcagcaagctaaggaagcaaaggagcgcgagctgaggaagcgggagaaggcggaggagaaggagcgtcggcgaaaggagtatgatgctcagaaagcttccaagcgggagcaagagaagaagcctaagaaggaaacaaatcaggccccaaaatcgaagtctggctctcgccctcgcaagccaccaccccgaaaacacaatcgctcctgggctgtgctgaaggggttgttgctgctgctgctgctatgtgtagcaggagggctggttgtatgccgggtgacagggctgcaacagcagcccctctgcaccagcgtgaacgccatctacgacaatgccgtccagggcctgcgccatcatgagatcctccagtgggtcctccagaccgactcccagcagtgagctcatcctcagcaccgctgcctcccagcctcggagcttggattcctatggaattgggttctgctggacacaacttctttttagcgtcagacctacctgccatcatcaaatggctgctgagtggtacttgagatctcccctttgtaggacttctctgttccttagtcagggttccctggtggaatgaggagaaatggagaggggggaggaagagttacctgcatgcctaaaggaataggcttaggggtggggagagagaaggcataggcttttctagttatgcaaagctgtgtaaggcaaggttcctttctactaaatggtcagctgtcactacatttatacttttgtatgtcacaaaccctttctttcattcctccctgggtaaccaggacggattggagggcagtgtgttactgggactaggggactaggaatacttgggtaaattcagcctaagctgggagggtaaagtaatacatttccttaaagatctcagacagtcaagcattttagcaatgtccaaaatgtctggctatgaacacatgttcactgccattggtccagtgtaacactttgaggcaggaggtgccgtccatgacttacttgcctacagtgttcaagctagtccaaggcacaacccagctttcactccagttttcttcctttcctttatgtcatttggcctcctttataatactcaaggggatgaactcacaccagagttgtcttagctaaagtgaatctttcataatagacggtcttaccacccacaaatagatctcatcagggtcctgggaaactaatcctgtggaattttgcctcagcttaaatggcttccacaaaatggcagcaggctgggctccttgcctcccttttagagcattaaactccctgatggcctggaagcacaggggcagatctctgcagcggcactgtgactgccctactagcacttggtatgatgaaatacctcaaaggcaacctagaaacttgatctcacagaagcaggtgcagagttgcttctggacctgtaacagaagggaaggaatagaacagtgggagccaaagggaaacaaagtcacacggtggcgctgcaagtgatacataagtaaacattagcacaaaccagggcagcagcacccacctccctgctgctaccagaaagcattctccccgcttccctgtctcttcacaacagctgcaggaagggatcggaaacctgtctcggtgcttatttgctaaaactcccaactgcaagctctccctagaggagcaggacctgtcggagttcagacagtgtagccccagtggcccatgtgcttaggtcagccactcaagactgtcctgacacgggaagaaaggcctttgtttttccctcccccagatagttctgccgtgtaggtccacaccttactcagaatcactacacattcctttagtcttcctccaagctccagagccatcggtacaaatgctttattgagacaaaatacatactacatatggtgacatcatgaaaacagaagtcagcctcatagatccctggctggttgaggcagctcagtggctgggcgtagtcaagccaacccgcaggcaagagttcactctgacttcgagatttgatgcttattctttggatttctacaattattaaatccgtgtctgagtggtc

SEQ ID NO: 2886 - DNA, 1957 bp, Rattus norvegicus
  Genbank Accession No. D14015
tcgaggtcgacggtatcgataagtttgatatcgatttcctgcagcccgggggggatcccgccagcgccgcgcgctccggccgccgcctcccgcctcctgcttcccgcctgccgtcggcctcctgtccgctcgagcgcgcctgtctgcgggggacacagcttcgggtctgagttccaagtcctgagccatgccaagggagaggaaggagagagactcgaaggaccacaccaaatgaaagaagaaggtggttccgacctctcagtccgatccagaaaaaggaagccaaatgtgcccgtttttttgcaagatccggatgaagaaattgccaagattgacaagactgtgaaaagccaggatagcagtcagccttgggatgatgattcagcgtgcgtggacccctgctctttcatccccacccctaacaaagaagaggacaatgagcttgagtaccccaagactgcatttcagcctcggaaaatcagaccgcccagagcctccccacttcccgtcttgaattgggccaatagagaagaggtctggaggatcatgttaaacaaagagaagacttacctgagagatgagcactttctgcagcgccaccctctcctgcaggcgaggatgagagcagttcttctggactggctgatggaggtgtgtgaagtctataagctccacagagagacattctacttggcacaggacttctttgatcgttacatggcatcacaacagaatatcataaaaacacttttacagcttattgggatttcagccttatttattgcttctaaacttgaggaaatctaccctccaaagttgcaccagtttgcttatgttactgatggtgcttgctccggggatgaaattcttaccatggaactgatgatgatgaaggcccttaagtggcgtttaagccccctgaccattgtgtcctggctgaatgtttatgtccaagtggcctacgtcaacgacacgggagaagtgctgatgcctcagtacccacagcaggtcttcgtgcagatcgcagagcttttagacctgtgcgtcctggatgttggctgcttagaatttccttatggtgtcctcgctgcttctgctttgtatcatttttcctcgttggagttgatgcagaaggtctcaggttatcagtggtgtgatatagagaagtgtgtcaagtggatggttccattcgccatggttatccgggagatgggaagttccaagctcaagcacttccggggagttcccatggaagactcccacaacatccagacccacaccaacagcttggacttgctggacaaagcccaagcaaagaaagccatattgtcagaacaaaataggatttctcctcctccgagtggggtcctgacacccccacacagcagtaagaagcagagcagtgagcaggagacagaatgaccagacctgccatcgcctccaaagacagtggtgtggaagcacctgcctggagctccttgtgctgccttggaggtcaggagcccctgcagatgctatgctctgtggagaggtgtctcttccagagcagcaggggtctacaagatgccttggacggaagtgctttgattgaatgctaggtgttttaactatagggtcgagtacaccagccacctccagaacaccactgagtgctccagaagctgctaaggagggtgctacttggacccactggactcttcacacagacggcaaaagcttgaagttaaggaggccatggtgcttgctggcctctgctgggtgtcgcagggttgctgttgatagggtacggcgagtggtcgtgagcaagcatgggatgcagagccacagcctggcctgagctgcccttctccactgtcagttgacagcatatcctgccttcatgaacactcttgttttggaagtgctgctacgtctatcaattttaataaagataattctatctctgagaaacaaccaa

SEQ ID NO: 2887 - DNA, 1404 bp, Rattus norvegicus
  Genbank Accession No. D17349
gtaccctgaggctcacatgacttgtcctttgtgcccacaggaaagcgcatttgtcttggagaaggcattgcccaaaatgaattgttcattttcttcaccgccatcctccagaacttctctttggcaagccctgtggctcctgaggacattgacctcagtcccattaacagtggtataagcaaaataccctcaccataccagattcacttcctgtcccgctgtgtgggttgagagaggagtgtcaacgtctcacttttccccaactccataccctgtgaatggaataggaaaagctaatgaagggcctttcttgatgtaaagacagagagacttctggaggccacagcttgttctgagtcacctctctcatgcttgttaacagccatagtccctacttgccagtctatattccaggatctgtgtgaatagactacagatggtttctcttgagttggctccaccctactccgtgtgttgtgttggagggtcatgtgtgaggacctcattgatagatgagtaagagaccccatgaatgtatcacagtgctagtgagtggtggggacaagatcacgctgtgagtttagaagtgtgacccctctcctgcttgtgtttacatgcagatgaaatccatataacgaagctgacaaaattttttagttttgtattcagtgccagaggctcatgtagttcacactgacctcaaaatcctatatatattcaaagatgtcttgaaatctcgatctcctgaccagtgctgccatcacaggcacatggacctacacccagattttaacatgactatatcttaatgtttatattttaatctcctttaatttattcacaatacgtacaacttcactatctaattccaggtatcttgtcccatttaaccaacaccactccaagccccaacctattcaaagatcagtccctcattcgttctctccataacctcccctgcactggacacccacagtgccacttttgtttgacctttgtgtcaatggactggcctgacctgtgtgtcttgtagaaaaggcaaggatgtgaccttgcatgctggctgccttttatgccacacccaacttctcaggcccctgtactgtgcaggccacagtcacacaccttcacagaccttccccattcgctctcttagattctttaccctgaatcttctctctagacaaggatctcctcagccctccacccctgagctgtgtgactctacttagattctcgaacatccccctgtaagtcctccatggatctcataaatacaccaaccttcctcaccaatcaaaaaaggatccctggtatgattttgtttgagcgtggtttgcttgcttgtttgtagagacaggatctcactatctacctctggctggtcttgagctcactgaattc

SEQ ID NO: 2888 - DNA, 2880 bp, Rattus norvegicus
  Genbank Accession No. D17521
gcgactcctgcagcttctcttccagttcagcgggtcagggccggtccggtcgggatcgctctgctgccagctcagtgccggtgcgctcggggcgggcccgccgtccggaggatgaggctggagtgggcggaggcgtgagaaccgggttactttcctcccgaggtggagcgcggctgccctgtagtcctttgaaagcgctgtgaacccggagactcaagtcggggcagaggcaggttgactagagggcccgctagagccggagattgaacttcaccccgaaaccagcctccgccagtcccacctggccgcatttacgtaacctcttcccaaagccgggtagcagtgaagtccgccggggtggccacccggcagccgtgtcccggtgaagctcccggggcggctggcgcgggatctcaagcagatgcggggtccacaggcagcgcatccaccagccgccgagcttgctatgcctctgagctgcaaggaactcattatacaatgacaaatggaggcagcattaacagctccacacacttgctggatcttttggatgagcccatcccaggtgtcggtacatacgatgatttccatactattgactgggtgcgagaaaagtgtaaggacagagaaaggcacagacggatcaacagtaaaaaaaaagaatcagcatgggaaatgacaaaaagtctatatgatgcttggtcaggatggcttgtagttacactgacgggattggcgtcaggggcgctggctggattgatagacattgctgctgactggatgactgacctgaaagagggcatctgcctcagtgcattgtggtacaaccatgaacagtgttgttggggctctaatgagacgacgtttgaagagagggataaatgtccacagtggaaaacatgggcagagttaatcataggtcaagcagagggtcctggatcttatatcatgaactacatcatgtacatcttttgggctttgagttttgcctttcttgcagtttccttggtgaaagtatttgctccgtatgcctgtggctccggaattccagagattaaaactattttgagtggattcatcatcagaggttacttgggaaagtggactttaatgattaaaaccatcacattagtgctggctgtggcatcaggtttgagtttaggaaaagaaggtcccttggtacatgttgcctgctgctgtggaaatatcttttcctacctctttccaaagtatagcacaaatgaagctaaaaagagggaggtgctgtcagccgcctcagctgctggtgtctctgtggcttttggtgcgccaattggaggagtgctttttagtttggaggaggttagctattattttcctctcaaaactttatggagatcgttttttgctgctttggtggcggcctttgttttgagatccatcaatccatttggtaacagccgtctggtccttttttatgtggagtatcatacaccatggtacctttttgaactgtttccttttattctcctaggggtatttggagggctttggggagctttttttattagggcaaatattgcctggtgtcgccgacgcaagtccaccaaatttggaaagtatcctgttcttgaagtcattattgttgcagccattactgctgtgatagccttccccaacccatacacaaggctcaacaccagtgaactgattaaagagctgtttacagactgtggccccttggaatcctcctctctttgtgactacagaaatgacatgaatgccagtaaaattgttgatgatattcctgaccgaccagcaggcgttggagtatattcagctatctggcagttgtgcctagcactcatatttaaaataataatgacagtattcacttttggtatcaaggtcccgtcgggcctgtttatccccagcatggcgatcggagccattgcagggaggattgtggggattgctgtggagcagctcgcctactaccaccacgactggttcatcttcaaggagtggtgtgaggtcggggctgactgcatcactcctgggctgtatgccatggttggtgctgccgcatgcttaggtggtgtgacaagaatgactgtctctctggtggttattgtttttgaacttactggaggcttggaatatattgttcctcttatggctgcagtaatgaccagtaaatgggttggtgatgcctttggtagggaaggtatttatgaagcacacatccgactaaatgggtaccctttcttggatgcaaaagaagaattcactcatacaaccctggctgctgatgtcatgagacctcgaagaagtgaccctcccttagctgttttgacacaggacaatatgacagtagatgacatagaaaacatgattaatgagaccagctataatggctttcctgttataatgtcaaaagaatctcagagattagtgggatttgccctcagaagagacctgacaattgcaatagaaagtgccagaaaaaaacaagaaggtgttgttggcagttctcgggtgtgctttgcccaacacactccatctcttccagcagaaagtcctcggccattaaaactgagaagcatccttgacatgagtccttttacagtgacagaccacaccccaatggagattgtggtagacgtcttccgaaagcttggtctgaggcagtgccttgtcactcacaatgggcgcctccttggcattataacaaaaaaagatatcctccgtcatatggcccagacggcaaaccaagaccccgcttcaataatgttcaactgagtcctgtagatgaggagagagaggagacagaagaggaagttcgtttgttgaatagcacaattctttaatctgcgggactcgtccacttttttcttcttt

SEQ ID NO: 2889 - DNA, 3631 bp, Rattus norvegicus
  Genbank Accession No. D25290
cctgggcgagtggcagggtgtccccaggagccggaaggcaaacagagataccctctgaaagccaagcagagaacattaaggaagaaaggaggaatgagcctgggtctggtgcggtgaaaagagacgcattaaggaaaggggaactcacaacccagacgctccactgccagccttgccatcagcatgagaacttaccggtacttcttgctgctcttttgggtcggccagccctacccaactttctcaaacccgttatctaaaaggactagtggcttcccagcaaagaggagggccctggagctctctgccaacagcaggaatgagctgagccgttcaaaaaggagttggatgtggaatcagttcttcctcctggaggaatacacgggatcagattatcagtacgtcggcaagttacattcagaccaggatagaggagatggatcacttaaatatatcctttcaggagatggagcgggagatctcttcattatcaatgaaaacacaggcgacatacaagccaccaagaggctggacagggaagagaaacccgtttacatccttcgagcccaagctatcaacagaaggacagggagacccgtcgagcctgagtctgaattcatcatcaagatccatgacatcaatgataatgagccaatattcaccaaggatgtttacacagccacagtccccgagatggcagatgtcggaacatttgtagtccaagtcacagcaactgatgccgatgacccgacgtacgggaacagtgctaaagtcgtgtacagcatcctgcagggacagccctacttttcagtggagtcggaaacaggtatcatcaagacagcgttgctcaacatggatcgagaaaacagagagcagtaccaagtggtgattcaggccaaggacatgggcggccagatgggaggactgtcggggaccacgaccgtgaacatcacactgacagatgtcaatgacaatcctcctcgcttcccccagagtacctatcagtttaagactcccgagtcttctccaccaggaacaccaattggcaggatcaaagccagtgatgctgatgtgggagaaaatgcagagatcgagtacagcatcacagacggtgagggacatgatatgtttgacgtcatcaccgaccaggaaacccaggaagggattataactgtcaaaaagctcttggattttgaaaagaagagagtgtacaccctcaaggtggaagcctccaatccccacatcgaaccccgatttctctacctgggtccgttcaaagactcggccacagtgagaatcgtggtagatgacgtagatgaacctcctgtcttcagcaaaccggcctacatcctacagatacgagaggatgctcagataaacacaaccataggctctgtcgcagctcaggatcctgacgctgccaggaatcctgtcaagtactcggtggatagacacacagatatggacaggatattcaacattgattctggaaatggctccatttttacatcaaaacttctcgaccgggaaacgctgttgtggcataacatcacagtgatagcaacggagattaataatccaaagcaaagcagccgcgtgcctctatatattaaagttctcgacgtcaatgacaatgccccagaatttgctgagttctatgaaacttttgtctgtgaaaaagcaaaggcggatcagctgattcagaccctgcacgctgttgacaaggatgatccttacagtggacaccaattctccttctctttggccccagaagcagccagtggctctaattttaccatacaagacaacaaagacaacactgcagggatcctaactcggaaaaatggctataacagacacgagatgagcacttatctcctgccggtggtcatttcagacaacgactacccagtccaaagcagcactgggacagtgactgtccgggtctgtgcatgtgaccaccatggaaacatgcagtcctgccacgccgaggccctcatccaccccacagggctgagcacaggggctctggtggccatccttctgtgcatcgtgatcctactagtgacagtggtgctgttcgcagctctgaggcggcagcgaaagaaagagcctttgatcatttccaaagaggacatcagagacaacattgtcagttacaacgacgaaggtggcggagaggaagacacccaggcctttgatatcggaaccctgaggaaccctaagccatggagacagcaatcgcgcagggacatggtgcctgaagctctttttctaccacggcggactccaacagctcgtgacaacacggatgtcagagatttcattagccaaaggttaaggaaaatgaacacggacccaacagcccctccctacgactccttggccacctatgcctacgaaggcactggctcggtggccgactccctgagctcactagaatcagtgaccacagatggagaccaagattatggctatttgagtgactggggccctcggttcaaaaagctggcagatatgtacggagggatggacagtgacaaagactcctaatctgttgccttttcattttccaatatgacactggaatatgtgacgtggctattcctttctatttatccactattccgtgaggggttctccgttgtacccgttccaaaagtcaatggctgcagtccgtgtggatccaatgttagagacttttttctagtacacttttatgagcttctaagaggcaaatttttattttttagttcatgcagttaaccaagttagcccagcaggcacgctgcgggaggagaggaaggaacggcgtttttcccgtgttccccttagagcaggttggccacgccccttactgctggcctagactctactttggttcacggcctccattccgctgaatgctccaaatgtacatttcacatgctacacatgctaatgaagaagggatcatactttgatgattaaaaatatagttttagtatttaaaaggggggagggaacaattgggaaattgatcctggtctatcagttgtcaaggagataattaactgtgaaggggtttgtaaggatatgcgtgtgtcaaggaatataaagtggggcatcctgtctgtgctggaaggggtgtttctggcatcaacaaatactcgtaatgctgaatccttccatgttctaagatggcttagaagcaaatcaagtggtatcatgttcaaagacagtaacgaaagacagggctgtgttccctgacgagattttgttgcatgtgataaacagatgcttcaccatcatgccaaacaaaggaaaaaagagaaatagctttacaaaaaaaaattaacaaaggacatatttagggaatttcaaggttttgtactaccaacagtatcccgggtcccttcattctttcaactatcagtaaactaatgagaagtaggtctaatcatataagcgtccttgagagaatttcctgaggcaaatgttaactctttgtctgtagttgttgttactattatcctactatacctgagtgtagcagtgtgaagtacaataattcatattcttcaaaaaaagaaaaaaaaaggatccgcggccgccgaattcagcttggacttaaccaggctggaacttgcta

SEQ ID NO: 2890 - DNA, 1500 bp, Rattus norvegicus
  Genbank Accession No. D28557
taaccgcgccaaccgccaccgaggtgcccggagagaggcggagaggcggcatgagcgaggcgggcgaggccaccaccggcggcaccacgcacccgcaggccgcggccgacgcgcccgccgcggcgcccccggaccccgcgcctaagagcccggcggccagcggcgcgccccaggccccggcgcccgccgcgctgctcgcgggagccccggcgagagccagcccccgggcccgccccggcctcatcagcccccgcgggaagcgaggacgcgagaagaaagttctcgccaccaaagtccttggcactgtcaaatggttcaacgtcagaaatggatatggatttataaaccgaaacgacaccaaagaagatgtgtttgtacaccagactgccatcaagaagaataaccacgtcaagtatctgcgcagtgtgggggatggagaaactgtagagtttgatgtggttgaaggagaaaagggtgctgaagcagcaaatgtgactggcccagatggagttcctgtagaagggagtcgctatgctgctgatcggcgccggtacagacgcggctactatggcaggcgccgaggacctccccgtaatgctggtgagattggagagatgaaggatggagtccccgagggagcgcagctccaggttcatcggaatcccacttaccgcccaaggttccgcaggggacctgctcgcccacgacctgcccctgctattggagaggctgaagataaagaaaatcagcaagcggccaatggtccaaaccagccgtctgcccgccgtggattccgacgcccctacaactacaggcgccgcccccgtcccctcaacgctgtttcacaagatggcaaagagaccaaggcaggtgaagcaccaactgagaaccccgctccagccaccgaacagagcagtgccgagtgaccctggctcccaggcaccttcaccaccagcagggtgaccttaagaattaatgaccattcaaaaacaaggcaaaaagcacacccacgaccttaccaacaccaaagaaacatctaagcaataaaacggaagactaacaagatttggacattagaatgtttactgctattctctacgaaactaacaactgcaaagggaaggagcccgcactgtccatcaagctgcgtcccgggaacctgcacaggcagagagcagcctccccatttcagcaacctagtgctttatatttttttcctggtttttactgttttggtaatatgaattaaaagaagaaatattaataccacatggggattgccccaaccaaagaaatctgaaatatatagtaaatgctctttttcctttgttgttcattttggatgctggtgctaaacttccaagtgtcatgatttaagaagaaattttatgcccttatttattcctaggatgaggggagaacatttttgctttcttacatagctctctctgaaatgtgcagtaacaagttcctcaaaaataaaatttttaccttcaaaga

SEQ ID NO: 2891 - DNA, 2996 bp, Rattus norvegicus
  Genbank Accession No. D30734
ccgccttgacgggctacgcaggcggtagggctgcggtaggggccgggcggcaccatggcggcggcagcgcctgctgcggcggctttaaccgaggcgccggccgtcccgggcaccgcagaacccgagacgggagacgaggacagtcgtgaggtccgagtgctgcagagcctgcgcggcaggatctatgaagcaaaaaatttattgccatatcttggacccaacaaaatgcgggattgtttctgcactataaatttggaccaggaagaagtttatcgcacccaggttgttgaaaagtctttaagtccatatttcagtgaagaattttattttgagattccaagaactttccagtatttgtcattttatgtttatgataaaaatgttttacaaagagatcttcgtataggaaaagtagccatcaaaaaagaagacttgtgcagtcatagtggtaaagaaacttggttttcattgcagcctattgactcaaattcagaagttcagggaaaagttcaccttgaattaaaactgaatgaattgataacagaaaatggaactgtgtgccagcagcttgttgtacacatcaaggcatgccacgggttgcctcttatcaatggacaaagctgtgatccttacgcaacagtttccctcgtgggcccttccaggaatgaccaaaagaagacaaaagtaaagaagaaaacaagcaatccacagttcaatgaagtcttctactttgaggtaaccagatccagcagttacaccaggaagtcccagttccaggtggaggaggaagacattgagaagctggaaatcaggattgacttgtggaataatgaaaacctagttcaagatgttttcctgggggagattaaggttcctgtcaatgtgttaagaaatgattcctctcatcaagcctggtacttgctacaaccaagagacaatggaaacaagtcgtctaaacctgatgacctgggatccctcctgttaactctgtgttacacagaagactacgtgctcccatcagagtactatggacccttgaaagctttgctgctaaaatcaccagatgttcagccagtatccgcctcagctgcttatattttgggtgaaatatgtcgagaccagaaggatgccgttttgcccctcgtacgactgttgctgcatcacaataagcttgttccctttatcactgcggtggctgacctggacttgaaggatactcaagatgccaacgcaatatttagaggaaactccctggctacccagtgtctgactgagatgatgaagatagtgggagggcactacctgaaagtcacattgaagcctgttctggatgagatatgtgagtcctcgaaatcctgtgaaatagatcctgttaagttgaaagagggagataatgtggagagtaataaggagaatctgtactactatgtggacaaagtattcagtgcgatcgtaggatcgagtgtgagctgtcccactgtgatgtgtgatattttttattctctgagacagatggctgctaagagatttcctaataaccctcatgttcagtactctgccgtgagcagctttgtgtttcttcgtttctttgctgtagcgattctgtcacctcatgcttttcatttgcgacctcattatccagatacacagacagttaggactttaactctcatctcaaaaaccattcagattattggaaactggggatgtcaatccagaagaaagtcacggttcaaaaagtcagtcatgtgtgaatttctcaaaatgtttcaagaagaaaggtattttacagacgtgaaaaagttcttggatgaaatttcgtctacggaaactaaggagtccagtggtacgagtgagcctgtgcacctgaaagaaggtgagatgtataaaagagctcaaggaagaacccgtattggaaaaaagaacttcaagaaacgatggttctgcttgacaagcaaagagctcacctaccacaaacagcaaggcaaagatgcaatttacactattccagtaaagaacattcttgctgtggaaaaactggaagaaagctctttcaacaagaaaaatatgttccaagtgatccatacggagaaaacgctgtacatccaagcgaataactgtgtggaagctaatgagtggatcgacatgctgtgcagggtgagcaggtgcaaccacaacaggctcagctccttccacccgtcagcatatctcaacggaaactggctctgctgccaggagaccagtgaaggcacaccaggctgcaagccatgcactgcaggcatccctgcagacatccagatagatattgatgaagacagagaaacagaaagaatttactccgtttttaccctcagtttacttaaactgcagaagatggaagaggcttgtgggtctatagctgtatatcaggggccacagaaagaacctggttattctaagttcaccatcgaggattctgtcgcaacctttaagacaattcagcaaataaaaagcaccatagagaaactagatgaacctcatgagaaatacaggaagaaaagatcgagtagtgcaaaatacggaagcaaggaaaatccaattgtgggaaaaatatcatagtgtttgatcaactgacggagaactggaaaatactcttatcatcaagtttttcaattcaccccatttgttccagtgtgtaagagcagacattggctttgaagacacctgctcttgcaatgtatttaatatttaatgattgaaattaactggggatcctgatactgatgtgtttattactaaagaatttgaaaaccaagatttccttcatagccatgcatccaaatccatgtctctgcaacttcctttcaacagaaaggatctttctaaggaacgttcccaagaagctttgtaataagggagcacttgctagcaagaagccatctctacttggagcactcctgtgtcactcactaccatcagtgcctgccctgtgctgccaacattgagcttccagagaa

SEQ ID NO: 2892 - DNA, 3383 bp, Rattus norvegicus
  Genbank Accession No. D31838
cgaacttgcggagaccttcaccagcagtggaccggtcagtctccgctggacataatcgcgccgcagtcgtcgccgtcgcggcgtcgggagcttggcaggcctcggagtcgccgccgctgacccggcgcaggcccgctgcagcctcagccgggcgcgccggatcgcacgtggcggacccgccccctgtgccagccgcgacctggacgccgccggcctgtgctcgccggtcctctgctctccggtgctccgccgtgactgcagccgggaaatgagcttcctgagccgacagcagccgccgcccacccgccgcgccgcagccgcctgcagtttgcggcagaagctcatcttctcacccggcagcgattgtgaggaggaagaggaggaggaggaggaaggcagcggccacagtacgggggaggactcggccttccaggagcctgattcgccgctgccctctgcacgcagccctgccgaggccgaggccgagcgccgccgccgctcgcccggcgcggagcccagcagcccgggagagctggaggaggacttgctgctgcggggcggcggcgggggcgcgcaagcggcgggcggaggagccgagggcgactcttgggaggaggagggtttcggctcttcgtcgcccgtcaagtcacctacgactgcctactttctgggcagctcgttctcgccggtgcgctgcggcggccctggggatgcctccccgcggggctgcggggtcccgcgagccatggacgacccctgttctccgcagcccgactacccgagcacccctccgcacaagaccttccgcaagttgcgcctgttcgacacgccgcacactcccaagagtttgctttccaaagctcgagttattgattccagctctgttaaactccggggtagttctctattcatggacactgaaaaatcaggaaaaagagaattcgacacacggcaaactcctcaagtgaatattaacccctttactccggatcctgtaatgcttcattcctcaggacagtgtcgtgggagaaagagagcatattttaatgattcctctgaagacatggaagccagtgattatgagtttgaagatgaaacaagacctgccaaaagaattacaattactgaaagcaatatgaagtcacgatatacaactgaatttcatgagctggagaaaattggttctggagaatttggttctgtgtttaaatgtgtgaagaggctagatggatgcatttatgccattaaacgatcaaaaaagccattggctggctctgttgatgaacagaatgctttgagagaagtgtatgctcatgctgtgcttggacagcatccccatgtggttcgttatttctctgcctgggcagaagatgaccatatgcttatacagaatgaatactgtaatggtgggagtttagctgacgctgtaagtgagaactacagagtcatgagctactttactgaagcagagctgaaggatctccttttgcaagttggcaggggcttgagatacatacattcaatgtctttggttcacatggatataaaacctagtaatatttttatatctcgaacctcaatcccaaatgcagtctctgaagaaggagatgaagatgactggatatccaacaaagttatgtttaaaataggtgatcttgggcatgtaacaagaatctctagtccacaagttgaagaaggtgatagtcgttttctagcaaatgaagttttacaagagaactatagccatctaccgaaagcagatatttttgctcttgctctcacagtcgtatgtgctgctggtgctgaaccccttcccagaaatggagaccagtggcatgaaatccgacagggtcgattacctcggattccacaagtgctttcccaggagttgacagagttgctaaaagttatgattcatcctgatccagagagaagaccttcagcaatggtgctggtgaagcattcagtgttgctgtctgcctctagaaagagcgcagagcagttacgaatagaattgaatgctgaaaaattcaaaaattctcttttgcagaaagaactcaagaaagcccaaatggcagccaaagttgcagctgaggaacgggcactcctcacagatcggatggccactagatctaccacccagagtaatagaacttctcgacttattggaaagaaaatgaaccgctctgtcagccttactatatactgaactgcttacattccccagcccttccccctcaaaggacaaaaaaaactgtgacaagaggaagctaggttgaaatcactgctagaatccactttgcaattactttgccattggtgtcagtagttttcctaaaatgccttttgtgactttgtgaattacagttgagagctgtattctgacttggctctgtcaggcttttgtctcatcttcccgtctgtttcatgtaggatgtcagtcactgttggatgttccaccaccctttgcggggtgagcactgtggtggtgtgctgcttcgtcattcactgttgccgtgtgatgaaaggtgtctttccttgttttgactgtggaaaggactcgagggctttactgcgatcatcctctcccttcaaaaagggaaatgctcagagactcagtactactcagcctccaatgtacctgtgtcaatcttaacgtttctttttttctattgtgaattatacttgtatatccaactgggagcactttaggcatcatgtgcaccatgggatggtcattctgtggaagccttgccttgtgaatttggctgctattttagtttcctcttgctgtaaaactagcattaaacaatcattgttgttaataggctttctttcaaaacaattatgtgaaatatgtagctgctcttcatgaaaagcagctttgcctccttttctttggactttgaagctagtgcattgaaaaagtgcacctaccccttccctgttcgaatgctgtattaatgtagtataattattactggttttgtaaatttttcttataatgtcctctgactttaaaacatgtttccttcctcctgtcaagtcttgtacttggttgtatggttagcctatttttaaatgttttgcccagtttctcttcaatactttgtgtatataaactgatcttggtaatactgtacatagctgtttaatatatccagaatgacttctgactattcaagttttttcacaaaattacattttacctgtgatttagccatttgactaacagtgtttggctagtagatgttgccctccaaaatgagggggaaattgtctcattttgtttttcattaactttgcggaaacacccattgcactgtctgtttgaaacccccctgtgcttattaacattacggcgattaaaagcacggcacacc

SEQ ID NO: 2893 - DNA, 4492 bp, Rattus norvegicus
  Genbank Accession No. D37934
gtggtcgacggtatcgataagcttgatatcgaattccggcaccacaacatagctgatgggtgatgccaaagaagaggcaggcactggtagagtttgaagatgtgctgggggcttgtaatgcagtaaactacgctgcagacaaccagatctacattgctggtcaccctgcttttgtcaattattctaccagccagaagatctctcgccccggtgactctgatgactcccggagcgtcaacagtgtgcttctgtttaccatcctgaaccccatctactccataaccacggatgttctttacactatctgtaatccttgtggccccttgctgatgagggaggcgaagggctgcacctgcagggaggtgcccatgatgatgaggaggtccacctttgagagtctgactgcatgcaggagaagaagcgcggtgggaggttctcaccgaaaaacacgatatcgggctttaccacattctgacacttctcacacttgggagttgcttctgagaagatcttctctttcatccagctcatcgtgtactcttttccacaggaggtgttgacacagtgtgatgtgtagaaggtgccgtgggcctccaccaggtcctggggctccagccccgccactcgttccagagtgtcaatattctgcgtgtagcagcgcagcagcagccccttctccttcagcaggcggatgaagtagtggcagatggtcggcttgaactgcccaggatagagctccttagcaagggcaaagaagggttctggatgtttcttgaagtagctgatctcaaagatggcctctgggtatggaaggtggtatttctccaagtttgcatagaggccagtggatggggagcggaagtcagggattcctgcggatgtggagattccagctcccaccaaacagatgaccctgcgacagcgctcgctctgcatgtagcgtgtcactccttcaagggtcagctcgtccagcagacgctccttctgggaaccaggcccagggtctgggtgaataatattccgcaggaaggtccatctctgcctctccgccagtggctcctccctcagtgtccgagtctgaatcggtccggctcggccatgggaacggggtgggggctctcgggactgtcaccgactgctctgtcccgtgacggctacgagaccgagacccctttttcccccgagggagccttcccaggtggggggccggccgaggaggaaggggtccctcggccacgggctccccccgagccacccgacccaggagcgccccggccacccccagacccgggtcccctcccactcccagggtcccaggagaagccaacctttgtagttcaggtgagcaccgagcagctgctgatgtctacgggaggatgtgacaaagaacctcctaggggacaaggggtcgacacccggggagacaggacccaggaaggcggggagaagccccgcgaacagagagaagggcccaggcccgaacagggacctgacatccctggtcagcaggaagaaagtccccagcaggagccttccagtgaacggggtgacagtgttggagaacgggaagccaggagtcccggacatgaaggagaaggtggcggagaatggcctggaatctccggagagaggagagagagccctggtgaatggggagccgatgtccccagaggccggggagaaggtgctggcgaatggggttctgatgtccccaaagatcgaggagaaggtggcagagaatggggtcctgaggctgcccaggaacacggagaggccgccagagactggacttcggagagtcccaggaccctgggagaagatgcccgagactgggggtctagctcccgagacgctgctggatcgagcccctgcgccctgcgaggcagtcttgccccagaacggcttggagatggcccctggccagcttggcccagtccccaagagcgggaacccggaccccgggaccgagtggagagtccccgagagtgggggggcaccgagagcccccggggctgggaagctggacctcgggagtgggggccgagccccggggggcgcggggacggtccccgccggcggccccgcaagcgccgtggacgcaaaggccggatgggtagacaactcgagaccactgccacctccgcctcagccactgggggcccagcagaggaggccggagccagtgcccctgaaggccaggccggaggtggccccagaggaagagccaggggtcccagacaacaggctcggcggagacatggcccccaacgtagacgaggacccccccaagccggagaggaagggcccggagatgccacgcttgttcttggacttgggaccacctcaggggaacagcgagcagatcaaagccaaactctcccggctctcgctggcgctcccaccgctcacgctcacgccgttcccgggcccgggcccgcggcggccaccttgggagggcgcggacgcaggggcagctggcggggaggccggcggggcgggggcgccggggccagcggaggaggacggggaggacgaggacgaggacgaggaggacgacgaggcagcgggctctcggggacccgggaggacgcgggaagccccagtgcccgtcgtggtgagcagcgccgacggggacacggcccgcccgctgcgggggctgctcaagtctccacgcgcggccgacgagccagaggacagcgaactggagaggaagcgcaagatggtctccttccacggggacgtgaccgtctacctcttcgaccaggagactccaaccaacgagttgagcgtccagggcacccccgagggggacacggagccatcaacgcccccagcgcccccgacgcctccccaccccaccaccccaggagatgggtttcccaacaacgacagcggctttggcggcagtttcgagtgggcggaggatttccccctcctccccccaccaggcccccccctgtgcttctcccgcttctccgtctcacctgcgctggagaccccggggcctcccgcccgggctcccgacgcccggcccgcaggccccgtggagaactgactccccaaagacccagcccttttgcaccccaagaagagggtttgcgagcagaatcttgtgtggacgatggagccattgcccccgacactgacacagcctctggggaggtgcctgaggctgggccctccctctcctccaccatgtgccaaatgggaaggcccaggccctcccccaagtcccccagatgagtcccctgatccccctgatccccccgaccccctcggagccacatgaggcagaaagccccatcgctgaacagccacacttcttggaactgaactgaactctgtgggcccagagcccctggcacagcagaggcccctcctggcctcatgagggtcactggcttcaggaacctgggcccccatcttgcgtctccccttcccccaagcctggcccctagagggggcctctaattcaaaccttcgcgtgacattttcacattatttaaaaaaaaaccggaatttttttttttttttctttgttttagtcaccatcttaggcttttactgctgtgaacagacaccattaccaaggcaaatcttataaggacaacatttaattggggctggctttcaggttcagaggttcagtccattattatcaatgcaggaacatggcagcatccaggcaggcatggtgcaggcagagctgagagttctacatcttcatttgatgtctgctagcagaatattggcttctaggcaactaggttaagggcttaaagccacaagcacagtgacacacctattccccttctaatagtgcactccctggactgagcatatacaaaacatcacagtcccaataactagtgccaagggacataaaatgttctgccagtggttaaaagtatcttctgtgctttttgaaatttcttgggctactccaatgaaagctgtgtatgtatctctccctgcacagctttcattggagtagcccaagaaagctgtgcagggagagatacatacaccgttctttactggtgatagcatccccaaagtttaccaaagaatagctcttgcttaatatctagacatgctctcaatttgttagctatgcattttctccaccgcagccacctgaggttagcaatcagcgggtgcatgagttcactccacagggttgctaccgaattaattcgcggccgccacaactccagtgctgttggcccatggggaacgggcggagtggccactgaggagtttctccctgtcaccccaattctggaaggctttgtcattcttcgaaagaaccccaactacaatctttgaaaaatggctgacactagagaccctggctgcagctgactttttttagcaggctgtactgcccctgccaggggcagatactgttccagatctttgggggaattgttacctcctgctgttttgttactgagtaagataatcttgtcgaataaagacctttatcccc

SEQ ID NO: 2894 - DNA, 864 bp, Rattus norvegicus
  Genbank Accession No. D38066
atggacacaggattgtgtgcaccccttcgaggactctcaggactgctgctcctgctgtgtgccctgccctgggctgaaggtggaaaggtgctggtgtttcccatggagggcagccactggctgagcatgagggatgtcgtgagggagctccacgcccgaggtcaccaggctgtggtcctggctccagaggtgactgtgcacatgaaaggagaggacttcttcaccctccaaacctatgcctttccatataccaaggaagaatatcagcgggaaatactgggcaacgctaagaagggcttcgaaccacaacattttgtgaagactttctttgaaactatggcatctataaaaaagtttttcgatctctacgcaaattcttgtgcagctctattgcacaataagaccctgatccagcaactgaattccagttccttcgatgtggtcttaacagaccctgttttcccctgtggagcattactggccaagtatctacagattcctgctgtgttttttctgcgctctgttccctctcccatagactatgaggctacacaatgtccgaaaccttcctcttatattccgaacctactcacaatgctttctgaccacatgaccttcctgcaaagggtcaagaacatgctgtaccctctgaccttgaagtacatttgccatttatcaatcactccctatgaaagcctggcctctgagcttttgcagagagaaatgtctttagtggaggttctcagtcatgcatctgtgtggctgttccgaggggactttgtgtttgactacccgaggcccatcatgcctaatatggtcttcattggaggcataaactgtgtcatcaagaagcccctctctcag

SEQ ID NO: 2895 - DNA, 393 bp, Rattus norvegicus
  Genbank Accession No. D45240
caggttctatcatggaccagatggaggctttgcccggctcagccatttggtgctctgtggcttctctgctccttcctgaagccccttcttgaaaggtgaagtggccagtaacccacggcctccacctttcacccactctctttacttccttacccagcaacaaactcatcatctcagagaactgctctgattggctgcttactgcaagggtcttcccctaacctagactccgtttctttttatctccatcttgctcccttgctccccaaacaaacgttgttaaagccacccagcccggcaatggtcctctttgtggagctggtccaggtatttctaaccataatgagcttcctgggtccccggggagtatgggccatcaagggtaagtgctgg

SEQ ID NO: 2896 - DNA, 846 bp, Rattus norvegicus
  Genbank Accession No. D45247
cgttgctgtcgggcgctggccagcgtgttgcagcggccgatgccggtgaatcagcacgggttttttggactcggaggtcgtgcagatctgctggacttgggtccggggagtcctggtgatgggctgagcctagccgcgccgagctggggtgtcccggaggagccacgaatcgaaatgcttcatggaaccaccaccctggccttcaagtttcagcatggagtcattgttgcagcggattcccgggccaccgcaggtccctacattgcttcccagacagtgaagaaagtgatagagatcaacccttaccttctgggcaccatggctgggggtgcagcggattgcagcttctgggagcggttgttggctcgacagtgtcgaatctatgagcttcgcaacaaggaacgcatctcggtcgcggcggcctccaaactgcttgccaacatggtgtatcagtacaaaggcatggggctgtccatgggcaccatgatctgtggctgggataagagaggcccgggcctctactatgtagacagtgaggggaacaggatctctggaaccgccttctcagtgggatctggctccgtgtatgcgtttggagtcatggatcgaggctactcctatgacctacaagtggaggaggcctatgacctggcccgccgagccatctaccaagccacctacagagatgcctactccggaggagcagtcaacctctaccatgtgcgggaggatggctggatccgtgtctccagtgacaatgtagctgacttacatgacaagtatacttcatctatcccctgagggaaggtggagtgccctggttataataaataatagtacccgttc

SEQ ID NO: 2897 - DNA, 1603 bp, Rattus norvegicus
  Genbank Accession No. D49434
gaattcggcacggctcggtcatccgcacgccgcacctggatgcgctggcggccggcggcgtggtcctggacaactactacgtgcagccgctgtgcacgccctcgcggagccagctgctcaccggccgctatcagatccatatgggcttacagcattacctcatcatgacctgtcagcccaactgtgttccgctagacgaaaaactcctgccccagcttttaaaggacgcaggctcaagtacgcatatggtcggaaaatggcacctgggaatgtaccggaaggaatgcctgccaacccgcagaggattcgatacgtacttcggatacctcctaggcagtgaagactactacacccacgaggcctgtgcaccgattgagtgtctgaacggtacccgctgtgcgcttgatctccgagatggcgaagaacctgcaaaagagtatacagatatttactcaacaaacatatttaccaaaagggctacaaccctcatagctaaccacccccccgagaaaccactgttcctctaccttgctttccagtctgtccacgatcccctgcaggtccccgaggagtacatggagccatatgacttcatccaagacaagcacagacgtatttatgcagggatggtgtccctcctggacgaagcagtggggaatgtcaccaaagccttgaaaagccgagggctctggaacaacacggtcctcatcttctccacagacaacggcgggcagactaggtctggaggcaacaactggccacttcgaggaaggaaagggaccctgtgggaaggtggcatccgaggagcaggtttcgtggcaagccccttgctgaaacagaaaggtgtgaagagccgggagctcatgcacatcaccgattggcttccaacgctggtgaatctggctgggggaagcacccatggaaccaaacctctggatggcttcgacgtgtgggaaacaatcagtgaaggaagcccatccccaagagtggagctgctacttaacatcgatccagactttttcgatggcttaccatgtcctggcaagaacacgactccagaaaagaacgattcttttcctttagaacattctgcctttaacacatctatccatgctgggatcagatacaaaaactggaaactcctcacgggctacccaggctgtggttactggttcccgccaccgtctcagtccaacatctctgaggtaccttcagtggactcaccaaccaagactctctggctctttgacatcaatcgggaccctgaagaaagacatgacgtgtcccgggaacatccccacatcgtccagaaccttctttcccgcctacagtactaccatgaacattctgtgccttcttacttcccacctttggacccccgctgtgatcccaagggtaccggtgtatggagcccctggatgtagggctcaggggaggtggggctggagtacatttctgtgcaggctagcctcaggcccatactctcctggcttctccatcatcccccaccctgtcacctggccctcacgctgtataacccactgagggagtccaatttcaacccacagtacatttttaaagccagtaaaatctggaaggatcc

SEQ ID NO: 2898 - DNA, 2155 bp, Rattus norvegicus
  Genbank Accession No. D78610
cccaaacagttcagataccgctggtcaggcctgcgctgtacacagctcagccatgagcagcagaaagaacttttccaggctcacctggttcaggaagcagaggaaagccgtggtcaacagcaacgacaagaagatgcctaacgggatcctagaagaacaagagcagcagagagtgatgctactgagcagatctccatcgggtcccaagaagtacttccccatccctgtggagcacctggaggaggagatccgggtgagatctgcggatgactgcaagcggttccgagaggagttcaattcattgccatccggacacatacaaggaacctttgaactagcaaataaagaagaaaacagagaaaaaaacagataccccaacattctgcccaatgatcattgcagagtgattttgagccaattggatggaatcccctgctctgactacattaatgcttcctacatagatggctacaaagaaaagaacaaattcatagcagctcaaggccccaagcaggagacagtgaatgacttctggagaatggtctgggagcaaaggtcagccaccattgtcatgttgacgaacctgaaggaaaggaaggaggagaagtgctaccagtactggccagaccagggctgttggacttatgggaacatccgggtgtgtgtagaggactgcgtggtcctggtggattacaccatccgcaagttctgcatccatccgcaactccccgacagctgcaaagctccacggctggtctcacagctgcacttcaccagctggcctgactttggggtaccatttacccccatcggaatgctgaagttcctgaagaaagtgaagacactcaacccctcacatgctgggcccattgtggtccactgtagcgcgggcgtgggtcggactggcaccttcattgtgatcgatgccatgatggacatgatccactcggaacagaaggttgacgtcttcgagtttgtgtctagaatccgcaatcagcgccctcagatggtccagacagatgttcagtatacattcatctaccaagccttactggaatactacctctatggggacacggagctggatgtgtcctccttggagaggcacctgcagacgctacatggcacagccacccattttgacaagatcgggctggaggaagaattcaggaaactgaccaacgtgcgaatcatgaaggagaacatgaggacgggcaacctgccggccaacatgaagaaggcccgtgtaatccagatcatcccatatgacttcaatcgggtaatcctgtccatgaaaagagggcaagagttcacagactacatcaatgcatccttcatagatggctacaggcagaaggactacttcatggctacacaggggcctctggcgcacacagttgaggacttctggaggatggtctgggagtggaagtcacacacaatcgtcatgctgactgaggtgcaggagcgggagcaggataaatgctaccagtattggccaaccgagggctcagtgactcacggagatataactatagaaataaagagtgacaccctgtctgaagcaatcagcatacgagactttctggttactttcacacagcccctggcccgccaggaagagcaggtccggatggtgagacaattccatttccatgcctggcctgaggttggaatccccactgagggtaaaggcatgattgacctgctctcggcagtgcagaagcagcagcagcagacagacaaccaccccatcaccgtgcactgcagtgcgggagcagggcggacaggtacattcatagcactcagtaacattttggaacgagtgaaagccgagggactcctagatgtgtttcaagctgtgaagagcttaagacttcagagaccacacatggtgcaaaccctggagcaatatgaattctgctacaaagtggtacaagattttatcgatatattttctgattatgctaatttcaaatgaagatccctgccttaaaatattttttaatttaatggtcagtatattttgtaaaaaaaatcatgttaatttatttcctagtggatattaatatccgtcctgattcctttggtatatattttgttatgttctaaaggctacctgctgtaagattattaaatcataaatgtccttttt

SEQ ID NO: 2899 - DNA, 6857 bp, Rattus norvegicus
  Genbank Accession No. D83538
ttccagaatcgatagtggttcggcccacctctgaaggttccagaatcgatagtggttcggcccacctctgaaggttccagaatcgatagtggttcggcccacctctgaaggttccagaatcgatagtggttcggcccacctctgatggttccagcacctcccgaggtttttatttcaacacagtgctttcactggcccgctccctggctgtgcagagacctgcatccctagagaaggttcaaaattcggcccacctctgaaggttccagaatcgataggctctggttccagcacctcccgaggtttttatttcaacacagtgccttcactggcccgctccctggctgtgcagagacctgcatccttagagaaggttcaaaagctgctgtgcatgtgcccagtagattttcatggaatcttccagctagatgaaagacggagagatgcagtgattgctctgggcatttttctcattgagtctgatcttcagcacaaagattgtattgttccttatcttcttcgacttctcaggggtcttccaaaagtctattgggtagaagaaagcacagctcggaaaggcagaggtaacctcccggttgcagaaagcttcagcttctgcctggtgaccttgctgtctgatgtggcttgcagggacccctcgcttagggatgagattttagaggcacttttgcaggttttacatgtccttctggggatgtgccaggccctggagattcaagagaaagaatacctttgcaagtatgcaatcccatgcctgatagggatctcgaaatcttttggacgttacagcaattcagaagaatctctcctctcaaagctttttcccaaagtccctcctcattccctgagaatccccgaagagctagaaggtgtccgaaggcgttcctttaatgacttccgctccatcctgcccagcaacctgctgactgtctgtcaggagggcacactgaagaggaaaaccagcagtgtgtccagcatctctcaggttagcccagaacgtggcatgccccctcccagctcccctggaggatctgcttttcactattttgaagcctcttgcctgcctgatggaaccaccttggagcccgaatactacttctctaccatcagctccagtttttctgtctctcccctgttcaatggtatcacctataaggagttctatattccactggaaatgcttcgagaactcttaaacttggtaaagaagattgttgaggagcctgttctcaagtccttagatgcagctgtagccagagtgatggaggccaatcccagtgctgacctatactacacgaccttcagtgatcccgtctacctgaccatgttcaagatgcttcgagacactctgtactatatgaaagacttacccacctcctttgtgaaagagatccatgattttgtgttggagcagttcaacatgagccaaggggaactccaaaagattctccatgatgcagacaggatccacagtgagatgagcccactcaaactgcgctgccaagcaaatgctgcctgcgtagacctcatggtgtgggctgtgaaggatgagcagggtgcagaaaacctttgcatcaagctgtctgaaaagctgcagtccaagacatccagcaaggtcatcatcgcccatttgcccttgctgatctgctgcctacagggtctgggccgcctatgtgaacggttcccggtggtggtccactcagtgacaccatctttgagagactttctggtgattccatccccagtgctggtgaagctctataagtaccacagtcagtaccacacagttgctggcagtgatataaaaattagtgtcaccaatgagcattctgagtcaactctgaatgtcttgcccggcaagaagaaccagccatccatgtatgagcagctccgggacatcgccattgacaacatctgcaggtgcctgaaggccggcctcaccgtggaccctgtgatcgtggaggccttcctggccagcctctccaaccggctctatatctcccaggagagcgataaggatgctcacttgattcctgaccataccattcgtgccttgggacacattgcagtggctctgagggataccccaaaggtcatggagccaattctgcagcagaaattttgccagcccccctcacccctcgatgtgctcatcatcgaccagctgggctgcctggttatcactggaaatcaatacatttatcaggaagtgtggaatctcttccaacaaatcagtgtgaaggccagttcagttgtatattcagccaccaaagactacaaagaccatggctacaggcactgctccctcgcagtcatcaatgccctggccaacatcgcagccaacattcaggaggagcaccttgtggatgagctgttgatgaacctgctggaactgtttgtgcagctggggctggaggggaagagagccagtgagagggccagcgagaaggggcccgccctgaaggcttccagcagtgcagggaatttgggagtgctcattcctgtaatagccgtgctcacccgacgattgccacccatcaaagaagctaaacctaggctacaaaagcttttccgagacttctggctctactctgtgctaatgggattcgctgtggaaggctcagggctctggccggaagagtggtatgaaggagtctgtgaaatagcaaccaagtcacctctgcttacctttcccagcaaagagcctcttcgatcagtcctccagtacaactcagccatgaaaaatgatacagtgaccccggctgagctgaatgagctccgaagtaccatcatcaacttgctagatcctcctcctgaggtgtctgccctcatcaacaagctggactttgccatgtccacctatctcttgtctgtgtatcggctggaatacatgagggtgctgcgttctacagatccagatcgcttccaggtaatgttctgctacttcgaggataaagctattcagaaagacaaatctgggatgatgcagtgtgtcatcgctgttgctgacaaagtatttgatgccttcctgaacatgatggcagaaaaagccaagaccaaggagaatgaagaggagttggagcggcatgcccagtttctgctggtgaacttcaaccacattcacaagaggatacgcagagtggctgacaagtacctgtctggtctggtggataagtttccacacttgctctggagtgggactgtgctgaagaccatgttggacatcctgcagaccctgtcactatcactaagtgctgatattcacaaggaccaaccttattatgacattcctgacgccccctatcggatcacggttcctgacacgtatgaagcccgggagagcatcgtgaaagactttgctgcacgctgtgggatgatcctgcaggaagccatgaagtgggcacccacggtcactaagtcccacctgcaggaatatctgaacaagcatcagaactgggtgtcaggactgtcccagcacacgggattggccatggccactgagagcatccttcactttgccggctacaacaagcagaacacaactcttggggtaactcagctcactgagcgcccggcctgtgtgaagaaagactactccaacttcatggcatccttgaatttgcgcaaccgctatgccggcgaggtgcacgggatgattcggttctcaggtgccacaggccagatgtccgacctgaacaaaatgatggtccaggatctgattacagctctggaccacagtcatcctcagcactatacccaagccatgttcaaattgacggccatgctcattagcagcaaagattgtgacccacagctccttcatcatctgtgttggggtcccctccggatgttcaacgagcatggcatggagactgcactagcctgctgggagtggctgctggctggcaagaatggagtggaagtgccgttcatgcgggagatggcaggagcctggcacatgacagtggagcagaagttcggcctcttctctgcagaaacaaaggaagcagaccccctggcagcgtcagaagcaagtcagccacgaccctgtccccctgaagtgacacctcactacatctggattgatttcctggtgcagcggtttgagattgccaagtactgtagctctgaccaggtggagatcttctcaagcctgctgcagcgctccatgtccctccacatcggtggagccagggggagcatgaacaggcatgtggcagccattggaccacgtttcaaactgctgaccctggggctgtccctcctacacgctgatgtggttccaaatgcaaccattcgaaacgtgcttcgagagaagatctactcaacagcctttgactatttcagttgtccaccaaagttccctactcaaggagaaaagaggctgcgtgaagatataagcatcatgattaagttttggactgccatgttctcagataagaagtacctgactgccagccaactcgttcccccagataaccaggacacccgaagcaacttggatataactgtgggctctcgacaacaggctacacagggatggatcaacacataccccctctccagtggcatgtcaactatctccaaaaaatcaggcatgtctaagaaaaccaaccgaggttcccagctgcacaagtactacatgaagcgtaggacgctgctgctgtcactgttggccactgagatcgagcgcctcatcacttggtacaacccgctgtcagccccagagctagagctggaccaggcaggtgagaacagtgttgccaactggaggtccaagtatatcagcctgagtgagaagcagtggaaggacaacgtgaaccttgcctggaccatctctccatacctcgctgtgcagctgccagccaggttcaagaatacagaagccattggaaatgaagtgacccgtctcgttcgcctggacccaggagctgttagtgatgtccctgaagctatcaagttccttgtcacctggcacaccatcgatgctgatgctccagagcttagccatgtgttatgctgggcacccacggacccgcccacgggcctctcctacttctccagcatgtaccccccacaccctctcactgcacagtatggggtgaaagtcctgcggtccttccctccggatgccattctgttctacatcccccagattgtgcaggccctcagatatgacaagatgggctatgtgcgcgagtacattctctgggctgcagccaaatcccagcttctggcacaccagtttatttggaatatgaaaactaacatctaccttgatgaagaagggcaccagaaagaccctgacattggtgaccttctggagcagttagtagaagaaatcacagggtctctatcaggcccagccaaagatttctatcaacgggaatttgatttctttaacaagatcaccaacgtgtcagctatcatcaagccctaccctaaaggcgatgaaagaaagaaggcttgtctgtcagccctgtctgaagtgaaggtgcagcctggctgctacctgcccagcaaccctgaagcaattgtgctagacattgactacaagtcagggacaccaatgcagagtgctgcaaaagcgccgtatcttgccaagtttaaggtgaagcgatgcggagtgagtgaacttgaaaaagaaggtctgcagtgccgctcagacacagaggatgagtgccgcaggcaagaggctgatggcaagaagatctgctggcaagcagccatcttcaaagtgggggatgactgccgacaggacatgctagccctgcagatcatcgaccttttcaagaacatcttccagctggttggcctggacctcttcgtttttccctatcgggtagtggctactgcccctgggtgtggggtgattgagtgcattccagactgtacctcccgagaccagctaggccgccagactgacttcggcatgtatgactactttacacgccagtatggggacgagtctaccttggccttccagcaggcacgctacaactttatcagaagcatggcggcctacagcctcctgctgttcctgctgcagatcaaggacaggcacaacggcaacatcatgctggacaagaagggacacatcatccacatagactttggcttcatgtttgaaagctcaccgggtggcaaccttggctgggagccagacatcaagctgacagacgagatggtgatgattatggggggcaagatggaagccacacccttcaagtggttcatggagatgtgcgtccgaggttatctggctgtgcgcccctatatggatgcagtcgtctccctggttacactcatgttggacacaggcctgccctgtttccgtggccagacaatcaaacttttgaaacacaggttcagcccgaacatgacagagcgggaggctgcaaattttatcatgaagatcatccaaaactgtttcctcagcaacaggagccggacctacgacatgatccagtactaccagaatgatatcccctactgaggagactgtacctgaagccttgagtgtcacagagcagcttgtactgtcaccataagcctgggtgtggaggtgacaggcacatggaacttggatgcacaggtgtgagtctttttcacactggacacattccctatttgttcacccatcttactatgttggtacatgaagtattttcctgtgtaaacatgagaaattgacataaaaaataagaaccctaaaatgtgctacttctgtttgttaggtcaccaagactttgtccttagtcaaaggtaccctttgaatccctggtccttccaactcacacctagcttagtcttgctttgatttggtcctgaggatc

SEQ ID NO: 2900 - DNA, 1156 bp, Rattus norvegicus
  Genbank Accession No. D87991
cctggagctttcgccttcgcctccggtaccgctacctgttctgaacggatctccggccgactcgtccctgcgtctcatggccgctagcagatccctggtgcccgaccggctgcgcctaccactctgcttcttgggtgtctttgtctgctacttctactatgggatcctgcaggagaagataacaagaggaaagtatggagaaggacccaaacaggagacattcacctttgccttaactttggttttcatccagtgtgtgatcaatgctatgtttgccaagatcttgatccagttttttgacactgccagggtggatcgcactcggacctggctctatgctgcctgctctgtctcctatgtgggcgccatggtctccagcaactcagcactacagtttgtcaactatccaactcaggtccttggtaaatcctgcaagccaatcccagttatgctcctcggagtgaccctcttgaagaagaagtacccattggccaagtacctgtgtgtgttgctaattgtggctggcgtggctcttttcatgtataagcccaagaaggtggttgggatagaagagcacacggtcggctttggagagctccttctgctcttgtctctgaccctggatggactgacaggtgtttcccaggaccatatgcgggctcattaccaaacaggttccaatcacatgatgttgaacatcaacctttggtccacggtcttgctcggtgctgggatcctgtttactggggagctctgggagttcttgagtttcgccgagaggtacccgaccatcatctataacatcctgctctttggcttgaccagtgccttgggtcagagctttatcttcatgacagtcgtgtacttcggccccctgacctgctccatcatcaccacgactcggaagttcttcaccatcttggcttctgtgatcctctttgccaatcccatcagctccatgcagtgggtgggcaccgtgctggttttcctgggtctgggtcttgatgccaagtttgggaaaggaacaaagaagacctcccactaggaaaagagaggcttcctccactccagaaacacttaaattattatctccaacagtgacatcttgggaaaatggactcagtcacgataagggactgggttccaatctttttat

SEQ ID NO: 2901 - DNA, 3657 bp, Rattus norvegicus
  Genbank Accession No. D90109
ccaacacagaactatggaagtccacgaattgttccggtattttcgaatgccagagctgattgacattcggcagtacgtgcgtacccttccaaccaacacactcatgggcttcggggcttttgcagcgctcaccaccttctggtatgccacccggccgaaggccctgaagccaccatgtgatctgtccatgcagtctgtggaagtaacgggtactactgagggtgtccgaagatcagcagtccttgaggacgacaagctcttgctgtactactacgacgatgtcagaacgatgtacgatggcttccagagggggattcaggtgtcaaatgatggcccttgtttaggttctagaaagccaaaccagccatatgagtggatttcttacaaacaggttgcagaaatggctgagtgcataggctcggcgctgatccagaagggtttcaaaccttgctcagagcagttcatcggcatcttttctcagaacagacctgagtgggtgaccatcgagcaggggtgcttcacttactccatggtggttgttccgctctatgacacgcttggaaccgacgccatcacctacatagtgaacaaagctgaactctctgtgatttttgctgacaagccagaaaaagccaaactcttattagaaggtgtagaaaataagttaacaccatgccttaaaatcatagtcatcatggactcctacgacaatgatctggtggaacgcggccagaagtgtggggtggaaatcatcggcctaaaagctctggaggatcttggaagagtgaacagaacgaaacccaagcctccagaacctgaagatcttgcgataatctgtttcacaagtggaactacaggcaaccccaaaggagcaatggtcacccaccaaaacattatgaacgattgctccggttttataaaagcgacggagagtgcattcatcgcttccccagaggatgttctgatatctttcttgcctctcgcccatatgtttgagaccgttgtagagtgtgtaatgctatgtcatggagctaagataggatttttccaaggagacatcaggctgcttatggatgacctcaaggtgcttcagcctaccatcttccctgtggttccgagactgctaaaccggatgtttgacagaatttttggacaagcaaacacgtcagtgaagcgatggctgttggattttgcctccaaaaggaaagaggcggagcttcgcagtggcatcgtcagaaacaacagcctgtgggataaactcatctttcacaagatacagtcgagcctgggcgggaaagtccggctgatgatcacaggagcagccccagtgtctgccacagtgctgacgtttctgagggcggctctcggctgtcagttctatgaaggctacggacagaccgagtgcaccgctggttgctgcctgagcttgcctggagactggacagcaggccatgttggtgcccccatgccttgcaattatatcaagcttgtagatgtggaagatatgaattaccaggctgccaagggcgagggtgaggtgtgtgtgaaaggggcaaatgtgttcaaaggctacttgaaagacccagcaagaacagctgaagccctagataaagatggttggttacacacgggggacattggaaaatggctgccaaatggcaccttgaagattatcgacaggaaaaagcacatatttaaactagcccaaggagagtacatagctccagaaaagatcgaaaatatctacctgcggagcgaagccgtggcccaggtgtttgtccatggagaaagcttgcaggcctttctcatagccattgtagtacctgatgtggagatcctaccttcctgggcacagaagagaggatttcaagggtcctttgaagaactgtgcaggaacaaggatatcaataaagctatcctggaagacatggtgaaacttgggaagaatgctggtttgaagccatttgaacaggtcaaaggcattgctgtgcacccggaattattttctattgacaatggcctcctgactccaacactgaaggcaaaaaggccagagctgcggaactatttcaggtcacagatagatgaactgtactccaccatcaagatttaacatgaggaagaatccttagaggaaatggcgcacctccacaatcctcctcgtaccaatggcctttgagttggtaactctgcctgcagcgagtgtgggaaaggaaatgccatgctggacttgtgcacagggtcttaccatagggatagcagagggcacggaacactgccttacagtcacctgtgttgtagcccatgatcctggggatacacagtttccaaaacgagccttaaacattgtaaaggggaacccataaaagtgctaagttatttaagacttcaaccaataaggtgggtgttaaaacttctgtctcctgtttttctaaccaaggggttaggacttactctttctgatacgtctgctgctggctgcacaccctgcagccgtctgctgctctgaagagtacagtacactggaagaaagctacccctttaagagcaactgtccaggctgaagaaagtcacagtggaccagagatttctcttcttaaccccttccccttgtccctttccctcaccactcacatgcagtacatttatgtgacccttctggtttgtaagggttccaaagggtccctgttgtgcctgctggtaacctcgtgtttccagtacactaaagaacagatcctcctcagaacaatgcgggtacccagtctcagaaaaggaaaaaaaaaaaaaggtggctcctgcgttgagccagcaacttgcaggctcacacagatgtcctcagactccgctccatctctgctccctgcccctcccattcttcccaggggttatgagaaaccctgccttagactctgcagtgaagatggtgttccgaagaatgacctggatgggccatgctcaactgtgattcctcccccgctgtccactcgctcgctcgtcgtggaaccagcccgtatctgcagcggcctctgtgctccaaatgtggttttctagcaaatgctaatgtggtgatcaacttgctttgttttctttccctcccagttaaactcaggcacagcatgtcttcagaagtatctaggcagttggtatacgtgggtacttattaaagtggacagtaataagtaaatgtccttattataaaactacctgatttatgtgaaatgcatttgataagccaaaaatctggggtgtagaaatctgggggaaaaaaaatcatatcctgggatcaacttcccaaggtatattttttaagttaatttgggaaatgaacagcatttcactttgccgcgagtcttggccacatttgacctatttgagctgtttatacatttgaagccactgttgttggctgtgtgacagtgtgtgtatcttgaagcacaactgggtttgcactaaagaatcatcattgtaataacactatttggtagcctaacttcattttcgtattcttaactgcacaggaagtcgataatttgtcacaacggggttttgaatgtttgctttcagtgttggctatttctatgttttataaaccaaaacagaatttccaaaaacaatgaaggaaaccaaaataaatatttctgcatttggagtgagtgg

SEQ ID NO: 2902 - DNA, 3330 bp, Rattus norvegicus
  Genbank Accession No. E00593
gctagagtaccagtgagtacagctttacgaggtaagtctgatcttgaactttctaaggaaattcaagacagtctatcagaagtaaagtggaaaatggctttacaagttatgtttggccttgaattttttctagtgttagaagcccttttgttccttttcacatgttatcaagtggttaaggcagggcggattctagatgaaattcaggacaagctatcagaagtaaagcggggagagagagtaggaacaaagaggaaatatggtacacaaaataagtatacaggcctttccaagggtcttgaacccgaggaaaagttaaggttaggtaggaatacctggagagagattagaagaaaaagaggaaaaagggaaaagaagaaagatcaattagcggaggtctctaggaaaaggagcctgtgctcatcgctggatgggctcgggaagccagctcttagtagctctgaagcaggtgaagaatcctcctctgaggaaacagactgggaggaagaagcagcccattaccagccagctaattggtcaagaaaaaagccaaaagcggctggcgaaggccagtttgctgattggcctcagggcagtcggcttcaaggtccgccctatgcggagtccccgccctgcgtagtgcgtcagcaatgcgcagagagatgcgcagagaggcagtgcgcagagaggcagtgcgcagactcattcattcccagagaggaacaaaggaaaatacaacaggcatttccggtctttgaaggagccgagggtgggcgtgtccacgctccggtagaatacttacaaattaaagaaattgccgagtcggttcgtaaatatggaaccaatgctaattttaccttggtgcagttagacaggctcgccggcatggcactaactcctgctgactggcaaacggttgtaaaagccgctctccctagtatgggcaaatatatggaatggagagcgctttggcacgaagctgcacaagcgcaggcccgagcaaacgcagctgctttgactccagagcagagagattggacttttgacttgttaacgggtcagggagcttattctgctgatcagacaaactaccattggggagcttatgcccagatttcttccacggctattaggcctggaaggcgctctcgagcaggtgaaaccactggtcagttaacaaagataatccagggacctcaggaatccttctcagattttgtggccagaatgacagaggcagcagagcgtatttttggagagtcagagcaagctgcgcctctgatagaacagctaatctatgagcaagccacaaaggagtgccgagcggtccatagccccaagaaagaacaaaggcttacaagactggctcagggtctgtcgagagcttgggggaaacccagactccttaagactgataatggaccagcttatacgtctcaaaaattccaacagttctgccgtcagatggacgtgacccacctgactggacttccatacaaccctcaaggacagggtattgttgagcgtgcgcatcgcaccctcaaagcctatcttataaaacagaagaggggaacttttgaggagactgtaccccgagcaccaagagtgtcggtgtctttggcactctttacactcaattttttaaatattgatgctcatggccatactgcggctgaacgtcatgttcagagccagataggcccaatgagatggttaaatggaaaaatgtccttgataataaatggtatggcccggatcctatcttgataagatccaggggagctatctgtgtttccccacagaatgaagacaacccattttgggtaccagaaagactcacccgaaaaatccagactgaccaagggaatactaatgtccctcgtcttggtgatgtccagggcgtcaataataaagagagagcagcgttgggggataatgtcgacatttccactcccaatgacggtgatgtataatgctcaagtattctcctgcttttttaccactaactaggaactgggtttagccttgattcagacagccttggctctgtctggacaggtccagatgactgacaccattaacactttgtcagcctcagtgactacagtcatagatgaacaggcctcagctaatgtcaagatacagagaggtctcatgctggttaatcaactcatagatcttgtccagatacaactagatgtattatgacaaataactcagcagggatgtgaacaaaagtttccgggattgtgtgttatttccattcagtatgttaaatttactagggcagctaatttgtcaaaaagtctttttcagtatatgttacagaattggatggctgaatttgaacagacccttcgaggcttgccatcattcaggtcaactccacgcgcttggacctgtccctgaccaaaggattacccaattggatctcctcagcattttctttctttaaaaaatgggtgggattaatattatttggagatacactttgctgtggattagtgttgcttctttgattggtctgtaagcttaaggcctaaactaggagagacaaggtggttattgcccaggcgcttgcaggactagaacatggagcttcccctgatatatctatgcttaggcaataggtcgctggccactcagctcttatatctcacgaggctagtctcattgcacgggatagagtgagtgtgcttcagcagcccgagagagttgcaaggctaagcactgcaatggaaaggctctgcggcatatatgagcctattctagggaaacatgtcatctttcatgaaggttcagtgtcctagttcccttcccccaggcaaaacgacacgggagcaggtcagggttgctctgggtaaaagcctgtaagcctaagagctaatcctgtacatggctcctttacctacacactggggatttgacctctatctccactctcattaatatgggtggcctatttgctcttattaaaagaaaaagggggagatgttgggagccgcccccacattcgccgttacaagatggcgctgacatcctgtgttctaagtggtaaacaaataatctgcgcatgtgccaagggtatcttatgactacttgtgctctgccttccccgtgacgtcaactcggccgatgggctgcagccaatcaaggagtgatacgtccgaggcgaaggagaatgctccttaagagggacggggttttcgttttctctctctcttgcttcttgctctcttgcttcttgctctcttgcttcctgcaccctggctcctgaagatgtaagaaataaagctttgccgcagaaaaaaaaaaaaaaaaaaaaaaaaa

SEQ ID NO: 2903 - DNA, 1983 bp, Rattus norvegicus
  Genbank Accession No. E12286
ggaccgtcgccatgcgtcgtgtaccgctgctgctcgtgctgggcttgctgttcgtgctgggcttgctgttcgctggccctgtcgccccttcgcgcctcatctcgaagcgcccttcccaacttggtggcttctcctgggataactgtgatgaaggaaaggaccctgcagtgatcaaaagcctcacgctccaacctgaccccattgtcgttcctggagatgtgatcgtcagtgctgagggcaagaccagcattcccctcacttctcctcagaaggtggagctcaccgtggagaaggaagtggctggcttctgggtcaagatcccttgcgtagaacagctaggaagctgtacctatgagaatgtctgtgacctgatagaccaatacatcccccctggagagacctgcccagagccgctgcacacctacgggctgccctgccattgtcccttcaaggaaggcacctactcactgccttcgagcaacttcacagtgcctgatctggagcttccaagctggctaagcacgggcaactaccgcatccagagcatcttgagcagcggtggaaagcgcctggcctgcatcaagattgccgcctctctcaagggcaaataaccaggcagcagccaccatagaatgaaagggcaccaggaaggcatgcttcttcttctgtgttccggggcccagagctgcctgcctctaactccgttctatggttctctaccctttctgcaaatcacgacaacctgacctgagggaggatggaccaggcgggtctcgacatctgttgggctgtacgccatgctccttcgcacccctaccaactttctaagagtttctctcatgtcccaaacagtcaaggaatgggaaccaacatgttatggaatcttaagttcaagctggcccaacatgggcctcctgaagctatgctcaccccacctcttcgttttagccaccaacttaaaaaccaagatgacagtattaatctctcattccaccctaaacctctcatccagcaaagaggtctaggtagccagtcttaggtctgcccccctattaacttccatgattaactacattccctttgcaacttgcctagccaacactggggctgacagatcctgaaagggcaggatggcgtgtgacagaaaccctgggagagttattgttgggcatgccccattaacctcagtaaagcacaggtgcccagggccaagcagatcgagggagccaaagcagtcactcccaggagcgatgcccacttttcttcctttggtatgacgcatacagaatgggatgacattccttatacctgacaagaaacaaaactgaaaccccaacagcacatgtgctccagtgccaggaggccagggtctggaatggcatgtctagtcctggaggtacagtccagtgacctgtaagtgccatgtaaggaatgttaccggatatttgcaacagttttcttccttaggccccaaaccccagacttttctatgaagtcttagattttttaactattagaaacaaattgttttttatatactgttcaggccaaaggggccacgtggacttgtctggggggtggggggggacatagctggctcacaggtggctgctttttttctcacacctgttcgtcttctcagtctcaagttatctgacttcatttctctccccctcaaggtcaagtccttggtaccagacctcagagagggctcagcctgcactggagcaggtctgcatggcctctgagagctgggccctgtgccagcctcagagccccatcaccatcagggtataggggttcacactggagtggatctccccacccccaccccccagcagccaccttgtggaacaggggtcccatgtagagagtggatcccacaccgggttgtaccatgacaacttcctgagcctccgtcagcccggttctggactgcaagactagtctgtcaataaatcttcttaaaaaaaaaaaaaaaaa

SEQ ID NO: 2904 - DNA, 313 bp, Rattus norvegicus
  Genbank Accession No. H31078
  misc_feature (1)..(313): n = a or c or g or t
agacaggactcttctactttatttgagttatttcaaatgacagttacaaaagcttttaatttttataatactcttcataagaaaataaaatttaaataaaaatacattctcaacaatacaacatggttacacaaattcactatattacgttctgataacttacattttcaaacgaagacactgtaaaanccagtattaactagcaacatattaattcccaagttaaaaatggaagcaggtaacatcaaccatgatcagtcatttaactctggaatgngtctngcatttgtcacagatgtgagggccactggga

SEQ ID NO: 2905 - DNA, 405 bp, Rattus norvegicus
  Genbank Accession No. H31117
  misc_feature (1)..(405): n = a or c or g or t
ttgaccacttggctttagatgagatcaagaaacgcgggatccgggtgggctacacgccaggtgtcctgacagacgccacggcagaacttgctgtctccctcctgctcaccacctgccgccggttgccggaagccatagaggaagtaaagaacggtggctggagctcctggagccccttgtggatgtncggttatggactctccgagagcactgttggcattgtggggctggggcgcataggtcaggccattgctcgacggactgaaaccatttggtgtccagagatttctctacacggggcgccagccagggccttcaggaagcagcagagttttcaggcagagtttgtgcctattgcttcagctggctgccgagttcagacttcattgtagtgttcctgcttcc

SEQ ID NO: 2906 - DNA, 294 bp, Rattus norvegicus
  Genbank Accession No. H31118
aaatggcaagtgtagaaatttatttgaaccaacattcccaccacaatgaaatgactcaacactgatccaggcgcccacggctgagggttagggagtattgcactttgcatttctttaggactccatacacggcaaaaagtttcaaaaacgttttgcttgttttgttttacacactctcccaactcatgcacacactcattccaaaccaacgtttggttatcccaaaaatggggaagaactccaaaaaaaaaaaaaaaaaaacccatagccttaaattgcactaaagttctgtaa

SEQ ID NO: 2907 - DNA, 355 bp, Rattus norvegicus
  Genbank Accession No. H31144
  misc_feature (1)..(355): n = a or c or g or t
gacgtaaaatagaaacagactttatttctctggaagaagcagatatccatggctgggacanagctttggcaacanaggcgatgggaacacatcaaatggacacaggggaggaacaggcatcaaacaggacaagtactggtgccgctggggtctccctccacacccggggcctggggccctggtccctgccagagaagatcctggcgcctcttctgtttctnagccacttcaggctgtttacanttacaagatctaagaccagccaagcccgagttcacagtgaagccacaggtcacattctgtccaacactccacattcctacaggggttccctgggaaaagggggcctggtcct

SEQ ID NO: 2908 - DNA, 403 bp, Rattus norvegicus
  Genbank Accession No. H31367
cacaattctatcagctttttatttcttaataagcagccaatctgactcaagaaagtaacaaagcagcagtgaaccgctaaccaattgataaagtcctctacttacaaccaaaaccagtaactttatcattgtccttatcccaggcaaggcacagggttagacagcagacagagaaaacagtaacgtaagagtaagggcatcaacagggcagtgtcaaacaacagtgcaagaaaccttgcaaatccgatgccagatgtggatgttgccccgccacccttcattattcaaacagggctcgttatgtttggttccagctgtggaccatccctgagattcaatgtttgctgctgcttaggtggaggatgtctggtaactcagctaagcagcaggctgtggcaatctc

SEQ ID NO: 2909 - DNA, 320 bp, Rattus norvegicus
  Genbank Accession No. H31373
  misc_feature (1)..(320): n = a or c or g or t
gcgacccgctgaatttaagcatattagtcagcggaggaaaagaaactaaccaggaatntgctagagatgacttttgagtgccagaacctggggaagctcacaactgtccagattggccacgataattctgggctgtatgccaaatggcttgtggaatatgtgatggtcaggaatgagatcacaggacatacctacaagtttccatgtggccgatggctgggcaagggtatggatgatggaagcctggagcgtgtgcttgttggggagctgctcacgtccctacccgaggtagacgagaggccttgtcggactncaccact

SEQ ID NO: 2910 - DNA, 356 bp, Rattus norvegicus
  Genbank Accession No. H31456
agtctacatacacttttacttattcataaatactgatttacatataataacccacacaattttatcttcaaaaacaccatccaaaacttcaagttaaatatactgcaggattaggttgagtttttatttatttttgaagtttagtttttaaccatgtcttccttcaggtatacgtcatcagaacagcacacaggaaggacactttggggcatgtctagcccaccagcagatccatttctaggcatacaggctactacacttggcatggtcgtgtcacccaacttctctgggactgccctttcctttggaagggacctagctcaactgtgattttttgtggttcagatggtgtcaaa

SEQ ID NO: 2911 - DNA, 357 bp, Rattus norvegicus
  Genbank Accession No. H31489
  misc_feature (1)..(357): n = a or c or g or t
ctgagacagggttctctgtgtagcgcaggctgccctgcaacttgttctgtagaccaggctgcccttgaactcacagagatccacctgcctctgtcttccgagtgctgggattaaaggtgtgcgccacctctgccaggctccccaggagtcattcatgccatcaggttagttgaggcttatgggcctccccttgtgtctcttcgtactcctcccacggtttcagctgaggaccaggaatcatcaaggtcttgagaattggttgcttagggggtgcccacgggggcacaatcttggcatgcattctccagctnccatacgggttcatcaagtgcctttcaaacaccacatattccaggg

SEQ ID NO: 2912 - DNA, 471 bp, Rattus norvegicus
  Genbank Accession No. H31610
  misc_feature (1)..(471): n = a or c or g or t
cttgagtcttgaggcaacttttttcaatgcaatgcagttgtcaatcacaacaaatcgaggacagcccaggaggaacgacttcagccctcctgccttctccagtatctggcgagtttcttcagggaagaactcatattcctcagagaacatcctatcactcatatccaaggggccgtgctcttccagcaactgagagaagtaatcatacagagttgaacatttctgtttggggttaatatcccacagcttcttatttcggacaacatactcgctgctgtgctggtcgtaaagagcttcgaactcttccacatcttgccgaagtgggtcaggcactgcaaatggtcctgcagaatctgaattgcgcctgttatggtcttctggagtgacagtctcactacttggngttactgatgctgttccagatcccactaacatcgggntttgaatcttttggnttctttttcctgcctt

SEQ ID NO: 2913 - DNA, 482 bp, Rattus norvegicus
  Genbank Accession No. H31625
  misc_feature (1)..(482): n = a or c or g or t
atagtaaaataaatgactttnatttggatactttcaaaataatacacatctatgaaaaattaacgttcaaaccccaaaattatcctgcatattgaaggatgagaaacatttgcnttgctgagccattttttggaagagcctctgaagaaattgaatgttcccagtttacagagcattagcctatatccctttcttctgggaaacaaccctcctaggctgcagtggactttgagtcatgagaggacttggtgtgggtgccgatggttccgcgatgggtcccattgctgggaatggggagccgggttccttggtccacctggctagttattgggaggagtcatgccttctcaggtgtcaatgagcaggctcaccactgagcggattttgcaaggcaaaccatcgcctaggggncaaaagtattgataggggaattnttcaaactcaggggtcttgcggtatctcggaaaaggaacgcaaaggca

SEQ ID NO: 2914 - DNA, 298 bp, Rattus norvegicus
  Genbank Accession No. H31648
  misc_feature (1)..(298): n = a or c or g or t
actattcacgaagcatttattacataaagtatgacgtttattagctaattgantccttagcagtcaggtaggtaatgatgtccactcacagaggaataaactgactcactagcatttaaggaatttaaggtttgtcagctatgaagtggcagaggcaggattcagatccaggcagagcctgtaaccacaccacctcttagatcataagancagcaaagttcccaggggaaaacacagcaccgattacaaatgccagccgatggaatacaagacgggaagcagacaagtctgacttagg

SEQ ID NO: 2915 - DNA, 384 bp, Rattus norvegicus
  Genbank Accession No. H31692
  misc_feature (1)..(384): n = a or c or g or t
aaataaatttttatcaaaatggcacttgtctgccaatctctcaaacttgtcactgccctaaacacacgtgaccatccccttggccactatgccttcactcaggcctcgagggcaggcagtggccagcgagggacactgtggatacctagcagccgagtgccctggggctgcagggtacatggcagcccttagcactcaacactggtgacaacttctagggccaggctttaaaaccccantggtaatggtgctgctttcccgctcagagccttcacagctagtttgagcccatcgatttcattgagaatcaggtgttaaaaacaagtaaatcgaatgaccaaataaattaaaatgttttaaagccctgngagttcatagactggt

SEQ ID NO: 2916 - DNA, 340 bp, Rattus norvegicus
  Genbank Accession No. H31695
  misc_feature (1)..(340): n = a or c or g or t
gtggagcacaaagatattttattttctgtttagggaagatactcaccccaacctctttctttttaggatgacagagtgcatttctcagctaaaatgatcaggtcaattacctggngtgggggtgggtgtaattcgtttacacagcagaaaatggccgaaatgtctggccacagattacagcattaacattgtttgaagggtcacgtgcctngcaattttatctgcagacactcctaaatctgtcaataccaacactggtttggcctttaagatttctattcacagacagtaggactgtgagggaactgcagggaagaagccctccaccattacccacacg

SEQ ID NO: 2917 - DNA, 440 bp, Rattus norvegicus
  Genbank Accession No. H31707
acagtcatgacattatttatttacaagcacagatgaatccctgacctctcccaagacagtgaccctacctcagcccagttcaatacttcaactggaagtaaagccggaaggaggaattcagggatgcacagggttaggggaacatatcccatattaaatagttatatatatacacaacagttcctgtagttctgtacagagcagtggctgaccccaccccacgggacccgaaatgtggggagaagagactgagggtgttgaggccggagccagcccctggtgaagtgcaatagcagcagcaaggtcctaacggtacacaagagggaggggaacaccccctcccactttccacccccaccctgccctgggaatgtactgagggacaggaatggttctcaaagagcacatacaggaaggacatggctagaaccatctttagg

SEQ ID NO: 2918 - DNA, 438 bp, Rattus norvegicus
  Genbank Accession No. H31813
  misc_feature (1)..(438): n = a or c or g or t
ggcttcaatggattttattagccttctttcatgtactgactgggtataggaggccttccagaggaagaggcctgcaagtnagaggctcaggagaagccaaatcactgacacccagagctggttagggtgggatggacaagatctgagcgattcctcttctggaggagggaacgaacagtgctgctgaggcatgtnacccacccagccagacactcttcacagaacagttctggagggtgtggtgaaggatgtcctgctccatgcagggatgggtgtcannngaggaagggaggagtttatcagaaggcaagaggaagtaacaaactgagaggagcggaggaggaggaaagcagttaagctgccttcgtctgcaagcctccaggatggcacggaagatggctgcagccgcgacttctccaggatctggctgatctagtt

SEQ ID NO: 2919 - DNA, 421 bp, Rattus norvegicus
  Genbank Accession No. H31847
  misc_feature (1)..(421): n = a or c or g or t
gcagagantaaatactttattaactgattacagttgaaagtcatgancaaaaaggagtatattaaggcagagccatatatatacatacatatatatagatatatatatgtgtataaccaactgcaaagccggttctctctccacgttcacaacctctgcatcggtcgccctcaggcggtgtgctttctttctcttgattaaaggngcctcttggccactggttctggtccatttgatggtggctcatgggtcacggagtgcgcgactgtgagtttctcagnacatcgcaggcgtcaccacacagctgttggttggtgtgcgaaatctgacaactgaccagtcttcttcagaaaaacatggtatctttaaaagtgattggaatagtcttacctgaaaaaagtgtagacttctgagtcaatca

SEQ ID NO: 2920 - DNA, 445 bp, Rattus norvegicus
  Genbank Accession No. H31887
  misc_feature (1)..(445): n = a or c or g or t
ctactagagtttttatttattgaggtctctatcccaaccagtcatttaaaaaccaagtaccacagacctgaggggtaggagctaggaactgtacctcctcaccacacgaacagcagtggggaagaagatgagggcagcagaggtggagaagggagacgacaatagcagcagcaatggggcatcaatgtcacagagacagccactcggtcctcccccaatccctagctagagcccctatggcttggggtggaagaggtaagtcccaccccaggtccctcctctcagacagcctcctcagggctcaacccatttnttctgtcaggagactcaggcacatgggagaggaggaagtggggggaggagactttgggagaggcagggtntggtaggatnaaggcagaagtgggggggcattagcaaggttttaaccctgccattcccacca

SEQ ID NO: 2921 - DNA, 336 bp, Rattus norvegicus
  Genbank Accession No. H31907
  misc_feature (1)..(336): n = a or c or g or t
gcggctctgaaatggtttattgttgagttctgaaaacacatgtgggaacagggcaagtccaaccaagactacccttggtgtaacattnccggtccccaccagcagacatcaacatgttcttctgtgtcaaagaggagattccctgagtaaaggcatttccttaaagaatgtccaggcttcagtggctgtcctgggtggagatggctcttgctggctttcaggctagggcactacccatgacttcagagaaaccacttggtgttacaggcctcacctgctgagcttcctgcagtccaggctggatccctttccaggccagagacttctctaatttgg

SEQ ID NO: 2922 - DNA, 270 bp, Rattus norvegicus
  Genbank Accession No. H31955
  misc_feature (1)..(270): n = a or c or g or t
acaacttgaatacaaacatttatttatcaaatccaaaatttaaaaacaaggacttgcaacactgcccagactcattttgaactacagagttcaagtgatcctcccacaccagactcctgagtagctgggatcagagtaagtatacatgcaccactgggctcagcaacaaaatcaacttcttataaatccactagagagcaaagtcaatgcttctaagtaaagaactgtaagccactaaggtcaaggccagcctggnctccacccagcaag

SEQ ID NO: 2923 - DNA, 349 bp, Rattus norvegicus
  Genbank Accession No. H31976
  misc_feature (1)..(349): n = a or c or g or t
gtgttgggntgtttattaacaaagtgagcaaggggcttcaaggactggtggatccaggacgcttctttttcttccttctttggagagcaccttgtttctggtccaaatnagggagctttcgcttggcagctgcctccaaagacgcccaaagttcatctgtctctgtgtcttctgggggcactaggttgggctcttgaggttcttggggctcatcctcccagttatcccggcctgacaggagaaggcagttcagttgagacttgagataaaccttatgctctagccctcgtggattgcggatcctgtgtatcctcaggactctgtctaagccacaagatgctaacagggg

SEQ ID NO: 2924 - DNA, 367 bp, Rattus norvegicus
  Genbank Accession No. H31990
  misc_feature (1)..(367): n = a or c or g or t
tttgaactctgaattagacagtttgtattctaaaacacacacaaatctgtaccaattaaatacaaagtcgaaagggaatataaattacagttttngttttcaacggatgatagtaaaacactaccgtcagctcaccacacacacaaacagcagcttttcaatagagtctcccaggcctccctcaccaatgctaaggacttaaaaaataaaaagtacagcaggctgcacatgctctctcacttcctcacaatacacggatagctgtacactgaggtccattgtacaggcatctacagagtaagtacataaaatatatttgtaaaattcttccacgcacgatcctacaatgtctctcctcgcaggatac

SEQ ID NO: 2925 - DNA, 303 bp, Rattus norvegicus
  Genbank Accession No. H32109
  misc_feature (1)..(303): n = a or c or g or t
gcagcccacagctcttccactcgttctttncagagggcatgatgggaggtgcagaggccgagagttatgcagaccaaaggagcaggttgcggctaggcttgaatcctgagctttgaggcttctggctatgtaagcttggactagtcacttaacctctttgggacacagttgccatatctgtcagaaaacaaattggaaggttactttgtcccantgttgtgagagctgcatggagtcatcattnaggctctgagggggaagctatggttaagcttgacaggagccaatgcagcatactttcac

SEQ ID NO: 2926 - DNA, 341 bp, Rattus norvegicus
  Genbank Accession No. H32189
  misc_feature (1)..(341): n = a or c or g or t
cagaaccatgcctatnatactgggatactggaacgtccgcgggctgacacacccgatccgcctgctcctggaatacacagactcaagctatgaggagaagagatacgccatggggacgctcccgactatgacagaagccagtggctgantgagaagttcaaactgggcctggacttccccaatgtggagagacagaggaggagcggattcgtgcagacattgtggagaaccaggtcatggacaaccgcatgcagctcatcatgctttgttacaaccccgactttgagaagcagaagccagagttcttgaagaccatccctgagaagatgaagctctactct

SEQ ID NO: 2927 - DNA, 398 bp, Rattus norvegicus
  Genbank Accession No. H32747
ggcaagtacagttttaatgttgattacagcagtgtgtgtctttatttcctctgctagaatagaaaagagcccaatatattcctcatgaatgctctctgaacctgtgaacagcatcatggttctaccccaccttctgaacactcgggaattgggcttcctcccctcccctcccctcgtagacagcagtgtttggagtgataatagtagcttgatagctagattcctaaccctggcttttattggctttttgaaaaactgtcttcctcctgattccctaagtgggcttggtgtagtcacttggtgggatgttttggaaaggacagtaactcacctgtgagcttgtggaacttgtgttttctactgtggacattgaaattaaaggattgcttaactgtcag

SEQ ID NO: 2928 - DNA, 364 bp, Rattus norvegicus
  Genbank Accession No. H32966
  misc_feature (1)..(364): n = a or c or g or t
gacatctgaatagtttaatnacttctcctccatacaggccacctggnagggctgtgcagcccaggcaggccctgctccagtgcgtgcctatgtcccanagcgcttctntcctgggctgcactctgcaggcgcatgnctttcctgggcagcccctgcctctttcccaaaggctgggctggggaaggccaatnactcttgctcctggngcagctcttgaggctctctcttgagaggccctttntnagtaccccaccaaagggtgtctcccttccccagacagaaaatacagcaagagaagatccccagctggttcccccaggaccctgagctcagctgaccctccaactcagtttaccagttgagg

SEQ ID NO: 2929 - DNA, 376 bp, Rattus norvegicus
  Genbank Accession No. H33001
  misc_feature (1)..(376): n = a or c or g or t
atactagggacgtggagatgttaaaacgacaacaaaaaatatatatatataaaancaggaatgaaatctgtgagagaatatttttggttctaaagacgggtgcatccgtttgtnttcgcccgantcccttgccggagaccacgcgggctgtgacattgcacggagagggcagctttgggttcccggccgtcactgaaatcactgaaaccaccggaaggcagctcccgacggaagcatcaccttctggtggggcgggagacaaaaacaaggagagagttcagtcagggtcccggtgggcctggtgcaagatgctccccgtggccggctcaaatgaccggaggnaccgggcattgagaaccgnatggcccatttaccc

SEQ ID NO: 2930 - DNA, 378 bp, Rattus norvegicus
  Genbank Accession No. H33020
  misc_feature (1)..(378): n = a or c or g or t
agcatttcagatctgcttagtaaaccggtatatcacccaccatgttggctgcaaggcttgtgtgtctccggacactaccttccagggttttccagcccactttcatcaccaaggcctctccacttgtgaagaattccatcacaaagaaccaatggctcttaacacccagcagggaatatgctaccaagacaagaattaggactcaccgtgggaaaactggccaagaactgaaagaggcagccttggagccatcactgggaaaaagtctttaaaattgaccagatgggnaagtggttttttgcgggaggagcagctgttggtcttggagcgctgtgctactatgggttngggatgtcttattgaggttggggctatccg

SEQ ID NO: 2931 - DNA, 347 bp, Rattus norvegicus
  Genbank Accession No. H33086
  misc_feature (1)..(347): n = a or c or g or t
gggaaagggttctncattgcacatttaatagttcatgcagcacttggtgacataaataggggatgggggaacagggccacagaatccacagatagtccacagtgcaggcaagacacacatggccagggccacacagcagggagctgatggtcagctggaagggtcacctagacgtgcacagcggggcagacaaaggttgntcacactgtctcatgacatgctggtcatccagaggacactgagcagttntggacactcatgtggccctcgggcctggctggctcatatcacagtccactgttgatggtttagggatgtggggtcaagcctggtttcaatacattatc

SEQ ID NO: 2932 - DNA, 351 bp, Rattus norvegicus
  Genbank Accession No. H33101
  misc_feature (1)..(351): n = a or c or g or t
cggagctggggactgaacccagggccttgtgcttgcnaggcaagcgctctaccactgagctaaatccccaacccctagagcagacactcttaagtggcacagtggtaaccgggctcctagagtgtcagaaccctgacatctttcttttcagagacagagggggccggatggaggggaagcagcctctgctccttaccttactctgcaacactgagaaaccagaaaaaaagacctgggactatattaagactcccaaagtaaaactatatggaagtgtttattttttaaagtctagtaccagagaacaggacagacatgacagttactactcacaaggggcagtgtcccact

SEQ ID NO: 2933 - DNA, 345 bp, Rattus norvegicus
  Genbank Accession No. H33149
  misc_feature (1)..(345): n = a or c or g or t
aatttaaaattatgcttttattaacattggaacagctcttttatatttatagtcttgacaccaaggtaatttaaagagcatttggtcgttgaggaaggcataagtngtagtatgcatccttgttccaaaagtctggacccttccatccacaccagcccttttccaatataacttgcaggncttcagcacctgtatagtgtgggtctagaattaggaatttgatctgccctgtagtttcattccatgcgactcctagtattgtgtgagccaatactcctcccccaatcattactgggagtgnccacatttctgggaaatgggttggctagttcccggtccttgagg

SEQ ID NO: 2934 - DNA, 381 bp, Rattus norvegicus
  Genbank Accession No. H33219
  misc_feature (1)..(381): n = a or c or g or t
cttttaaattattttattattgtataagctaaanggaaatttacacactgaaatctcaaaacccttgggcatgcatattaacccgttagaggttcttctacatgtctctcctgcttccataggaattgccccaaacgtttaaaacccacagcttgtttttttgtttttttactgtatatacagcctaaaccatagcaatctaggattatgtcattttacactgtgcaaaatcctcaaaaaatagtggtatgacagagcagaaagatctctacaaatttcattttaagacattcatataattnggtccttctccaaatcacaccaattaaaacaggcacattctctgtcaagcctccagtcacgncctgacagtgatcccgg

SEQ ID NO: 2935 - DNA, 422 bp, Rattus norvegicus
  Genbank Accession No. H33426
  misc_feature (1)..(422): n = a or c or g or t
aaagatttattcatgcagtttatgtatatgagtnctgtcttcatacacatcagaaggaatcagacctcatagatggttgtnagccactatggggttgttgggaattgaacttaggacctctggaagaactactgggtgctatcactcagacccaggtttttgggagagacagtgtcctgtgtagcctataactgattaggaatttgaatctcttctgcctccacctaccacatgctgggatgactgctaagagttgtagcttccagaaaggatgaacattaagacctttgtgcttctgtaacagaagttaaagaaccatgggaacattactttggtttcaacaggatggtgtttgttcaaggctgagagcctcaagtgagcaatttagcagagtctgtatacaaacagatttaccactgggg

SEQ ID NO: 2936 - DNA, 419 bp, Rattus norvegicus
  Genbank Accession No. H33459
  misc_feature (1)..(419): n = a or c or g or t
gaacatgttaccttttatttaaaagtgttactagccctgcctggggctcctatacaaaaacaacacacaacccaaatnaggctgnttcccgtctctagactcggggacagtgttggggtttagcgagtggaatgtgtgctgaaggagggcacccaggnggctcctaccccagtcctcaggatggcaccagctgtcccgttgcctttctatttaccacagaggaaggaaaggcagtnttttgagatgctcagtagaagtcgagcatggatggcttcatcaccaggctggggcagtnttggcaagacgcctcattcgccttgtgttcctgtcttgatcccggntcttcttctccatctcagcatccgtcantgtctccagcagggggcaccactggtcagcatctccagtatttcggatgg

SEQ ID NO: 2937 - DNA, 283 bp, Rattus norvegicus
  Genbank Accession No. H33528
  misc_feature (1)..(283): n = a or c or g or t
cccaaatctaaaactacctttatttgtggctggctcagcataagtngccttcatcagtgagcagaattataaaactgtacaagaggtaaaaaaataggccgtttaacttagtgaccctcatatcatgagctttgaaaatacacataaaattgtacaatctggcagtttataaaatataaagctaaaaagaatattttagttcccacaaagaggagtgaatcacacaatcagcacatatccattaaacanttaactgtccacagagaagacacatggcacaaga

SEQ ID NO: 2938 - DNA, 360 bp, Rattus norvegicus
  Genbank Accession No. H33656
  misc_feature (1)..(360): n = a or c or g or t
ggagaccaaagggcttgggttttatttgccattccataaatacgggccgcaccttggtccgagtctgtcaggaagctggaggcgtttgcggtcggccttggtggggtgcagttagcgaggagccacgctcgtnaaaaaatggggagagaaagcacgttatgtacacggccagagcgggcacccaggtgccctcctgtgcctcaggaccctgggtctgggatgagcaggagcagggctccatgtgccagatcctatacatagccctcctcctgcaccaggcctgacagactacttcaagagggtggagagaggctggcttggtctgaccagcaggcagttggactaaaggaaggagaggcc

SEQ ID NO: 2939 - DNA, 294 bp, Rattus norvegicus
  Genbank Accession No. H34047
  misc_feature (1)..(294): n = a or c or g or t
ctttagcacaagtggtctcctggtcacaagccggtgtggagccttctgtcatgggagtaggaccgattccagccataaagcaagctgttgcaaaggcaggctggtccctggaggatgttgacgtgtttgaaatcaatgaagcctttgcagcagtgtctgcagcaatagctaaagaacttggattaagccccgagaaggtgaacatcgatggaggagccattgccttgggacatcctctgggagcatctggctgtaggattctagtgaccttnttacacaacctgggagagagtt

SEQ ID NO: 2940 - DNA, 684 bp, Rattus norvegicus
  Genbank Accession No. J00728
acgagtgctgacatgatcactctctgtgttcacaggaaagcgcatttgtcttggcgaaggcattgcccgaaatgaattgttcctcttcttcaccaccatcctccagaacttctctgtgtcaagccatttggctcccaaggacattgacctcacgcccatggagagtggcattgcaaaaatacctccaacgtaccagatctgcttctcagctcggtgatcgggctgaggcagccaggtgccccagttctgttgggaatggcctcatgtttctgcctctgggggacctgctgaaaaccaggctccaaggccactgctccacatcttcctattgcagttctccaaagtcccaaggcttgttcttattcctgtgaatggcactgaagaagtcaatcgactgtcttattttgacatgtgacagagatttcatgagtacacatctcatgctgagtcacttccctcttcctcctaatagcccacgtccccacttatcagccctccatggtctgtgatctgtgctaatggactctgtatatggtctcagtgctatgtctacagacttacatagtatgtatggttcaggtaaacagaatcacagagtgtgtgagcttcggtgtgttgtgcctttacttcacataatattatctaggttcctgtgttctacaggccacagtcacacacattcat

SEQ ID NO: 2941 - DNA, 6849 bp, Rattus norvegicus
  Genbank Accession No. J01435
  misc_feature (1)..(6849): n = a or c or g or t
ccctcacagtattaagtacccttaccctaccgctttcctcccaactaatcacatagaagtttaggatatacagttcaagagccttcaaagcccttagaaaacaaacaagtttaacttctgataaggactgtaagactatatcttacatctgttaaatgcaaatcaactgctttaattaagctaaatcctcaactagattggaaggattcaaacctacgaaaatttagttaacaactaaataccctacttactggcttcaatctacttctcccgcctatcagaaaagaggcgggagaagccttagtagaggagattctctacaccttccaatttgcaattcgacatgataatcaccttaaggctttttggtaaaaagggggctcaacccctgtctttagatttacagtctaatgcttactcagccattttacctatgttcgtaaacggttgactcttttcaactaaccctaaagatatcggaaccctctacctattatttggagcctgagcaggaatagtagggacagctttaagtattctaattcgagctgaactaggacagctaggcgcactcctaggagatgaccaaatctataatgtcctcgtcacagcccatgcattcgtaataattttctttatagtaatacctataataattggaggcttcggaaactgacttgtaccactaataattggagcccctgatatagcattcccacgaataaataacataagcttttgactgcttcctccatcatttctactccttttagcatcctccatagtagaagctggagctggaacaggatgaacagtatatccccccttagccggaaacctagcccatgctggggtatccgtagatttaactattttttccctccacctagccggggtgtcttctatcttaggagctatcaactttatcaccactatcattaatataaaaccccctgctataacccaatatcagacacctctctttgtatgatccgtactaattacagccgtcctactacttctctcactgccagtattagcagcaggtatcactatactccttacagaccgaaatctaaatactactttcttcgaccccgctggaggcggaggcccaattctttatcaacacctattctgattcttcggccacccagaagtgtacatcttaattcttctagggtttgaaattatttcacatgtagttacctattactctggaaaaaaagaacccttcggatatataggtatggtatgaaccataatatctattggcttcctaggatttattgtatgagcacatcacatattcactgtaggcctggatgtagacacccgagcctactttacatctgccactataattatcgcaattcctacaggcgtaaaagtattcagctgactcgctacactacatggaggaaatatcaaatgatcccccgccatattatgagccttagggtttatcttcttattcacagtagggggcctaacagggatcgtactatctaactcatcccttgacattgtacttcatgatacatactacgtagtagctcacttccactatgtcttatctataggagcagtattcgccatcatagcttgcttcgtccactgattcccactattctcaggctataccctaaatgacacatgagcaaaagccctctttgccattatatttgtaggtgtaaacataacattttttcctcaacacttcctaggattagcagggatacctcgtcgttactctgattatccagatgcttataccacatgaaatacagtctcctctataggctcattcatctcacttacggccgtccttgtaatgatcttcatgatttgagaagccttcgcatcaaaacgagaagtgctctcaatttcctactcttcaactaacctagaatgactgcatggatgccccccaccttaccacacattcgaagaaccttcctatgtaaaagttaaataagaaaggaaggattcgaaccccctacaactggtttcaagccaatttcataaccattatgtctttctcaatgagatattagtaaaataattacataaccttgtcaaggttaagttatagacttaaatctatatatcttacatggcttacccatttcaacttggcttacaagacgccacatcaccaatcatagaagaacttacaaactttcatgaccacaccctaataattgtattcctcatcagctccctagtactttatattatttcactaatactaacaacaaaactaacacacacaagcacaatagacgcccangaagtagaaacaatttgaacaattctcccagctgtcattcttattctaatcgcccttccctccctacgaattctatacataatagacgagattaataacccagttctaacagtaaaaactataggacaccaatgatactgaagctatgaatatactgactatgaagacctatgctttgactcctacataatcccaaccaatgacctaaaactaggtgaacttcgcttattagaagttgataatcgggtagtcttaccaatagaacttccaattcgtatactaatctcatccgaagacgtcctgcactcatgacccatcccttcactagggttaaaaaccgacgcaatccccggccgcctaaaccaagctacagtcacatcaaaccgactaggtctattctatggccaatgctctgaaatttgcggctcaaatcacagcttcatactcattgtactagaaatagtgcctctaaaatatttcgaaaactgatcagcttctataatttaaactcattgcgaagcttagagcgttaaccttttaagttaaagttagagacaacaaatctccacattgacatgccacaactagacacatccacatgatttattacaatcatctcctcaatagccacactatttaatttatttcaattaaaaatttcttcccaaacctttcctgcacctccctcacccaaaactatagccacagaaaaaacgaataacccttgagaatcaaaatgaacgaaaatctatttccctctttcattacccccacaataataggtctaccaattgttgtgaccattattatgttcccatcaattctattcccatcatcagaacgcctaatcagcaaccgactacactcatttcaacactgactaatcaaacttatcatcaaacaaataatgttaattcacacaccaaaaggacgaacctgagccctaataattgtatccctaattatatttatcggctcaaccaaccttctagggcttcttccccatacatttacccctaccactcagctatctataaacctaagcatagccatccccctatgagcaggagccgtaattctaggcttccgacacaaactaaaaaattctttagcccacttcttaccgcaaggaacccccatctcactaattcccatactaatcatcatcgaaactatcagcctatttattcaaccgatagcactagcagtacgactaacagcaaacattacagcaggccatctattaatgcatctaatcggaggagctaccctagtacttatagacatcagcccaccaaccgctacaattacatttattattctacttctacttacagtacttgaatttgtcgtagccttaattcaagcctatgtattcacccttctagtaagcctgtacctacatgataacacataatgacccaccaaacccatgcataccatatagtaaacccaagcccatgaccactaacaggagccctatcagctcttctactcacatccggcttagtaatatgattccattacaactccacaattctcctatcattaggcctcctgacaaacatcctaactatatatcaatgatgacgagatatcatccgtgaaggaacataccaaggccaccacacccctattgtacaaaaaggcctccgatacggaataatcctgtttattgtctccgaagtattcttctttgccggatttttctgagcattttatcattccagcctagttcctacccacgacctaggcggttgctgacccccaacaggaatcacccctttaaatcccctagaagtaccccttctaaatacatcagtcctcttagcatcaggagtctcaattacatgagcccatcacagcctaatagaaggcaaccgaaaccatataaaccaagccctactaatcaccattctcttaggattatatttcactatcttacaagcctcagagtatttcgaaacatcattttctatctcagacggaatttacggctcaacattcttcatagcaacgggatttcatggccttcacgtaattattggctcaactttcctaattgtctgtctactacgacaactaaaattccacttcacatcaaaacatcatttcggatttgaagccgcagcatgatactgacacttcgtagatgtagtttgactattcctatacgtttctatctattgatgaggatcctactcccttagtataaacaatacaactgacttccaatcagttaattctgaaaaaactcagaagagagtaattaacctacccattatcatcacaattaacatcaccttatcttttatcctcatttcaattgcattctgattgcctcaaataaacttatactccgaaaaagcaaacccatatgaatgtggcttcgacccaacaagttctgcacgccttcctttttcaataaaatttttcttagtagccattacatttctactattcgacctagaaatcgccttactacttcccctcccatgagcgattcaaacaaccaataccgctacaataatagcaactgcctttattttagtcactattttagctcttggcctaagctacgaatgaacacaaaaaggactagaatgaacagaataattggtaattagtttaaataaaattaatgatttcgactcattagattatgataataatcataattaccaacaatgacatctgctttcctaaatttaactatagcctttacattatctctactaggtacttttatatttcgctcccacttaatatctactctcctctgcctagaaggaataatactatcactatttgtcataacttcaacatccacattaaactccaactccataatctccataaccatcccaattaccattctagtttttgcagcctgcgaagtagcagtaggtttagccttactagtaaaaatttcaaatacccacggaacagactacgtacaaaacctcaaccttctacaatgttaaaaatcattttcccatctatcatactcctcccactaacatgactctcagccaacaaaaaaatctgaaccaatgtcacctcctacagctttctagtgagcctattaagcttatcactcctatgacaaaatgacgaaaattacctaaatttctcagttatattctcctccgatccattatccaccccactaatcattctaacaacttgactcctcccactaataatgctcgctagccaaaatcacataaaaaaagaaaatataatgcatcaaaaactttacatctcaatacttattagcctccaaattttactcatcataacattctccgcaacagaactaattttattttatatcctgttcgaagccactctaatcccaacactaattatcattacacgatgaggcaaccaaacagaacgcttaaatgcaggaatttatttcctgttttatacactaattggctccatcccactcttaattgccctcatttcaatccaaaactcaataggaacactcaacttcctaatcctctccctcacaacacaccccctaccctcaacatgatccaacaccattctatgactagcatgtataatagcatttataatcaaaataccattatacggagtccatctatgattaccaaaagcccacgtagaagctccaattgcaggctctataattttagcagcaattctcctaaagctagggggttatgggataatacgagtttccatcattctagaccccctaacaaaatctttagcctacccattcatcatcctctcattatgaggcataattataactagctcggtctgcctacgccaaacagatctaaaatcattaattgcttactcatcagtaagccatatagccctagtcatcacagccattataatccagacaccatgaagcttcatgggagctacaatactaataatcgcccacggcttaacctcatcactcttattctgcctagcaaacaccaactacgaacgaattcacagccgaactataattatagctcgaggattacaaataatcttttcattgatagcaacatgatgattattagcaagcttagccaacctagcactaccacccctaattaacctcataggcgagttattcattgttatagcaacattttcctgatcgaacccctctatcatccttatagcaactaacattgtcactacaggaatatactcaatatatatgattatcacaacccaacgaggaaaactaaccagccacataaacaacctccaaccttcccacacacgagaattaacactcatagctctacacattattcccctcatactattaacaatcaaccctaaactcatcacaggcctaacaatatgtagatatagtttacaaaaaacattagactgtgaatctaacaacaggaaatcaaattccttatttaccaagaaagtatgcaagaactgctaattcatgcacccatacctaaaacatatggctttcttacttttataggatagaagtaatccattggtcttaggaaccaaaaaccttggtgcaactccaaataaaagtaata

SEQ ID NO: 2942 - DNA, 909 bp, Rattus norvegicus
  Genbank Accession No. J02592
tacagcatgggggatgctcccgactatgacagaagccagtggctgagtgagaagttcaaactgggcctggacttccccaatctgccctacttaattgatgggtcacacaagatcacccagagcaatgccatcctgcgctaccttggccggaagcacaacctttgtggggagacagaggaggagaggattcgtgtggacgttttggagaaccaggctatggacacccgcctacagttggccatggtctgctacagccctgactttgagagaaagaagccagagtacttagagggtctccctgagaagatgaagctttactccgaattcctgggcaagcagccatggtttgcagggaacaagattacgtatgtggattttcttgtttacgatgtccttgatcaacaccgtatatttgaacccaagtgcctggacgccttcccaaacctgaaggacttcgtggctcggtttgagggcctgaagaagatatctgactacatgaagagcggccgcttcctctccaagccaatctttgcaaagatggccttttggaacccaaagtagcaccacaaagtccagacctagggatactcatgagtgccctgctggctgtgggcctagagcatggctctggcgcccaccacatgcagctttctcctcctttccattccctgttcctccatctcctcttcccagcccttgcctcagtcaagcctcagttccctggtctctccatttcttcattagtcccctcccttgtctctgccctgcatccaacccttccctcactgattttcggaggactgtaccagacccctgaatccccagcctggcctgagagattagatctcactgtgctgccctggtccccaggaggacccattttatttgcaataaagtgtgaaccacaaa

SEQ ID NO: 2943 - DNA, 659 bp, Rattus norvegicus
  Genbank Accession No. J02705
aaaggcgtgactgcagaagaatcctggtgttccaagtcgttcttgccggcgagaccaccgtgcgggacagaaaatgagcatcacggacatcctgagcgctgaggacattgcggcagccctgcaggaatgccaagacccagacacctttgaaccacaaaagttcttccagacatcgggcctctccaagatgtctgccagccaagtgaaggatatcttccggttcatagacaacgaccagagtggatacctggatggagatgagctcaagtatttcctacagaagttccagagtgacgccagagaactgactgagtcagagaccaagtccttgatggacgcggcggacaacgacggagacgggaagattggggcggatgaattccaggaaatggtgcactcttaaggcccaagtctacggaagagagagaggggaagggcaaatctgcctgaaggtttcaaaagccctgggactgggaagctccccaacctctcccgaactactttaccgagtcccccgaagcccttctgcaccatgttccttgttgagggaatgcaatggtttgtgatggtgggtaggtcctgataacctctgtaagcaccccccccctctggcagacaatgcctttaaaaaccacccaataaaatcatttctcatcatt

SEQ ID NO: 2944 - DNA, 1723 bp, Rattus norvegicus
  Genbank Accession No. J02861
tggaagggtctccatggatccagttgtggtcttgttgctcagtctgttctttctgcttttcctgtctctatggagaccgagctctgggagagggaaactccctcctggcccaactcctctcccaattattggaaatttctttcaggttgatatgaaggacattcggcaatccttaaccaatttttctaaaacctatggacctgtgtatactctgtatgttggctcacagcctactgtggtattgcatggctatgaggcattgaaagaagctcttgttgatcatggggaagaattctctggaagaggaaggttgccaatttgtgaaaaggttgctaaaggacagggcattgcttttagccatggaaatgtatggaaagccacaaggcatttcacagtcaaaaccctgaggaatttgggcatgggaaaagggaccattgaagacaaagtgcaagaggaagcaaagtggctagtgaaagaactgaagaaaaccaatggctcaccctgtgatccccaattcatcatgggatgtgctcctggcaatgtcatctgctccattatcttgcagaatcgttttgattatgaagataaggattttcttaacttgatagaaaaagtgaatgaggccgttaaaattataagctctcctgggattcaggttttcaatatatttcctatacttcttgattattgtccgggaaatcataacatatatttcaaaaatcatacatggcttaagagttaccttttggagaaaataaaagaacatgaagaatcgttggatgtttcaaatcctcgggacttcattgattatttcctaattgaaagaaatcaggaaaatgccaatcagtggatgaactatacacttgaacacctggcaatcatggtgactgatttgttttttgctggaatagagacagtaagctcaacaatgagatttgctctcctgctcttgatgaagtacccacacgtcacagctaaagtccaggaagagattgaccatgtgattgggagacaccgcagcccctgtatgcaggacaggagccacatgccctacacaaatgccatggtccacgaggttcagagatacattgacattggtccaaatggtctgcttcatgaagtgacctgtgacactaaattcagaaactacttcataccgaagggaacagcagtactaacatcacttacatcagtgctgcatgacagcaaggagtttcccaacccagagatgtttgacccaggtcactttctagatgagaatggaaactttaagaaaagtgactacttcattcctttctcagcaggaaaacggatgtgtttgggagagagcctggcccgcatggagctgtttctattcctgacaaccattttacagaatttcaaactaaaatctctggttgacccaaaggacatcaatacaaccccaatatgttcttcactttcttcagttcctcccactttccagatgcgcttcatccctctctaatgaaaaccagaaaacagaaatgaagatgaggaaagatcctgctgttttgttttctgaaggtacccacagaagccttcatttactactgtcatagaaatgccactgtatccttccttcttctcacagcttcggttctctatttgtccaaggataatagttctgcattatatagttcctaaactcaatgtaaaagatcctgataaagaagccacttcaaataaaagagttctactgtga

SEQ ID NO: 2945 - DNA, 5224 bp, Rattus norvegicus
  Genbank Accession No. J03914
aaggcagggagttgacggtgaagaaggaacaatgccaggaagataatgaacagggttgcactttgcccatcaaaagtctctaactgcacatctggtggaaacagcacaccagagcaagaacagggagctgccgacacaggtgctagcccattcctgtctttgattactgactgcttagactggttcctgagccagtatagatatatttttttccctgtccctggatccatagctccttcccccaacaatccctcccgtggaatgtctgaaatttgaaacactgtaggccaatggtccaatagaaagccataaccaggtcccgcctcctccttgcctaagacattatcaggaagctcagacttgcaagacccaggtttgtctgctctgtacaccctaccagcacgatgcctatgacactgggttactgggacatccgtggggtgagtgagagcctcttctgctgggtgggacatgtgtggggtgaggagtagctaggatgtgatttccaggagacagattgagtgctgaagttgttggaaagttttgcctctcagggcaagttcaaacacaggggggcttgtgcttatgtggcctgtgtgtgagcttgtgtcgtgactgttcagtgtaaggtgtaggctcaccaagagattgcacagtcagactgtcaggcttttccaatctgtgacttgtgatatgtcatcttcccagctggctcacgccattcgcctgttcctggagtatacagacacaagctatgaggacaagaagtacagcatgggggatggtgattacacctgcttctcagacccctgctcccctgaccctggtgctcagcaactctgctctgaccccctgttgctcagctctacacagctcctggagttgggtttagaaactgtcccttctagaaaccttgaattttggagggctgacttttgaaaatcttagtgatatacagaagcattctctgtccttggggtgtgtgaagtaggtgaaattgcagatcttggggtgttctcatgactcactccttggagggatccctagagaaggaagctgggatactggggtgatttcttttgacatcctcttgtccaccacagctcccgactatgacagaagccagtggctgagtgagaagttcaaactgggcctggacttccccaatgtaggtggagggaaggggaggtgtggggaaggcctagtgctctcacctcatctcctggcctggctgaggggttggcatcagtgtttctgcttgcctgtttcatccctgctggctgcacagtgtttctgtgttgggctgtgtcctggctctcccactcagtcgacaccgtgctcatggagggtttcctggggcagcacactgagtgccagggccatgtctatcctcacccagggaagggattcagctaccccataacccatctgaccatccctgattgtctatccagctgccctacttaattgatgggtcacacaagatcacccagagcaatgccatcctgcgctaccttggccggaagcacaacctttgtgagtggggctgactgcagggtggggacagaagccatccctcttggcttggctggagcaggatgctgagagtgggtctgtgttgtgtgtgctgcaggtggggagacagaggaggagaggattcgtgtggacgttttggagaaccaggctatggacacccgcctacagttggccatggtctgctacagccctgactttgtgagttccaccagccctgagttgaagctggccctgcactcttgctcttgtatcagctctagccccgtttgccaccacagcctctcagtgctactcatggtacagtgtttgaaattgccgacagagtaacccccaagctcagtttgccaaatgaaaacttctagtcatttgctctaagatcgtatccagactctccacagcgacatttagtccctgctaggacagacagagtgtgatccctccagttctagctgctggttctgtcctgagctgtgtctttctgttgccctggggtcttgccatgtctgcagccctcatactcacactatgagaagacactggggctagggaacacttcctcccaaatggcttcccagagctgtgtccttgacacccacagagagaagcagatgctcccaataggcaactcagtcagtcaaaggccttggatcctcggctcctgtttcattttgtcctctcaaattcccctcatttctttggaacctgtactgaagtcctcactgccccagtaggcagaacactacctgtttcctgggccgtttcagttgtttgcttctgcctcatgtgaggtcagagttcagagtcaggtgcctacaactgtctcatgcaaggtggttctgataatgatggtggagtccagggaacagagctgtatcttgttgggctgtttccaaagaacagtctaatcatggtgttgctctaactaaacacgtgggcctcaacccagactgaatctcacgaaggtgactgcttctctgcacgctggggcctgtacagccctgtgaggccagcctctgccagggagcctgtgtctgaaggtagtgatggttgttctctgcttcaggagagaaagaagccagagtacttagagggtctccctgagaagatgaagctttactccgaattcctgggcaagcagccatggtttgcagggaacaaggtaaaggcagcgggtggggagaaggatttgccatttcttcccaggtgtcaaattctagcactcacccttggcttcctgcagattacgtatgtggattttcttgtttacgatgtccttgatcaacaccgtatatttgaacccaagtgcctggacgccttcccaaacctgaaggacttcgtggctcggtttgaggtgatgtcctgaccccgcttcctcttgacctacttcccttccccccttccagaatgcctttctactccttgaaatggagatgaaaatggctagcttctgttgagcatagaactgtgttctgctctttcgtcccttgcatggagtttcccagcacaccctgcatgttgtgtaggattatcagctccttaggatcattttggaagcggattgtaaagactcagttcctcagggagtcagtaccattggaaggggacgtggtttttttccagtgtgcttctagcttccaagaacagggggcaatagatctaccggataccaaaggaaaaaagccataggttgcaatagagcctggattttccagccctgaagcctatggaaattcaggacatgcccggaatgtatagggagcactattcaggattgatgcacagtaccaagatacagtatccatatctggcctatacaattctttgctcagtcagacccctgagtggggaagcactgggacccagggctacagttagtgtgagtagacagctcactgctgttggaggattttatcctccaacatcctgtttctttcctttccttttcctccttggtgacatcttgatgtttgactgtagaatcattacagtgagactgtactgccatcgtcatcttctctagtgtggcctccgtgtggcacagttctgagctcagtacgatgtggaaacctgcgtctctgtccaggcatgcagagtggcaggcacgcctgactatgatgtacatgtgatccccacaagccccactttattagagatttgggggatcgaggccatagtccaatgggaatcttagcgtggggtcttctcctctgtccctgctgcacacgtgatgcgtttttccttagttttcattggcttgccttctggtccagcctgctcggctctggagattgtgtgagaactgttgaacagtgtggtgggagagtgtgggaggctgcagtccaaggccagccaagcctggcttcttgggtaaggctgccctggaactttgaattcatcacagtttatctgggcaccgtactggaaagatagcacacagcacagtgccattctgtagaatgttctctagcagggctgagtctaggcaggatggacacactaagtatgcatttagctcccagtgttctgagtgtagatttttctgcatcaggagaatggccaaggccactccattggccttgctgtgtcacctatccctctgctcattcagtcaggatttcctgaggtactgggtgagatctttgctctcttccaaagtacactggcatgttactggtccctttgacctgtttggtcctttcccaatgtggaaacgcagggcaagaaggagcctgcaggtaaaaaagaaaagaaaagaaagcgagaattgcgtaaccgggtagcaacaaggtagcttagggagtgaaccgagggaatcagaatggaggctgctgagcccctccctgtgtagaccgggatgcagactctcgctgttcctgctgagcctgtgtgcctggcttcctcctggcaggagcacagcactgttttgcgggattctgtggagagctccctcttcttctatacctgcaccacagctgcagatggacgcagctgaacgcagtgccagtttcccctacatcagaggacattaaagcatccccttaccagagttgtgcccctgagcaacccgggctgtgttggggttcttagagatgtcccagatcctcaattctcgctttctcctcctcctcccttcagggcctgaagaagatatctgactacatgaagagcggccgcttcctctccaagccaatctttgcaaagatggccttttggaacccaaagtagcaccacaaagtccagacctggggatactcatgagtgccctgctggctgtgggcctagagcatggctctggcgcccaccacatgcagctttctcctcctttccattccctgttcctccatctcctcttcccagcccttgcctcagtcaagcctcagttccctggtctctccatttcttcattagtcccctcccttgtctctgccctgcatccaacccttccctcactgattttcggaggactgtaccagacccctgaatccccagcctggcctgagagattagatctcactgtgctgccctggtccccaggaaggacccatttgatttgcaataaagtgtgaaccacatttgtccagtgtcctgttttgctgtctgtgacactcagggctgactgtgttgacttggttgattttgttttgttgctcgcaggaggagctagagggatggactctgggctatttga

SEQ ID NO: 2946 - DNA, 2470 bp, Rattus norvegicus
  Genbank Accession No. J05035
acctcagctatggagttggatgagctgtgcctgctcgacatgctggtctacttggaaggtttcatggccttcgtgtccattgtggggctccggtcggttggctctccgtacggccgctactcgccgcagtggcccggcatccgagtgcccgcgcgacctgcctggttcatacaggagctgccctcgatggcctggccgctgtacgagtacattcgtcctgcagccgcgcgactgggcaacctgcctaaccgcgtcctgctggctatgtttctgatccactacgtgcaaaggacgctggttttcccggttctgatcaggggagggaagcccaccctcctggtcacctttgtcttggccttcctgttctgcaccttcaacggctatgtacagagcagatacttgagccagtttgcggtttatgctgaagactgggtgacccatccctgtttcctgacaggctttgccctgtggttagtgggcatggtgataaatatccactcagaccacatcctgaggaatctgagaaaaccaggggaaactggatacaagatacccaggggaggcctgtttgaatacgtatctgcagccaactattttggggagctcgtggagtggtgtggctttgcactggccagctggtccctccagggtgtagtgtttgcactgttcacactcagcacactgctcaccagagcgaagcagcaccatcagtggtaccatgagaagtttgaagattaccccaagtcaagaaaaatactgattccatttgtgctttagtgctctgttagcgctgttgcctcccatgagctgagtctgtctgtctccctggtgactttgctctgagcacttacgaatgaattgttttccttaattctcctgcagcccctttctcaggaaaggctgggggtgggggggtgtcgtcccctggtaaaggacaaagccaatgataaactaatccaccacatgcagttaggggctacactgcctgctggatccgaagcaggtagccctgagtcattatggcgctctctgacttcagcaatcagcagcccttacaatcctgcaagattccacccaagtcagcagcagtcacgggcctccttcactgatgtgtgttctgcctgctcagcccctgccacagaggcctggaggtgtgggagtgtggcctaagcacagtctgccatccttgaccgcagacctcttggacccacccccactccctccagacactggtaagagaagccttcctgcaacatgtcctgtcctcaggaggtgagacagcagagtgcttccattcactcgatgaccccatttttgctcttcctttgggctagaattcattaaggtccttaaaaacaaaacaaaactttttcttaatagtacaaaacaaaatatcaaaacaaaatttgttattttgaatgcacccaaggaccaatcatgtcacacaaagaaagctcagggctagcctgggctgtgtagggagaccctgtttgggaaaaaaaaaatgaagataacaaccagctaactgtccaaagaagtgaccgcagtaataaaagacgccgcccacacaggcaccagcttgggagaaagatgtgcgcctgggattgtaaacccactgttgctctgggcaggctgaggcccactggtgaagagccattcccaccggacccatgcacactgcctcggggcagcgtctgcactcacctctcacccgctgccaccacagctaaagaacagaacggatagaactgtgtgctctgaacccagtgaagatgctgcatgaagacctgcaggcacacctgatggcgtgcacggtgcccaccactcgcctgactcggaccatctctgtgtgcccgctgccacctctgtgtgccctttccagctggctttcccatcagggcttcctcagctcttctgctctcagacagaaactattctctgttcctctggttcgcagaatgtctagatttgacccagaaaacttcatgacacagctacttcattttaacaaagagcagtgtttaatggggaactacccttcaatcctttaccctccccttttctggccaagtaactgcttgaaaacctaaagcactaaacattgtaggtctcctctcaaaacctcaggcctgtctggtgtgttctgaaacgtttgtgtggaaggagatattcagctgagaccctgggaatgtttgctgtgaacttgacctcccttggagggcatggtgctagataaacttggaacctaggactccaggttgctaggcggatgccctgacactaagccacatcacacattagctctgtgatgcctctttctttatgaaggaccaagctgcccacatactaagtgagattaatttaagaggaatcctgtcctaacactgtatacttcattccctacaactcaacttacttgtatgaaccatgattgttaaggaaattaataaactacatttataagtaaaaa

SEQ ID NO: 2947 - DNA, 2178 bp, Rattus norvegicus
  Genbank Accession No. J05181
cagagcggagctgcggccaggaggaggacgcggccatggggctgctgtcccaaggctcgccactgagctgggaagagacccagcgccacgccgaccacgtgcggagacacggcatcctccagttcctgcacatctaccacgcagtcaaggaccggcacaaggacgtgctcaagtggggtgacgaggtggagtacatgttggtgtcctttgatcatgaaaataggaaagtccagttgttactgaatggcggcgatgttcttgaaactctgcaagagaagggggagaggacaaaccccaaccacccaaccctctggagaccagagtatgggagttacatgattgaagggacacctggccagccgtacggaggaacgatgtccgagttcaacacagtggaggacaacatgaggaaacgccggaaggaggctacttctgtattaggagaacatcaggctctttgcacgataacttcatttcccaggctaggctgccctggattcacactgccagagcacagacccaacccagaggaaggaggtgcatctaagtccctcttctttccagacgaagccataaacaagcacccccgctttggtactctaacaagaaacatccggcatcggagaggagaaaaggttgtcatcaatgtgccaatattcaaggacaagaacacaccatctccgtttgtagaaacatttcctgaggatgaggaggcatcaaaggcctctaagccagaccacatctacatggatgccatgggatttgggatgggcaactgctgtcttcaggtgacattccaagcctgcagtatatctgaggcaagatacctttatgaccagttggccactatctgcccaattgttatggctttgagtgctgcatcgccattttaccgaggctacgtgtcagacattgattgtcgctggggagtgatttctgcatctgtagatgatagaacacgggaggagagaggactggagcccctgaagaacaatcgctttaaaatcagtaagtctcggtatgactcaatagatagctacctgtccaagtgtggagagaagtacaatgacatcgacctgaccatcgacacggagatctacgagcagctcttagaggaaggcatcgatcaccttctggcacagcacgttgctcatctctttattagagacccactgaccctttttgaagagaaaattcatctggatgatgccaacgagtctgaccattttgagaatattcagtccacaaactggcagacaatgaggtttaagcctcctcctccaaactcagatattggatggagagtagagttccgaccaatggaggtacagttgacagactttgagaactctgcctatgtggtatttgtggtactgctgaccagggtgatcctctcatacaaactagacttcctcattccactgtccaaggttgacgagaacatgaaagtggcacaggagcgagatgccgtcttacaggggatgttttatttcaggaaagacatttgcaaaggtggcaacgccgtggtggatgggtgtagcaaggcccagaccagctccgagccatctgcagaggagtacacgctcatgagcatagacaccatcatcaatgggaaggaaggcgtgtttcctggactcatccccattctgaactcctaccttgaaaacatggaagtcgacgtggacacccgatgcagtattctgaactacctgaagctaattaagaagagagcatctggagaactaatgactgttgccaggtggatgagagagtttattgcaaaccatcctgactacaagcaagacagtgtaataactgatgagatcaactatagcctcattttgaaatgcaatcaaattgcaaatgaattgtgtgaatgtccagagttacttggatcaggctttagaaaagcgaagtacagtggaggtaaaagcgacccttcagactagacatccagcaaagtggatggcagctgcagccctgaccccgagcccactcagacgctgtgaagaccaagatggcctacagtgttccagttgcccacaagtgactagaagcttccttcagtaggtgaatctgagtttgtatatgtatatactaaagtatttttatgattattaacaatgtattttaataacactgtatctacagtcatggtgaactggcttgtacattttt

SEQ ID NO: 2948 - DNA, 1021 bp, Rattus norvegicus
  Genbank Accession No. K00996
acagagttccatcatgagaacctcatgatctccctgctctctctcttctttgctggcactgagaccggcagcaccacactccgctatggtttcctgctgatgctcaagtacccccatgtcgcagagaaagtccaaaaggagattgatcaggtgattggctctcacaggccaccatcccttgatgatcgtaccaaaatgccatacactgatgcagtcatccacgagattcagagatttgcagatcttgccccaattggtttaccacacagagtcaccaaagacaccatgttccgagggtacctgctccccaagaacactgaggtgtatcccatcctgagttcagctctccatgacccacagtactttgaccatccagacaccttcaatcctgagcacttcctggatgccgatgggacactgaaaaagagtgaagcttttatgcccttctccacaggaaagcgcatttgtcttgacgaaggcattgcccgaaatgaattgttcctcttcttcaccaccatcctccagaacttctctgtgtcaagccatttggctcccaaggacattgacctcacgcccaaggagagtgacattgcaaaaatacctccaacataccagatctgcttctcagctcggtgatcgggctgaggcagccaggtgccccagttctgttgggaatggcctcatgtttctgcctctgggggacctgctgaaaaccaggctcaaggccactgctcacatcttcctattgcagttctccaaagtcccaaggcttgttcttattcctgtgaatggcactgaagaagtcaatcgactgtcttattttgacatgtgaacagagatttcatgagtacacatctcatgctgagtcacttccctcttcctcctaatagcccacgtccccacttatcagccctccatggtctgtgatctgtgctaatggactctgtatatggtctcagtgctatgtctacagacttacatagtatgtatggttcaggtaaacagaatcacagagtgtgtg

SEQ ID NO: 2949 - DNA, 1053 bp, Rattus norvegicus
  Genbank Accession No. K01701
cctccccttctaggctgtgtcccttttgagctcaggtcattagctgaggcggtgaccttgaccccagcccagaccctgcaaatgaagggcctgcttctaaacagtgtggaacagtttgacccaagagacctggctgtgaccagtcatgcagtcaccctcttagactgggccccaccatggcagtggacaaggcataaaaaggtcggtctgggctggagaaaccatcaccgacggtggatctcggactgaacaccaacgccatggcctgccccagtctcgcttgctgcctgcttggcctactggctctgacctccgcctgctacatccagaactgccccctgggcggcaagagggctgcgctagacctggatatgcgcaaggtgagtctccccgacgccatcccgtcccgttctggcaaggctaaggaccagagatgctctcccaccttcagagagcatcccctcacacttgccagccctacgcggcctcgcatgggaacccggagctccctcttgacgccgtgaaggcacgctgtccctgccccaccacagtcccgatatggattgtgcacagcgcccatccgcgtctttccccccgcagtgtcttccctgcggacccggcggcaaagggcgctgcttcgggccgagcatctgctgcgcggacgagctgggctgcttcgtgggcaccgccgaggcgctgcgctgccaggaggagaactacctgccctcgccctgccagtctggccagaagccttgcggaagcggaggccgctgcgccaccgcgggcatctgctgtagcccgggtgagcaggagggggcctagcaggaccgaccggcagggagccgtcgggtttgctgctcaggccactgacccatttctcttgcagatggctgccgcaccgaccccgcctgcgaccctgagtctgccttctccgagcgctgagccctgctttgtgatgatacctttagggcgcttccttcgttccccatggccactaccagaaaaaaattaaaaaaaaaacataaataaataaataaagcagatttccttttc

SEQ ID NO: 2950 - DNA, 1362 bp, Rattus norvegicus
  Genbank Accession No. K01721
accttcctcttccagtgcatcacagccaacatcatctgctccattgtgtttggagagcgctttgactacacagaccgccagttcctgcgcctgttggagctgttctaccggaccttttccctcctaagttcattctccagccaggtgtttgagttcttctctgggttcctgaaatactttcctggtgcccacagacaaatctccaaaaacctccaggaaatcctcgattacattggccatattgtggagaagcacagggccaccttagacccaagcgctccacgagacttcatcgacacttaccttctgcgcatggagaaggagaagtcgaaccaccacacagagttccatcatgagaacctcatgatctccctgctctctctcttctttgctggcactgagaccggcagcaccacactccgctatggtttcctgctcatgctcaagtacccccatgtcacagagaaagtccaaaaggagattgatcaggtgattggctctcacaggccaccatcccttgatgatcgtaccaaaatgccatacactgatgcagtcatccacgagattcagagatttgcagatcttgccccaattggtttaccacacagagtcaccaaagacaccatgttccgagggtacctgctccccaagaacactgaggtgtatcccatcctgagttcagctctccatgacccacagtactttgaccatccagacaccttcaatcctgagcacttcctggatgccgatgggacactgaaaaagagtgaagcttttatgcccttctccacaggaaagcgcatttgtcttggcgaaggcattgcccgaaaggaattgttcctcttcttcaccaccatcctccagaacttctctgtgtcaagccatttggctcccaaggacattgacctcacgcccaaggagagtggcattgcaaaaatacctccaacgtaccagatctgcttctcagctcggtgatcgggctgaggcagccaggtgccccagttctgttgggaatggcctcatgtttctgcctctgggggacctgctgaaaagcaggctccaaggccacctgctccacatcttcctattcagttctccaaaagtcccaaggcttgttcttattctgtgaatggcactgaagaagtcaatcgactgtcttattttgacatgtgaccagagatttcatgagacacatctcatgctgagtcacttccctcttcctcctaatagcccacgtccccacttatcagccctccatggtctgtgatctgtgctaatggactctgtatatgtctcagtgctatgtctacagacttacatagtatgtatggtttcaggttaaacagaatcacagagtgtgtg

SEQ ID NO: 2951 - DNA, 912 bp, Rattus norvegicus
  Genbank Accession No. K02111
cgggcggcgctgcaggctgagatcgaggagctgcgggccactctggagcagacggagaggagcaggaagattgcagagcaggagctgctggacgccagtgagcgcgtacagctcctccacacccagaacgcgagcctcatcaacgccaaaaagaagttggaaaatgatgtttcacagttgcagagtgaagtggaggaagtaattcaaagagcacgcaatgcagaagagaaggccaagaaagccattactgacgccgccatgatggcggaggagctgaagaaggagcaggacaccagcgcccacttggagcggatgaagaagaacatggagcagacggtgaaggacctgcagcaccgtctggacgaggctgagcagctggcgctgaagggcggcaagaagcagatccagaaactggaggccagggtacgtgaacttgaaggagaggttgagaatgaacagaaacgtaatgctgaggccgttaaagggttaaggaagcacgaaagaagagtaaaggaacttacctaccagaccgaggaggaccgcaagaacgtgctgaggctgcaggacctagtggataaattacaggcgaaggtgaaatcttacaagagacaagcagaggaggctgaggaacaatccaacgtcaacctggccaagttccgcaagctgcagcacgagctggaggaagccgaggagcgggcagacatcgccgagtcccaggtcaacaagctgcgggtgaagagccgcgaggttcacaccaaaatcagtgcagagtaaacgcatcttgaggaggccgccaagtggctgaaggaaaggcacagaatgtgctgccttgggtcgcttgctgggtcgcttgcctctcgtgtttacttttctcccactgctgactgaataaaaccacaactcattgtaatt

SEQ ID NO: 2952 - DNA, 681 bp, Rattus norvegicus
  Genbank Accession No. K02815
tcagcccaacaccctcatctgctttgtagacaacatctttcctcctgtgatcaatatcacatggttgagaaacagcaagccagtcacagaaggcgtttatgagaccagcttcctttccaaccctgaccattccttccacaagatggcttacctcaccttcatcccttccaacgacgacatttatgactgcaaggtggagcactggggcctggacgagccggttctaaaacactgggaacctgaggttccagcccccatgtcagagctgacagagactgtggtctgtgccctggggttgtctgtgggcctcgtgggcatcgtggtgggcaccatcttcatcattcaaggcctgcgatcagatggcccctccagacacccagggcccctttgagtcacaccctgggaaagaaggtgcgtggccctctacaggcaagatgtagtgtgaggggtgacctggcacagtgtgttttctgccccaattcatcgtgttctttctcttctcctggtgtctcccatcttgctcttcccttggcccccaggctgtccacctcatggctctcacgcccttggaattctcccctgacctgagtttcatttttggcatcttccaagtcgaatctactatagattccgagaccctgattgatgctccaccaaaccaataaacctctcataagttgg

SEQ ID NO: 2953 - DNA, 615 bp, Rattus norvegicus
  Genbank Accession No. K02816
tttcttcgagctcttcaggcagtgattctgacagcgaagttgaaaaaaagttaaagaggaaaaagcaagttgttccagagaaacctgtgaagaagcaaaagcctagtgagagttctagagcactggcatcctccaagcagagtagcagcagcagagatgataacatgttccagattggaaagatgagatatgtcagtgttcgggactttaaaggaaaaattctaattgatattagagaatattggatggactcagaaggtgaaatgaaaccaaggagaaaaggtatttctttaaacatggaacaatggagccagctgaaggaacagatctctgacatagatgacgcagtaagaaagctgtaaagtctgagccatatcaagcctgtactgtcgtagctgttttacttcgctgtcttttcacattggcttttgttttctaaaatgttgtttttcacgctgttgtatatttggattgcagaacaatttgtaagacaaatacttttttttaatgtgcattattaaaatgttctaagtgaagctaattgtcgactttattaaagaggattgctttgtgccccttacctagtgtaaaataaagtcagatcattacaatctt

SEQ ID NO: 2954 - DNA, 593 bp, Rattus norvegicus
  Genbank Accession No. K03045
ggctgcagcctcctctcgctaaggaaaggctgcctgcccgttctagggagtcagtggttagcaagttggtcagggccccggggctactgtgtctctctgacttacagacgatgaccactggatcatcgatacggactacgacaccttcgctctgcagtattcctgccgcctgcagaatctggatggcacctgtgcagacagctactcctttgtgttttctcgtgaccccaatggcctgaccccggagacacggaggctggtgaggcagcgacaggaggagctgtgcctagagaggcagtacagatggatcgagcacaatggtggagcaactcttcctgagggacttagcagggctgggaggataagaggtgcagcatctgtgcaagtgggttacccgaggcctcctttggaccaagtctgattaaatttttccaggactgccatcagccacacagacaaggaccaaaggtttctcttcccctaaacgctaggcacttttctataaccaaagttgtgaaaccactctcttcttatgtttttgctccccacatttgctgctagtgcacaagccgagaccatcgcaagataaggtt

SEQ ID NO: 2955 - DNA, 2639 bp, Rattus norvegicus
  Genbank Accession No. K03243
gaatgctggcagtgtgggtgctatgtaaaagtatttacatagctttgtagagtgagccaagcccagtctgtttgggatgactcttcacagtgcctcgaatctgtcacacgtcttagtaagcagagtcacagagtttctgtcacatcatcctcctgcctacagggaagtaggccatgtccctgccccctactctgagcccagctgtgggagccagccctgcccaatgggctctctctgattgacttctcactcacttctaaactccagtgagcaacttctctcggctcgttcaattggcgtgaaggtctgtgtcttgcagagaaggttcttcacaactgggataaaggtctcgctgctcaagtgtagcccagtagaactgccaagccccttcccctcctctccctagactcttggatgcaagaagaatccaggcagctccaagggtgattgtgtccaacctagaatgtcttgaaaaagacattaaggggactagagaagacaggggatccaacggttctctgcagcccagcctgactgacatgtaactcttctggttctcaccagccagctggacctgcttagtattctttctgcctcagtttcccagcctgtacccagggctgtcatagttccatttcaggcagtagtaatgaatgagctgacataaaacatttagagcaggggtcagtatgtatatagagtgattattctatatcaggcattgcctcctcggaatgaagcttacaatcacccctccctctgcagttcatcttggggtggccagaggatccagcagacacctagtggggtaacacaccccagccaactcggctgttgcagactttgtctagaagtttcacgtctcagagctgaattcccttctcatgacctttggccgtgggagtgacacctcacagctgtggtgttttgacaaccagcagccactggcacacaaaatgtgcagccagcagcatatgaagtccaagaggcgtcccggccagccctgtccttgacccccacctgacaattaaggcaagagcctatagtttgcatcagcaacagtcacggtcaaagtttagtcaatcaaacgttgtgtaaggactcaactatggctgacacgggggcctgaggcctcccaacattcattaacaacagcaagttcaatcattatctccccaaagtttattgtgttaggtcagttccaaaccgtgctgaccatggctatgatccaaaggccggccccttacgtcagaggcgagcctccaggtccagctgaggggcagggctgtcctcccttctgtatactatttaaagcgaggagggctagctaccaagcacggttggccttccctctgggaacacacccttggccaacaggggaaatccggcgagacgctctgagatctctgatccagaccttccaaaaggaggaagaaaggtaggcagggccattccactctcctctccaaaagtaccactgaggggtccactcacagtctttgccctgacaaccaaggccctctagccatgtgcaactcatgcaaagtctacagaaggaacgggaagggcccatgggtgccggtgttcaagagcctctctttttgtttcaggtggcaccagagtccctgcctctctccacaccattgcaagaatgcctcctcagctgcataatggtctggacttctctgccaaggtcatccagggcagcctcgacagcctgccccaggaagtgaggaagtttgtggaaggcaatgcccagctgtgccagccagagtatattcacatctgcgacggctccgaggaggagtacgggcggctgctggcccacatgcaggaggagggtgtcatccgcaagctgaagaaatatgacaactggtgagtcccttcagcccaaagtctctgcctacaggctccccagctctaccttctcggagtctggagaataaagacccttgcagtagcaaacgcctgagaagcttaggagatcagtcagaatccagacaccctgtgaggttagcatagccagcttctagattccagatagccatgcaaggcggcccctttccctagggccagctcatggcttagcaaatgtctacctggtcaagttcccgttggcttggcttccatacctaagtaacacggtcaacgtccttgtgtctgcaaggccgggaagagcctgaggtaggcaagagaggtacatccccaagggtaccttgctgaaggcatccctgtgactttttcagttggctggctctcactgaccccagggatgtggccaggatcgaaagcaagacggtcatcattacccaagagcagagagacaccgtgcccatccccaaaagtgggcagagccagctgggccgctggatgtcagaagaggacttcgagaaagcattcaacgccaggttcccggggtgcatgaaaggtgggtgaggccagaccccaggcctgacagtgtgctgtgtgcacgttcacgctcccggtagtagcttaagctgcaaagggtggcccgcgtgcgaagctccgcgtctggttctgtctcacggaatatcaaattgttctctgagagtacgggtggctccgacctgtcatctcagacatggaagctgaggcaggggcattcaaagtttaaggcc

SEQ ID NO: 2956 - DNA, 551 bp, Rattus norvegicus
  Genbank Accession No. L00117
gcgccttccagccgtcgggtacatggagccttggtccatgaatgctggctcacagccattctaagacctgtccttgcttgtcttggcgtacaccgaggcatcttgtcgtacaacacctactctctctgactgtcccataaacccagtgtgctgccacacccaacaagtgagaggacaggttacggactgagtatcctgtcttttcctcaggtcattgcctacaactgaacgtcttcctgagtccagtggcctccccaagatggtgcttagctctgcaataagatctgaagtaagcgagaaggagttagggctggggttatcgctcagcggcagaacactttctaatatgtgcgaagcctgggttccatccctaatactgcagcgggggcaggggagtgctgctggtgtctctctgctctttctccagtatctggggcaaaggtggttaatgaaaaacagctctgagactgagccagatacagaaaggcaaataaaactcaatgtgttatcatactgtgtgttcgcgttggtaattaagcccctacaggaaa

SEQ ID NO: 2957 - DNA, 2350 bp, Rattus norvegicus
  Genbank Accession No. L00191
gtgcccggaagcaagtccaccgccaccatcaacaacattaaaccaggagcagactacaccatcaccctgtatgctgtcactggccgtggggacagtccagccagcagcaagccagtttccatcaattatcaaacagaaattgacaagccatcccagatgcaggtgacggatgtccaggacaacagcatcagtgtcaggtggctgccttcaacttctcctgtgacaggttacagagtgaccaccgctcccaaaaatggcctaggaccaacaaaatctcaaactgtcagtccagatcaaacagaaatgaccattgaaggtttgcaacccaccgtggagtatgtggttagtgtctatgctcagaaccggaacggagaaagccagcccctggttcagactgcagtgaccaccattcctgcgccaaccaatctgaagttcactcaggtgtcacccaccaccttgactgcccagtggacagcgcccagtgttaagctcactggctaccgagtgcgggtgaccccgaaggagaagacaggaccaatgaaagaaatcaacctttctccagacagcacctccgtgattgtgtcagggctcatggtggccaccaagtatgaagtcagcgtctatgctctcaaggacacattgacaagcagaccagctcagggagtcgtcacgactctggagaatgtcagccctccaagaagggcccgtgtgaccgacgctacagaaactaccatcactattagctggagaacgaagacagagacgatcactggcttccaagtcgatgccattccagccaatggccagaccccggttcagaggaccatcagcccggatgtcagaagctatactattacaggtttacagccaggcactgactacaagatccacctgtacacgctcaacgacaatgcccggagctctcctgtggtcattgatgcctccacggccattgatgccccatccaacctgcggttcctgaccaccacacccaactccttgctggtatcatggcaggcaccccgtgccaggattactggctacattatcaagtatgagaagcctggatcccctcccagagaagtggtccctcggccccgccctggtgtcacggaggccaccatcactggtttcccatcaggtctggagccaggaaccgagtacaccatctatgtcatcgcactgaagaacaatcagaagagtgagcccctgattgggaggaaaaagacaggtaaagactcctaaccgaccgttggtttgcagggtgaagttctctacgttttgacacatcgctcctggatttttttttttctagcagaatggcttatatattgtactattaggcacaaatcacctaacatgctctaaaaatgtcttatttatttttctacagccttaagcttcttttaccttgcagaaattcaaattagattgtttgaattggggttgaggtgggggggggctttttaatggtgagagtaaaacctctccgatttgtgttgatttgtttattatttgatttctgaacttcagatatttcagttagttgcaaaggcttaactggagcagagatggctgtctgtggggctcagcggttcaaagctttgtctgtatgagaattcaaactaacattttttcccccatctaaactataaagaaatctgtgaaaagaagaaaaaatccagatttctttctagagtgttctgtgatctgagaaccgctggctgtctgggagcattgatcgggttgatatacagttgttgcctggattgatggtgattggttgcttcttctttgagcttaacgcgctttgcttttttggctctaacctctctcttggctagatgagcttccccaactggttacccttccacaccccaatcttcatggaccagagatcttggatgttccctccacagttcaaaagacccccttcgtcaccaaccctgggtatgacaccgaaaatggtattcagcttcctggcacatcccaccaacaacccagtgttgggcaacaaatgatctttgaggaacatggctttaggcgaaccacgccacccactgcggccacccccgtcaggcttaggccaagaccatacctgccgaatgtagatgaggaggtccaaatcggtcatgttcccaggggagacgtagactaccacctctatcctcatgttccggggctcaatccaaatgcctctacaggacaagaagctctctctcagacaaccatctcttggacgccattccaggagagttctgagtacatcatttcatgccaacctgttggcactgacgaagagcccttacaggtatatattacagcccttattatgagtgtctctctagat

SEQ ID NO: 2958 - DNA, 685 bp, Rattus norvegicus
  Genbank Accession No. L00320
acgagtgctgacatgatcactctctgtgttcacaggaaagcacatttgtcttggcgaaggcattgcccgaaatgaattgttcctcttcttcaccaccatcctccagaacttctctgtgtcaagccatttggctcccaaggacattgacctcacgcccaaggagagtggcattggaaaaatacctccaacgtaccagatctgcttctcagctcggtgatccggctgaggcagccatgtgccccagttctgttgggaatggcctcatgtttctgcctctgggggacctgctgaaaaccaggctccaaggccactgctccacatcttcctattgcagttctccaaagtcccaaggctttttcttattcctgtgaatggcactgaagaagtcaatcggctgtcttattttgacatgtgacagagatttcatgagtccacatctcatgctgagttacttccctcttcctcctaacagcccatgtccccagttatcagccctccatggtctgtgatctgtgctaatggactctgtatatggtctcagtgctatgtctacagacttacatagtatgtatggttcaggtaaacagaatcacagagtgtgtgagcttcggagtcttgtgcctttacttcacataatattattctaggttcctgtgttctacaggccacagtcacacacattcat

SEQ ID NO: 2959 - DNA, 1619 bp, Rattus norvegicus
  Genbank Accession No. L08812
ggattccaagctgttcagaccatgcattcctcatgaacagaccccttgacttttgcgcttatgttgagggacgagggactatatgtggagctgtttgcagctgtaatgatataacacagctagaacccaatcagtgctggtccaggcacacttgaaacctctacgaggcctcagcttccaaaggctcagacacagcaagttactccttttatgactcttgaccatcggttgttcagccagactctcaagagagcacagcctctagcagcaagctgcatgcctctggcagagcatggacccaggagcccagacagtgatgctggctgtgcaggaaacccattcacaaatcctctggctcttgggaaagaagatggcgttgtggaatggcggttgtctggtagtattttggatgtatatagtggcgagcagggcatttctccagttaacactggtcttatgaatgcttcttgtccaagtattctacccatgaagaaggaaattgcagaaactgacactagagctttggcaaaggagagacagaaaaaggacaaccacaacctcattgaaagaagaagaaggtataatattaattacagaatcaaggagcttggcactcttattccaaagtctaatgatcctgatatacgctggaacaaaggaaccattctaaaagcatcagtggactacatcaagtggctacaaaaagaacaacagagagcccgggagttagaacacaggcagaagaaattagagcatgctaaccggcagcttatgctccgcattcaggagctagaaatacaagcacgtgctcatggtctaccaatcctggcttcactcggcacagctgactttggtacccacatcactaaacagcagacccattctgagaagaactcagtaggctgttgccaacaactgactccatcccaggggacaagcccggagttctatgagcaagctgtggctttctctgatccactgtctcacttcacagatttatcgtttagtgctgctttgaaagaggagcaaagattggatggtatgctactaagtgatacaatatgcccctttgggacggacccgctactctctgccatttctcctgcagtttccaaagcgagcagtcgaagcagccttagctcagaggatggcgatgaactgtaagccacagacagactcaagtcatcaaccaggaagcagctccgtgctggtgcttctcaatcgtggtctgtgcttcatacctggctctcacttaattctctgaaaggaatgattataagtgatggaatatctcatgggaagaagaaacatgatgctaaagaatcattgaagatcacagtattgttgcccactttgcctacagagttcagatttccttacatttaatttcctggaagtggttcaacttaataaccactgcggtgttaataccgtcagagctgtgacatcatagaatattactggagttacagtctctcaggagactgcaacatcccactcccctctcacttccacaccctgcctcaccttctacaacatcattttctgaagattcacaactaagaagattgatgataatttttttcctttgtctggtggacatattacctatagtcaaa

SEQ ID NO: 2960 - DNA, 2082 bp, Rattus norvegicus
  Genbank Accession No. L08814
gaattccaccagaacgatgatgctgaagtatctctcatggaggtgcgcttctatgtccctcccacgcaggaagatggagtggaccctgtggaggcctttgcccagaatgtcctgtcaaaggcagatgtgatccaggccactggagatgccatctgcatcttccgggagctgcagtgtttgactcctcgtggtcgttacgatatccggatctaccctacctttctacacctgcatggcaaaacctttgactacaagatcccctatactacagttctccgtctcttcctactgccccacaaggatcagagacagatgttctttgtgatcagcctggatccccccatcaagcagggccaaactcgttaccacttcctgatcctcctcttctcaaaggatgaggacatctccttgactctcaacatgaatgaggaagaagtagaaaagcgctttgaggggcgactcaccaagaacatgtcaggatccctttatgagatggttagccgggtcatgaaagcacttgtaaaccgtaaaatcacagtcccaggcaacttccaagggcattcgggggcccagtgtatcacctgctcctataaggccagctcaggactcctgtacccactggagcggggcttcatctatgtgcacaagccccctgtgcacatccgcttcgatgagatctctttcgtcaactttgcccgtgcgaccacaaccactcgttccttcgactctgagattgagaccaagcaaggcactcagtataccttcagcagcattgagcgggaagagtatggaaagctgtttgattttgtcaatgcaaaaaagctcaacatcaagaacagagggctgaaagagggcattaacccaggttatgatgattacgctgactctgatgaagaccagcatgatgcctatttggagaggatgaaggaggagggcaagatccgggaggagaatgccaatgacagcagtgacgactcaggagaagaaactgatgagtccttcaatcctggtgaagaagaagaagatgtggcagaggagtttgatagcaatgcctctgccagctcctccagtaatgagggcgacagcgaccgagaagagaagaagcggaaacagctcaaaagagccaagatggccaaggatcggaagagccgcaagaagtcttcagaggggaagaagggtaaggatccaaatgcccccaagaggcctatgtctgcgtacatgttgtggcttaatgcaagccgagagaagatcaagtcagatcaccctggcatcagcatcacagatctttccaagaaggcaggcgaaatctggaagggaatgtccaaagagaagaaagaggagtgggaccgcaagggggaggatgctaggagggagtatgaggaagccatgaaagagtatgaaggaggacgaggggactcgtctaaaagggacaagtctaagaagaaaaagaaagtaaaagcaaagttggaaaagaaatccactccttcccggggctcatcatccaaggcttcatccaggcagttgagcgacagcttcaagagcaaagagtttgtgtccagtgacgagagctcttcaggcgagaacaagagcaaaaagaagaggaggcggagcgaggactctgatgaagaggaactagccagtactcctccaagctcagaggactctgcctcaggatctgatgagtagaggaagagaattcctgcccttgccctgtcacacctccaggctccctactcatttggtaccagtgtctatggattctgtgccatctgagtaactgctcttggtggcttccacttccctgaggctttgagggaagcacctaacctctgctttgcaaggaaatgctaccatgcaatctggaaagagacttgggtactggctacgcgatcgaaggatccaagtacctcatcctactttgctactttcctgactgtaggggaaaactgcttcctgtcctgttcaagttgctgcagcaggggtcatgcgaagtcaggcctgtagctcctaatagggggctatttctacttttattttgtatgaactgactttggaaaaaaaaaaaaaaaaaaaacggaattc

SEQ ID NO: 2961 - DNA, 2240 bp, Rattus norvegicus
  Genbank Accession No. L10073
ggttcccagtgtgcaggcatcagtccccagttctgcaggcggttggttactctgaagaccacaaagagactgggagaggttgatgcgctggacaaagctagactaaggagtctcaactggaaaaaagggtctacgaaaacctcaaaaaagaagcgcctacagtttggaaaaagaacaaaggtggcgcggcttagacttctttttgtgttgctgggctcgcgcagtgcccctcctgcctcgccacctaaccacagttcatgcaatcacgggcacatctgccagagagcccgagtccctgaacaatggaagtctctaacctctcaggcgccacccctggcattgcctttcctccgggacccgagagctgcagtgacagcccaagttccggcagaagcatgggatccaccccaggggggctcatcttgtccggccgcgagccgcccttctctgccttcaccgtactcgtggtaactctactggtgttgctgatcgctgccactttcttatggaatctgctagttctggtgactatcctgcgcgtccgcgccttccaccgtgtgccacataacttggtagcctcgaccgccgtctcggacgtcctggtggcggctctggtgatgccactgagcctggtgagcgagttgtcggctgggcgacgttggcagctgggcaggagtctgtgccacgtgtggatctccttcgacgtgttgtgctgcacagccagcatctggaacgtggcggccatcgccctggatcgctactggactatcacgcgccacctgcagtacacgctgcgcacccggcgccgcgcttcagcacttatgatcgcgatcacctgggcactgtccgccctcatcgcgctcgccccgctgctctttggctggggcgaagcctacgatgctcggctgcagcgttgccaggtgagccaggagccttcgtacgccgtcttctccacctgcggagctttctacgtgcctctggccgtggtgctcttcgtctactggaagatatacaaagccgccaagtttcgattcggccgcagacggcgggcggtagtgcccctgcccgccaccacgcaggcaaaggaagcacctcaggagtctgagacggtattcaccgcgcgttgcagagcgacagtggccttccagacaagtggagactcctggcgggagcagaaggagaagcgagccgccatgatggtggggatcttgatcggtgtgtttgtgctgtgctggatccccttcttcctgacggagctcgtcagcccgctctgcgcctgcagcctgccacccatctggaaaagcatattcctgtggcttggctattcaaattcgttcttcaatcccttaatctacacggcctttaataagaactacaacaatgccttcaagagcctctttactaagcagagataagcagggctggggagataaaaaggaagaccggggaagagaaaggggatctgccgtcctcatttcaccagagacctgggggcttctccccgccgcccacacccccctaacgacactccagaaatcacaccgtagggcctggaatgttgagttctcacgaaggtagacaacggtttggcaaatacatccatgccttctacgcgtcgtgacagacattgctagtgaattgtgctacatttctgcaccaggcaggaaccccgccaaaccctttccgggtgtattttaggtattattgctcatttgtcagactccacatgtggcagagttgatttgcttttgcgttagtactatgtccctcagtgagggtctcttggggctctcctgagactgactccttgacatagcctctcctctaccccttatccatcagagcactttacctttcttagcctcacacaggacctccacaaggcaatgattctcagtttaggaagagatgtcctcgcctgaagctttgttaaaaagtgttccacacagacgtcgtcaagatggctcagtagagggggttggggatttagctcagtggtagagcccttgcctagggagcgcaaggccctgggttcggtccccagctccgaaaaaaagaaccaaaaaaaaaaaaaaaaaaaaaaaaagatggctcagtagatgaaggcgcctgtccccaagcctggtggcctgcttttgagatacatgtaatggaaggaaataaaatgattgcaagttgtctctgacctccagatatgtgccatcagccctctcccccatgtgcacagcggccgcgaattc

SEQ ID NO: 2962 - DNA, 2500 bp, Rattus norvegicus
  Genbank Accession No. L10336
ggtagccactttggacttatcttcaagaatgtgacatttgtggtaatattctttgcttccccatggcctcaccgtgccacaacagtgttacgtgtttgacactcactgcttgtgcacccatcacttctgatgtatggcagttttgggtcaataagatattagtattactttgactttgacttgtgagtctaggttaaaatcattcggaggattttttattctccgaggtcaccccaaccgaaattttttagttcatatttattttgttttagcccattaggttgtttttatataattgaactagtaaattaaagctccatagggcttctccgtcttattgggagattccagcctcttcactggaaggtcaatttcactgattgaaagtaagagacagttgaaccctcgtttagccattcattctagtccctaattaaggaacaagtgattatgctacctttgcacggtcaggataccgcggccgtttaactttagtcactgggcaggcaatgctctaatacttgttatgctagaggtatgtttttggtaaacaggcggggttcatgtttgccgagttccttttactttttaatctttccttaaagcacgcctgtgttgggctaacgagttagggataggtaattctattgttgggttagtacctatgattcgataattgacaatggttatccgggttgtcatacacttgtgctaggagaggcaatggaaccctgcgagctgcagaacgagctagtgtcagccgaaggccggaaccggaaggcggtgctgtgccagcgttgtggctctcgggtgctgcagccagggactgctcttttctctcgccggcagcttttcctcccctccatgaggaagaagccggatctggtggacggcagcaatcctgatggtgatgtcctcgaggaacactggctggttaatgacatgttcatctttgagaacgtgggctttaccaaggacgtgggcaacgtcaagtttctagtctgtgcagactgtgagattggacccattggctggcattgcctagatgacaagaacagcttctatgtggccttggagcgagtttcccacgagtaactgaggggtttgggacttggctccaccctagctataaagctctgcccacaagaaccgacactgatgtgtcagcagtgctggcagacttcttggtactaatataagcaccggtgtttgcccttgaacttgcagagggccggtcctgtttcctcaggcctcagagcatgtctcctacttagtcctctctgtcacatgtgtcctagagccctttcccctgacttggaacatggaagaacacgcgagtgctctaccagtgtagtctggttccggcactctgcctccgcacctcgatgccaagctctcttcttctcagcaagaacaacattcatctttagccatcacgacgggaactaagatgctaatatttgaaactccacctttcctcattctagaagccaagtgtgatagggtgcacatctgtaatcctaggtcttgagtgggtagaggcaggaagatcaggagttcaagggcagccttagctacatagactgggccaagtgagatgttgtctcaaaaaacataaagcatacaagtatttgagagtaatctcattgtatgtgacctacttatctacagtaatttattctttttaaaagtaaaacatttacagatgtcagtatttaaacctcactttagatacatttttagtactgtgtttgagagccttttttccgggtcaatagtggcattttataatgaggacgaacacgactcctcttccctcagatcttgatcaggtttctctttttagtcattccttgcccctgatgtcaaccctaaggaaaactcagccctagctgtgtgccagactctcttgtaaacctgttccacggacatttctattgttatggacaaggtgttaccttttcttattattagccaacttaaatcttcaatatgatttccagttactctgtcatttctcttctggagtgactcagtagcttaaaaggactctgtgtaaacaggttcaaatactgtgtcatcatcccctcctctgagggcctaaattgagataagtagagacttcattattcctcatgccagagcttaggaagtgggggcagatcaagagttcaaggtcagcctcagttactataatatcaaattcaaggccagcctgtactatggagatcttgtttcaaatgaacaaaacacaaaataaacaagtaggacctgcaaaagtgacacgtagttaaaaatgtttgctgctctttcaggcgacctgagttcaggaccttgcaccctcatgggaggtttattccagttcaaggagatctgcgccttctggtccctgcagatgccttcatgtgtgtggcacccatacaaacaagtgagcacactcgcgtacacacacacacacgcacgcacgcacgtgaataaaaattttacaaaaaaaaaaaaa

SEQ ID NO: 2963 - DNA, 123 bp, Rattus norvegicus
  Genbank Accession No. L13235
cagaagtttaaagtaatccttggctacctagtgagtgtaaggccagcctggaatcaataagagttggtttcaaagaagcaggaggagaaggaggaacaggaacaggaggaggagcagggggag

SEQ ID NO: 2964 - DNA, 126 bp, Rattus norvegicus
  Genbank Accession No. L14001
gagcccaagaggtgtctctgagagacgagggttcagagcaggggctcatttcaggaggaagagccatttgaagcctctttatacacatatgctaggatgtcaggatagctcttctcctccatctct

SEQ ID NO: 2965 - DNA, 209 bp, Rattus norvegicus
  Genbank Accession No. L14002
cagatactctcgacctcttacatttggagagttttgagcagacaggaagaagacggagcctgggagcagctgttctccaatagtcaaattaagactgttcctctctgagctctgtacttcaaccagcacctttaggcagaagccatcaaatcagaaatgtctgttaataattaaagtctatgattgccaccaaaaaaaaaaaaaaaaaa

SEQ ID NO: 2966 - DNA, 115 bp, Rattus norvegicus
  Genbank Accession No. L14003
aatcccaatattaagaggttaaaaaataggaccagaagtttaaagtaatccttggctacctagtgagtgtaaggccagcctggaatcaataagagttggtttcaaagaagcagga

SEQ ID NO: 2967 - DNA, 242 bp, Rattus norvegicus
  Genbank Accession No. L14004
tcctgtcactcatgtggacctcagataagagcacagatactctcgacctcttacatttggagagttttgagcagacaggaagaagacggagcctgggagcagctgttctccaatagtcaaattaagactgttcctctctgagctctgtacttcaaccagcacctttaggcagaagccatcaaatcagaaatgtctgttaataattaaagtctatgattgccaccaaaaaaaaaaaaaaaaaa

SEQ ID NO: 2968 - DNA, 1210 bp, Rattus norvegicus
  Genbank Accession No. L15011
gaacagccgcggcggcccggctggcgcgcggctctccatcctcgctcggtctccaccgctccaggggcggatggggtgggctgagccggggctgccacagcctccgccactaccgccgccacccggggaagaccagagcaaagcagcgacgagtcccaagaaagagaaagagagaggggctgcagggcggccggtccccgtctaggaccaaggagcgcggcgatgtgagctatgagtgcgccgtggacactgtcaccggagccgctgccgccatcgacggggcctccggtgggcgcgggcctggacgtcgagcaacgcacggtgttcgccttcgtgctctgcctgctcgtggtgttggttctgttgatggtgcgctgtgtacgcatactgctagacccctacagccgcatgcccgcctcgtcctggaccgaccacaaggaggcgcttgaacgtgggcagttcgactatgcgttggtgtgatgaggaaccagtcccgggcaggtccttagagagatcccacaagggtcggccccgtggagggtgcccccagcctggactgcgctcagggttatgcctagatgccctagctcagagttgagggcgttcggagaagtccagcccttacccaccttaaccacccatcttccatcctggccaggccagaaccccccacctggtgcctttatctgccctgtccccttctctacacactcatcctcaatgctgatccctcaacactgaatccctagtgagcgaagcacccggcaccaacctcagccttccccaacaaccaggcatgttacatcctttcctgggaatgcggactcctcttatctcttattcctttccccctgttatggtcatcagcagtgtcagtgcacttcttgagttctggccctggcaggcaggctctcttcgactcacattggacactgcctacctataatgcacggtacagcctgccccagagacagaccccaaaactccaccatggctgctgcttgtgttgataatgtctggcacttatgtgcaggagtacaaggaggctcattcccttcccagacccggccccagcacaggttagagtgcctttcctttcctttgccccacctctcctatctccccccatgtccccatgcccttccctgcctatcacacctccctggctctgaacggtggtgatgataataaaaactattattgagtgctt

SEQ ID NO: 2969 - DNA, 2301 bp, Rattus norvegicus
  Genbank Accession No. L16532
ccccgtgtccctcgcgcaggcgggcggccccggagacatagtgcccgcaaaggcggtgacggcggtgcgcccactcatcatgagcacaagctttgcccgaaaaagccacacattcctgcccaagatcttcttcagaaaaatgtcatcctcaggagctaaggacaagccagagctgcagttccctttccttcaagatgaggacacggtggctacgctgcacgagtgcaagacgctgttcatcctgcgtggcctgccgggcagcggcaagtccactctggctcggctcatcgtggagaagtaccacaacggcaccaagatggtgtctgctgatgcttacaagatcattcctggctctcgggcagacttctccgaggagtacaagcgtctggacgaggacctggctggctactgccgccgggacatcagggttcttgtgctcgatgacaccaaccatgagcgggaacggctggaccagctttttgaaatggcagaccagtaccagtaccaggtggtgctggtggagcccaagacggcgtggcgactagactgtgcccagctcaaggagaagaaccaatggcagctgtcgctcgatgacctgaagaagctgaagcccgggctggagaaggacttcctgccactttactttggctggttcctgaccaaaaagagttccgagaccctccgaaaagccggccaggtctttctggaggagctgggaaatcacaaggctttcaagaaagagcttcgacacttcatttctggggatgaacccaaggagaagcttgacctggtcagctactttggcaagagacctccaggcgtgctgcactgtacaaccaaattctgtgactacgggaaggccaccggggcagaagaatatgcccaacaggatgtggtgaggagatcttacggcaaggccttcaaactgtccatctctgccctctttgtgacacccaagacagctggggcccaggtggtgcttaatgagcaggagctgcagttgtggccaagtgacctggacaagccctcatcctccgagagcctgcccccagggagccgagctcacgtcaccctaggctgtgcagccgacgtgcagccagtgcagacaggccttgacctcttagagattttacagcaggtgaaggggggcagccaaggtgaggaggtgggtgagctcccccggggcaagctctattccttgggcaaagggcgttggatgctgagcttggcgaagaagatggaagtcaaggccatcttcacggggtactatgggaagggcaaacctgtacccgtacacggcagccggaaggggggtgccatgcagatctgcaccatcatctgagggttcacgccactgtgccaccgctgtggacacagcaacatgccttccacttgatttttaagattttttttttttactcaaagctaatctacctataactttttagaagtctgtaaaataaccatcagttccttcacccaccctcttccccttaacactcagctcaacacaggcaggtgggcagaggaagacaccattcaggaacctggaccagaggtggtaattaaagggctgggtcattggcctggagcggccacctagatgcacccaggaccttgttaaccctcccttagccgctgcccatgcagagctgggcacacacacctcagagccaccacacatcatgcaagggacaaatgctactgccacaggaaaacagtggtagctttgagaggggacagacccctgggtgccaatcttaatcactgtagccccaaggaaggcttgggctacttactgggctgtaaaaggggcttacctctcaccgttggtcattcccaactccctctctccttcactggcactaggttaatggtgtgaccactaggggagaaaatggcattaccggaagccacatctctggttccggtctggctatctagccttaacagctgtctctgctaaggtcagagagatgctttaagaaactccagctttgctttctgcccagcccatcttgcctccgtggtgcctctgggcctcctctaaaggatggtggtgggtaccaagagccaacggagggggccctgagccagcaagagtaagccccatctgctctggggaagtctgaacacgcgcgtgtgctgtggttcctggagtacctcactctgctcagtaacaggaccttgctaattgggttgtcacccaagcatctgggatttatgttcctaccctcaccctgtgttgcccacctcagcaacaactaagactgatactgaaataaatcgtgttaatcccaa

SEQ ID NO: 2970 - DNA, 3115 bp, Rattus norvegicus
  Genbank Accession No. L16995
gaattccggtccgcagcctaggggcggggcgcggacgacggagccatggattgcacatttgaagacatgcttcagctcatcaacaaccaagacagtgacttccctggcctatttgatgccccctatgctgggggtgagacaggagacacaggccccagcagccctggtgccagctctcctgagagcttctcttctcctgcttctctgggctcctctctggaagccttcctgggaggacccaaggtgacacctgcacccttgtcccctccaccatcggcacccactgctgtaaagatgtacccgtccgtgccccccttctcccctgggcctggaatcaaagaggagccagtgccactcaccatcctgcagcccccagcaccacagccatcgccagggaccctgttgcctccgagcttccctcctccacctgtgcagctcagccctgctcctgtgctggggtactcaagcctgccttccggcttctcaggaacccttcctgggaacacccagcagacgccatctagcctgccactgggctccacgccaggaatctcgcccacccccttacacacccaggtccagagctcggccgcccagcagccgccgccagcctcagcagcccctagaatgagcactgtggcctcacagatccagcaggtccccgttgtactgcagccacacttcatcaaggcagactcgctgctgctgacagctgtaaagacagacacaggagccacaatgaagaccgcaggcatcaacaccctggctcctgcgacagccgtgcaggcaggccccttgcagaccctggtgagtggagggaccatcctggccacagtcccactggtggtggacacagacaaactgcccatccaccgactagcagctggtggcaaggccctgggctcagctcagagccgtggtgagaagcgcacagcccacaatgccattgagaagcgctaccgttcctctatcaatgacaagattgtggagctcaaggacctggtggtgggcactgaggcaaagctgaataaatctgctgtcttgcgcaaggccatcgactacatccgcttcttacagcacagcaaccagaaactcaagcaggagaacctgaccctgcgaagtgctcacaaaagcaaatcactgaaagacctggtgtcagcttgtggcagtggaggaggcacagatgtgtctatggagggcatgaaacctgaagtggtagaaacgctgacccctccaccctcagacgccggctcaccctcccagagtagccccttgtccttgggcagcagaggcagcagcagtggtggcagtgactctgagcccgacagcccagcctttgaggataaccaggtgaaagcccagcggctgccttcacatagccgaggcatgctggacccgtcccgcctggccctgtgtgtactggtcttcctgtgtctgacctgcaacccattggcctcactgtttggctggggcatcctcactccctctgatgcttcgggtgtgcaccgtagttctgggcgcagcatgctggaggccgagagcagagatggctctaattggacccagtggttgctgccacccctagtctggctggccaatggactactagtgttggcctgcttggctcttctctttgtctacggggaacctgtgaccaggccacactccggcccggctgtacacttctggagacatcgcaaacaagctgacctggatttggcccggggagattttgcccaggccgctcaacagctgtggctggccttgcaagccctgggccggcccctgcccacctcaaacctggatctggcctgcagcctgctttggaacctcgtccgccacctgctgcagcgtctttgggtgggccgctggctggcaggccaggctgggggcctgcagagggactacaggctgagaaaggatgctcgtgccagtgcccgagatgcggctgtcgtctaccataagctgcaccagctgcatgccatgggcaagtacacaggaggccatcttgttgcttctaacctggcactgagtgcccttaacctggctgagtgtgcaggagatgctatatccatggcaacactggcagagatctacgtggcagctgccctaagggtcaaaaccagcctccccagagccttgcacttcttgacacgtttcttcctaagtagtgcccgccaggcctgcctggcacagagtggtgcagtgcctcttgccatgcagtggctctgccaccctgtaggtcaccgtttcttcgtggatggggactgggctgtacacggtgccccccaggagagtctgtacagcgtggctgggaacccagtggatccactggcccaggtgacccgactattctgtgaacatctcctggagcgagcattgaactgtatcgctcagcccagcccaggggcagctgatggacacagggagttctcagatgcccttggatatctacagttgctaaatagctgttctgacgctgtcggagctcctgcgtgcagcttctctgtcagttccagcatggctaccaccactggcacagacccagtggccaagtggtgggcctcactgacagccgtggtgatccactggctgaggcgggatgaggaggcagctgaacgcttatacccactggtagagcacattccccaagtgctgcaggaaactgagagacccttcccagggcagctctgtactccttcaaggctgcccgggctctgctggaccacagaaaggtggaatccagcccagccagcctggccatctgtgagaaggccagtgggtactgcgggacagcttagcctctacatcaactgccagttccattgacaaggccgatgcagctgctcctgtgtgatctacttcttgtggcccgcaccagcctatgcggcgccaacagtcagcagcttcagcccagggagctcacggtaccagcaatggaccccaggcctctgctctggagctgcgtggtttccaacatgacctgagcagcctgaggcgcttggcacagagcttcggcctgctatgaggagggtcttcctacatgaggccacagctcggctgatggcaggagcaagtcctgcccggacacaccagctcctggaccgcggaattc

SEQ ID NO: 2971 - DNA, 1776 bp, Rattus norvegicus
  Genbank Accession No. L18889
atggaagggaagtggttactgtgtttgctactggtccttggaactgcagctattcaggctcatgatggacatgatgatgacatgattgatattgaagatgatcttgatgatgttatcgaagaggtagaagattcaaaatctaaatcagataccagcactcctccatctccaaaggtcacctacaaagctccagttccaacaggggaggtttattttgctgactcctttgacagagggtctctgtcagggtggattttatctaaagccaaaaaagacgacactgatgatgaaattgccaaatatgacggaaagtgggaggtagatgaaatgaaggaaacaaagcttccaggtgataaaggacttgtattgatgtctcgggccaagcatcatgccatctctgctaaactgaacaagcccttcctgtttgataccaagcctctcattgttcagtatgaggttaactttcagaatggaatagaatgcggtggtgcctacgtgaagctgctatccaagacctcagaactcaacctggatcaattccacgacaagactccgtatactattatgtttggtccagataaatgtggagaggactacaaactgcatttcatctttcgccacaaaaaccccaagacaggcgtatatgaagaaaaacatgctaagaggccagatgcagatctgaagacctatttcactgacaagaaaacacatctttacacattaatcttgaatccagacaatagttttgaaatattagttgaccagtctgttgtgaacagtggaaacctgctaaatgacatgacccctccggtaaacccttcacgtgaaattgaggacccagaagaccggaagcctgaagattgggatgaaaggcccaaaatagcagatccagatgctgtcaagccagatgactgggatgaagatgccccttctaagattccagatgaagaggccacaaagcctgaaggctggttagatgatgaacccgagtatattccagaccctgatgcagagaaaccagaagattgggatgaggatatggacggagaatgggaggctcctcagattgccaaccctaagtgtgagtccgcccctgggtgtggtgtctggcagcgacctatgattgacaaccccaattataagggcaaatggaagcctcctatgattgacaatcctaactaccagggaatctggaaaccaaggaaaataccaaatccagatttctttgaagacctggaaccttttaggatgactcctttcagcgctattggtttggagctctggtccatgacatccgacatcttttttgacaactttatcattagtggtgaccgaagagtagttgatgactgggccaatgatgggtggggcctgaagaaagctgctgatggggctgcagagccaggtgtagtggggcagatgctggaggcagctgaagagcgtccatggctttgggtggtctacattctgactgtagcgttgccagtgttccttgtgatcctcttctgctgttctggaaagaaacagtccaatgctatggagtacaagaagacagatgctccccagccagatgtgaaggacgaagaagggaaggaagaagagaagaacaagggagatgaagaggaagaagaggagaagcttgaagagaaacagaagagtgatgctgaagaagatggtggcactggcagtcaagatgaggaagatagcaagcctaaagcagaggaggatgaaattttgaacagatcaccaagaaacagaaagccacgaagagagtga

SEQ ID NO: 2972 - DNA, 975 bp, Rattus norvegicus
  Genbank Accession No. L19927
cgagacattaccaggagactgaagtccatcaaaaacatccagaagattaccaagtctatgaagatggtggcagcagcgaagtacgcccgggctgagcgggagctgaagccagctcgagtgtatgggacaggctccttggctctgtatgagaaggctgagattaagggacctgaggacaagaagaagcacctcattattggtgtgtcctcggatcgaggcctttgtggtgctattcattcctccgtggctaaacaaatgaagaatgacatggctgccctcacagcagctgggaaagaagttatgattgttggaattggtgaaaaaatcaagagcatactttataggactcactctgatcagtttttggtgtccttcaaagacgtggggcggaagccccctacttttggagatgcatcggtcattgccttggagttgttaaattcgggatatgaatttgatgaaggctctattatctttaatcagttcaagtctgttatctcctacaagacagaagagaagcccatcttctctttcagtaccgtcgtggctgctgagaacatgagcatttatgatgacattgatgctgacgtgctgcagaattaccaggaatacaatctggccaacatcatctactactccctgaaggagtccaccaccagtgagcagagtgccaggatgaccgccatggacaacgccagcaagaacgcctctgatatgattgataaattgacgctgactttcaaccgcacccgccaggccgtcatcacgaaggagctgatagagatcatctccggggctgctgctctggattaatgagaatcaagttacatcctcagacaagaggtgaagaaggaaaaggcagctgattttaactgattgctgtccttgttagaagaaacttggtccactgagtcacaaagacagcaggatgtttgtaaattatcttacaataaacaacttacaatgagaaaaacg

SEQ ID NO: 2973 - DNA, 606 bp, Rattus norvegicus
  Genbank Accession No. L22190
tctagagtcgatctgcccagcagacaccagcaggatgaagctactcaccagcctggtcttctgctccctgctcctgggagtctgccatggagggtttttttcatttgttcacgaggctttcctaggggctggggacatgtggcgagcctacactgacatgaaggaagctggctggaaagatggagacaaatacttccatgctcgggggaactatgatgctgctcaaaggggtcccgggggagtctgggctgctgagaaaatcagtgatggaagagaggcctttcaggaattcttcggcagaggacacgaggacaccatggctgaccaggaagccaacagacatggccgcagtggcaaagaccccaattactacagacctcctggcctgcctcagaaatactgagcatcctcctattagttcagaaggctgtgttgggggcctgagggtggggtctgggcttcctatctaggaacactgaagatgctctctgggaatacatagtatacctctcatgtgtgtatcccacaagggtttcagaactgagttactcgagcagtagtaactgcttgaggaggagagggtaataaacaggaatttggaactgg

SEQ ID NO: 2974 - DNA, 3313 bp, Rattus norvegicus
  Genbank Accession No. L22761
cccgaggctccgctgttgctgcagctccgcggactcacggagatcgcgccggctctctgggaaactggagctggccaggactgtcgcttcgaagggaacgggccctcttcgtccttcgctggagccgcactggagccaccaaatgcgcctgggtgtgcagcaggcagaaagcaaggactaggcacctctagcccgtgggtgatccgaaggcctgcgcagggtgttcgagaccagtcttgactgagttctgggcatctccagcctctgggccctggagtagagtcagccctcctgcagtttctggagcaaccacaaatccaatttgggatttttgttttcttcttgagcaaaccagagcctaaagattgttgctctgatgctggatttaattcgtatatattttgagcgagttgggcctgtcctcattgttttttgatctccgttttcgcgacagttctgcacacctgtattccaattcttgtcgctttggtctgccgcgcccgcgtgggctccttgacttgcaaataaaggggagcacaccgaagctcagagcttggggcgatgtaccaaagcctggctatggccgccaaccacgggcccccgccgggcgcctacgaagcgggtggacctggcgccttcatgcacagtgcgggcgccgcgtcctcgcccgtctacgtgcccactccgcgggtgccgtcctctgtgctgggcctgtcctacctgcagggcggaggcagtggtgctgcttctggagccacctcgggtggcagctccggggccggcccgtcgggtgctgggcctgggacccagcagggtagcccgggctggagccaggctggagctgagggagccgcttacaccccaccgcctgtgtccccgcgcttctccttcccggggactactgggtccctggcggccgccgccgccgctgccgcagcccgggaagctgcagcctacagcagtagcggcggggcagccggcgctggcctggctggccgagagcagtacgggcgtccgggcttcgcaggctcctactccagcccctacccagcctacatggccgatgtgggcgcatcctgggccgcagccgctgccgcctccgccggccccttcgacagcccagtcctgcacagcctacctggccgggccaaccctgcgagacaccccaatctcgatatgtttgatgacttctcagaaggcagagagtgtgtcaactgcggggccatgtccaccccactctggaggcgagatgggacaggacactacctatgcaacgcctgtggcctctaccacaagatgaatggtatcaaccggcccctcatcaagcctcagcgccggctgtctgcctcccgccgggtaggcctctcctgtgccaactgccagactaccaccaccacactgtggcgccgtaacgctgagggcgagcctgtttgcaatgcctgcggcctctacatgaagctccatggggttcccaggcctcttgcaatgcggaaggaggggattcaaaccagaaaacggaagcccaagaatctgaataaatctaagacaccagcaggtcctcctggcgagagcctccctccctccagtggtgcctccagcaactccagcaacgccaccagcagcagcagcagcagtgaagagatgcgccccatcaagacagagcccgggctgtcatctcactatgggcacagcagctccatgtcccagacattcagtactgtgtccggccatgggtcctccatccatccagtgctgtcggctctgaagctctccccacaaggctatccatctcctgtcactcagacatcacaggccagctccaagcaggactcttggaacagcctggtcctggctgacagtcatggggacataatcaccgcgtaatcagcacccccttccctcttcaaattcctgctcggacttgggacctggggccagcaaagtaaaaggctggggcaccctggccagcccctctgtgtgggaacaactcctgaagaacaactggtagaacttgaagttgttgacaatcacttagggataagggtgctgggtttcttcaaatacctttccaggtggagcactggaagaagcctgcattctcacagaaaagcccaccttggctgcaagcacagcacagtgaggctcttcagtgagcaggagacttcttcctccttctctacctgcctgtccaggacagacacataatcttcaccccagctccccaccccagtggctgtggtgatgggtttttctttgtgatcctagagtggctgtagggaccgaggcttcaagacactgtctacagccggcgcagggtgtctacttgtggactagacatagcagccctgcccttgtccaacactccccttgaggcatggaacatctcatgtgtcccatacctgatctgactccaaagcgctgggtgcagtgcagatgttactgagtgcttcctggggggtttaggtgaggagaaggcacatcacccatcacacagatcgcagcccgtcagaggtgccttcccttcctctcccaggaacagcaacccccttgctctccagcctgaacatctcctaccctctgtaaaactagagcccagttgtacagcaggctaataccactaggtgctgttcccagcatccatttccacctcttcacacacaggggttccaaggaggaacaaaacctgctactaaagcagggttggtgactgtgctcatctgcaccttgggaccctctggaggttgtgtctacagcacaatcctgcccccaggactccagcttacttgctctgagcctgccaagccaagctctctcaagtcagacagttaactggctctgggactttctccagcacagatcctttgtctagaaaatacggactgtttgcaaaacaaattcagagcagaaacaacaaagggaaatttttgaaaggacaagggtgatggatggaagaagatgtccccaggcctgatgggacagccatgcttgcagttgtgctagaactggcaacccctctccctcctccattactggggctcccaaagattcttccttgtcttcatcacccacagagctgtagccaactgtggcattaccttgttttgccccaaatttccagccccgcccctaaaccttactggccgtagcagagaatagctttgaaccaagattctgttgtaatcatttacgctgtttctccctcaaggccgccttcctatgcctccccctcctccacaacccgttaacattgtcttaaggtgaaatggctgtaaaatcagtatttaactaataaatttatctgtattactcttaa

SEQ ID NO: 2975 - DNA, 2643 bp, Rattus norvegicus
  Genbank Accession No. L25387
gtgaccaggactcttcgacgtccagcacctcctttccgaagtacctggagcacctctctggggatggcaaagcatggtgtcctgaccagcggcggggagtcccaaggcatgaatgctgctgtccgtgctgtggtgcgcatgggaatgtacacgggggcccaagtgtactttatatacgagggttaccaaggcatggtggatggaggctccaatattgtggaagccaagtgggagtgtgtctccagcattctacaagtgggtgggaccatcatcggcagtgcccgttgccaagccttccgcagccgtgaagggcgtctgaaagccacctgtaacctggtacgcttgggcataaccaacctgtgcgtgatcggtggggacggaagtctcacgggagccaacctcttccggaaggagtggagcggtcttctggaagagctggctaagaatggtgagatcgattcggacacagtgaagaagcacgcctacctcaacgtggtgggcatggtgggctccattgacaatgacttctgtggcacagacatgaccatcggtacagattcagctctgcaccgaattattgaagttgttgatgccatcatgaccactgcccagagccaccagagaaccttcgtcttggaggtgatggggagatactgtggttacttggccttggtgagcgccttggcttgcggtgccgactgggtgttccttccagagtctccgccagaggaaggttgggaggaagaaatgtgcctcaaactctccgagaaccgtgcccgaaagaaaaggctgaatatcatcattgtgtctgaaggagcaatcgacacccaaaataagccaatcacctctgagaaaatcaaggagcttgtggtgacaaatttgggctttgacacccgggtcaccattcttggacatgtccagagaggagggaccccttctgcatttgacaggattttggccagccgtatgggagtggaggctgtccttgccttgctggaagctacccctgagaccccagcctgtgtcgtgtcactgagaggaaatcaagctgtacgcctgcctctgatggagtgcgtgcaaatgacccaggatgtacagaaagcaatggatgaaaggagatttgatgaagccgtaaaactccgaggaaggagttttgagggcaacctgaacacctacaagcgtcttgccattaaggagcctgatgacaagatccccaagagcaattgcaatgtagccatcatcaatgtaggggcacctgccgcgggaatgaatgcagccgtccggtccgctgttcgggttgggattgcagagggccacaagatgttcgcaatctatgacggctttgatggcctcgccaatggccaaatcaaagaaatcggctggggagatgtcggaggttggacaggacaaggagggtccattcttgggacgaaacgcaccctacccggaaagtacttggagaagatcgcagaacagatgcactcgaaaaatatcaatgcccttctgatcattggcggattcgaggcctacctgggactcctagagctggcagctgcccggaacaaacatgaggcattctgtgtccctatggttatggttcctgctactgtctccaacaatgtgccaggttctgatttcagcatcggggcagacacggctctgaacactatcacagacacgtgcgaccgcataaaacagtcagccagtgggaccaagcgccgggtgttcatcattgagaccatgggcggatactgtggctacctggccaacatggggggacttgcagcgggacgcgatgctgcctacatctttgaagaacaatttgatatccgagatttgcagtccaacgtcatgcacttgacggagaaaatgaagaccagcatccagaggggccttgtcctcagaaatgaaaactgcagtgtaaattacaccacggacttcatctaccagctctactcagaggaagggaaaggagtgtttgactgcaggaagaacgtgctaggccacatgcagcaggggggagcaccttctccattcgacagaaactttggaaccaaaatatctgccaaagctatggagtggatctcggccaaactgaagggctcccacggcacagggaaaaaatttgttagtgatgattccatttgtgtcctgggaattcagaagagagacctcctgtttaaaccagtggcagagctaaggaaggctactgactttgagcaccgtatccccaaacaacagtggtggctgaaactgctaccaatctcgaagatcttggcaaagtatgaggcaagctatgacatgtcagacgtaggcaagctggagccggtgcataaccacggagaactatcagccatctgattgaatatgccgtctcctgacctgcacacttacctagggaagcctgtaatgttctccagggaccacccctttttgtaacatagttatttatcagcactctatgcaagaattgttggccgagtattgtcagcagtaataatcagagagcatcacttgctataaccattgacgcaacagaccctaagacatgaaacccagcctcgcgcgattgatcacgtgtcagttttctactgtaccgggtactactgtcttgtgctttaccatgtgtgtatcttgtgggat

SEQ ID NO: 2976 - DNA, 2245 bp, Rattus norvegicus
  Genbank Accession No. L26267
agggagattctgaatccccctgagaaagaaacacaaggtgaggggcccagcctgttcatggccagcaccaagaccgaagcaattgccccggcatccaccatggaagacaaggaagaggatgtggggtttcaggataacctctttcttgagaaggcgctgcagctcgccaagcggcatgccaacgccctcttcgactacgcggttacgggagatgtgaagatgctgctggcggtacagcgccatctcaccgcggtgcaggatgagaacggggacagtgtcctacacttagccatcatccaccttcatgctcagctcgtgagggatctgctagaagtgacatctggttcgatctctgatgacatcatcaacatgagaaacgatctgtatcagacacctttgcacttggccgtgatcaccaagcaggaagatgtggtggaggacttgctgagggttggggctgacctgagtcttctggaccgctggggcaactctgtcctgcacctagctgccaaagaaggacatgataaaatcctcggggtcctactcaagaacagcaaggcagcactccttatcaaccaccccaacggggaaggtctgaatgccattcacatagctgtgatgagcaacagcctgtcatgtctgcagctgcttgtggctgctggggcagaagtcaacgctcaggagcagaagtctgggcgcacggcactgcacctggccgtggagtacgacaacatctcgttggccggctgcctgctcctggagggtgacgccctcgtggacagcaccacctacgatgggacgacacctctacacatagcggctggaagagggtccaccaggctggcagctcttctcaaagcagcaggagcagaccccctggtggagaactttgagcctctctatgacctggacgactcttgggagaaggctggagaagatgagggagtagtgccaggcaccacacccctggacatggctgccaactggcaggtatttgacatactaaatgggaaaccatatgagccagtgttcacatctgatgacatactcccacaaggggacattaagcagctgacagaagacacgaggctgcaactctgcaagctcttggaaattcctgatcccgacaagaactgggccactctggcgcagaagttaggtctggggatattgaacaatgccttccggctgagtcccgccccttctaaaactcttatggacaactatgaggtctctggggggaccatcaaagagctggtggaggccctgcgacagatgggctacacagaggccattgaagtgatccaggcagccttccgcaccccggaaaccacagcctccagccccgtgaccactgctcaggcccacttgctgcctctctcgtcctcctccacaagacagcacatagatgagctccgagataatgacagcgtgtgtgacagtggtgtggagacatccttccgcaaactcagcttctcggagtccctcactggagatggcccactgctatctctgaacaaaatgcctcacaattatgggcaggatggacctatagaaggcaaaatttagcctgctggcggttccccacactgtaaaccaaagccctgaaaggccatcatatcgttccgaaggagaaggcaaaaaacgcatcccaaggtgctggaaggtcaccggcctgcagggtcaatcttgatgtcattcgaggccttccgaatttggcttcctttcttggctctgaaatgaaatttagttgtcatatacagatggtgtctagcaatcacggctgcactcggtgtggcttggggtatggtggcttgagcttttccagctgctattggattacacttgctttgtgttgtcactgctgtccctctgctgggtccccgctgtcattaaggtatcgcagtccccacctggtgttctttctagccatctacagtacagtcatgcactcaaattaagattaaggaaaaagatatttttaagtgagtaacttcatgcgcaataaaaaaaagacatggctttttctaatgtggtttatctgtgatttaaaaaaaaaaaacacatgaacttaacaatatttaaaacctgctacaatcagtgctgaaaatagtattttcccccttttctgcattttactattgtaaatatgttttctaaatcaaatactttaaaagaagaaatgttggatttataaatgctattttttattttacttttataataaaagtacaagcacactgtt

SEQ ID NO: 2977 - DNA, 861 bp, Rattus norvegicus
  Genbank Accession No. L28114
gagctggtgtcccgctgcggggagatgctccacatccgctaccggctgctccgacaggcgctggccgagtgcctggggaccctcatcctggtgatgtttggctgtggctccgtggcccaggttgtgctcagccggggcacccacggtggtttcctcaccatcaacctggcctttggctttgctgtcactctgggcatcctcatcgctggccaggtctctggggcccacctgaaccctgcggtgacctttgccatgtgcttcctggctcgtgagccctggatcaagctgcccatctacaccctggcacagacgtcgggagccttcttgggtgctggaatagtttttgggctgtattatgatgcaatctggcactttgccgacaaccagctttttgtttcgggccccaatggcacagccggcatctttgctacctacccctctggacacttggatatgatcaatggcttctttgaccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatc

SEQ ID NO: 2978 - DNA, 640 bp, Rattus norvegicus
  Genbank Accession No. L35558
gaggcgtgttttcagcagtacaaaaccaagcgtgaagaagtgaagcctgccagtgatcctggggggaaccagacagaggtgtctgtcaccacggccatgacaacaatgtctgagaacaagacaaaggaatacaaaatcgtttgcctgtactcagacggcatcaacgtcctgggcctgattatcttcttcctcgtctttggacttgtcattggaaaaatgggagaaaagggacagattctggtggatttcttcaatgcgttgagtgacgccaccatgaaaatcgttcagatcatcatgtgttacatgccgatcggtattttgttcctaatcgctgggaagatcatagaagttgaagactgggaaatattccgcaagttgggcctttatatggccactgtcctgagtgggcttgcaatccactccctcgtagtgctgccactgatctatttcatagtcgttacgaagaaccctttccgctttgccttgggcatggcgcaggctctcctgacagctctcatgatctcatctagctcggcaacccttccagttacattccgctgtgcggaagaaaagaaccacgtggacaagaggatcacaagatttgtgctgcccgtcggcgccaccatcaacatggacggca

SEQ ID NO: 2979 - DNA, 3974 bp, Rattus norvegicus
  Genbank Accession No. L38482
tcgactacccatattccccaccagccaaccggttcctcaccaagatgtggcacccaaacatctatgaggtaagacactagaggcctgcttcaggcacactccaccacacacttctctgcctcccttgcacatgctccacccctcctctaaccctggtcactcttgcagacaggggacgtatgcatctccatccaccatcccccagttgatgacccacagagtgggagctaccctcagagcggtggaaccccacgcagaatgtcaggtgagaattgccatggaactgcaccgtgggcacccgcaaacaccctgtaccctaagatccacccttccctgctccagtcaggggttcccagagtctggggagctgagcttgcacctacggccctacaggaccatcctcctgagtgtgatctccctgctgaatgagcccaacaccttctcgcctgccaacgtggacgcctcggtgatgtacagaaaatggaaggagagcaaggggaaggaccgcgagtacacggacatcatccggtgagtgcttcctactgtgaagagtgatctggggtgtgggtggggtggggacttgttgtatgtttccattttttgcatcccgggctggatgtgtggaggactctggggcccccagagcacggagttgaccacccagggtggccaagatcccctctgccttgttgttgacttaactccatgagcaactgggctctctgggccacaccctcactgtctgacagagagcatcaatcacttgcatttcgtgcttctgaaacttagagcttttttttttttttttgcaaagtgggaagggggctgagcccactgtgagtctgtcctcagttagggaccagggctgcgacctgttgctgtctatgagtggcagtgtccacacctatcatcgcttcttagcaggagctcctggcctgtctggggccaggcagtctcccctacacccctcacgttgggtatgaagttgcacttgaggggttcagtctttgtcgcttagcttctgtgttttctgagacaggctttcatataactccgtatctccttgtggtccctctgatgtcaggatgacaacacacattcctcggaagtgaccccagtgcttgtctacacagtgacccaaacacagggcctgtcctgtccccaagcctgccctctcagagttggtacaggccgcagctcggtaggcagtgctggtctagcatgtgcacacacacagggttagtctctgtcttaggcaaggtggatgtagccagcatggtccttcatggaggtataagttactcaggaaggtctgagcgctgcactacggaggtgtccccttcaccatggtcaggtcagcaacggtcccggtcactggaagtccctgcagactgtcccctttgttttctgttcagactggctgaacagaactttgttcctcctgctcttcctcagctgagaggaaggctggctgccctagctgttctatatagttctggctgtcctggaagaggagaccctgggtctggccctgtcactgcactctccaccctcctggcagcctttaatccacttctggctgcttcctccctggatccctggcccagagcaggagcccaggctatttttaccattctgactccaggagccacttgctctgaccaggaggcctgtaccactcctggaactcaacctgagccagtatctagtcatgtccctgcctgagcacaaggacaggatagctaggagcctgtgagaaggaccttgagatggatctaggctattgggtgtgctgctgtcccacgtgcccctccaccatagccttgtccccattcccctattccttctgggcagctgaaaacagtgtctgctctgcttgactgcactgggacctgtgccccaagactctggcctgacggtggcctggcctctcaggcacctagttaattgctgcctgccctgtgcaaggaagcccttacatgttgcttcacccatggcctgtgggacctggaacctcagttgttccggaactgcccttcatcatggtgccctcaggtcaggctgcaatttgttgttggtgtgaggaggtgcatgttacctagcccacaactagggtagtgccccccacagtctgggattacagctgtttctgtggtgctgggagctggacatgggtccttatgcttacagaaggagcactctggctgcccctgttgtcggttatagccgaggtcagcctgaatctcatagtagttctcctgcctccgcctccaaggactgggtgacagaccgtctcccacagctggctgtggttacatttctgctggagttggtcactgagccactccttgtcgcctggccctctcctcccacctgctccctgcccccattcatctcatcgtcctgggccgtggcctcacccgccctgtctccccaggaagcaggtcctggggaccaaggtggacgcagagcgcgatggcgtgaagtgcccaccacgctggccgagtactgcgtgaagaccaagcgccggcgcccgacgagggctcagacctcttctacgacgactactatgaggacggtgaagtggaggaggccgacagctgctttggggatgaagaggatgactctggcaccgaggagtcctgacccacgtccctgaaataaacttacaaattttacctcagcaggacccgtgtgggcctcaggcgacagactacctcaccgaggttcaatgtgggctcccatcccatgatccttaggtcctcttaccctgtattccccatgggttttcctcggctttggagaagagctgtggtgcagggcagacaccccactcagccttcagaggatgacaagcctgggaggctgggaaccgactgcccaggggagccagagactccagcccaaagagggccagccccacagtctcctctctgcttttggtgtgtgtgaaatccaaataaaatagctttctgagaagctgagagaagcagccaggacgccggtggcactgggtactgagggctacctgggtacccaggcagggctgtgggatgggcaggaagaggtagcgatggtggcctgtttgttggggctcagtagcatacaggagccccaggcccagaagaaacttgctgcctgcaaatcccacccgcctgcatcgggcactgtggttgcgtccaccccaagcctgtgttcaggaggcctgggtcctgaggcctacaggggattggtattcccaacagtccttgtgttctgggcacttcctcagccctggaaactagtgctgcctgaggagtccctctgatacctgagctgcagcctggtgactccacagcaggggcaggctgagtgaattctctgaccacaccatgctgtgcagggcacctgcagtgaccccgtgctgagatagcagatctgctctgccacctgcatgtttacgggtgctgtggaaagaaagtgtcacttcctcttatgcgggcctgttaatgtccaaagttccagtcaacccatgccagtcagaactgatcagagaaggacacatcggaaaaaggtgttcaggcgatcctctgcccatacaatttgctgccagcctgatctacagttgcaaaaccagcgggaaggctcagtgggcaaaggcctgcaccaagcctagcagaggacccacttggctccaggtggtccctgtgggggttgaggtcagttgagacaaatcccccccccccccccggagttcaccccagtgctaaaaggagcagtgtgccaggagagggagcatcgcttggctgtagttgctgcccccagacacagggcaactttgacagcagagttgctttctaaaaccacacagcagggtgtgaaggaggaggagctgacacgtgggtaaggtgggtggtgcttggaaggccacttgtctccaccggaagagaaagtgtggggccccttcccccagggaccaccagtcctgtgccagg

SEQ ID NO: 2980 - DNA, 1882 bp, Rattus norvegicus
  Genbank Accession No. L38615
tggagtttgagcttggcgagcagctggacaacgagcgagttgggatggccaccagctggggaagcatcttgcaggatgagaagcagctggaagagttggcacagcaggccatagaccgggccctggctgagggggtgttgctgaggtccgcaaagaaccccagctcctctgacgtggtgacgtatgccccattcacgctcttcccctcaccagtgcccagcactctgctggagcaggcctatgctgtgcagatggacttcaacatcctggtagatgctgtcagccagaactccgccttcctggagcaaacactgtctagcaccatcaaaaaggatgagtatactgcccgtctctttgatatctacaagcaagtcctgaaagagggcatagcccagactgtgttcctgggcctcaatcgttcagattacatgttccagtgcagcgcagacggctccaaagccctgaaacagattgagatcaacactatctctgccagctttgggggcctggcctcccggactccggctgtgcaccgacatgttctcaatgtcctgaataagaccaacgaagcttccaagatcctgtccaacaaccccagcaagggactggccctggggatcgccaaagcctgggagctctatggctcagccaatgccgtggtgctactgattgctcaggagaaggaaaggaacatatttgaccagcgtgccatagagaacgagctgctagacaggaagatccatgtaatccgccgaagatttgaagatgtctctgaaaggggttctctagaccaaaaccgaaggctgtttatggaggaccaggaagttgctgtggtttacttccgagatggctacatgcccagtcagtataacgcacagaactgggaagctcgcctgctgctagagagatcatgtgctgccaagtgtcccgacattgccacacagctggctggcactaagaaggtgcagcaggaactgagcagggtgggcctgctggaagcgctgctcccgggccagcccgaggctgtggcccgcctccgtgccacctttgctggcctctattcactggacatgggtgaagaaggggaccaggctgtcgctgaggcccttgctgcccctagccactttgtgctgaagccccaaagagagggcggaggtaataacttctatggggaggaaatggtacacgctctggagcagctgaaagacagcgaggagagagcctcctacatcctcatggagaagattgaacctgagccttttaggaattgcttactacggcctggcagccctgcccaagtggtccagtgcatctcggagctgggtatttttggagtctatgtcagacagggaacaacacttgtgatgaacaagcatgtggggcatctgcttcgaaccaaagccattgaacatgcagatggaggtgtggcagcaggagtggcagtcctggacaacccctaccctgtgtgaagacatgttctgggcttcactcaagagaccttctatcctctgtacttggcactcctctcctgaggggctacccctgtacctgtgttaggggagggagcttgtctctttcatagacctccaggggctttagggaagggaaaatcccgggtcccttctctcagccttccatccaaggaccagaaaagctatgattccattggaagagttctggagctccccagatttggagtgggaatggaagctcctttgaggcaaaggcccacaaaccccacacatcttcattgccctctcgccagcctttccagcaggttctagtgccttgacctggggtaggaccaagtgacaggaggaagagggtagatgggcatagacttccccagctctgccctaaataaaacaatgctgattcaatg

SEQ ID NO: 2981 - DNA, 1621 bp, Rattus norvegicus
  Genbank Accession No. L40364
agaagacttaaaacaaccctgacaccatgctctgacactatgtgggctctgatcttctgcttcctgagtcacccccgagacactggagcccgatcacactctctgcactattcttactcagccgtgacagagccgggcccaggagttcctgcattttttgccagtggctttgtagataaccagcccttcatccactatgacagtaggaagatggaggcagagccttgtgctgactggctgagggaaaatccatattactttgatgaggagacccaggttttcaccaatcggatgaagatctaccagttgaagcctgagaaacattcagcaatactacaacagctctggtgaccggagtcagagagcagatggcttctaccagcaagcaggccctcacaccctccagttcacgtacggctgtgagatgcaggacaacaggaccacagggcactggcagtatggctacgatggcagggattacctgaccttggacttggactctatgcaatatacagcagccaccttcattgctggctacaccaagcacaagtggcaaaacaatgagtactggctgcagagagagaagacctacttggagaaggagtgtgtcctgtggctaaagagatacttaactatgggaggagagaactttacccgagctgaccctccacagacaacagtgacacaccaccccagacctgaaggtgatgtcaccctgaggtgctgggccctgggcttctaccctgctgacatcaccctgacctggcagttgaatggggaggacctgacccaggacatggagcttgtggagaccaggcctacaggggatggaaccttccagaagtgggcagctgtggtggtgcctcttgggaaggagcagaagtacacatgccatgtggagcatgaggggctgcctgagccgcttacccagagatgggagcctccttcatccactgattccaacatggaaaccaatgtcatttatgttgtcgttggagccgtctctgctgtggccattattggagctgtgatcattggagctgtggtggctgttgtgaggaagaggaggagaaacacaggtggatatgaggagactacgcccctgctccagcatgaagacagctgcctggagtggactgagtgacagacgatgtgttcaggtctctcctgtgacatccagagccctcagttctctttagacaccagtgtctgatgttccctgtgattctatggcttcagtgtgaagaactgtggagcccagcctgccctgcacttcagaccctgtccctgcactgcctgtgttccctaccaaggccgaaccttgctggtccagcctggggggtcggtggtggagacatctgcatcctgaacctttgtgccaccctgagcttcagcccctcacttcacactgagaataagaatctgagtgtgagaggttggggatttagctcagtggtagaggactttcctagaaagcgcaaggccctgggttggatcctcagctccggggggaagggggggagaatctgagtgtgaacttgattgttcacatccttgacgcaagtgtggatggctttttaaattactggattcagaatacttaaaaaaaaaaaaaaaaaaa

SEQ ID NO: 2982 - DNA, 513 bp, Rattus norvegicus
  Genbank Accession No. L41684
cggcggaaagccgtggctgtgtgcagcgtggctccaaacttgcctcccccacccccttccaactctccctcagacagcgactccattcagaagcccagctgggacttcgactacgacgctaaagtggtggatcttgacccttgtctttccaagaagcccctggaggaaaaaccctctcagccatacagtgcccgggagagcctgtccgaggtgcagtcccttagctccttccagtcagagtcctgtgatgacaatgaatctttggctgctcctgacctcagcaaaccaagagggtaccactgggatacatcagactggatgcccagtgttcctctgccagacatacaagagttccccaattacgaggttatcgatgagcacacgcccctctactcagctgatccaaatgccatcgacactgactattaccctgggggttatgacattgaaagtgactttccacccccaccagaggacttccctgcacccgatgaactgccaccattgcctcca

SEQ ID NO: 2983 - DNA, 682 bp, Rattus norvegicus
  Genbank Accession No. M11251
caaacataatcacatgtacccaggacacaaagaacatacagagaagcctccataatttaagattatacatgtaaatacaccctagacatgcaagaatagaccacccagtgcatctagactcagacaaagaaatatacatctgtacgtttatatcagaaatgatctttcacatagaaaaagcatatagcgtgcacgcacacacacaatcccatgccctagtaagtaaacagagctgacaaaactgagctgacaagtgcacacccatccccataaaacaagaggcctaagtcccagtgcccttttgtcctgtgtatctgtttcgtggtgtccttgccaacatgtatggtgtgggtaagggaatgaggagtgaatagctaaagcaggaggcgtgaacatctgaagttgcataactgagtggaggggcggattcagcataaaagatcctgctggagagcatgcactgaagtctaccgtggttacaccaggaccatggagcccagtatcttgctcctccttgctctccttgtgggcttcttgttactcttagtcaggggacacccaaagtcccgtggcaacttcccaccaggacctcgtccccttcccctcttggggaacctcctgcagttggacagagggggcctcctcaattccttcatgcaggtgagacattcacagggcctgg

SEQ ID NO: 2984 - DNA, 610 bp, Rattus norvegicus
  Genbank Accession No. M11851
ctccttgaattcttcagaggcagcagccagcctcagacaccatgtcaccaaagaaagccaagaagaggttagagggcggaagctccaacgtgttctccatgtttgagcagacccagatccaggagttcaaggaggccttcacaatcatggaccagaacagagccggcttcattgacaagaatgacctaagggacacgtttgctgccctcggacgagtgaacgtgaaaaacgaagagatcgatgagatgatcaaagaggctccaggtccaattaacttcactgtgttcctcaccatgtttagggagaaacttaaaggagctggcccggaggagacccttctcaacgccttcaaggtgtttgccccaaggcgaaggattactggagccgactgtgtccaagagatgctaaccacgcaagcagagaggttctccaaagaagagaccgaccagatgttcgcagcttttccccctaacgtcaccggcaaccttgattataagaatttggttcacatcatcacccacggagaagagaaggactgagccctgaaccgcggcctcgggtgacctatagcctgttctccatccccaggccctgctgtcccacctgcggg

SEQ ID NO: 2985 - DNA, 377 bp, Rattus norvegicus
  Genbank Accession No. M12112
ccatggagacaaggccagcgtcagagagctatcctgggcaaaaatcagtgccttcacccctggcttcccgtcactccttccagcaaggcagaggccgtctccttggagatggcgctaactgagaataaatgatgagcagcagcctcctggggtgtgggtttgtttggacactggggtgagagccaggagctggcactctgtataggaggactgccatcctggaaaaaaaaaatggaccaaacaactgtttgtgaaataaaaaaaaaaaaattccctttttatttgagaacacaaagtgggttttaacattaaaatgcacactgtccccttgttttgggtttgcaattagctgagtgtgagaccacgacctccgagtc

SEQ ID NO: 2986 - DNA, 8048 bp, Rattus norvegicus
  Genbank Accession No. M13100
  misc_feature (1)..(8048): n = a or c or g or t
gaattcggcccaggataaacagatatataggtaaatgactggatagatacatggatttgatctctaactcaacttaggcaccatagaaaacaatccttgaattattttaataattttaaatcctagtttactgagaaacacgttgacgaggcagggcttcagcctctctgaagcagcactgcccctctgtggccacacaggaagtcttcactcagcagtttcctgacttaaggcctaggcctgaggaaatgcattgaatatttctctgggggacaatagttctgagaaggaaagagagtttgtctatgttgaggtcagttaaggatggttttctttccttccctcccagccttttctccatgcaacatcatgagtccccatctttctatcctgcctaaaaccacttccttctgggaaatgagaaaatccactcatacaaaatggaaacatcccgaggatcccggcccgcagcagctctctgcccccagaccctgtgagagagagacccaaccgcctggtcaggtgggcactcctgaggctgcagagggaagagaccaccaacactgctcacccctgcccacatccctggcccaagaggaaactgtataaggcctctgggtcctgtgggggagggcccaggagcggcaggacccctgtgcctgagagaccaccaccagaaccagaaggaaacagaccggataaacagttctctgcaccaaatcccgtggagggagagctgaaccttcagagagaaagacaagcctgggaaaccagaagagactgctctctgcacacacatctcggacgccagaggaaaaagccaaagaccatctggaaccctggtgcactgaagctcccggaaatggtgcacaggtcttcctggttgctgccgctgcagagagcccgtggtagcaccccacgagcgaacttgagcctcaggaccacaggtaagaccaacttttctgctgcaagaaagctgcctggtgaactcaagacacaggcccacaggaacagctgaagacctgtagagaggaaaaaccacacgccggaaagcagaacactctgtccccataactgactgaaagagaggaaaacaggtctacagcactcctgacacacaggcttataggacagtctagccactgtcagaaatagcagaacaaagtaacactagagataatctgatggcgaaaggcaagcgcaggaacccaagcaacagaaaccaagactacatggcaccatcggagcccaattctcccatcaaaacaaacatggaatatccaaacacaccagaaaagcaagatctagttccaaaatcatttttgatcatgatgctggaggacttcaagaaagacgtgaagaactccttagagaacaagtagaagcctacagagaggaatcgcaaaaatgcctgaaagaatcgcaaaaatccctgaaagaattccaagaaaacataaataaacaagtagaagcccatagagaggagacacaaaaatccctgaaagaattccaggaaaacataaataaacaagtagaagcccatagagaggagacacaaaaatccctgaaagaattccaggaaaacataaataaacaagtagaagcccatagagaggagacacaaaaatccctgaaaggaattccaggaaaacacaatcaaacagttgaaggaattaaaaatggaaatagaagcaatcaaaaaagaacacatggaaacaaccctggatatagaaaaccaaaagaagagacaaggagctgtagataaaagcttcaccaacagaatacaagagatggaagagagaatctcaggagcagaagattccatagaaatcattgactcaactgtcaaagataatgtaaagcggaaaaagctactggtccaaaacatacaggaaatccaggactcaatgagaagatcaaacctaaggataataggtatagaagagagtgaagactcccagctcaaaggaccagtaaatatcttcaacaaaaccatagaagaaancttccctaacctaaaaaaagagatacccatagacacacaagaagcctacagaactccaaatagattggaccagaaaagaaacacctcccgtcacataattgtcaaaacaccaaacgcacaaaataaagaaagaatattaaaaacagtaagggaaaaaggtcaagtaacatataaagggagacctatcagaatcacaccagacttctcgccagaaactatgaaggccagaagatcctggactgatgttatacagaccctaagagaacacaaatgccagcccaggttactgtatccagcaaaactctcaattaacattgatggagaaaccaagacattccatgacaaaaccaaatttacacaatatctttccacaaatccagcactacaaaggataataaatggtaaagcccaacataaggaggcaagctataccctagaagaagcaagaaactaatcgtcttggcaacaaaacaaagagaatgaaagcacacaaacataacctcacatccaaatatgaatataacgggaagcaataatcactattccttaatatctctcaacatcaatggcctcaactccccaataaaaagtcatagattaacaaactggatacacaacgaggaccctgcattctgctgcctacaggaaacacacctcagagacaaagacagacactacctcagagtgaaaggctggaaaacaaatttccaagcaaatggtcagaagaagcaagctggagtagccattctaatatcaaataaaatcaatttccaactaaaagtcatcaaaaaagataaggaaggacacttcatattcatcaaaggaaaaatccaccaagatgaactctcaatcctaaatatctatgccccaaatacaagggcacctacatacgtaaaagaaaccttactaaagctcaaagcacacattgcacctcacacaataatagtgggagatttcaacacaccactctcatcaatggacagatcatggaaacagaaattaaacagtgatgtcgacagcataagagaagtcatgagccaaatggacttaacggatatttttagaacattctatcctaaagcaaaaggatataccttcttctcagctcctcatggcactttctccaaaattgaccatataattggtcaaaaaacgggcctcaacaggtacagaaagatagaaataatcccatgcgtgctatcggaccaccacggcctaaaactggtcttcaataacaataagggaagaatgcccacatatacctggaaattgaacaatgctctactcaatgataacctggtcaaggaagaaataaagaaagaaattaaaaactttttagaatttaatgaaaatgaaggtacaacatacccaaacttatgggacacaatgaaagctgtgctaagaggaaaactcatagcgctgagtgcctgcaaaaagaaacaggaaagagcatatgtcagcagcttgacagcacacctaaaagctctagaacaaaaangaagcaaatacactgaggaggagtagaaggcaggaaataatcaaactcagagctgaaatcaaccaagtagaaacaaaaaggaccatagaaagaatcaacagaaccaaaagctggttctttgagaaaatcaacaagatagataaacccttagccagactaacgagaggacacagagagtgtgtccaaattaacaaaatcagaaatgaaaagggagacataactacagattcagaggaaattcaaaaaatcatcagatcttactataaaaacctatattcaataaaacttgaaaatcttcaggaaatggacaatttcctagacagataccacgtatcgaagttaaatcaggaacagataaaccagttaaacaaccccataactcctaaggaaatagaagcagtcattaaaggtctcccaaccaaaaagagtccaggtccagacgggtttagtgcagaattctatcaaaccttcatagaagacctcataccaatattatccaaactattccacaaaattgaaacagatggagcactaccgaattccttctacgaagccacaattactcttatacctaaaccacacaaagacacaacaaagaaagagaacttcagaccaatttcccttatgaatatcgatgcaaaaatactcaataaaattctggcaaacgaattcaagagcacatcaaaacaatcatccaccatgatcaagtaggcttcatcccaggcatgcagggatggtttaatatacggaaaaccatcaacgtgatccattatataaacaaactgaaagaacagaaccacatgatcatttcattagatgctgagaaagcatttgacaaaattcaacacccttcatgataagagtcccggaaagaataggaattcaaggcccatacctaaacatagtaaaagccatatacagcaaaccagttgctaacattaaactaaatggagagaaacttgaagcaatcccactaaaatcagggactagacaaggctgcccactctctccctacttattcaatatagttcttgaagttctagccagaccaatcagacaacaaaaggagatcaaggggatacagatcggaaaagaagaagtcaaaatatcactatttgcagatgacatgatagtatatttaagtgatcccaaaagttccaccagagaacgactaaagctgataaacaacttcagcaaagtggctgggtataaaattaactcaaataaatcagttgccttcctctatacaaaagagaaacaagccgagaaagaaattagggaaacgacacccttcataatagacccaaataatataaagtacctcggtgtgactttaaccaagcaagtaaaagatctgtacaataagaacttcaagacactgaggaaagaaattgaagaagacctcagaagatggaaagatctcccatgctcatggattggcaggattaatatagtaaaaatggccattttacccaaagcaatctacagattcaatgcaatccccatcaaaataccaatccaattcttcaaagagttagacagaacaatttgcaaattcatctggaataacaaaaaacccaggatagctaaagctatcctcaacaataaaaggacttcagggggaatcactatccctgaactcaagcagtattacagagcaatagtgataaaaactgcatggtgattggtacagagacagacagatagaccaatggaatagaactgaagacccagaaatgaacccacacacctatggtcacttgatttttgacaaaggagccaaaaccatccaatggaaaaaagatagcattttcagcaaatggtgctggttcaactggagggcaacatgtagaagaatgcagatcgatccatccttatcaccctgtacaaagcttaagtccaagtggatcaaggacctccacatcaaaccagacacactcaaactaatagaagaaaaactagggaagcatctggaacacatgagcactggaaaaaatttcctgaacaaaacaccaatggcttatgctctaagatcaagaatcgacaaatgggatctcataaaactgcaaagcttctgtaaggcaaaggacactgtggttaggacaaaacggcaaccaacagattgggaaaagatctttaccaatcctacaacagatagaggccttatatccaaaatatacaaagaactcaagaagttagaccgcaggaaacaaataaccctattaaaaatggggttcagagctaaacaaaaattcacagctgaggaatgccgaatggctgagaaacacctaaagaaatgttcaacatctttagtcataagggaaatgcaaatcaaaacaaccctgagatttcacctcacagtagtgagaatggctaagatcaaaaactcaggtgacagcagatgctggcgaggatgtggagaaagaggaacactcctccattgttggtgggattgcagactggtaaaaccattctggaaatcagtctggaggttcctcagaaaattggacattgaactgcctgaggatccagctatacctctcttgggcatatacccaaaagatgcctcaacatataaaagagacacgtgctccactatgttcattgccgccatatttataatagccagaaactggaaagaacccagatgcccttcaacagaggaatggatacagaaaatgtggtacatctacacaatggaatattactcagctatcaaaaacaacgagtttatgaaattcgtaggcaaatggttggaactggaaaatatcatcctgagtgagctaacccactcacagaaagacatacatggtatgcactcattgataagtggctattagcccaaatgcttgaattaccctagatccctagaacaaacgaaactcaagacggatgatcaaaatgtgaatgcttcactccttctttaaatgaggaaaaagaatacccttggctgggaagggagaggcaaagattaaaacagagactgaaggaacacccattcagagcctgccccacaggtggcccatacatatacagccacccaattggacaagatggatgaagcaaagaagtgcagactgacaggagccggatgtagatcgctcctgagagacacagccagaatacagcaaatacagaggcgaatgccagcagcaaaccactgaactgagaataggtcccccgttgaaggaatcagagaaagaactggaagagcttgaaggggctcaagaccccaaaagtacaacaatgtcaagcaaccagagcttccagggactaagccactacctaaatactatacatggactgaccctggactctgaccccataggtagcaatgaatatcctagtaagagcaccagtggaaggggaagccctgggtcctgctaagactggacccccagtgaactagactatggggggagggcggcaatggggggagggttgggagggggacacccataaggaaggggaggggggagggggatgtttacccggaaaccgaaagggaataacacttaaattatataagaaatactcaagttaattaaaaataataataataataataaaaagaattactcataaaataaagacaagatgatggataaaattaaaaaaacaaaaaaaacaaaaaaaaaccaaaatggaaacatgaaaatgctcactacttacaatagtgctttatgtaataagcaaatgactgcatttgacacgagttataatttattaaccccttagttagactacttgtacacatggtgattattaatccacaattattctttttcactaaaatccttatattttattctttgagattataatataatcacacaaattccctcttccctgtcatctcttcaaaaccttccatatagtcctccatgctgtcttttgaacgttatggcttcttttttatattcttgttttatattatatatatataatatatattataatatatatcatactatatatattcctcaggactgaccaatccatattggataaccaattggtgtgctcgtctcagggaaagaccatttccccaccatcagcattctcggtttccagtagttcattgtctagaatggagactgtgtgtgctttccccgtccactttagctgctgtgtttcagctcctcttgaggcagttatgttggtgagacctcatctgtgcggcttccaacattcctcagagacacagtgagttacacagtgtcacctgatcctctaactcccaccatctttcctgctgtcttctccagggtttcctgaacctcagcaggagcaggggttgtactgtagacacgcccaccttcactaggatccacagctcctcactttgatttgctgtggttttctgcaatggcttccatgtcctagtaaagtcatggagaccccataaccacgctgtactaaaccagacaatccctagctgcattctaagttcttgtccttatcccatacatgtgcatttagagagtctgcttattttgctcattatagaacgagtcaatcattctctttgagttgtaaaagctt

SEQ ID NO: 2987 - DNA, 809 bp, Rattus norvegicus
  Genbank Accession No. M13234
ggctgatacactacaacatcatgctacaaagccagtaaaatgggtctactcttccccttttctacgcagagaaagtccaaaaggagattgatcaggtgattggctctcacaggccaccatcccttgatgatcgtaccaaaatgccatacactgatgcagtcatccacgagattcagagatttgcagatcttgccccaattggtttaccacacagagtcaccaaagacaccatgttccgagggtacctgctccccaaggtgaggccacctgtgattcctcattgttactccattcatgagcatcctccactctcctaatcaccaacctcatcctgtctgtggttttccaggactgtgtttcttagggactgactgtttatcatatgggagtcagggtatgttaacatctttatcttataacttctcccagaacactgaggtgtatcccatcctgagttcagctctccatgacccacagtactttgaccatccagacaccttcaatcctgagcacttcctggatgccgatgggacactgaaaaagagtgaagcttttatgcccttctccacaggtgaggcagaattgtgattcctttcccagacactagagggcaggtcctccctctggacaccaacaccaataggtccctgttagtatactgagtctatctcagttaaacaatcccattaaatctggctacagctcatgaggggagtcttaactaactggagcatcctggtcaggacttttgggaattgtttaaggcaatgctaagaaatttaacacagcagccggtgggggtaagatcg

SEQ ID NO: 2988 - DNA, 807 bp, Rattus norvegicus
  Genbank Accession No. M13749
gtgcagctgtctttgactcaaccatgcttctctgggacactccttatgctggcagtttcaaccctgcttctttgggagcaggtgacttctgcaccaaattaccgaatgtccactggaagcctgtaccaacgagtggttgaattgtcgcactacactcatgatcttgcttcaaaagtgttcattgaatttgatatgaagttcggtaggacagtttggacacataaccttatgttaagtccttgccacacagctgctatccctactccagaaaacagtgagcaagtccaccaggcaaaatcggaagaccttctgaaagtgtccatcactattttacaagcctggcaagagcctctgaaacacatagtggcagcagtggctactcttccagatggatctgataccctgctgtcaagaacaaaggagttggaggaaagaattcaaggacttctggagggactggagaccatactcagcagggttcaacctggagctgttggaagtgattatactttctggtctgagtggtcagatttgcagtcatctgataaatccactaagaatggtgttcttagtgtcctgtatcggtgcatgcgcagggatacacataaagttgacaattttctcaaggtcttgaaatgccgcgatatttataacaacaactgctgagtagccatccctgtcctttgtctctgagaaggtccctcatgctctagaccttcagggcactaataaatctctacctctttggtgcccttcctgatttagtttgtatctttcttaaaaataaactcactctttggaaatgct

SEQ ID NO: 2989 - DNA, 2383 bp, Rattus norvegicus
  Genbank Accession No. M14050
ctctgtgagacacctgaccgaccgctgagcgactgactggtccacagcgccggcaagatgaagttcactgtggtggcggcggcgctgctgctgctgtgtgcggtgcgggcggaggaggaggacaagaaggaggatgtaggcacggtggttggcatcgacttggggaccacctattcctgcgtcggtgtattcaagaacggccgcgtggagatcatagccaacgatcagggcaaccgcatcacaccgtcgtatgtggccttcactcctgaaggggagcgtctgattggcgatgcggccaagaaccaactcacgtccaacccggagaacaccgtcttcgacgccaagcgcctcatcggacgcacttggaatgacccttccgtgcagcaggacatcaagttcttgccattcaaggtggttgaaaagaaaactaaaccatatattcaagttgatatcggaggtgggcaaaccaagacatttgccccagaagaaatttctgctatggttctcactaaaatgaaggaaactgccgaggcgtatttgggaaagaaggtcacccatgcagttgtgactgtaccagcttacttcaatgatgcacagcggcaagcaaccaaggatgctggcactattgctggactgaatgtcatgaggatcatcaatgagccaacagcagctgctattgcatatggcctggataagagagagggagagaagaacatcctcgtgtttgacctgggtggtggaaccttcgatgtgtctcttctcaccattgacaatggtgtctttgaagtggtggccactaatggagacactcatctgggtggggaagactttgatcagcgggtcatggagcacttcatcaagctgtacaaaaagaagactgggaaagatgtcagaaaggacaacagagctgtgcagaaactccggcgtgaggtagaaaaggccaagagagccctgtcttctcagcatcaagcgaggattgaaattgagtccttcttcgaaggagaagacttctcagagacccttactcgggccaaatttgaagagctgaacatggacctgttccgctctaccatgaaacctgtccagaaagtgttggaagactctgatctgaagaaatctgatattgatgagattgttctggttggcggatctactcgaattccaaagattcagcagttggtgaaagagttcttcaatggcaaggagccgtcccgtggcatcaacccagatgaggctgtagcatatggtgccgctgtccaggctggtgtcctctctggtgatcaagatacaggtgacctggttctgcttgatgtgtgtcctcttacacttggtattgaaactgtgggaggtgtcatgacaaaactgattccgaggaacactgtggtgcccaccaagaagtctcagatcttctccacagcttctgataatcagcccaccgtaacaatcaaggtctacgaaggtgaacgacccctgacaaaagacaatcaccttctgggtacatttgatctgactggaatccctcctgctccccgtggggtaccccagattgaagtcacctttgagatagatgtgaatggtattcttcgagtgacagctgaagacaaagggacaggaaacaaaaacaaaatcaccatcaccaatgaccaaaaccgcctgacccctgaagaaattgaaaggatggtcaatgacgccgagaagtttgctgaggaagacaaaaagctcaaagagcgcattgacacgaggaatgaattggaaagctatgcttactctcttaagaaccagatcggagataaagagaagctgggaggtaagctgtctcctgaagataaagagaccatggagaaagctgtagaggaaaagatcgaatggctggaaagccaccaggatgcagacattgaagactttaaagctaaaaagaaggaactagaagaaattgttcagccaattatcagcaaactctatggaagtggaggccctcccccaactggtgaagaggatacatcagaaaaagatgagttgtaggtgcactgatctgctagagctgtaatattgtaaatactggactcaggaactttcgttgggagaaaattgagagaacttaagtctcgaatgtaattggaatcttcacctcagagtggagttgaaaatgctatagcccaagtggctgtttactgcttttcattagcagttgctcacgtgtcttggggtcagggagaggaggaattggctattttaaaattggggaaaagctgggtcagggtgtgtgttcaccttggatatgttctatttaacggttgggtcatgcacatctggtgtaggaacttttttctaccataagtgacaccaataaatgtttgttatttacactggtctagtttttgtg

SEQ ID NO: 2990 - DNA, 410 bp, Rattus norvegicus
  Genbank Accession No. M14776
cggatttgggcatggggaaaaggaacattgaggatcgtgttcaagaggaagcacggtgccttgtggaggaactgaggaaaaccaatggctcaccctgtgaccccacgtttatcctgggctgtgctccttgcaatgtcatctgctccattattttccagaatcgttttgattataaagatcaggattttcttaacttgatggaaaaactcaatgagaacatgaaaattttgagcagtccctccacacagttttgcagttttttccctgttttaattgattattgtccgggaagtcatacgacattagctaaaaatgtgtatcatattagaaactaccttctgaagaaaataaaagagcatcaagaatcactggatgttacaaatccccggaactttattgattattaccta

SEQ ID NO: 2991 - DNA, 2462 bp, Rattus norvegicus
  Genbank Accession No. M14972
gatggctgcaccatgagcgtctctgcactgagctccacccgcttcacgggcagcatctctggcttcctccaagtggcctccgtgcttggtctgcttctgctgctggtcaaagcagtccagttctacctgcaaaggcaatggctactcaaggctttccagcagttcccatcacctcccttccactggttctttgggcacaagcagtttcaaggtgacaaagaactacagcaaattatgacatgtgtggagaatttcccaagtgcctttcctcgatggttctggggaagcaaagcctacttaattgtctatgaccctgactacatgaaggtgattctcgggcgatcagatccaaaggccaatggcgtctacagattgctagctccttggatcggatatggtttgctcttgctgaatggacaaccgtggttccagcaccggcgaatgctaaccccagccttccactatgacattctgaaaccctatgtaaaaaacatggctgactccattcgactgatgctagacaaatgggaacagctggcaggtcaagactcctctatagaaatctttcaacatatctccttaatgaccctagacactgtcatgaagtgtgccttcagccacaatggcagtgttcaggtggatggaaattacaagagctatatccaggccattgggaacttgaatgacctctttcactcccgtgtgaggaacatctttcatcagaatgataccatctataatttttcttccaatggccacttgttcaaccgtgcttgtcaacttgcccatgatcacacagatggtgtgatcaagctaaggaaggatcagctgcagaatgcgggagagctggaaaaggtcaagaagaaaagacgtttggattttctggacatcctcttacttgccagaatggagaatggggacagcttgtctgacaaggacctacgtgctgaggtggacacatttatgttcgagggtcatgacaccacagccagtggagtctcctggatcttctatgctctggccacacaccctaagcaccaacaaagatgcagagaggaagttcagagtgtcctgggggatgggtcctccattacctgggatcacctggaccagattccctacaccaccatgtgtatcaaggaggccctgaggctttacccacctgttccaggcattgtcagagaactcagcacatctgtcaccttccctgatgggcgctctttacccaagggtatccaagtcacactctccatttatggtctccaccacaacccgaaggtgtggccaaacccagaggtgtttgacccttccaggtttgcaccagactctccccgacacagccactcattcctgcccttctcaggaggagcgaggaactgcattgggaaacaatttgctatgagtgagatgaaggtgattgtggccctgaccctgctccgctttgagctactgccagatcccaccaaggtccccatccccttaccacgacttgtgctgaagtccaaaaatgggatctacctgtatctcaagaagctccactaattccgttgtggagctccgaaatctgaaatgagtttcactggcagaaagctgagttggtggtgtgactagccttcttcagaagagtgcttcagagagtcctctcctcctctcttcagtacagatcacccttctcagcactggaatattcctctgctttaaagccagcacccttcccataccccctcttctaaaagccttcccttttacaaatgttcttatgacatcatcaagaccactgaaaaactccaagataatttcccatctcaatattccttactccatctaacctactaagtcccttttgaattatgaggaataattcaatttgttccatgggctccaaaactcaaggcctgagcattattgtgaaacctttattcagcctaatatcatcttcacaagactgttacctggtacgttcatctaaatctcccctgcatagtctctctacctgactattcctcacacaagtttctttaccttccctcctttctccaataaagtgtccagtgtcctgcacaaaaagctcaaggagaactgattatcaccttctgattcgttcattgatgcattcaaattaaacctccacatagtagagactttttcaactattataaaaaccatcctgagccagacctgcagtcaacagcaagagcaggaagcgcataggaactacacctgcaaccaagctggcacaaagaccaagaattctgaagcagcccaaactcaagatgacatatttttacaagttagagaaaaatcaagatctgagttatcttgacaaactcgggatggaaagtaggagggaggggaaagcaaataaatacttccttattgtgtagcataaaaaaaccgaattcgtaggagggaggggaaagcaaataaatacttccttattgtgtagcataaaaaaaccgaat

SEQ ID NO: 2992 - DNA, 1346 bp, Rattus norvegicus
  Genbank Accession No. M15481
gaattccgggagacaaccttgtcaagcacctaattgtgccatccgtgcgatgccagccagctccatccaccttacaggagtgaagtcagcgttcatatacgctgtgtggtctggcagctgagatagtgtttcccaaagggactgtggaatgttacctcagcaggcattcatttcgcgtttggaaaatcgtctccaaatgaactttctttccgtgctgggtctgcagaacatttcagaagcggagctagcaatctgcttcaactttttttcccccggtgcttgcagcaggagatgcctgaagggagctgctgcgtggtggtctgaaacatagttcaaggaatagaggtcaactgcctagagcggtgcaggcagggcacaggctggctttgtactctgagtctcaaggtatttcccagtgcctgagccagggggaaggtggggggaggaagggaaggagctgccacttggatcgctattctgggtagccaagacagatagccatacaatggaaattagtggcttcaacttgggggaaaggatggactctaacttcgagctgtgcagttcgcccattgtttgaatggacaaaaggcagtttacccaggctcctagcatacctgcctgggtgtccaaatgtaactagatgctttcacaaaccccacccacaaaacaacacatgttcttaagtcctgggctttgttttcacttcggcctcataatacccactctgacctgctgtgtaaacgacccgggacgtaccaaaatgagcgcacctccaataaagatacacatcatgtcgtcttcacatctcttctacctggcactctgcttgctcacctttaccagctcggccacagccggaccagagaccctttgcggggctgagctggtggacgctcttcagttcgtgtgtggaccaaggggcttttacttcaacaagcccacaggctatggctccagcattcggagggcaccacagacgggcattgtggatgagtgttgcttccggagctgtgatctgaggaggctggagatgtactgtgtccgctgcaagcctacaaagtcagctcgttccatccgggcccagcgccacactgacatgcccaagactcagaaggaagtacacttgaagaacacaagtagaggaagtgcaggaaacaagacctacagaatgtaggaggagcctcccgaggaacagaaaatgccacgtcaccgcaagatcctttgctgcttgagcaacctgcaaaacatcggaacacctgccaaatatcaataatgagttcaataccatttcagagatgggcatttccctcaatgaaatacacaagtaaacattcccggaattc

SEQ ID NO: 2993 - DNA, 630 bp, Rattus norvegicus
  Genbank Accession No. M15528
gagctcctcgcagatccctaagaggtgaacggggccagtggacagtgcattcgaagttctggggttctgccatttgatcctcctccttgcccatctggagataaagaatgagattctcaaacatgaagggcgcaacccataggaccagtgctggctggagcagccttccaaacacacagtcaacagaacaacagcggccatcagtttggggatcgtttccattctaagggacatcaagacacagagggaagaatactttggaaagaagccagcacccggaccactgactccacagaaactgcagacacacagcttgttcagagacaaggaaatgggggcatctgcctgtcctaagctttacggacactggggacaggcacctgtactagattctggcatattcagtactttttttgtggtaatgtagtccactttttgtttatttgggttacccagaacccataattcatcccttaccaaattgaaactttcgccatgcattacccattataaattagttctcaactctgtcattcatgaagttagagctaggccatctgctctgaaaaaagaagtacctactgggtatctctggctaataaaaggttgcatgtatttgctaccctttgg

SEQ ID NO: 2994 - DNA, 805 bp, Rattus norvegicus
  Genbank Accession No. M15562
gtgattccagaggtgactgtactccccaaaagcccggtgaacctgggagagcccaacatcctcatctgtttcattgacaagttctcccctccagcggtcaatgtcacctggcttcggaacggacagcctgtcaccaaaggcgtgtcagagacagtgtttctcccaagggaggaccacctcttccgcaaattccactatctcaccttcctgccctccgtggaagattactatgactgtgaggtggatcactggggtctggaggagcctctgcggaagcactgggagtttgaagagaaaaccctcctcccagaaactaaagagaatgtcctgtgtgttctcgggttgtttgtgggtctggtaggcatcgtcgtcgggattgtgctcatcatcaagggccttcggaaacgcaacgcagtggaacgccaaggagccctgtgagataccgggaggtgatggcttccgtgagagctcatagaagaaatgtgctgtgacagcatctgaggctaccccttctctcagctcttcacctcagcagagacatcttctgcagtttccaacctcaagcctcgcgccagattctctggtctaatgtctggctggggttctccgtctgcttcctgtatctatattctattttccatcatttatagtaattcctctgtggcacatatcacagagctcttcctccgctgcggaactttctaagaatggaggcatcttctgttcacttacggcttgacatttctccaaactgtgttttctctttctctttttcaataaataataaacaccttgggtcctgaat

SEQ ID NO: 2995 - DNA, 1179 bp, Rattus norvegicus
  Genbank Accession No. M17960
tctagaggacttctctgaagccacagaaattagaggtgacttttcccgggtgctgtagggcccactggcttcagggtgaaacttagcctccactcccacccccaaaagaattgacccttaattccctaaaacccatctgttgtttttttcactctcccatttttaggcaattaaaattagctccccccccccaaatttcatgttgggaattttcttaaactcaacagcaacagcaaaccacctaacttctataaaatagcctaagattttgtgggttccccaaacttgctgactaagaccttaggttccccacgttaggcttggatcaagatgttccccttttttgcatagaataattttcctcatttcccaacttggattctaatttttctggaatctcaaatttagtcgtttgccacagttttcccatttatggagtctcattcaagtcctcctactttgggccactcattcccagggccgcaaatcagacaagggtctgatttgggatccccgaaatttgatcattgtttccgctggccactttcggcagcttcccgtcctgcgcataacatcgatatcggcctcttcacttctcctacggtgtcccagcggcagctcagattttggaaaagtgtgtgtgccccaaacacgcaccggacactgcgcggcggccaggacgtgggcagtgctgctcccgtgtccaggaaaaccactgggcattgcccccagtttcccccaaatttgggcattgtccccgggtcttccaacggactgggcgttgccccgggacactggggactgcctttggggtctcgctcaccttcagcaacgtccacttcagcagctcccacttctgcagctctcccgcccttctccgatcctcctgcgccagcggacccgaccttcggccttgcggtgagctcccggtggcgcgctcccttgtgctccagctcttccgttgcggggcaccggctacctcgcagtttgtcttcagggctgctgcggggtagcgcgggagcgggctgctggcttctcccttggcgaccgcgctcctttgggccgggcgctccgaaacacgcgccactttgtatgcactctgcaaacaacgcggtggtagggaaagcgcctgagcggccaggaagcgggaaaggcagagcgctccggcggcttggatcc

SEQ ID NO: 2996 - DNA, 1758 bp, Rattus norvegicus
  Genbank Accession No. M20406
agaccttatacatagtctgattagaccaggatcatggatactagtgtccttctcctccttgctgtcctcctcagcttcttgctattcctggtcagaggccatgcaaaagttcatggtcatcttccaccaggaccccgtcccttacccctcttgggaaacctcttgcagatggacagaggaggctttcgtaagtctttcattcagcttcaagaaaaacacggagatgtgttcacagtatactttggacctaggcctgtggtcatgctgtgtgggacacagaccataagggaggctctggtggaccatgctgaggctttctctggccggggaataattgctgtgcttcagccaattatgcaggaatacggtgtgtcctttgttaatgaagaaaggtggaagatccttcggcgattatttgtagccaccatgagagactttgggataggaaagcagagtgtggaggatcagataaaggaggaggccaaatgtttagtggaggaactgaagaatcatcagggagtctccctggacccaacgttcctcttccagtgcgtcacaggcaacataatctgctccattgtctttggagagcgctttgactacagagaccgccagttcctgcgcttgctcgacctgttgtataggaccttttccctcataagctcattctccagccagatgtttgaggtctactctgacttcctgaagtactttcctggtgtccacagagaaatctacaaaaacctgaaggaagtcctcgactacattgatcatagtgtggagaaccacagggccactttggaccccaatgctccccgagactttatcgatactttccttctgcacatggagaaggagaagttgaaccactacacggagttccatcattggaacctaatgatatctgtgctctttcttttccttgctggcactgagtctacaagcaacactctctgctatggattcctgctcatgctcaagtaccctcatgttgcagagaaagtccaaaaggagattgatcaggtgatcggctcacagcgggtcccaacccttgatgaccgctccaaaatgccatacactgaggcagtcatccatgagattcagagattttctgatgtttctccaatgggtttgccatgcagaatcaccaaagacacattgttccgagggtacctgctccccaagaacactgaggtgtacttcatcctgagttcagctctccatgacccacagtactttgaacaaccagacaccttcaatcctgagcacttcctggatgccaatggggcactgaagaaatgtgaagctttcatgcccttctccataggaaagcgtatgtgtcttggagaaggcattgcccgaagtgaattgttccttttcttcactaccatcctccagaactactcagtgtccagccctgtggatcctaacaccattgatatgactcccaaggagagtggattagccaaagtagccccagtgtacaagatttgctttgtagcccgctgattgtgctgaggcagtcagccgactcacttctgttcaaaatggccccatttttctgattctgggagacctgctggagaccaggcccaaggttgctgagtcattcctcacttcttcccaacagcctcagtccccatttatcaggtctccatgctctgtgatctatgctattggactatgtataaggtctgaattctatgtctacaggtttgcctagtatgtatggttcatgtaaacaggatcatatagtgc

SEQ ID NO: 2997 - DNA, 1780 bp, Rattus norvegicus
  Genbank Accession No. M20629
tctcttgctgtttgcccaatttggggacacccatcctcaccaccagtggtggacaccacaaaaggcaaagtcctggggaagtatgtcagcttagaaggatttacacagcctgtggccgtcttcctgggagtcccttttgccaagcctcctcttggatctctgaggtttgctccaccagagcctgcagagccctggagcttcgtgaagaacaccaccacctacccgcctatgtgctcccaagatggagttgtgggaaagttactcgcagatatgttgagcaccggaaaagagagtatacctctcgagttttccgaagactgtctctacctgaatatttacagtcctgctgacttgacaaaaaacagccgattgcccgtgatggtgtggatccatggaggtggactaataataggcggagcatcaccctatagtggactagctctctctgcccacgaaaacgtggtggtggtaaccattcaataccgcctgggatttgggggattgtttagcaccggtgatgaacacagccgggggaactgggctcacttggaccagctggctgcactacgctgggtccaggataacattgcaaactttggagggaacccggattcagtgaccatctttggagagtcagcaggaggtgtcagtgtctctgctcttgtcttatctcctctggccaagaacctcttccacagagccatttctgagagtggtgtggtcctcactacaaacctggacaagaagaatactcaggctgtggctcaaatgattgctactctttctgggtgtaataacacctcatcagccgccatggttcagtgcttgcgccagaagacagaggctgagctcttggagcttacagtgaaactggacaatacctccatgtccactgtgattgatggagtggtactgccaaagacaccggaagagatcctgactgagaagagtttcaacacggtcccctacatagtgggcttcaacaagcaagagtttggctggatcattccaacgatgatgggaaatctactctctgaaggcagaatgaatgagaaaatggccagttctttcttgaagaggttcagccctaaccttaacatctctgagagtgtgattccagcaatcattgagaagtacttaagaggaacagatgaccctgccaaaaagaaggaacttctcctggacatgttttcagatgtctttttcggtatcccagctgtactcatgtcccgtagcctcagagatgccggagcgcccacctacatgtatgagtttcagtatcgcccaagcttcgtgtctgaccagagaccccagacagttcagggagaccatggtgatgaaatcttctctgtatttgggactccatttttaaaagagggcgcctcagaagaggagaccaatcttagcaagttggtgatgaagttctgggccaactttgctcgaaatgggaacccaaatggagaggggctgcctcactggccaaaatatgatcagaaggaagggtatttgcagattggtgccaccacccagcaagcccagaaactgaaaggagaagaagtggctttctggactgagctcttggctaagaatccacctcagacagaacacactgaacacacataaatgggtctctgccagcctcagtaccagaggagcaaagatggggctattccacaaaggatggctatttgccaaagatgaatcttacagaggaaactgcacaattgtacagttggggtatttgtatctcaactttgaaataaatttccttttagaaagc

SEQ ID NO: 2998 - DNA, 508 bp, Rattus norvegicus
  Genbank Accession No. M20721
aaatcacctaaagaggtgtttactcaaagtcctgaatatgaagagtctgttcttccagctcaggctgagggtcaagaggaatctagagcccccccacatatgtcattacagcctctggatcaagacctcaccctgtcttctcaccctcatggttggattacccaccatccaaatacacatggcaagatttaccttcattatgcagaacctcccacaggaccttttgttgaacctccagatctgttctttctgaaaaccacaaaatctaagcctgtgcatgggtccccaaggcagattgacaaatcacataaagagatgtttactcaaagtcctgaatatgaggagtctgttcttccagctcaggctgagggtcaagaggaatctagagccccaccacatatgtcattacagcctctggatcaagacctcaccctgtcttctcaccctcatggttggattccccaccatccaaatacaccagacaagatttaccttcattatgcagaac

SEQ ID NO: 2999 - DNA, 3327 bp, Rattus norvegicus
  Genbank Accession No. M22631
aacggcgggatataacatgagctgtcttcggtatcgtcgtatcccactaccgagatatccgcaccaacgcgcagcccggactcggtaatggcgcattggccccagcgccatctgatcgttggcaaccagcatcgcagtgggaacgatgccctcattcagcaatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgccccgtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcagtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtcggaattccgggcggtcctcccagcaactgctgtggacgctgaagcgtgctccagtctattcacagcaatgcctagtggtgtcccgaagtctcagttctgtggaatatgagcctaaagaaaaaacttttgataaaattcttattgctaacagaggagaaattgcttgtagggtcattaagacttgcaggaagatgggcatcaggacagttgccatccacagtgatgttgatgccagctcggttcatgtgaaaatggcggatgaggctgtctgtgttggcccagctcccaccagtaaaagctacctcaacatggatgccatcatggaggccattaagaaaaccggggcccaagctgtacacccaggttatggattcctgtcagaaaacaaagagtttgcaaagtgtttggcagcagaagatgtcactttcattggacctgatactcatgctattcaagccatgggtgacaagatagaaagcaaactgttagccaagagagcaaaggtcaacacaatccctggttttgatggggtactaaaggatgcagatgaagccgtcagaattgcaagggaaattggctaccctgtgatgatcaaggcctcagcaggcggtggtgggaaaggcatgcgcatcccgtgggatgacgaagagaccagggatggctttagattttcatcccaggaagctgcttctagttttggtgatgatagactactaatagaaaaatttatcgataaccctcgtcatatagaaatccaggttttaggggataaacatggcaatgctctgtggctcaatgagagggagtgctcgatccagagaagaaaccagaaggtggtagaggaggcgccgagcatttttctggatcctgagacgcgccgagccatgggagagcaggccgtggcttggccaaaagcggtgaagtattcttctgctggaactgtggaatttcttgtggactcccagaagaatttttacttcttggagatgaatacaagactccaggttgaacatcctgtcacagagtgcattactggcctggacttagtccaagaaatgatcctggttgctaagggttacccactcaggcacaagcaagaggatattcccatcagtggctgggcagttgaatgtcgggtttatgctgaggacccctacaagtctttcggtttaccgtctattgggagactgtctcagtaccaagagcctatacatctacctggtgtccgagttgacagtggcatccaaccaggaagtgacatcagcatctatcatgaccctatgatttcaaaactagtcacatatggatctgacagagcagaagccctgaagaggatggaagatgcattggacagttatgttatccggggtgttacacacaacatcccactgcttcgggaggtgataatcaacacgcgttttgtgaaaggggacatcagcactaagtttctctctgatgtgtatcctgatggcttcaaagggcacatgttaacacccagtgagagagaccagttattggctattgcatcatccttgtttgtggcatcccagctacgagcacagcgctttcaagaacattcaagagttccagttataaggccagatgtggctaagtgggagctctcagtaaaattacatgatgaagaccatactgttgtggcatccaacaacgggccaacatttaacgtggaagttgatggctcgaaactaaatgtgaccagtacgtggaacctggcctcacccttattgtctgtcaacgttgatggcactcagaggactgtgcagtgtctttctccggacgcaggtggaaacatgagcatccagtttcttggcacagtgtacaaagtgcacattttaaccaaacttgctgcagaactgaacaaattcatgcttgaaaaagtacccaaggacactagcagcgttctgcgttccccgaagcctggagtggtggtggccgtttccgtcaagcctggagacatggtagcagaaggtcaggaaatctgtgtgattgaagctatgaaaatgcagaacagtatgacagctggtaaaatgggcaaggtgaaactggtgcactgcaaagctggagacacagttggtgaaggagacctgctcgtggagctggaataagtacttgtagcccttcagtcaccactgctcactgctttaattagcatttccattattctctaaccctcaatttgctcaggcgtttacaggagcactctgcagcaggttctacagcatcgtatttattccttagaagagggcaaaaccgacactctgccaaaaaaatcaccaatgggaatttttattgatataaatacttgtacatatgatttgtacttctgctgagatttcccagtgtcaaaattaaatcaataaaaccaacggaa

SEQ ID NO: 3000 - DNA, 3157 bp, Rattus norvegicus
  Genbank Accession No. M23572
gttgtttcaggatgtgcttctccgtccgctccagggagcggtcacttctttgcagagcgtggtccatctccaaagtcaagcttgccccctcttgttatcccaccaagtgaaagctcgggacagcgtgaagaggatcaagttctgtgtggttttaagaaactctcagtgaatggggtgtgcgcttccacacctccacttacacccattcaaagctgctcttccccgtttccctgtgcagctccctgtgatcgcagttcccgaccgctcccaccattgcccatctctgaggacccatctctggatgaggccgactgtgaggtggaatttctaaccagtgcagatacagacttccttttagaagactgcgtgccttccgatttcaaatacgatgttcctggcaggcgaagcttccgtgggtgcggacagatcaattatgcgtattttgacagcccaactgtttctgtggcagatcttagctgtgcatctgaccagaacagagttgttccagatccaaaccctcccccgcctcaaagccatcgcagattaaggaggtctcactcaggaccagccgggtcgtttaacaagccagccatccggatatctagctgcacacacagagcctctcctagctcggatgaagacaagcctgagatcccgccccgggttcctatacctcccaggccagccaagccagactacagaaggtggtcagcagaagtgacctctaacacatacagtgatgaagataggcctcccaaagtccccccgagagaacctttgtctcggagtaactcccgtaccccaagtcctaaaagccttccgtcttacctcaatggggtcatgcctccaacacagagctttgcccccgaccccaagtatgtcagcagcaaagccctgcagagacagagcagcgaagggtctgccaaggccccctgcatcctgcccatcattgagaatgggaagaaggtcagctccacgcattattacctactacctgagagaccgccataccttgacaaatatgagaagtattttagggaagcagaagaagcaaacccaagcacccagattcagccattacctgctgcctgtggtatggtctctgccacagacaagctggcctccagaatgaaaatggatgtgggcggccacgggaagcgcaaacacttatcctacgtggtttctccgtagatatggggtcatggttcaacagaagttacatggaacggatggctgccaagtttccaatttgaggttcatagaacagtgtcaagtggcaacatgaagtggtggactctgccttggtgaggaaggcatagagccgttatgaggtgctgttgtgctgggagtccctgacctatcagcataggaagaaaaaagtatgatttaaagatgtgctagagggacacttttacatttgactacattatatacctatgtataaacgtgcggtgtaaccatagaccatagctgcaggataaccaattagtcactctagagtaatctatattcagaacaattcaaacgagctggaggcacagctccagacagtgtgaaaattgagcaaacgggagagagcagtactgttgatcagttataaatgtagagattcctggcattcaggcctgctatctagtttgttttcttccccttccctgccagcagtcttctccatacacgacagggcgtgctcttcgccaggcctgtaacgtcttgttgaaatcgttctatggcctaatacttgccgctctgggcgtttgtcttgagaggagaggacagccgtttctggaccatgttatctatcacctgtgtatgtctctcttggaaatggacagaattggtgacttttccatgctattcctgcttttcccgtccactgaagaggctttcaagagtgcagttgagtggtgctggccgtcagtgttgggtataagttttatagaccagcccagtgattagccatgattgagagttatcgtggggtgtatgggatgttgttttgtttttgagactttaaagtacaacacaagctggtcttgtgttttggttcctattcagtatttcctggggattgtttgctttttaagtgaaacacttctgaccaatagcacagaacgtcttaatgccagaggtcacttcagcatcttcctgcttagaaaactcacagctggctgcctcactgccctgagagtcagtgagacgtgtagcttgtgttcaatttttacatcctctgattgtttatcttgtatagataagcacaaagagaaggtgcttgctaacagagggacaccgctgccatgtcccaacaagctgttcagtttaaactgctgaatgacattatttgagctatttaaagcttatttttagtatgaactaaatgaaggttaaaacatgctttagaaaatgcactgatctccgcactgtgtgtacagtattggacaaaggatttgttcattttgttgcattattttgaatattgtcttttcattttaataaagttatattacttatttatgacaccgttaatgtcttgtctaaactcttatgtctcaagcaattggtgttattttttcaagcatgacagtgtttggggttcaatacatgttgaaactattgtagatttctaaatgacaatctgagcaactttacttgggtgttataaaaatgtatgggctgaagacttggtcagttgttgaagtgcttactctggacttggtcccgagtatcacgtaaacagggcatgcccataagtccagcacttgagatggtggctggagaatcagcagttcacaacgtcatctttggttcccctaggccacatgaatccctgtctcaaaaaagaaaaagaaaaaaagtatggcaaaaatcaagccttttttgctctcacctggaacaataaacagtaaacttggttctggagcttctgtggaaacagtaacacgaggaaggccaggctgtgcagtccgtaggacactctgtgtgcagacttcttgagctttaggactcagtctgggtcactctgggccctttgtgaccttcactgcttgcttgtctgaggccttaatccccgtggccaggcactgcagagagccttgcagactgctgggctgctgtatccaagctggtggccctgtgtgtcactctagcttgggaattc

SEQ ID NO: 3001 - DNA, 426 bp, Rattus norvegicus
  Genbank Accession No. M23888
ccaacgtttctctgggccagtgttcatgctttgtcttgaattttcttccaggctcttttgatgctgctgttattcagacgccaagacatttgatcaaaatgaaagggcagcaagtagagatgaactgtaaccccgaaaaggatcaccctgctgttttctggtatcagcaaaaacagagcaaagagttaaagttcctgatttactttcagaatcaacggcctgtcgatcaaatagacatggtcaaggagagattctcagctgagtggccctcaaactcacgctgtagcctgaaaatcagtacttctgaagtagaagactcagcactgtacctgtgctccagcagtcaaatagacgaggcccagtattttggagaggggactcggctctctgttctagaggatctgaaaacggtgactccacccaagg

SEQ ID NO: 3002 - DNA, 412 bp, Rattus norvegicus
  Genbank Accession No. M23889
cttggatgttagtgctcagactatccatcaatggccagctgtcaaggtccaggctgtgggcagtccactctctctgcagtgcaccgtaaaggggacatcaaaccccaacctttactggtactggcaggctccaggagggacccttcagcaactcttctactcttttaatgttggccagtcagaattggtggtgcagcggaacctctcagcttccaggcccaagagtgaacagttcatcctgagcactgagaagttactcctcactcactctggcttctacctctgtgcctggagtccaggacagggctcatatgagcagtatttcggtcccggcaccaagctcacggttttagaggatctgaaaacggtgactccacccaaggtctccttgtttgagccatcagaagcagag

SEQ ID NO: 3003 - DNA, 635 bp, Rattus norvegicus
  Genbank Accession No. M24026
aatgtcatttatgttgtccttggagccatctctgctgtggccatcattggagctgtgatcattggaggtgtgttggctgttgtgaggaagagaaacacaggtgggaaaggagactacacccctgctccagatagggacagctgccagagctctaatgtgtctctcccagattgtaaagcatgaagacagctgcctggagtggactgagtgacagacgatgtgttcaggtctctcctgtgacatccagagccctcagttctctttagacaccagtgtctgaagttccctgtgattctatggcttcagtgtgaaggactgtggagcccagcctgccctgcacacctggaccctgtccctgaactgcctgtcttcccttccacagccaaccttgctggtccagcctggggttgggggctggggacagctgcatcctgttactctgtgctgccctgagctgcagctcctcacttctacactgagaataagaatctgagtgtgaaattgactgttcacatccttgacacagtgttgattgctttttaaattactagattgagaatacttagaggttgttttttgtttttatttttgttttgttttgttttaaataaatggcaggcggagaaccttccaga

SEQ ID NO: 3004 - DNA, 1461 bp, Rattus norvegicus
  Genbank Accession No. M24353
ggattctcaccccacatcattagagtggaaagaaagggccagctttcaatattgcaagaaaagatcgaccatttggagcgtttgctagcggagaacaacgagatcatctcgaatatcagagactcggtcatcaacctgagtgagtctgtggaagatggcccacgaggtccagcaggcaacgccagccaaggctctgcgcacctccactctgcacagttggccctacaggctgaccccaaagactgcttgtttgcctcgcagagcggaaaccagcaccgggatgtgcagatgttggatgtttacgatctgattccttttgataatccagatggtggagtttggaagcaagggtttgacattaagtacgaagctgatgagtgggaccgtgagcccctgcaagtgtttgtggtgcctcactcccataatgacccaggttggttgaagactttcaatgactactttagagacaagactcagtatatttttaataacatggtcctaaagctgaaagaagactcaagcaggaagtttatatggtctgagatctcttaccttgcaaaatggtgggatattatagataatccgaagaaggaagctgttaaaagtttactacagaatggtcagcttgagattgtgaccggtggctgggtgatggccgatgaagccactacacattattttgccttaattgaccaactgattgaagggcatcaatggctggaaaaaaatctaggagtgaaacctcgatcgggctgggccatagatccctttggacattcacccacaatgacttaccttctaaaacgtgctggattttcacacatgctcatccagagagtccattattcggtgaaaaaacacttctctttgcaaaaaacgctggaatttttctggagacagaattgggatcttggatccaccacagacattttgtgccacatgatgcccttctatagctatgacatcccccacacctgtggacccgatcccaaaatatgctgccagtttgattttaagcggcttcctggaggcagatacggttgtccctggggagttcccccagaagcaatatctcctggaaatgtccaaagcagggctcagatgctactggatcagtaccggaaaaagtcaaaacttttccgcaccaaagttctcctggctccgctcggagacgattttcggttcagtgaatacacagagtgggacctgcagtacaggaactatgagcagttattcagttacatgaactctcagccccatcttaaagtgaagatccagtttggaactttgtcagattatttcgatgcattggagaagtctgtggcagctgagaagaagggtggccagtctgtgttccccgccctgagtggagacttcttcacctacgctgaccgagacgaccattactggagtggctacttcacatccagacctttctacaaacgaatggacaggataatg

SEQ ID NO: 3005 - DNA, 600 bp, Rattus norvegicus
  Genbank Accession No. M25823
gtctttgtcacagggcaaggaacaaccgacgatggactggacacaacagagattgttcttctgcctcaaactgaccctttacctgctcgcaccactgaattcacacccccaaggatctctgaaagaggaaatggctcctcagagaccacatatcttccaggtttttcatccacgctgatgcctcacctgaccccacagcctgactcacagaccccctctgccagaggagctgacactcagacactcagcagccaagctgacctcaccacactcacggctgctcccagcggcgagactgacccaccaggtgtgcccgaagagagtactgtaccggagacctttcctggaggcacccccatccttgcacgcaacagcactgctccctcacctacacacacttccaatgtcagcaccacagatatctcctcaggtgccaacctcacaacccctgcaccatccactctgggctttgcaagcaataccaccacaagcacagaaatagctacccctcaaacgaagccatcatgtgatgaaaaatttgggaacgttactgtgcgttacatctatgatgacagtagtaagaattttaacgcaaaccta

SEQ ID NO: 3006 - DNA, 846 bp, Rattus norvegicus
  Genbank Accession No. M26247
agagtttctgttgcctacaattctaaaaagatcacccgtgctgagactgttttttctaataccgactatggaaattccactgaattaatcctggatgacatcaccaacagcaccattcttgataacctcactgaaaatagtgaaccaattaatgacttcactcgagttgttggtggagaaaatgcgaaaccaggtcaaatcccttggcaggtcattctaaatggtgaaattgaggcattctgtggaggcgccatcattaatgaaaaatggattgtaactgctgcccactgtcttaaacctggtgataaaattgaggttgttgctggtgaacataatattgatgagaaggaagacacagaacaaaggagaaatgtgattcgaactatccctcatcaccagtacaatgcaactattaataagtatagtcatgacattgccttgctggaactggataaacctttaatactaaacagctatgtaacacctatctgtgttgccaataaggaatatacaaatatcttcctcaagtttggttctggttatgtgagtggctgggggaaagtcttcaacaaagggagacaggcttccattcttcagtaccttagagttccactggttgaccgagccacatgccttaggtccacaaaattcagcatctataacaacatgttctgtgcaggttaccgtgaaggaggcaaagattcatgtgaaggagatagtgggggaccccatgttactgaagtagaagggacaagtttcttaactggcattattagctggggtgaagaatgtgcaatgaaaggcaaatatggaatatatactaaggtttccaggtatgtcaactgg

SEQ ID NO: 3007 - DNA, 3128 bp, Rattus norvegicus
  Genbank Accession No. M27440
aattctaagggtactcggtcttcagtaaggttacaaggagcctctaattttgctgggatctggaactttgaagtaggagaaaattttgctggagaagctactctccgacgcatctatggcacatgggaacacaatatgataaaccatttacaggtattcagctactttgacacaaaaggaaaacaaacatgcagagccaccctagagctctccccatggaccatgtcaacccttctacaggttcatgtgagtcaacccagtcccctctttgatctccatcactttgaccaggaagtgatcctgaaagctagcactaagaaccagaaggtcagctggaaaagtgaggtccaggttgaatcacaggttcttcagcacaatgcacacttctccaatgaccaagaagaagtacgccttgacattgctggatccttagaaggacagctgtgggaccttgaaaatttctttctaccggcatttggcaagagcttgagggaactcctacagatagacggaaagcgtcagtatcttcaagcttcgacttctcttcactataccaaaaacccgaatggctatctcctctcactccctgtgcaagaactgactgatagattcattataccagggctgaaactaaatgacttcagtggaatcaaaatctataagaaattaagtacttcaccatttgccctcaacctaacaatgctccccaaagtaaaattccctggggttgatctgttaacacaatactctaaaccagagggctcctctgtccctacctttgagacaactatacctgaaattcaattaactgtgtcccagtttacacttccaaagagctttcccgttggcaacactgtctttgatctgaataagctaaccaacctaattgcagatgttgatctgcctagtatcaccctgccagagcagaccattgagatcccatcccttgagttctctgtacctgctgggatttttattccgttctttggagaactgactgcacacgttgggatggcctctcccctgtataatgtcacgtggagcactggttggaaaaacaaagcagaccatgttgaaacattcctggattccacatgcagttcaaccttgcagtttctggagtatgctctaaaagttgtgggaacacacaggattgaaaatgataagttcatctataaaatcaaaggaacacttcaacactgtgacttcaatgtgaagtataacgaagatggtatatttgaaggactttgggacttggagggagaggctcatctggacatcaccagcccagcactgactgacttccatctgcactacaaagaagacaagacaagtgtgtctgcctcagcagcctccccagccataggcactgtgagtctggatgcaagcacagatgaccagagtgtgaggctgcatgtctacttccgccctcagtcccctccagataataaactcagcatattcaaaatggagtggagggacaaggagtctgatggtgaaacatacatcaaaattaactgggaagaagaagcagctttcagattgctagactccctaaaaagcaatgtgcccaaggcttctgaggctgtttatgattatgtcaagaagtaccacctgggacatgcttcttcagagctaagaaaaagtcttcagaatgatgctgaacacgccataaggatggttgatgagatgaacgtgaatgcccagagggtaacccgtgatacctaccagagtctatataagaagatgttggctcaggagagccagagtatccctgagaaactcaagaaaatggtgttaggcagtctagtacgtattactcagaagtaccacatggcagtcacatggctgatggactcagtcattcatttcctgaagttcaatagagtccagttcccagggaatgctggaacatatactgtggacgaactttacactatagccatgagggaaaccaagaagttactctctcagctgtttaatgggttaggacacctgttttcctatgttcaagaccaagtagagaaatcaagagtaatcaatgacataacatttaaatgtcccttttccccaacaccttgtaaactaaaagatgtcctattgattttcagggaggacttaaacattttatccaacttaggccaacaggatatcaattttacaacaatactaagtgactttcagagctttttggagagacttttagacatcatagaagaaaaaattgaatgcctaaagaacaatgaatctacttgtgtccctgatcatatcaacatgttcttcaaaacacatatcccatttgcatttaaatccctgagagaaaacatatactctgtcttcagtgagttcaatgactttgttcaatccatacttcaagaggggtcctataagctacagcaggtccatcagtatatgaaggcctttcgtgaagagtattttgatccgagtgtggttggctggacagtaaaatattatgaaatagaagaaaagatggttgaccttatcaagacccttttggctcctctgagggatttctactctgaatacagtgtgacagctgctgattttgcttccaaaatgtcaactcaggttgagcaatttgtgtccagggatatcagagagtatcttagcatgcttgctgacataaatggaaaggggagggaaaaggttgcagagctttctattgtggtaaaggaaagaataaaaagctggtccactgcggtggcagaaataacgtctgattacctccggcagctccattccaaactgcaggatttttcagaccagctctctggctactatgaaaaattcgttgctgagtccacaagactgattgacctgtccattcaaaactaccacatgtttctcagatacatcgctgagttactgaaaaagctgcaggtggccacagccaataatgtgagcccctacctaaggtttgctcaaggagaactgattatcaccttctgattcgttcattgatgcattcaaattaaacctccacatagtaggagactttttcaactattataaaaaccatcctgagccagacctgcagtcaacagcaagagcaggaagcgcattaggaactacacctgcaaccaagctggcacaaagaccaagaattc

SEQ ID NO: 3008 - DNA, 334 bp, Rattus norvegicus
  Genbank Accession No. M28255
ggcggggtcctggatatcaccattgggctcacttcctgcttcgtgtgttgtcttctacctgcgggctgggtcctgtcacacctggaaagctacaagaagcgggagtgaagggagcgtcttccctcatcctttgactagaccactcttgccagcccaccttgatcatgtttcctgcattcctggctggcttacccygggatcatgttattcaattccagtcacctcttctgcaatcatgacctctcgatgtctccatggtgacaactgggaccacatatattggttctgcttgatggggtccccctttgtaacaataaagtctatttaaaccttg

SEQ ID NO: 3009 - DNA, 913 bp, Rattus norvegicus
  Genbank Accession No. M29295
gaatgcagcctgcaaaatggccggatcttcatcgggaccttcaaagcttttgacaagcatatgaacttgatcctctgtgactgtgatgagttcaggaagatcaagccaaagaactccaaacaagcagaaagagaagagaagcgagtccttggtctggtgttgcttcgaggagagaacctggtctccatgacagtagaaggacctcctcccaaagatactggcattgcccgagtgccacttgctggagctgctggggggccaggcatcggcagggctgctggcagaggaatcccggcgggtgtgcccatgccccaggctcctgcagggcttgctggaccagtgcgaggtgttggagggccgtcccagcaggtgatgaccccacaaggaagaggcactgtggcagctgctgcagctgcagccacagccagtattgcaggagccccaactcagtacccacctggtcgtgggggtcctcctccacctatgggccgaggggcacctcctccaggtatgatgggcccacctcctggcatgaggcctcccatgggtcccccaatggggatccctcctggccgaggaactccaatgggcatgccccctcctgggatgcgacctcctcctccaggcatgcgaggtctgctttgatcttcgcacagcattatgtcagtagctccgaagagacatggaccctattccccagggtcaggttaccacagacctgtttgtttgttatgctgtttatggagtcttactggaggtctggtttctttcaggctccctccctggaaatgtgccctccgaggcccctagacctcatcttggtcctcctccgcttcctagcttcttccaacctttgtttcccaaaaaggctgtacatagtccttttttttttctgtggcccatgaagctggtt

SEQ ID NO: 3010 - DNA, 1821 bp, Rattus norvegicus
  Genbank Accession No. M31322
gaattcgttacctcctccatctcagagaaccctgtggatgtccgggtgagctctgaggaaagtgaggagatcccgccgttccaccctttccatcccttcccatccttgtctgagaacgaagacactcagccggagttgtaccacccaatgaaaaaaggatctggaatggcagagcaagatgggggcctgattggtgcagaagaaaaggtgatcaacagtaagaataaaatggatgaaaatatggtcattgacgagactctggatgttaaggaaatgattttcaatgctgagagagttgggggtctggaggaagagccggactctgtggggcctctacgggaggacttcagtttgagcagcagtgcccttattggcttgctggtcatcgcggtggccattgctacagtcatcgtcatcagcctggtgatgctgaggaagaggcaatacggcaccatcagccatggcattgtggaggttcatccaatgctcaccccagaagagcgtcacttgaacaagatgcagaaccacggctatgaaaacccaacctacaaatacctggagcagatgcagatttaaggacagcagcgtgtgcgacaccctggctgaggctgctgcaggtgggctggaagagcctcagcgtttgtgcttgactgctgaccaccagcggtgccagaggcctcatcctacatcctgctctcctggattgttaagactataaagtactactgtaggattgcaatttccattcttttaaatgggtttaaaagatgttaatataacaatatatgatatataaaccttaagtgaaaaaaagatctattgcagatatctgatggatgtagttttctttttttaaattagaaatgccacttctattgtattgtctcacacatgctctatataaatggaaaatgttgatttttcaatgatagactatatacacaggctgttcccgttatgtaagtctgttctttaggctcgtttgctgggctggttttgtcgtcatttgttttaatgtataaaggcagtattccccttttcaggttgctgagaaatgtaagtggaactgaagtacattgtatgcagttactgactgttttaggcatagtctccttggaagcctagagcttccagtgccgggtgtccagtgcctgtcaccaaagcaagggctaagtcaccttgagctagctggatgcaaactagatccactgtgctttccttcaaatccagttcttccacagcaaccagcccatagttgttctgtgttcttccacagctgtttacggtagcctcctagccactctcctcagcaagtgcatccaagagtgcaccacccccttctttggacgtctccgtcccatgcactgaccctctgcttgccttcgtacctcacttcctccaccgctcttcagcccctttgatgtcccctcagagaataccgatatacacatggctaaggacccaggagacttcacgggaggcctcattaggtgaaaggacgatgttctgggctgtacatgaaattggatctgtagacactgtgtttccttcactgacttgtaatgtcacgcagctggagttgatgccacaacccttagtgctttgttgctgttttgtttttcagggttctggtaacctgctactgtttttgttttggttttggtttggttttttttgtatttttctgtgatttccctccccttcccccccatgcctcttcccactatgcacagatggaaactttacctacaaactccttcgtatgatctgtggagaatgtacagaacttattacatcaataaaacactttaacttcccccg

SEQ ID NO: 3011 - DNA, 1041 bp, Rattus norvegicus
  Genbank Accession No. M32754
cctgctcttaggagcctctcccagccccctcccacagcctgggcctctgggctctttcccctcctccctcccacctccagcagccaggtctccaactgccggccaggcttgggcctgagtgactttgtcgcctgcagctgccaatcccaaaaatattctctgatgacacagctggaggtcaagagcccagactggctcctccaggctaagtatagatagagcaggcaggaccacctgccctccacccagagcctcaaccccaggtcttccctcccacgttggcctagcagctgctacggttgaaaagagccccagaaagtctgaggggtttggggcattctgtcctcctgacaaatgatttgatgactggccaaccctaagcaccctgtgtgtgtgtgtgtgtgtgtgtgtgtgtgtgtgtgtgtgtgtgtgtgtgtgtgtggtgggttgtatgcttgcctgaatgggtcaggtcacttggggtgaatacccatcacagccccttcccccacattcttggcgggagtggagataaggctcagggccacagacatctgcgtcagagataggaggtctcaatgccatgggcaggggcaactgggactggagggcgtgggaaggactgggggagactggggaagaagggtagaagaaggcaagcagtgggatggggagggaagagtggggaggtcctagacagaaagggcacagggcagagtgtgggctccctgtcgtcagggcaagagaactatggtgatccagccgtctctgctgctccttttgctgttgactctacaggatgtggacagctgccaggggccagaacttgtccgggagcttgtcctggccaaagtgaaggcactattcctagatgccttggggcccccagcaatggatggggaaggtgggggtcctggaataaggcggctgcctcgaagacatgcccttgggggcttcatgcacaggacctctgaaccagaggaggaggatgtctcccaggccatccttttcccagccacaggtaatgaagttggggtgacc

SEQ ID NO: 3012 - DNA, 18820 bp, Rattus norvegicus
  Genbank Accession No. M33312
gaattctagtacggtagccctggctttcatcaactagttagtgccaaatatttgagaaaagttacaggttcaagctaataaaagttgcagagagtataaaagaatgcagattagacaagaaaaaattaattagagcccttctagccaacaaagcctcagatccaggagaaaagactaccatagaaatggccaaaggcttatttatcaaagaaactgggctcagtggcagcaggatgaccaccttgcctgtgtttattgttgccacagcactgttggataaagatgcaaataaattaactttgggacagaagttgatcatgactgctcctccccctgcccccgcaattctgattgaggctcagtaatgcctacatgcttcattatcacactttactaatcagccctggctgagatattttccagccacctgtttccctgaaccctgcgactcttccacccaaccctgacttgggctgtccacttcatcaattcgatgaggttcaggcccagatacacaataccagaccttacttgaggaactctcatccatcagaaacagagcatacctggttcacggacagaagtagcttcatccataagggtcagaggagaacaggggcagcaataacaacagaaggaaaggtaatctggactcagtctcttccttccaggcacttcaactcaaaagaacaaactaagaacattaacacaagtcctcatcatgggaaaaggactggctgttagcatctgcagggacagccagatatgcatttacaactactcatgtgcacggagccatttacaaggaacaacagctcctaacagcagaaggaaaaactgtcagaaataaagataaaactctacaggacatcaaaaagaaaccaatggctagagataacagtctgactgataaggcttctaagaaggtagccttaaaggaaacagccaacactagattggccattgtcctacctgaaccacctagagtaactgataaatgcagaaaaagaaattaaatgggctggtgatggtcaactgaaggtaagcgaatattgcccacttctcagaaagatccacagtcactcacttgggagtaaaatgaatgacaaactttaaagtttgccagctgaccaacactcacaggaagcccaaacatccaaattcctgactgcgagttaagagacttggagcctactgggaaaattgatttttttcagaaatcaagcaagaaagatatggctcaaaatatctgctgatatttgtagacattttttttcgagatagatggatagatgtactaggagagatctttccgatgtttggagcacctaaggtaacaggatcagacaatgggcctgtcttcatatctcaggtaagtcagggacttgctaagatcttggggactaattggaaactccattgttcatatcatccccagagttcagggcaggtagaaaggatgaatagaactctaaaagagaccttaacagaattagccttggagactggtggggactgggtgaggctctttccctttgccctatattaggtgtacatggcattctagctcccattgtatctagcctacagttggtagctattacagaactgaaaaatgataatttaagatttaaggtcagagctaccaaataggctcatgaatttgtttgggcctaaattatgtaccttctgtgaagcaggcctggttccagaaccacacaagtcaaaagagactgggtctctatgaagagatttcaccaaggtgcgactaaacccatgtgaaaatggcaattcatcatcctgttgatcatgatcaccacctgggtgtacaacaaccacaccagaccagttcctccaatgaagaactctgcctggctccagctgtaccaaaatagagggttcaaaaggacaccaagcccttcaagttaaagttgactcagtctcagtcctgagtctcttgcccctgctaactctatgtctatatatactgtatgtcttagatccccccctgttaggaaggtaccctagctggatccttgataattttacttttatttctgacttttggcccctgtattttaagttgcttagtagtttataagagaattcagtcaagttaattatcttaaggcaacactatctacagctggaagcagggaagcaagcatatgagttagaagactataagcttcaagatcaaagctatgctaaaagaaaaggggggaatgaaaagccagagttggggtcaatctgaggccaatgagaaaaacccaccattaacatccaagcacagaacgacccttctcttccagaaagagtaaagctagtttagttcctggaacagctacaagccaaactgttgaacaaagccacatgtaactccccatccaacctccagaaagtcccagaatggcacactgaccacaagtcattttggaggttacttcaccccactaatagtagtactcttcctagttactgttgtgcaaattctgccccaattgtttgtaaggtatatacagacccagttagagtctgctcagggtcttctctttctgaaagggagtcaaccccgacgcattaaaataaagctagtcttggttttgcattgattagcacctccttgagtctcactcaaggggtcccggaaagggtcagattagacctcatatacctctgagcacagcttgtatggtgactaagatacaggatacccacaggctgggattagagagtttaaaccaaagatctttcatccatgtgctccatgcctgccctgtgcccagggggaaacatggattctaattacagaagcctccctaaggatcttaatgggaaccaagtaggagacttttccagttagaagccttctgacaactggggtttccccatattggtagtttaggttgttatttcacaaaactacaattccttcaccaactggagttctgagttattctcctctagtctggaaaatgatctgctaaaatatagctgtggttttctacccttttcaaagccatacatagacagggaaggttgcccatccttccctgaagttgaagatccttttagaagtcaatgcacccatcagtggtgataaatgcctttaatcccagtatgcagcaaactctgtgagtttgacgccaaattggtctacagagtgtgttctagaacagtcagagctaaagagagaaacactctgtggaaaagaaagaaagaaaaaagaaaggaaggaaagaaggaaggaaggaaggaaggaaggaaggaaggaaggaaggaaggaaaaagaaaggaaggaaggaaaaaggtacagagagagggaaagagggagggagaaaaataacatatatgaagacacagtacaggaccaatctgggctcaggtgcccactttagtctcctactggaattttcatccacttgtaccagaaactcagcacccacagatccttcttgccatgtgaccttccagtccatagtttggaatctttcctgttttccttactaatatttttctcctaataaaaagactaaaccatctagactctaggactccagagatgactctgtgggtaagagcacttgttgctcttgtagaagacccaggttttattcctagaacccacatggtggcttacaaccatgtgtgaccccatttccaaaggattcctctaaatcttttggcatctttggacagtgtgcccaattgttacccagacttaaatggaagagaaaccttcatattacataaaaaattaacacaataagatccataaagaaatatataaaagaagataatcttttttaaaaaggatacattggatacattgccaggcctggagagatggctcagtggttaagagcactgacagctcttccagaggtcctgagttcaaattcccagcaaccacatggtgactcacaattatctgtaatgggattcaatgcccactactggtgtgtctgaagacagtgacagtgtactcatatacatgaaagaaataaatgaatcttgagaacaacatttaatgcctgaagccatgtttcctgtattgttccagtcaaatctaagaatgtgaattctatcacagaccacaacatttacatctatgagggctttcttcatgagctcaaccatacaaatatagatttttagttctagatttgatctggtggacccagaaatggacagcctcctgataatagccacagtccccaatacagcaccaatctcatcatagcatttgaagagtgtattatatgttggcctgttcaccttgtccactaaaaccctcagcttggtccaccaaagcctctttgactgcattgtatcaacacaccaaagcacaccgaggctttaagaattttgaagtaagcctgccacccagaggtcttcctatttgcccatgttgtgggtgttgcaacaaagacagggtcagtgttaggagataggattggagggtaaaagactcaactagacaaacaggagcaaaggccatcctgtgtccctgggagtataaaggtactatctcagccttggctatcagcctgtcaatcctcactggccactatgctggacacaggactgcttctggtggtcatattggcctccctgagcgtcatgctcttggtgtccctctggcagcagaaaatcagggggagattgcctccaggacccactcctttgcctttcattggaaattatctgcagctgaatacaaaagacgtatacagttccatcacacaggtatcactggatgaggggatggatgggacatgggagcacaagaggctgtgatgttttgcatgttttgtggcagaagattcatagaggaatccaaagtcttgtattagtggagtttagaaagataaggagctatttcaagtctttggtttgttgtttgttgtttgttttgtttgttgtttgtttctttgtttctttgttttttcaatcatttatttgtagagtaacacataatctgacctctgtgtactggtccagttcagtgaataagtcatctaacagcccccatctaccccacatcagctcagtgagcgctatggtcctgtgttcaccatccaccttgggcctcgccgggttgtggtgctttatggatacgatgcagtcaaagaggctttggtggaccaagctgaggagttcagtggacgaggcgaacaggctacctacaatacactcttcaaaggctatggtgaggaggataccacattggggaacatgcccaaggacatttgttggcgtcatttaagtagccttcatactaactcatctctccctcaaggctgtacagagttctctgaatttctctccatatccatgttgaatgttggctctcattgtgaccctccctagcatttctgagattgaaaacagacttttgcaaattctgtgggttctttcttccatccttctctaccgttttcttccgccctttctaccacctatcactagataggaaagaaaaggagatagaggtgaaaggggacattactgttagattatttcctgctgattaggagtgacgagctccttagggaaagttttatcttctctgtcaggatatctaatttcttcttgttgttatttctttacataagactacttaacaaatcacaagcaacagcaactaaccaatagccaaaaccaatttctcagggtccttgcatttacacaaccttgaggagtcccagtatcctgagtgtcacacactctcagaaactatctgcagctggcaaaatcataacctcctgctttggacaacctgaaccagccccatatgccatacctgggagtaaacagaaacatatttctataatagttctgtatttttcaaagaaatcaaatttcttactacatctggccattgctgctcttctctctctctctctctctctctctctctctctctctctcacacacacacacacacacacacacacaaacacacacacacaaacacacacacacaaacacacacacacaaacacacacacacacaaacacacacacacaaacacacacacacgcacgcacacacacacaacctctcggcattctcctagatggatgactcctttttaatttagctgatatttttatccttcttaaacatttatccacacacagagcatcagttgcaggtctcaggcattcactcctgatgcctctggattggttttttagattctttgttcttacttttccatctatgggtgctgggctctcaagcacatctctgcacagtgtgtgtgcctggtgcccatggaagcaaaaagatggagtcagatctcctgaactccaggggttccctgagttccagggttatgagctgccaggtgagtgctggggtacaagcacaggtcctctgcaaggtcagccagtgctcttgagtgcagagccagctttgctgccccccactgcctatatttttaaatgctgttttacatactccatgtgttgtccctaagatgtgtataatgcttatagaacgtcacagtctggtaagtgctggccaaagctacagaagtataaaatggccttgaacagcaaaacactggttataagcaagaaaggtcaaaataaagagaaaatccacaaagagccaaatatctttataacattaattctgtagttaaaatttaacacagagagtgtatctcgttccttgaagaactgaaggacacacaaatgactacttctacctagggtcaaaatatagcggtgactacagctcaagacacacaaaaccagagtcaagaatcagggagtggtaataaaataataaaaaatcctggctcagggtttcttcccacctttccctgatgaaaggcacacacagcctttatattttagtctgccttatgcagcacaatagctgggcagctgcctaccctccatgctgttagaatccattttcctattgaaagccccaagttaatactttacaagtttctttataccatatttgctattcttgacccaactgaggagcccttttggccacactgtcttggcccatagcacatggtgtctctccttctaccttctgctctttcttcttccatggcttccacagaggctcctcaatcccattctccttcctcatgctctctagccccagaaaactaagcaccacaagtctcttctcccagctattagctgctgacatctttatttaccaatcagaatgaactgcgggcaggatcactcagacaaactacagactccaaatcttagaggccaacacttactgttataggaaacaataaaagacaaaaacctcaacaccagggtatgtttctgggtaggctgtccttgctttaatggggatttgctgttttcagaaaatgctcaatattgattgattttgccatttccaggaccctttgctgcattctgtctgtaagtctctttttatttgcctggctgacttgtttcaactttctttctctgactgtgtctgatgcacagtctgtgtttgtgtcttttgtgtccttgccatttctatccaactttgtctcttttctttcccccttagaacccctttccagggtgggcctcatccatcctcagcctcagtctacttctcctgaccccttatatttatatctctacaggcgtggcattcagcagtggggagcgggcaaaacaactcaggcgcctctctatagccacattgagagattttggtgtgggcaagcgtggtgtagaggagcgtatcctggaggaggcaggctatttgatcaagatgttgcagggcacttgtggtaagcaagagaccattaagtgtttgggcaagagaaagaacatccctgacacctagaccctatgggttgtggataagaagggcggggaagaccgcctaccaaaccatccccagaatctggtgctgagagattggtgcctcactccaattcccacaccatctgctaactcttctccctcataatgccaatgtcttccaaacaatgtcacccctctcaggagcccccattgaccccaccatctacctgagcaaaacagtctccaatgttattagctccattgtcttcggggaacgcttcgactatgaggacacggagttcctgtcactgctgcagatgatgggtcaaatgaacagatttgcagcttcacccacagggcaggtaacagatccagctctgccaattgtccttatagtgtcccacattgaccataccaacaaagggcaaggaccaccctgactctcatggctacaaacaaaagctcccctcaaaaacagaagctcccctcaaaaccagcctttacttcagaaaactgaacctttacatcagagcccacagaagctatccagtgctcacaatctaatgtcctctggatatctcagtagcctgagaacacagccctctgcttgactctcttccctgggcaggtttctccagcttaacctctaataaatcctctatgtggtcctcctgaaaatttagacaactgcccaagggatacaagtgaccacctctggccccctcctccaatcctgaacacctacctagttctgcaaaactgtggtcagtaaagctattcagtccatacacccagttctccccaaagatcccactgacacaatggcacaaaagtcacctgttgtctcaggtaaattcaggaatgagtagacaggcacctcaaccaaggcaaccaagcacagacctctggatggactgtttccccaaacacccatatgtctcccagctacacacaacccacatcaagacaatatctgacaggtgtgtctcacaccttataacctgaaccaccccaccatgaagacctgactatgtgaaaaaccgattctaatctcaaacaaatatcaagacatctaatcttagccctctcaaatgcccaaacatatagatacttgattcactgcgacactcatgtcctgaatactagaaacctggagtaatggtctgatccaaaaatcagttaaataactgaatgtctactaatgttcccttttgatccagttcattgggattgtaagacaatgaccttcattctttaaatcacctagaaaactgtggtctctggggcctctgacagttcagtggtttaagagcatgcactgctcatcctgaggaccgagttcagttcccactacctatgctgaacatttcaaaactctatgggagtacacctgcaccgtgcacataattaaaagtaaaatattcaaacgaatataaagagttctttcaagagtggaggtgctgtttgttgcaattcatcctaacataaatacatgaacacctggatggatcccttgagactcgacccactcccacgggtgttgccactgacaagccttttcttttctcctcccaccccccagctctatgacatgttccattcagtgatgaagtacctgcctggaccacagcaacagatcatcaaggttactcagaaactggaagacttcatgatagagaaagtgaggcagaaccatagtaccctggaccccaattccccaaggaacttcattgactcctttctcatccgcatgcaagaggtgatcccaatcatggtggatggaatgtctaaaacagggcagctctaaatcatcctagaaaaggaggaggaatataggcccattaagtgcccatgattctcctcacagtcccggttatagttaaacctcactctttcacctgttgagccttatccaagccagggtatgggttagcaaattaccatgacaaccgatattccagtgttcccctatgagacactgttttcagtgttcaactacttagcatgcactgaagctactgtcgaagaccctgtggagcctaaacttcgcaaagagggaaagtgtgcccagacttgcatgctgactttatggagacagaaaactatacagccttgcctctatggctctcaggcttttactattagccacatggtctctagcatttcatatctctgttaggaaatacacatcagtacacatcagtggcctaagacctgggtttttttttcttttgtctgttctagtaatttttttattgtttttcatttttgtgtttttttcttttattggattttttatttctatttcagatattatcccctttcttggtttcccttccagaaacctgctatctcctcatgcttctatgaggattctctcccacccacacaacactccctgccacctccctgtgctgacattcccctacactggggcatcgagcccagacaggaccaagggtctctcctcccattgatacccaacaaggccatcctctgttatacatatggctgaagcaataggtacatccctgtgtactcttgggatggtttagtcactgggagctctggtgggtctggttggttaatattgttgttcttcttatagggtggcaaaccccttcagctccttcagtcctttctctaactcctccatatgggaccattttctcagttcaatggttgactgcaagcatctgcctctgtaattgtcacgctctgcagagcctctcaggagacagctatatgaggatcctgtcaacatatatttcttggcatccacaatattgtgtgagtttagaggatgtcaatgggatgaatccacctgtagggcagtctctgaatggcctttccttcagactctgctccaaactttgtctttgtatttccttctttgagtatttttgttccccctttcaagaaggactgaagcatactcacttgagtctttcttcttcttgagtttcatgtggtctctgaattctatcttgggtattccaagtttttggactaatatttacttctcagtgagtgcataccatgtgttgggttacctcacttaggatgatattttttagttccatccatttgcctaagaatttcatgaagtcattatttttaatagcagtgtagtactccattgtgtaaatttactatattttttgtatatatttctctgttgaagaacatctagtttctttccagcttctggctattataaataaggctgttatgaacatagtggagagtgtgtctttgttatatgttggagcatcttttgagtatatgcccaggaatggtatagctgagtcctcacataatactatgtccaattttctgaggaacctccaggatgatatccagagtggttgtatcaaattacaatccaccaacaatggaggagtgttactctttctccacatccttaccagcatctgttgtcaccttcgtttttgacctttgccattctaactggtgtgaggtggaatctcagagttgttttgatttgcatttccctgatgactaaggaggttgaacatttctttaggtacttctcaaccatattcctaagctgagaattctttgcttagctctttactccatttttaatggggttatttgattctctggagtctaacttcttgagttctttgtatatatttaacattagccctctatcggatgtgggattggtaaagatcttttcccaatctgttggttgtcgatttgtcctaatgacagtgtcctttgccttacagaagctttgcaactttatgaagtagtatttgtcaattcttgatcttagagcataagccattggtgttttgtttaggaaactctccctggtgcccatgtgttcaagaccctttcccactttctgttctattagttccagtgtatctggttttattttagtttaattttatttttcttggataattatgtattacacatcaaatgttattccctttgtcccctctctcatatccccttcccctccctctgcctctatggggatgctaccacccccatccacccactcccacctcaaccccctagcattcccttacattgagaaaaagagccttcactagaccaagggcttttcctcctattgatgctggacaatgccatcctttgctacatatgcagctgaagccacgggtccttccatgggtacgctttggttggtggtttaggccctgggagctctcgtggagtctggttggttagttgatattattcttccatccctaaaatgaatgacagtcacctagacagagaaatgagcaaagcttctcatgcaaacccaagactgctaacacagcctggagatctttttccaacgattggtctggaccctatgagaactagatccaaaggaaattgcagaagtgctgcctattgcatccctctcctccatgaggaacttaatccacagttgacggctgtttagagacgatgaaataatattcctttgcagtgtggctactagtaaattgacctttctcaagtaaagaacccctcgcccatatgcatgcagccacacctaattataagcagttacccacaacacccccaacaaacaggaaaataggaaggagacttattaggaataagaaatggttcaaaaaaatggaaagtagaaaataatagaggggaatacgtttaaagtgcatttcatgtatacgtctgaaaaataaggactcaaggttcagtgggtatggaaggggattcatctgggagggtttggaggaggggtatgaatatattcacaatacaataaatgaaattctcaaagaattaataaaattatttataaaagaattactagaaatgtttcagaaaattaaaacccttaatgttccccaaggatgacaaaatgatagatttatgccctctctctctctctctctctctctctctctctctctctctctctctctctctctgcaggagaaaaatggcaattcagagttccacatgaagaacctagtgatgacaacactaagcctcttctttgctgggtctgagacagtcagctccacactacgctacggcttccttctactcatgaagcatccagatgtggagggtgaggctggctatgtggcagggaagttgggaaccgcagactctccaactgcttacaacctaacaatgaccctcacttctcccaggttcctggatgctcagtcatgctcagctatgcagagacaggggcatattaaatgcataaacacagttctcacaaacttaaaatattagacattcccaaattgatttcactctgacttccagatctctgctctctgttctcttccctgactcctgcttcttctccccaccatgattctgtcacgaaaaggataaaatgaccctgtccagcatttaggtatggatatatgtttaaatggtttaaatgcatgttatttacagagacatgtaatacatgcagtggtacacatgtgaactattccacctgctttgaggcctctggatttttaaaaataccccatctccgcttgtctttcagccaaggtccatgaggaaattgagcaggtgatcggcaggaaccgacagcctcagtatgaggaccacatgaagatgccctacacccaggctgtgatcaatgagatccaaagattttctaacttggctcccttgggcattcctcgaaggattatcaagaacacaaccttccgtggcttcttcctccccaaggtagcagccatgcccatccaggaggggcctccagcccacttactgatgcttcagggcttctttccatctgtagctatctaactccactctaattcctccaaccaaagaattcatccacatgtccccaaattcttgtccagctgctttgaactccattttctatctactcttctgccttgctaccttccaatctctcaactcctgggctagaggcaaaggcctgctgtcacactaacaccctatcttagcacatgatcccctggagctcaaatctccaattgctgatggcacatatcgtagcccctcaaatctcctattccctaatgccttttcctgaggagacctccaactctgtgccttgcagttgtctatatttggacatcctttctccatcaacccatcttctaaaatctcctttcttccctcttccagggcaccgatgtgttccctatattaggttctctgatgacagacccaaagttcttccctagccccaaagacttcgacccccagaacttcctggatgacaagggacagttgaagaaaaatgctgctttcctccctttctccactggtaaggagacagtgggttattgaactactgttcacaccaacatgggtagcacatgccagcttccctgtctgtgatgctgcctagaatcaggctaaccaggtatagcccctgcacctcccaagcaccagacatgctggatgcaggtgagaggatccctgggaccagtgatctgtgtcagagaccggggaggggttgggaataccaactttcctaggtgatgctcatgcaagcaatttcttcacactctttctaatgcagcttttaaataattgtttgtttttctttattttttaagtaatttatttaatgtgcaatggtgtgaggttgtcagatgccttggaactgaacttatagatgattatgagctgccatgtggctgctgagaattgaaccttggatcttcagaagaacagacagtgctcttaaccaatgagccatctcccagccccatcttcagactcttaaaagtgggataacaaccaggtggtataggtgcatgcctttaaccacagtactggtggatatctgagttcaacaccagcctgggactatagagtgagttacaggacaacccaggctacatggaggaaaccatgacttcaaaaactaaaaataaataaataataggtaggtagatagatagatagatagatacatacatacatagatacatagatacatagatacatagatacatagatacatagatacatagatacatagatacatagatacatagatagatgcatagatagatacatagatagatagagacatagatagatgcatagatagatacatagatagatagatgcatagatagatagatacatagatagaaagatgcatgtatacatacatgcatgcatacatagataaatagatgactcataaaaaattaaaagaataaaaaaataaacaaggccacagcagagcatctacatttgagaggataattaataattgatagaggaagcatctgtactccatattgctccagcctaaaatgagttgtcccacgttgtgtgtagggacaccagggttttaagagggttaggagcctttcctaatgatccctcatgctccagtatagcagccccttctccttttttttttctttttttctttattaacttgagtatttcttattaacatttcgagtgttattccctttcccggtttccaggccaacatccccctaatccctccccctccccttctttatgggtgttcccctccccaccctccccccattgccgcgctccccccaacaatcacattcacagggggttcagtcttagcaggaccaaggacttccccttccattggtgctcttactaggctattcattgctacctatgaggttggagtccagggtcagtccatgtatagtctttaggtagtggcttagtccctggaagctctggttggttggcattgttgttcatatggggtttcgagtcccttcaagctcttccagttctttctctgattccttcaacgggggtcctattctcccacccttcccccactgccgccctccccccaacaatcacgttcactggggctgaaccccatttttaatagggttatttgtctccctgcggtctaacttcttgagttctttgtatattttggatataagccctctatctgttgtaggattggtaaagatcttttcccaatctgttggttgccgttttgtcctaaccacagtgtctttgccttacagaagctttgcagttttatgagatcccatttgtcgattcttgatcttagagcataagccattggtgttttgttcaggaaattttctccagtgcccatgtgttcaagatgcttccccactttttttcctattagtttgagtgtatctggtttgatgtggaggtccttgatccacttggacttaagctttgtacagcgtgataagcatggatcaatctgcattcttctacatgttgacctccagttgaaccagcaccatttgctgaaaatgctatcttttttccattgaatggttttggcccctttgtcaaaaatcaagtgaccataggtaggtgggttcatttctgagtcttcaattctattccattgatctatctgtctgtctctgtaccaataccatgcagtttttatcactattgctctgtaatactgcttgagttcagggatagtgattccccctgaagtccttttattgttgaggatagttttagctatcctgggttttttgttattctagatgaatttgcaaattgttctgtctaactctttgaagaattggattggtattttgatggggattgcattgaatctgtagatcgcttttggtaaaatggtcatttttactagattaatcctgccaatccatgaacatgggagatctttccatcttctgaggtcttcttcaatttctttcttcagcgtcttgaagttcttattgtacagatcttttacttgcctggttaaagtcacaccaaggtattttatattatttgggactattatgaagggtatcgtttccctaatttctttctcggcttgtttctcttttgtgtagaggaaggcaactgatttatttgagttaattttatacccagccactttgctgaagttgtttatcagctttagtagttctctggtggaacttttgggatcacttaaatacactatcatgtcatctgcaaatagtgatattttgacttcttcttttccaatctttatccccttgatctccttttgttgtctgattgctctggcttgaacttcaagaactatattgaataagtagggagagagtgcagccccttctctttaagagaacacagctttgcacttggcactgaggcaaggcagcggtgagagcttccttcccaactgtgctccttccctctctcctcttcagggaagcgattctgcttgggagatggcctggctaagatggagctcttcctgctgctcaccactattttacagaacttccgtttcaagttcccaatgaaactagaagacatcaacgagtcccccaaacccttggggtttaccaggatcataccaaagtacaccatgagcttcatgcccatctgattctgagttgaatcaaggtggggcaagagggagagagagcctgaagtggggccagggtgcaggtggagagaacaggggaggtgaagatgagggttaagaagggaccacacccatggaagaaacacaaaagacttctcactttggtaaaattgtaacagtcctaataaaaagaaagaaatactcagtgggcagcagtaacaacaactgagactcatggggcaaaggtggctcacctctgcagaagctgtcctgtccttctctcagtcctctacacaagagcagcatgtccccaagtccaacgtacaggttgcaaagatggaacttacaaatttgaacctaaactgaggtggaaaaaactcaagttagctaggattgatgttttggactctatcaccagcattcaggagggagggaacatggctctctaccatgtctgccaggactacacagtgagagcttatctcaaaagaaaaaagaaaaaaagaaaaaaatttatatatatatatatatatatgtatatatatgtatatatatatatggagagagagagagagagagagagagagagagagagagagagagagagagagagtttgcattgtacatgatcagggaaataataaaaactagtttgacagtcacataccagtgggttctaatttatcaaactccacccccacccccactgccactgctgccctatgaaggaactgaacagaagcttaactttccttgggccatttcgacagctgttgtgtcatcaaggcttctgttttcctatggagacactacacatgggacagagaggataacagggagctcatgactgagagaccttcaggccaaagcacttgaacctttgtttatcctgtttattctgaattttctgcttctgggctctcatttccccaccattaaaatgagaatatcaatatttacagctgcactgcatctctttttggagtgattcctggtaactaagaaataagtagaaaatggaaggatgaaatccaccaggaggtttgagtaaattccactgtgggaaacacaggggactgtgggatggcaaggatgagagctggaaagaatgcaaggccacactatgtctcatgcatattttatatcttttttatattctttatatctttgtagtgtttttattagcctacaaagaaatacatttctcactggcaacttcttacatatatatcactacctatgttctcattcactttccttcgctggtcttggcctcttcgcaaaattattcaccggtaatttattcacactttctaatttttgagcatggtgcattccagtaagatttaatctctgtggccatggtgtttcacagctctgtaacactgaagcacattcatcatcaactgcactgaagtcatcaacttaagaagcaaaggaggattcttctggtctccatctgcgcccagagctaagtctgccccacaaccctccagattcaaaacctccccagacagagctagtcctccaggagtgctctcactactaaggccacaagtgagaccccatttcccttcaataccgatccaaagaggagcccaccagataccaggtaccaaagttaaatgaggatccgttgacctgcaggtc

SEQ ID NO: 3013 - DNA, 1994 bp, Rattus norvegicus
  Genbank Accession No. M33648
atctctcccaggggctgtggactgctggctttctgttgataccttagagatgcagcggcttttggctccagcaaggcgggtcctgcaagtgaagagagtcatgcaggaatcttcgctctcacccgctcacctgctccccgcagcccagcagaggttttctacaatccctcctgctcccctggccaaaactgatacatggccaaaagatgtgggcatccttgccctggaggtctactttccagcccaatatgtggaccaaactgacctggagaagttcaacaatgtggaagcagggaagtacacagtgggcttgggccagacccgtatgggcttctgttcggtccaggaggacatcaactccttgtgcctcacagtggtgcagaggctgatggaacgcacaaagctgccatgggatgccgtaggccgcctggaagtgggcacggaaaccatcattgacaagtccaaggctgtcaagacagtgctcatggagctcttccaggattcaggcaacactgacatcgagggcatagataccaccaacgcctgctatggtggcactgcctccctcttcaacgctgccaactggatggagtccagctactgggatggtcgctatgccctggtggtctgtggtgatatcgcagtctacccaagtggtaacccccgccccacaggtggtgccggggctgtggcaatgctgattgggcccaaggccccgctagtcctggaacaagggctgaggggaacccacatggagaacgcctatgacttctacaaaccaaacttggcctcagagtatccactggtggatgggaagctgtctatccagtgctacctgcgggccttggaccgatgctatgcagcttaccgcaggaaaatccagaatcagtggaagcaagctggaaacaaccagcctttcaccctcgatgacgtgcaatatatgatcttccacacacccttttgcaagatggtccagaaatccctagctcggctgatgttcaatgacttcctgtcatctagcagtgacaagcagaacaacttatacaagggtctagaggccttcaagggtctaaagctggaagaaacctacaccaacaaggatgttgacaaggctctgctgaaggcctccctggacatgttcaacaagaaaaccaaggcctccctttacctctccacaaacaatgggaacatgtacacctcgtccctctacgggtgcctggcctcacttctctcccaccactctgcccaagaattggccggctccaggattggagccttctcctacggctcaggcttagcagcaagtttcttctcatttcgagtgtccaaggacgcttccccaggttcccctctggagaagctggtgtctagtgtgtcagatctgcccaaacgtctagactcccggagacgcatgtcccctgaggaattcacagaaataatgaatcagagagagcaattttaccacaaggtgaacttctctccccctggtgacacaagcaacctcttcccaggcacttggtaccttgaacgagtggatgagatgcaccgcagaaaatatgcccggcgtcccgtctaaggagaccaatccatacaaccattccccggggaaagaatgtgagcagagccgttacccaaacggcttccacttaaaattccacccacagcagtgaacggtgaatagacacagcgaccccataggatctgctccgcggtgaagggcctccctctgtggatcctgggtgaccctccctgaagcagtgagcaccacaggttctgctgtggaccagagcccccctgtggagagggagaaagaaaggggagccgctgacctgcagggatacagaccttccccacagcctggcagccgcccgtttgttgcagcttattatcagactgtgggctatcatagttcatgctcgtttcttaaagtttcccgagaatttctaaaattttgtatctaaacttttaatatggcgattaaaaggagagaagga

SEQ ID NO: 3014 - DNA, 2140 bp, Rattus norvegicus
  Genbank Accession No. M33936
aaaccattaaccatgggtttctctgtatttacccctacaagatccctggatggtgtctctgggttcttccaaggggccttcctgctcagtctatttctggtgctgttcaaggcagtccaattctacttacgaaggcaatggctgctcaaggccctcgagaagttcccatccacgccttcccactggctttggggccacgacctgaaggacagagaattccagcaggttcttacgtgggtagagaaattcccaggtgcctgcttacagtggctctcagggagcaaaacacgagtcctgctctatgaccctgactatgtgaaggtggttctgggaagatcagatccaaaggcttctggaatttatcaattccttgctccctggattggttatggtttgctcctgttgaatgggaagaaatggttccagcatcggcggatgttgactccagccttccactatggcatcctcaaaccctatgtcaaaatcatggcggactctgtcaatataatgctagacaaatgggagaagcttgatgaccaggatcaccctctagagatcttccactatgtctccttgatgacactggacactgttatgaagtgtgctttcagccatcagggcagtgttcagttggatgtaaattccaggtcctacaccaaggctgtcgaggatctaaacaacctgactttctttcgtgtgaggagtgccttttatgggaacagcatcatctacaatatgtcctctgatggccgtttgtcccgccgggcctgccagattgctcatgagcacacagatggagtgatcaaaatgaggaaggctcagctgcagaatgaggaagagcttcagaaggccaggaagaagaggcacttggatttcctggacatcctgttgtttgccaaaatggaggatgggaagagcttgtctgatgaggacctgcgtgcagaggtggacacattcatgtttgagggtcatgacaccacagccagtggaatctcctgggttttctatgctctggccacccaccctgagcaccaagagagatgcagagaggaggtgcagagcattctgggtgatggaacctctgtcacatgggaccacctggaccagataccttacaccaccatgtgcatcaaggaggccctgaggctctacccaccagtaccttctgtgagtcgagagctcagctcccctgtcaccttcccagatggacgttccatacccaaaggtatcacaaccacaattttaatttatggccttcatcataacccaagttactggccaaacccaaaggtgtttgacccctctagattctcaccagattctcctcgccatagccatgcttatctgccattctcaggaggagcaaggaactgcattgggaaacagtttgccatgaatgagctgaaggtggctgtggccctgaccctgcttcgctttgagttgctgccagatcccaccaggatcccggtccctatggcaagacttgtgttgaagtccaagaatgggatccacctgcgtctcaagaagctaagataaatctggtggagataggacagctccagaggtctgctgcctgcaatacctgcatttgttactggctaatttatactcattttgctttctctttgattcccatcctctgctgagtgtcccgtcatctcatttttttgccctcatttctgtagcttttcctccagactccatcccagtttgtgcgtggacccatttcccatctgttttcacctctgaccagccactgaacttgccgccagcagcctgtcctccagcctgcttacccctcattatcattggactaacagagaaagatgtattttagagggaaactcttgcactttatctctcttcagttctcagagtcttgggacaatggacatcatgaattaaaatgttcttaaaaatcacatgctgggagaaaattaatcctaaaaattctggcaccagccagaggaaggatgttggctgaaaagaaaagatttctagatatttatgtttgtctcatggtgaaattaatgtatgcctcatcttttctatgaaataataattctgatacagaacagtagagagaaatgaatagtttttgctactttgggccaaactgtaaataaatccatttcacttc

SEQ ID NO: 3015 - DNA, 451 bp, Rattus norvegicus
  Genbank Accession No. M34331
tcctctttctctcgaaccgggcggcctcatccgcgaacagcgcagcaatggccaagattaaggctcgggacctgcgcggcaagaagaaggaggagctgttgaaacaactggatgatctgaaggtggaactgtcccagcttcgcgtggccaaagtgacaggcggcgccgcgtccaagctctccaagatacgagtcgtacgcaaatccatcgcccgtgtcctcactgtcattaatcagactcaaaaggaaaacctcaggaaattctacaagggaaagaagtacaagcccctggacctgcgacccaagaagacaagagccatgcgccgccggctcaccaagcatgaagagaagctgaagaccaagaagcagcagcggaaggagcggctgtacccactgcgcaagtacgcagtcaaggcctgagacgacgacaataacaataaagtccaaaactg

SEQ ID NO: 3016 - DNA, 511 bp, Rattus norvegicus
  Genbank Accession No. M35601
  misc_feature (1)..(511): n = a or c or g or t
cctgaacttggttccttttatgacagccgctttggttcactcacaaagaacttcaaagaatttggcagtaagacctctgattctgacatcttcacagacatcgagaaccctagctcccatgtacctgagttttcttncagtagtaaaacctcaactgtcaggaaacaagtaaccaagagctataaaatggcagatgaggcagcaagtgaagctcaccaagaaggagacactcgaaccaccaagaggggccgagctcgcacaatgagaggtatccacgcttaactctgggaagttgccctgaccccctagactaagttaaccatttctgcaaagtgcttaccaggcgcgctctttcttaacctcttctagtgctttggtggaatctcattttttttcatgctagactgtacgttccttgggggcagggactttgccatgtgtctatttctctaattccccaatgcataacagtgcagtcatttctcaataaatatattttaaataaatgaac

SEQ ID NO: 3017 - DNA, 1157 bp, Rattus norvegicus
  Genbank Accession No. M36410
ggcaggctaggttgcgctgtctgcgtgctgaccggggcttcccggggcttcggccgcgccctggccccgcagctggccgggttgctgtcgcccggttcggtgttgcttctaagcgcacgcagtgactcgatgctgcggcaactgaaggaggagctctgtacgcagcagccgggcctgcaagtggtgctggcagccgccgatttgggcaccgagtccggcgtgcaacagttgctgagcgcggtgcgcgagctccctaggcccgagaggctgcagcgcctcctgctcatcaacaatgcaggcactcttggggatgtttccaaaggcttcctgaacatcaatgacctagctgaggtgaacaactactgggccctgaacctaacctccatgctctgcttgaccaccggcaccttgaatgccttctccaatagccctggcctgagcaagactgtagttaacatctcatctctgtgtgccctgcagcctttcaagggctggggactctactgtgcagggaaggctgcccgagacatgttataccaggtcctggctgttgaggaacccagtgtgagggtgctgagctatgccccaggtcccctggacaccaacatgcagcagttggcccgggaaacctccatggacccagagttgaggagcagactgcagaagttgaattctgagggggagctggtggactgtgggacttcagcccagaaactgctgagcttgctgcaaagggacaccttccaatctggagcccacgtggacttctatgacatttaagcccatgtcctgtcacagcgccccccccccccagccctgcctaacacacatacaagccctccaacccagccagcgggagccacgggcactgccagtcctgagaaggcttctgcagaggctcgggagagagctgatgtgtactggagtcctctgtccccaggaagagaacttagggctgggagagcaggagaagcagaaacactgagcagatgaggcagagtctctcgtctgtggtcgttctcaggtgaagagggcggggtctgattcacagagaggaccgagggtattgaatctttgttgtactgccttcatcctggggtattcactggtcctccctcgactctggtcaaatacatggttatggcagatgccctaga

SEQ ID NO: 3018 - DNA, 1877 bp, Rattus norvegicus
  Genbank Accession No. M38566
ggtctctggctctaaactcttggcttctcagacacgatctatggctgtgttgagccgcatgagactgagatgggcgcttctggacactcgtgtgatgggccatggcctctgcccacaaggggccagagccaaggccgcgatccctgcagccctccgggatcacgagagcacggagggtccaggaacaggtcaagaccgaccgcgcctgcggagtctggcggagcttccgggacccggaacgctacgctttttattccagctatttctacgaggctatgtgctgcacttgcacgagctccaggcgctgaacaaggccaagtacggcccaatgtggacaaccacctttgggactcgcaccaatgtgaatctggctagcgccccgctcttggagcaagtgatgagacaggagggcaagtaccccataagagacagcatggagcagtggaaggagcaccgagaccacaaaggcctctcctatgggatcttcatcacacaaggacagcagtggtaccatctgcgtcatagtttgaatcagcggatgctgaagcctgctgaggcagccctctacacagatgccttaaacgaggtcatcagtgactttattgcccggctggaccaggtgcggacagagagtgcatcaggggatcaggtgccagatgtggcacatcttctctaccaccttgccttggaagccatctgctatatcctgtttgagaaaagggttggctgcctggagccctccatccctgaggacaccgccaccttcatcagatctgttggactcatgttcaagaactcagtctatgtcactttccttcccaagtggtctcggcctctgctgcccttttggaagcgatacatgaataactgggataacattttctccttcggggagaagatgattcatcaaaaagtccaggagatagaagcccagctacaggcggctgggccagatggggtccaggtatctggctacctgcacttcctgctgactaaggaattgctcagtcctcaagagactgtcggcacctttcctgagctgatcttggctggggtagacacgacatccaatacactgacctgggccctgtatcacctttcaaagaacccagagatccaggaagccttgcacaaggaagtgactggtgtggtacccttcgggaaggtgccccagaacaaggactttgcccacatgcccctgctaaaagctgtgattaaggagaccctgcgcctctaccctgtggttcccacaaactcccggatcatcacagaaaaggaaactgaaattaatggcttcctcttccctaagaatacacagtttgtgttatgcacctacgtggtgtcccgagatcccagtgtctttcctgagcccgagagcttccagcctcaccgatggctgaggaagagagaggacgataactccgggatccaacacccatttggctctgtgccctttggctatggggttcggtcctgcctgggtcgcaggattgcagaactggagatgcaactcctgctgtcaaggctgatacaaaagtatgaggtggtcctgtctcccgggatgggagaagtgaagtctgtgtcccgcatcgtcctggttcccagcaagaaggtgagcctacgctttctgcagagacagtagtaccaagctgggctcctgtctccatgggacttgtccagaagccctggcacagaagttcttggccagtctcacgtcacatgtcacgatgccagattcaacaggggacctctctgccctttccatagacaccagacgtctggcacaatctctactgagcagcacccatttaagacattagagcacctcatatcacaggacggtgcttgggtacaatttaaaataaaatttaaaattc

SEQ ID NO: 3019 - DNA, 16299 bp, Rattus norvegicus
  Genbank Accession No. M57718
  misc_feature (1)..(16299): n = a or c or g or t
attcaattgatatagtcccgttgaagacacactttattcaacctctcaaaagtccaagacaataaagtctcaaaccaaaagaaatatgccaagtctcatataagcatgggcttggtagaatattattagagtctacagcagaaacttttcataaatggactaaactttccaagcgttaggttgactgaatggatttttttaatgaaattcaactgtatgctatctacaaaaaaaatctcacaagaaggtgctaagggatggaaagaaacccactgattccaggaaagcaaaacaagcaccagagagagcccttggcatcccaaggcatggactgcccgtgagactggcctacctagaaggagaagagcagcagtgcctagatgctttctagtctgaattagcaaccagccaccatccatttggcatggacaattcagaagaaactatgtaggtgctgggtctgctgtggaaactcaaggacctcacaagagcaacaaataaagccacagacataagctatgcagcttgggaaagagccagtgtgtgaggacccccatatcacacaagactttaacaagagatatttatttttatatgacaaccttgtttgatttttaataattaaatgtttcaagaaaagataaaaagattaatggatgaatatttaaggaaattatgattattctgcttaacttatatgtgcagtacccaggtgttgaaatatcacactgtatcctataagtgtatacgccaaatacaatgaaaaagggaaataaaagccaaacaagtcaatgttcttgactagcacaaagagaggaaaatgggtgcaggtctggctattagccactgtcggctggaaaaaaaaaaatcatgtctctgattcccaaggtaaatcattcctgccaactgaactttgagatcaagattggtctgcctcacctttctccctcccacaggtaggcgggcaatccttacaggatttaggcaagaggcagaaaggatctgtgagagtgagggcagctactgaggagtggctgcaccatgagcgtctctgcactgagctccacccgcttcacgggcagcatctctggcttcctccaagtggcctccgtgcttggtctgcttctgctgctggtcaaagcagtccagttctacctgcaaaggcaatggctactcaaggctttccagcagttcccatcacctcccttccactggttctttgggcacaaggtatgaaggaaagggaaggatgggtgggaaagcagggaagatgggtgtctcagagactggtnatcgaaatcacaggacaaagcctgatgtataaaaattccaagtacctcatgagatacccagctcaggctgaggcacaccatccaacgatagggttattcaaccagtctggctgttgctcaactctgtactgatagccccacactttgaaagctttagttggtcttacctagtctcctcctcttctggctgagtacctttaatatctctgctgttctcaaacaacttttaagtagttccttacctagtgagttacctaccgctattctctcccaagctcagggcttgccagggaatgnatcagtgagttgaaaatcttgcccctgtgggttcttggtagagcagtagtgcacatcttagaagataccaggcacaggaagggttcacattgctgggatcagtgggtggctgccccagactaggagtattttcaggattggtgaaggtccaaattgaaatcccaaagtcatggcacattaaaggaaaaggctggggagggtcctcagatgacagcactaatgttagaattcccacagggtcatttagctctcccttctccttcccacacaccctgcactgtaagctacttagattgaatttatttccttgtaccacagagttcagctcaagagccaggaacagattataaaattccctagaaagggatagcagcctgtaggctaggaaggctgtaggccactgacccattgcactgtcaccccagggaataatgtacagagccaatgaggctacatagaaaggcgttcaacaaaggattgtgcaatagatgctcttagaaagacctgggtatgcagtgttttgtgtgcagatctgagaatctgaccctgtggctcctctgaggaacacagctccaaccaccaggactctcgaatctccctcaggatcagccctcgtacagcaaagctatgagtaatagcacagataattcatcgaactgcctcaccctcctgacagcttcggaaaaatccaaaactatgttcctgtgtttggtctcctcttgtctccagtccaaaaaataatcaagagtcccactaccttctttttccctcaacagcagtttcaaggtgacaaagaactacagcaaattatgacatgtgtggagaatttcccaagtgcctttcctcgatggttctggggaagcaaagcctacttaattgtctatgaccctgactacatgaaggtgattctcgggcgatcaggtgagcgtgacacgctgttgtgaagacataagcacattcctccttggtacttgccctaggctgtcaaattccagaagagcgtgaccctccacactctaccattcttccagactacaacccagcacagggccaacaatactcagaactgaaaagtcaaatctcttagcctaatgtctttgtctttctttattatttattcaaattaagatggtaagtctagttaattgtttcaggtttgaaatctctaattgttacctgcctgactcatagaataacgaagccaccacaaacacaccaacacacacacacacacacacacacacacacacacacacacacacacacaccacttgttccattctttgactttgatctcatggactgtttctcaccagctcagcatctcagccatggaggagtccagctactagaacacgaatcctaaccttcctaagcctgaatgttaggacagagtttgaagggaatatgagaaattgggcagtgagttcagacagtttgccaacagacagcacttaaaacatcatagaaactcgtgcctttaaccacagttgccttggggctgccttttaatcccttttcttgttaagtcattgtttccctttcagatccaaaggccaatggcgtctacagattgctagctccttggatcggtatgtatgtctaagttgggaatgtggtctacttctaattggattttccgagtgctgtgcctctggttcacagagaataaatgtgacagactgccactatcatggtctacccccaaatctctacttctgacccttcacttctccaaacagtcctatctgaacatcagtgtgatctgcctccttctaactctttccgagttttatctcacagctctcataatcacagcatgtatgccagtgccgctagctgggaaattcacgttctggactgtagcattcttcagaattatctctaacacttcatagttccctgtccccaatttatttagtggtctctctgatttgatcacacatatacacacacctctctcctgcccaggatatggtttgctcttgctgaatggacaaccgtggttccagcaccggcgaatgctaaccccagccttccactatgacattctgaaaccctatgtaaaaaacatggctgactccattcgactgatgctagtgagttcatttaactttattctcctctattcccctcagctgtgctgttctttctacatcagctgcagctttggctactactactgccacagataccatagctgctgtggctgcggctgcttcttcttcttcttcttcttcttcttcttcttcttcttcttcttcttcttcttcttcttcttcttcttcttcatcgtcttcatctccttttttcttcttccttctctgcttatagtctcctctctcctcaatctctctcttcacctactcagtgtatgcatcaacaagctttacatatgtattctactttgaatacaggttcttcacatatagttaaaatagaaatattccaggtactaggatatggccatacttgcttattacccaaggcaaagagcatcagagcatcttctccttcttcaaatcttcaactttagagagacttcccaggatgacacttagttggggtttcccttgggtcttagtgcttctgcatggacttgagtcagagagatggactccagatccacattgtcagagccaaaccttccataccaccacctttcaacaggcctctgggttatgactgttttagttcattggagctagcttatagttcagaggttggtccattgccatcatagtggaaattatggtagaacacagacatatatggtgtgctagggaggtagctaagaattctatatcctgatgcaaaggcagcaggaagagagtgagacactagtgtgccttgagcatctgagttctcaaagccctaccccaatgaccacttcctccaacaagactacccctactctaacaaggccacacctcctaatggacctatgagggccgttttcattcaaaccaccaaccacattcctctccctgacccccataagcttgtagccatatcttaatgcagaaatacaatcagttcaacttcaaaagtcctcatagtctaccacagcactgttcaaaagttcaaagttcaaagtctaagagactcatgcaatctcttaactttaatcctctataaaatcaaaataaaaaaaacagattacatactcctgacatgtacgggatataccttacaatcccaaaatggagaaaaggcagcatggtgaagaaatactgaaccaaagcaagactggaaaaacgttggcaaactccaaactctgcatctcaatgtcttatgtcaaagtgctcttctgatttccaactcctttcagctttgttggctggttccactccctgttagcagctttgctcagcaaacaacccacggcatctccaacactgtaggcttccaaggcaattgtggcttcatcttcaagcttcacacagtaacctctttaagcctctatgcaagaacacccatcacacgtgcctggcttcagcagttttccttagacaaggagggcaatcccataatccattccttctttccttgactctaaaccagaaccatgtggccaaagctgccaagttctcatactcattcaattacatcttcaccagctggttttgatggtttcctttactgcctaagcttggctgtcctaaaactcaatctgtgtaacaggccagccttaaactttaagatccacaaacctctgcctcctgagcacttggatcaaaggtgtgcaccaccaggcctggccctgggcttttctttaattccttttcacttttctttaatttcttttccaaaattggaagtttatctgggtgggatcttggtctgaggtcaccgctccctttattccacttagcatcaagcttttctctaatctgtttatctccttcaacacaggccttagctacagtctacttcctggtgcctcctttctcctcaaagtatgcatttttgtattttttctctttctcagtttgctccttttcactgtagatttgcatgagcgaatactaataaccatacaacaaaatccatactaggcaattgtaagatatcctctgccaatgcagctaatccaactcttcaccttagccttaggcaaaccttttgaacaagggcaaaagcagccacattctttgccaaaatatcataagatatctacgccacatactaaaatttttctcctctgtaacctcttgagccaggaccccacaattcaaattaccctcagccccaccgtccttcaactactacagcccattaagccccacttaaatcattcaaatgcttttataatccaaagttccaaagtccacattactccaaacaaagcatggctaggtctatcgcagcaataccccattgctggtaccaacttctgtcttaattagggtctcattgctgtgaagagacactataaccacacaaccaattataaaggacaacatttcatggaagccagcttacagtttaaaggtttagtccattatcatgatgggaagcatggtagcacaaaggcatacatgatgctagagaggtagctgcgagttctacgtcatatccaaaggcagcaggaagagagtgaaacactgggtcaagcttgagcatctgagacctcaaagcctgccccgcagtaacgactttctccaacaaggtcacacctaatccaacaagtccacacctcctaatagtgctgcttcctagaggcctataggggctattttcattcatccacaataatgagtcaattgttctcagcaagcttttgatgaatacactggggacccccattagaaatgccttcgtggctacttgggtgtttttatactctatatgtagaagtcctaccattatctcaggttgagctgagctctccaatcactgatgtatcatctttttaatctcctaaaaacagaattgcttatcaggtaaaacatgttaactaactgcaaacatgtgaaacttgtttcctttcttatgagtttctatatttaattttgaagtaatttacaagaatataggtgtcctttcacaaagatttgttttgcagtctgtaaaacatctgttatcaaaattgagtaacttagaacatagtatcttacaatatagggaaacaattcagtctattgagcacatattttctagggaaattaagtcaatgttcccctcccactacaggacaaatgggaacagctggcaggtcaagactcctctatagaaatctttcaacatatctccttaatgaccctagacactgtcatgaagtgtgccttcagccacaatggcagtgttcaggtggatgggtgagtgacaacccttgatcttcagggcctttgatcttaccaactaatatggatttatctgtgatgcatgtgggacattttggatactcaataaagagtcttatcccagccccaagtcaatccctgacccaattgaatcctatcccaaccacagaccactgatccctagctgaggtggaatcctagacactcatgccaccttctaccaccttctaccttgaaaattacaagggttatgagacagagttatgtgcctcagtgttgtctcttcttatcatatagaaatctccccagagtccgtactatctgtgggttggagagctctacagtctaatctgttctacttcttcttcttcttcttcttcttcttcttcttcttcttcttcttcttcttcttcttcttcttcttcttcttcttcttcttcttcagaaattacaagagctatatccaggccattgggaacttgaatgacctctttcactcccgtgtgaggaacatctttcatcagaatgataccatctataatttttcttccaatggccacttgttcaaccgtgcttgtcaacttgcccatgatcacacaggttctgtttgtgccttctgtctccctcatttcctaagatcagctcaagggggctattgatgacttctgaggcagatccagacccttcagtgcatccccctataggacctgggtcacatccatgctagttacttttacactgacaatgttagcagttggaatgtcagaatgccaggtgttgaatgtatgtcatcatattggtaatgtgtagtgagacctgacccagcaactcaagcagagcttctattgcccatggtgctaagagagttctgacctgtgtcagatcacactggtcctctaaccctacccaatcctatatagcgcacccgcacatagcttcaggcaaggagacacatggagctacatggggttactgtagctctcaggtctttggaataattgatgttctggaatagatggtgtgatcaagctaaggaaggatcagctgcagaatgcgggagagctggaaaaggtcaagaagaaaagacgtttggattttctggacatcctcttacttgccagagtgagtatgtgcagcagaggcctgagagtctgcctgggaacacacaaggaacaagtatagttctgatgatgcctgttgtttccctcagatggagaatggggacagcttgtctgacaaggacctacgtgctgaggtggacacatttatgttcgagggtcatgacaccacagccagtggagtctcctggatcttctatgctctggccacacaccctgagcaccaacaaagatgcagagaggaagttcagagtgtcctgggggatgggtcctccattacctggtaagagttcaagtagaagtgcccttattctttgggtctccagtctacctgacctccacattggactttatttcagggatcacctggaccagattccctacaccaccatgtgtatcaaggaggccctgaggctttacccacctgttccaggcattgtcagagaactcagcacatctgtcaccttccctgatgggcgctctttacccaagggtatgaatttcccaggcctttcatcctagagagaatggatgctcagtagtctgtgtccttcaacagttctgaatccctctgagtgccgtttccttttcagtaaataaatgcttcttactcataaagtacagtaataagcttaaatgacctcctataaagttaaatgctactttgcatgaatgacattgaaagcattcttcatcagctaacattccttcttcttttgaatctatgatctcatcatgaagcatccattctaatttgggaacaatgatgttttccagactcaattccagatgccagcaccatataactcatagccacacttattcttcagatgtcctcactgtcacatatgttttcatgttggggctggaaacacaggcatatgtttgtacatagaagtgggaggcagaggtcagcattagttgtcattccacaggcactgtccaccatgatttttcagttcaggaggtcttgtactggactgtagctcatctcttaggctaggctggccactgagctaggaacctgcctgtccccacctcaccagcagtgggataacaagcatgtgccaccacacacagtcttttttatatggattgaggtctttctctcaatccccaatcttttatcatgttctacatttgatataatgtgtagacatttttataaaaaactactatttatatatagatcagtaaataaaatgtgacctcagattcttgccaaggcaagtaaccggttactctccataacctgatagtcagaccctattgctgaagacacaacttatgtcatcaaacacagagaaaatgatctggtgcccaactagatttagacctaattattaacccaaatagtgaatagggtctctttttcaagcttatttcactaatagttttacattatacatttatacatatatttatattatacaggcacagaacacacacacaagggtggggagagagagagagacagagacagaggcagagacagagagacagtgacaaagacagagagagagagacagagttttcaaaaataaaaagagcaaatcaggcaaatttaaacagaagaggaagagttttttcttgcagagctccttggaatcttcaatgtgtctatctagatgtctgtgaaggaaataaggaacagagtttcctcacgccctgatgattgacatcttgtctctagcgtacattggaagtggagccccacagttcttttctgctgaccttttgctgtggcttggtatttgtttcctgccaaactcatacagctatgtaatacccagagtcacacgttaatggggttgggagggtgaaagctttgtgaatttatgttaatcatggtggtgctctaaattgtactgaaggcctcctgtttgctaagcatgtgctctaggactgagccacttaccatccccaagatgagatggataaacttggcttgactacgtgctttagagcacctgggagtggatagattacattagggttggtctcacattattctatatagtggctttagaaagagaaggagggagactgctaagatatacacctgtcctcaccatgataggatgcaaccaagggagagagctgtttgaactttcagctccaaatctgagctaaataagcttcatatatacatatatatacatacatacatatatacagacatacatacatacatacatacatacatacatacatacatacatacatacatacatacactgggatgtacagggtagatagagaatcagacaggggctagaggaatgtgtttcttttatgagacaaagcaagtaaaaaagagcaatgaattccatgccgtgagtcatatgtggtccagtctctgagaaggcacttgggttagtgacagagatgaactgatcaccaaatacaagacccctgcaatgtcaggaaagcaccctttgtctcacagctcattatggcaaaactctagtattgccacatcctgctttggtgatatgtaacccctctctgaaattttagtaactcacctgaaaaaaaaaacagaataaatcaactcactctggggacttaatatcttaatatcttaacatctttagtggaaatccttcatcaaatttaagttctaactttatttattcccaaaaccggttcatcttttttgcttctctctctctaattccatttttttatacttctcacttgtgcctcaggtttgtttccaactcatgcacatgtgctgaaagtgatggtctatagcaccctaacctcttgtgcaaacgtatcattccctgctgtctcaggaaccaaggagtcacccctgggtgtaacccatcttctctcacatttctatctgccccacaggtatccaagtcacactctccatttatggtctccaccacaacccgaaggtgtggccaaacccagaggtaggaggttcccccaaggagggcagaggagttggtctcaagatcaataccacctattgtccccacctctaggcacattgtccattgtgagttgcaagcaagggtttgacctctatctatcctgactgaagtgctgtctccctgcaggtgtttgacccttccaggtttgcaccagactctccccgacacagccactcattcctgcccttctcaggaggagcgaggtgagatagcctgtgtatgatgattgatatactgtaaagatctttgcagcattccttggttttatctcatgcatatatggcatcttcgggtatatcctgattgggggtgggggggagaagcttcttgaggatgtgtctgtgcaccaaaggagggtggcatttcatgacacactgtgaagacattaacccattggccaaacaaatttctatgcagtgcatgcacttgcttgtgttctgatgtttccctcactttaagggcaggactttacattgatttttttcacatgactttaacttcaggtgtccagcttgtccaatttgggggctcttaaagggcatgtcttttccacacctctatctgacccatcactattcctgcgtagttctctattctagaatcactgtgcaaggaattaatttgcttgcatgtctgccacattcaactgtccagtgaagtattacatcatttgaggcaaggttcacaccagggtatgctaattccacctttgctctctctctcccaacacaattttcaatccgtgttgatgctcacatctctcttgcaattgcccaatggccaaagcttgacagataatgtatattcctcaagtgaggctatgtagtctaacttcagacaaaaggcattaaaaagaaggagagtaatctgctctgaagtaaacctctattttacatataacagcatttttaaggtttctgggagtgaaatagaagacactcttgaaatagctactgaactggacaaagactttcccatggcttctagggaaatccttccacgggacctaactcactgcaaactttaaaaggtggtgcagaagaaggattttctgagcctatttttcatgaattcatgaagtggcaaatcagttttcacagaacaggctagaagtaagttgttcttccagacacaggctatgtccacacacttggcaaacttcaggattgaatgcactcaccgcaaatcatgccactgccactagaagacaggagagtattgtcttaactcagtagtaactcagcttaactcaccgagccatgctgctggtggtgtttgctaagacagagtctcaggcttgtctggagctcatggtccctctacctctgcctcccaagtgttgggattcagacacagtcccccatggcttgctttggtcagaagctttttcatctttattatatttcgttctattttttttcatcccttaaatccacatgaattacattttaagaaccaaggaaaggtaactattttaactgcaaaataaattttaaacaactcctgtgtgtccggtgctatgctataaaaatatagaaataatgatactatcccattcctgcctctaagagttcaaaactgtggcccacaaagacaaatatatctgtgattaaaatatattcttcccccattctttcactcatccactcagcagtttgcagaatgttccatgttcctggcatcatcccacgccctgagggtggcatggccttgaatatggtatagatggtgccttgaggcctagaaggagcagggtcagtcatcgaagaaataagagccaatcactcattgacctgagcttaggggatatgaaggaaggggtggtcctcaaatacctcaacagcttgatcttaagtaggaagtgggatgggcaggaaagaggtgagggcagcagccagtagagggtataactgcagctagacctttgttgttttgttttgtttaattttatatttttatttattcactttacattctacngccttccttccagtcacccctcccacaattctcccccctttcccctcccctcttcccctcctctgagcagatggaggcctccagagtgccgccaccccccacccccccaacccccccaccctgtgtacttcaagtctctatgagactcggcacttcctctcccactgaggccagacaaggcagcccagttagaagaacacatctcacatacagacaacagaaaagctaaacaagaagaaaagcctaagtaaggaagctcaaatctcacttagaagaggaaataaaagtcataagaggcagatggagggagagaactgggaggaagagaaggagaggagggggtgggggtttaggatcaggtatggggaaggacaggagagatggccggatggccatgaaaattaatggaaatctgcaactgatgggggtgggggaagcatctccaggaggagacagagacctgggataagggaggagcccaaaaatcaatgggggtgaccttagctgtgactcactacactggagatatggaacctgaagaggcaactaggcattgaacacagccctacctggtggaggtatagaggatcagtgtggagggagggccagggagaccaaagaagcccaggaaaggaaactgaagaaggaatagtgtacatttctgaagtagagttggaaagctatagaggccgatggattaaggatgtggggtaccctaagtaggaggcagatggggcagacacttgaagatcctcaacacagtcttcctgtaggtcctcttctactgatacccaattccactctgtgaaagctatatgctagatcttcctgaatgaagtaaacgattaacttattaaatgattcacaagtttgacttctagtccttaaaatactgtcctaacagatttcatacgtctaaaacaagaaaaactaggatcaaggtggcattgaaaaatgttgaggctatgtcaaaaagtcaggagagccaagtaggcatgacccgtcatctcagccattaaactgaacctgtgacagtaggccctgagtgttgttctgggatccttcacgggtcagcccttaaaacaggtaagaagctaatgagttttattttccctttctgacccaggaactgcattgggaaacaatttgctatgagtgagatgaaggtgattgtggccctgaccctgctccgctttgagctactgccagatcccaccaaggtccccatccccttaccacgacttgtgctgaagtccaaaaatgggatctacctgtatctcaagaagctccactaattccggtaaggacaaggacagactctatgaacatgtggcctggcaccttgtcccctgtcatcccttcctgtcaccatcttgctttctgtctgttcatcctcacacctatttgctccctggcctcttggtctcctcctctctctctctctctctctctctctctctctctctctctctctctctctctctcctctagattccccatttgttttttggtctcctgctacccacatctgactgtgcacctgatcctgaacatccttcatcctccatccttctctccttgcctcttcacttcttaccatctttttcccctacaggacttcttcattataccaataatcaacggtcacaaccttgatggtcgggaataacaggacgttattatcttacagttgtggagctccgaaatctgaaatgagtttcactggcagaaagctgagttggtggtgtgactagccttcttcagaagagtgcttcagagagtcctctcctcctctcttcagtacagatcacccttctcagcactggaatattcctctgctttaaagccagcacccttcccataccccctcttctaaaagccttcccttttacaaatgttcttatgacatcatcaagaccactgaaaaactccaagataatttcccatctcaatattccttactccatctaacctactaagtcccttttgaattatgaggaataattcaatttgttccatgggctccaaaactcaaggcctgagcattattgtgaaacctttattcagcctaatatcatcttcacaagactgttacctggtacgttcatctaaatctcccctgcatagtctctctacctgactattcctcacacaagtttctttaccttccctcctttctccaataaagtgtccagtgtcctgcacagcatctgtcttctcatgctggctctgaacacaggttcccattctgtttgaaactgctcctggatcaggatccatgatgagttctctgccttccctgagatgccatgctctgctttctcacacacacacatacactcacacatacacacacaacacatacacacacactcacacacacacatacacacacactcacacacactcacacgtacacacacaacacatacacacacactcacacacacacatacacacacacactcacacacactcacacgtacacacacaacacatacacacacaacacatacacacacacacacacacacatgcacacatcagagttcttggatttattcaaatactcatgaagaactggtattaataatggtgtcttgattagaagacaccagagtcaggaagcttcagctcaagttccttctagattagtgttccgccggttccttcctttaatatttaaattcagtcacagcctcctcctatcagagagggggtacctccacccagtctacactacccgagtgccaaggtgctgaagaaacaaatgttacagtttagactcaggcaccacccagtgacgcatgatggttatgactggagaatcagcgcccacgtcataactgttgaaatcttgctacatctgttcagagaacagtttatctgtgtgctagggcaaaagggcaagttagttgcattaaggcttctagctaacaggcacactataatgggaccttaacatcccagcttcgagtgtacagggagggctttacaggagttagcaagtatcttagggcagagcttccaagctgtggacttcttccaagcagaaaagaattggtagtaggaaaggtatatggcacatttcccaagatgccctagagtggtggttctgaaccttcccaacgctttgaccttttaatacagttcctcatgttggggtgactcccccacccccacccccaaccataaaattaactcattactactttataagtgtaacttcgcaaagaacataatataaaatctgtgctttctggttattgttggtggctcctgtgaaagagtcattcaactaccaaaggggtcatgagccacaggtaaagccactgccctagtcccagggctagaattc

SEQ ID NO: 3020 - DNA, 1712 bp, Rattus norvegicus
  Genbank Accession No. M57728
atggcgacggcagtgtgggcggctgcgcggctacttcggggttctgcggcgctgtgcgcgcggcccaagttcggttctcctgcacacagacggttcagcagtggcgccacctaccccaacatccctctctcttctcccttgcccggagtgcccaagcctatttttgctacagttgatggacaggaaaagtttgaaaccaaagtcaccactctggacaatgggcttcgtgtggcatctcaaaataagtttggacagttctgtaccttaggaattcttattaattcaggatcacgatatgaagcgaaatatcttagtggaattgctcattttctggaaaaattggcattttcgtctaccgctcgatttgacagcaaagatgaaattctgcttaccctggaaaaacatggtggtatctgtgactgccagacctcgagagacaccaccatgtatgctgtgtctgctgacagcaaaggcttggacactgtggtgggcctgctggctgatgtggttctgcacccccgcctgacagatgaggaaattgagatgacgaggatggctgttcagtttgaacttgaggacctgaacatgagacctgacccagagccactgctcaccgagatgattcatgaagctgcttttagggagaacacggtgggcctgcaccggttttgtcctgtggagaatatcgggaagattgaccgagaagtgctgcattcctacctgaagaactactacacccccgaccgcatggtgcttgctggagtgggcgtggagcatgagcacctggtcgaatgtgccagaaagtacctcctgggagtgcagcctgcctggggagctccgggagctgtgtggatgttgacagctcagtggcacagtacacgggggggatcatcaaggtggagagagacatgtcaaatgtcagccttgcgcccaccccgattccagagctcacacatatatggtggggctagagagctgctccttctggaggaggatttcatcccctttgctgtgttgaatatgatgatgggaggcgggggctccttctcggccggagggcctggcaaaggcatgttctccaggctctacctcaacgtgctcaatcggcaccactggatgtataatgcaacctcctaccaccacagctatgaagacacaggcctcctgtgcatccatgccagcgcagaccctcgacaggttcgagaaatggtagaaatcatcacaaaggagtttattttgatgggccgaacggtggatttggtggagctggagcgggccaagacacagctgatgtccatgctcatgatgaacttggagtccaggcctgtgatctttgaggatgtggggaggcaggtgttggctacacattcaagaaagctgccccatgagctgtgcacactcattcgcaatgtgaagccggaagatatcaagagggttgcttccaagatgctccgaggcaagcctgctgtggcggctctgggtgatttgactgacctgcccacgtatgaacacatccaggcagcgctgtccagcagagatgggcgcctgcccagaacataccggctgttccggtagagccctccagcggaggctgcagagtgcttctgtgcatgttactgttggtgtggacactgcataagaatagctagctctgtgaacagtgccaacagggaagctctggaaacttgaatgaaagttactgttgccactgc

SEQ ID NO: 3021 - DNA, 1164 bp, Rattus norvegicus
  Genbank Accession No. M58495
tggaggtcagatgaggatgctggatcccctgtagctgagttacaagtggttgtgggcagccccattaggtgctgggaactaaaaagggtcctctggaaaagcagtcagttactctaacagctcccccttccacttcctgacaaggccctacaagttctgtaggataactttaccatttttgttttgttttgggaaaggttcttaccatgtagccttaactatcctagaaattactacattgaccaggctagtcttcaactcacaagttccgtttgccggctcactcctgactgctgggattaaaggcatgggccaccatgccccacaaacataatttttatttaaggacatttaaaacctttttgtccagttctatattctgatgtaaatttcgtgtaaagttattaagttccacctgtggctacacaaatatttccctatggctgctgtctcccccgccagttttgctctggttcctggagggccacacagatgagttcgggggggggggggtggaggggtggggccacgacaccaaagctgaagagacccaagcgtgtacacccaagggccaccttttgcagtttctaagagcagaatcagaacgctgaaaagaagaaacgaattcactcacactagagacaagtctctcagagatttcagtctagagtcacagtgacttggcaaaatctgagccggtcctttagctgccccacccttccccttgcgtgcaaaggcgatttcccacatctgaccaaggactaacccacacaggcaggtcccacgaagctcgaaaattttctgttggaactttccattttgttcccagaagatcttggacagggagcagttgaatttacccaatatgtaaccatatcctcaaaacctctctcactctcaagctcccagaaacccttttgacttccatatacagaagtcctaggccagccctaaactgcttctccctgccaataacttggtatcctccccccagcgcctctgggctcggcaatccagccccgccctcgctggctgccctgcacagtgggctgggccggaaaagcaagatataaagcctgaaagtgctcagtacagctcgcactagcctaggctgtggcacgcaggatctttcctgaagcatttcagggtctgcctggcaaccag

SEQ ID NO: 3022 - DNA, 4400 bp, Rattus norvegicus
  Genbank Accession No. M59814
gtatagtttcgtgtgaggggtttccagccccaagaatgccagctatgaaactagcagggtcgcccacccacaactccccctccatctttttatggtttggctcgctctccctcaccctctctcacacacgcacgcacacacccacctctcccataaacacacacacacacatgcacacccacatccacgcgcgcccgcaccgccccacgcgcgcacactcccgcccacgcccacgccgcgctccggggagtccggtcccggccagagcgcgaaaggacacggagaagccacccgccgggagcgcagcggcgccctgggacgcggcgcgtctccgctggggctcggcctgggggccgctggccggcgatggccctggattgcctgctgctgttcctcctggcatctgcagtggccgcgatggaagaaacattgatggacacaaggactgccactgcagagttgggatggacggccaaccctgcctctgggtgggaagaagtcagtggctacgatgaaaacctgaacaccatccgtacttaccaagtgtgcaacgtctttgaacccaaccagaacaactggctgcttaccacctttatcaacagacggggcgcccatcgcatctatacagagatgcgcttcactgtgagggactgcagcagccttccaaatgtcccaggctcctgcaaagagaccttcaacttatactactatgagactgactctgtcattgccaccaagaagtcagccttctggtctgaagccccctacctcaaagttgacaccattgctgcagatgagagcttctcccaggtggattttgggggaaggttgatgaaggtcaacacagaagtcaggagctttgggcctcttactaggaatggtttttacctcgctttccaggattatggagcctgtatgtctctactttctgtccgtgtcttcttcaaaaagtgtcccagcattgtgcaaaattttgcagtgttcccagaaaccatgacaggagcagagagcacatctctggtgattgctcggggcacatgcatccctaatgcagaagaagtggatgtgcccataaaactctactgcaatggagatggagagtggatggtgcccattgggcgctgcacctgtaaggctggctatgaacctgagaacagcgtggcctgcaaggcctgtcctgcgggaaccttcaaggccagccaggaagctgaaggctgctcccactgcccctccaacagccgctccccttcagaggcgtctcccatctgcacctgccggactggctattaccgagcagactttgatcccccagaagtggcgtgcactagtgtcccatcaggccctcgaaatgtcatctccattgtgaatgagacatctatcattctagagtggcaccctccaagagagaccggtgggcgagatgatgtgacctacaacatcatctgcaagaagtgcagagcagaccgccggagttgctcccgctgcgatgacaatgtggagtttgtacccagacagctgggcttgactgagtgtcgtgtctctatcagtagcctatgggcccacaccccatacacttttgatatccaggccatcaatggagtctctagcaagagtcccttccccccacagcatgtctctgtcaacatcaccacaaaccaagctgccccctccactgttcctatcatgcaccaggtcagtgccaccatgaggagcatcaccttgtcatggcctcagccggagcagcctaatggcatcatcctggactatgagatccggtactatgagaaggagcacaatgagttcaactcttccatggccaggagccagaccaacacggcacgtatcgatgggctacggcccggcatggtgtatgtggtccaggtacgagctcgaaccgtggctggctatggcaagttcagtggcaagatgtgcttccagactctgacagatgatgattacaagtcggagctgagagagcagctacccctgatcgctggctctgcagcagctggggttgtatttgttgtgtctctggtggctatctccattgtctgcagcaggaaacgagcttacagcaaagaggctgtgtacagtgataaacttcagcattacagcacaggccgaggctccccagggatgaagatctacattgacccgttcacttatgaggaccctaatgaagctgtccgggagtttgccaaggagattgatgtgtcttttgtgaaaattgaagaggtcatcggagcaggggagtttggagaagtgtacaagggccgattgaagctgccaggcaagagggaaatctatgtggccatcaagaccctgaaagctgggtactcagagaaacagcgtcgggattttctgagcgaggcgagcatcatgggccagtttgaccatcccaacatcattcgcctagagggtgttgtcaccaagagccgacctgtcatgatcattacggagttcatggagaatggcgctttagactctttcctccggcaaaatgacggacagttcaccgtgatccagcttgtggggatgctgaggggcatcgctgctggcatgaagtacctatctgagatgaattatgtgcaccgggacctggctgctaggaacattctggtgaacagcaacctggtgtgcaaagtgtctgactttggcctctctcgctacctccaggatgacacctcagaccccacctacaccagctccttgggagggaagatacctgttagatggacagctccagaggccatcgcctaccgcaagtttacgtcagccagcgatgtctggagctacgggattgtcatgtgggaagtaatgtcatttggagagagaccttactgggatatgtccaatcaagatgtcatcaatgccattgagcaggactaccggctgccccctcctatggactgcccagctgccctgcaccagctcatgctggactgttggcagaaggatcgaaatagccggccccgttttgcagagatcgtcaacaccctggacaagatgatccggaacccagctagtctcaagactgtggcaaccatcaccgctgtgccttcccaacccctgcttgaccgctctatcccagacttcacggcctttaccaccgtggatgactggctaagtgccatcaaaatggtccagtacagggacagcttcctcaccgctggcttcacctccctccagctggtcacccagatgacatcagaagacctcctgagaataggggtcaccttggcaggccatcagaagaagattcttagcagcatccactcgatgagggtccagatgaaccagtcaccgtcggtaatggcatgagaactcgatgttcctaggggaggagaggaatgaaaaggaccagggtcaaaggggaaacagaggttgaccacggtggaatgtgccagaaagatcagcttcttggctgagaaacaacttcccacctgtgaagaatgaactggacctgctgcccatgggcaaccgccatttctcggccatggaagtgtgtagaagccgtgggaaaccaaacgcgtaatgattgacgataaagacagagaaaggtgatgctaaacagaagcgaagctgaaaccgtatgcgttgggaaccagggtgaactcagttcccatctgagagggactggagttccccgtctgcaggaagaaaggaaggaggtggagggaagagagggaagccctgggctgtgccatgctctccctcgccaatgacattcttttctttcctccattcgtactcctccctcagagcccctcctccctcccccacatccatttcccttgctcatgactcatgtagggaagtttcttcaaaataaaacccagctcctgagtcaaaacctggtctgagggagagcggttctccatccctcggtcccagagaacagagtgatatttaaaatgccatcgatggtgaggttattggaagaggaaggaccgttagcacacaccatcatggtaaataagtggagcctaagtgtcagcagacatgatgaaagccaagtcaccttgaaggtgacttttctgggaaggtcttaagcatgtaatgtcccttaataggagggaaagggacaatctcagggcagccttgtccaggtagaaatattttgcccccctgtctgttgttggtgaggggtcacaccagccagggagacctctgggaagaagctgccacacacaaggactctggaaggatccacatgtgagcccagccagggtcatacggttcccaacctgaggaaaaggtttttcacacactccttgctttctgctgagataagaaaggtgtcactctgcagagtgtgactttttacaggttaaataaagctgtatatgtctcattgttaaaaaaaaaaaaaaaaaaaaaaaaaaaaaaaaaaaaaaaaa

SEQ ID NO: 3023 - DNA, 1675 bp, Rattus norvegicus
  Genbank Accession No. M60666
cgcgctcggtctcctctggctcctctgcctaagggcccctcgccaccgccaccatggacgccatcaagaagaagatgcagatgctgaagctcgacaaagagaacgccttggatcgagcagagcaggcggaggctgacaagaaggctgcggaagaccggagcaagcagctggaagatgagctggtgtcactgcaaaagaaactcaagggcactgaagatgaactggacaaatactccgaggctctcaaagatgcccaggagaaactggagctggcggagaaaaaggccacagatgctgaagctgacgtagcatctctgaacagacgcatccagctggttgaggaggagttggatcgcgctcaggagcgtctggccacagctctacagaagctggaggaggctgagaaggctgcagatgagagtgagagaggcatgaaagtcattgaaagccgagcccaaaaagatgaagaaaagatggagattcaggagatccagctgaaagaggccaagcacattgctgaagatgctgaccgaaagtatgaagaggtggcccgtaagctggtcatcatcgagagcgatctggagcgtgcggaggagagggctgagctctcggaaggcaaatgtgccgagcttgaagaagagttgaaaacggtgacgaacaacttgaagtcactggaggctcaggctgagaagtactctcagaaagaagacaagtatgaagaggagatcaaggttctctctgacaagctgaaggaggctgagacccgggctgagtttgcagagagatcagtaaccaaattggagaaaagcattgatgacttagaagagaaagtggcacatgccaaagaagaaaaccttagtatgcaccagatgctggaccagactttactggagctaaacaacatgtgaaaccctccttagctgcggccacattctctcgtttccccctgttgttttattttgtctttaaacacatgcttaccatgaaaccccttcaatgctttttttttttatatatatatatacctttaccactgtcactgcaacatctgcagagagccagctagggcagggggtggggaaagacacacagaaagcaggtgtacttgttatttaaatgtgccatttcccaggttgacattgccacacttcacagagtttaggcatgcagtttgcttagccagtgtaggaagcctcacgaaaacaaaaggattaacagcctaagtgccaatggtggggtcatcaggaagactgatgttggagacaatcaggtgcagattggtgctaatttaaacaaaagaacccctggtgtcttttgttcagtctaatacaatttagacttctgtccaacactaatttatttttgtcttgagtagcactgcgagaggatatgggttccatgtgcccgtgttcctcacagccaagggtttgaaagccacgctggtcttgtaagattcccattccttcccagctgacatgcttgtggtcccttccaactcagtggggagagggctcagtgctgttcgccccccccccccccaattctccatgtcagggtaagagatctaggcactacatatgtaattggtaaagaaaaggcattttctcgagagttataactatgtaaacattgtataatgatatgaaataaaatgcacattgtaggacattttcta

SEQ ID NO: 3024 - DNA, 2314 bp, Rattus norvegicus
  Genbank Accession No. M61142
ggaccgcacaggcgtgaggacagaggagggcgtgccgtcccgcgcgcagctgccgccatgaaaccccccgcagcctgtgctggggacgtggtggatacagtgtcaccatgctccaccgtgaatcatctgcgctgggacctgagcgcacagcagatcagagctctaaccacacagctcatcgagcagaccaagtgtgtgtacgaccgtgtgggcgcccaggacttcgaggacgtgtcctatgagagcacactgaaggcactggctgacgtggaggtcacctacacagtgcagaggaacattctcgacttcccccagcacgtgtctccgaacaaggacatccgcgcagccagcacagaggctgacaagaagctctcagagtttgatgtggagatgagcatgaggcaggacgtgtaccagagggtcgtgtggctgcaggagaaaatcccgaaagactcactgaagcctgaggcagctcgctacctggagcggctcatcaagctgggccggagaaacgggctccacttacctcaggacacacaggagaagatcaagaacatcaagaagaggctgagcctgctgtgcatcgacttcaacaagaacctgaatgaggacaccaccttcctgcccttcacgagagaggagctgggcgggctccccgaggacttcctgaactccctggagaagacagaggacggcaaactgaaggtcaccctcaagtatccacactatttcccactgctgaagaagtgccacgtgcccgagacacgacgcctgttggaggaggccttcaactgtcgctgcaaggaggagaactgtgccatcctgaaggagctagtgtccctgcgggcgcagaagtccaacctgctgggattccgcacacacgcagactacgtcctggagatgaacatggccaagaccagtcagacagtagccaccttcctagatgaactggcccggaagctgaagccgctgggtgagcaggagcgtgcggtgatcctggagctgaaggaggcagagtgccaagcgcgggctgccattcgatgggcgcatccacgcatgggacatgcggtactacatgaaccaggtggaggaggaacacgctaccgcgtagaccagaacctgctgaaggagtacttccccatgcaggtggtcacgcgtgggctgctggccatctaccaagagctgctggggctgaccttcacgctggaggaaggtgctgccgcctggcacgaagacgtgcggctgtactctgtgcgtgacgccgcctctggagaggagattggcaagttctacctcgacctgtaccccagggaagggaagtatggccacgcggcctgcttcggcctgcagcctggctgcctacggcaggatggcagccgacagctggccatcgcggccatggtggccaatttcaccaagcccacacctgacgtgccttccctgctgcagcacgatgaggtggagacctacttccacgagttcgggcacgtcatgcaccagctctgctcacaggcagagtttgctatgttcagtgggacccacgtggagcgggactttgtggaggcaccgtcacagatgctggagaactgggtgtgggaaaaggagccactgatgcgcatgtcccagcattaccgcacaggaggcgaggcccctgaggacctcctggagaagctcatcaagtctcgccaggccaatgcaggtctcttcaaccttcggcagattgtccttgccaaggtagatcaggtcctgcacacacagacagatgtagacccagctgaggaatatgcccgctctgccaggagatccttggggtgccagccacaccaggtaccaacatgccagccacttttggccacctcgctggtggctacgacgctcagtactatggctacttgtggagtgaggtgtactccatggacatgttccacacacgcttcaagcaggagggtgtgcttagccccaaggttggcatggattaccggaccagcatcctgaggccggggggctctgaggatgccagtaccatgctgaagcagttcctgggccgtgaccccaagcaagacgccttcctcctgagcaagggtctgcaggtagagggctgcgagccacctgcgtgctgagcggtccccagctcgccctcctgtgccttagcctgccgggcggcaaggtcagcagcccttgggtacggatgagcctggggcagtttccatcctcgtcctccccccagctccaggtccccggcttcaggctgctgtgctctccttgcactatcccctccccaaactgatgttggacattaaatttcacacagggg

SEQ ID NO: 3025 - DNA, 2452 bp, Rattus norvegicus
  Genbank Accession No. M61725
cggaggcgcatcggcactgcctggttctgggggctggggtagggaagagtggggctcactcctacacccaccgatgaagtctgtgagcctcctgatccggtcttgctgagagtgtgggcctatgcccctcccatgtgggaggtgggatagaaagtccctttcctcagcctctctgagtgggtttggtatctcttcgaaagggtgaggtggctttgaccccgggttgcccgccagcgcgaccgaggaggtggctggacagctggagaatgaacggagaagccgactgtcccacagacctggaaatggccgcccccaaaggccaagaccgctggtcccaggaagatatgctaactttgctggaatgcatgaagaacaaccttccatccaatgacagctccaagttcaagaccacagagtcgcatatggactgggaaaaagtcgcatttaaggatttttcaggagatatgtgcaagctcaaatgggtggagatttctaacgaggtaaggaagttccgtactttgacagaattgatccttgatgctcaggaacatgttaaaaacccttacaaaggcaaaaaactcaagaaacacccggattttccaaagaaacctctcaccccctacttccgcttcttcatggagaagcgggccaagtacgcgaaactccaccctgagatgagcaacctggacctgactaagatcctgtctaagaaatacaaggagcttccagagaagaagaagatgaaatatattcaggacttccagagggagaaacaggagttcgagcgaaacctggcccgattcagggaggatcaccctgaccttatccagaatgccaagaagtcggacatccccgagaagcccaaaactccccagcaactgtggtacacccatgagaagaaggtgtatctcaaagtgcggccggatgagattatgcgtgattatatccagaagcaccctgagctaaacatcagcgaggaaggtatcaccaagtctaccctcactaaggccgaacgccagctcaaggacaaatttgatggacgacccaccaagccacctccgaacagctactccctgtactgtgcagagctcatggcaaacatgaaggatgtgcccagcacagagcgcatggtgctatgcagccagcagtggaagctgctctcccagaaggaaaaggatgcttatcacaagaagtgtgaccagaaaaagaaagattatgaagtggagctgctgcgtttccttgagagcttgccagaggaagagcagcagcgggtcctgggagaggagaagatgttgaacatcaataagaagcagaccaccagtccagcctccaagaagccttcacaggaaggtggcaaaggtggttcggagaagcccaagcggcctgtgtctgccatgttcatcttctcagaggagaagagaaggcagcttcaggaggaacgacctgagctctcagaaagtgagctgacccgcctgctggcccgcatgtggaacgacttgtccgagaagaagaaggctaaatataaggcccgggaggccgcgctgaaggcacagtccgagaggaagcctggcggagagcgtgaagataggggcaagttgccagagtcgcccaagagagctgaggagatctggcagcagagtgtcatcggagactatctggcccgctttaagaatgaccgggtgaaagccttgaaagccatggagatgacgtggaacaacatggagaagaaggagaagctcatgtggattaagaaggctgcagaagaccaaaaacgatatgagagagagttaagtgagatgcgggcccctccagctgctacgaactcttccaagaagatgaagttccagggagagcccaagaaaccgcctatgaacggttaccagaagttctcccaggagctgctgtccaatggggaactaaatcacctgccactcaaggagcgcatggtggagatcggcagccgttggcagcgcatctcccagagccagaaggagcactataagaagctggctgaggaacagcagaggcagtacaaggtgcacttggacctctgggtcaagagcctatctccccaggaccgcgcagcatacaaagaatacatctccaataaacgtaagaacatgactaagcttcgaggcccaaaccccaagtctagccggaccaccctgcagtccaagtcggagtcagaggaagacgacgatgaggaagatgatgatgatgatgacgaggaggaagaagaagatgatgagaacggcgactcgtccgaggacggtggggattcttctgagtcgagcagtgaagatgaaagcgaggacggggatgagaatgaggatgatgacgacgacgaggatgacgacgaggatgacgatgaggatgaagacaacgagtctgagggcagtagctccagctcctcatcttcaggggactcctcagactctgactccaactgagg

SEQ ID NO: 3026 - DNA, 3912 bp, Rattus norvegicus
  Genbank Accession No. M62992
cacagcttgggccttagagcagcaactagagagtgtgacaactgtgcctgtgatatctacatttgaaagatttgtacaaaaaagattacaaggttcaatgtcagtggctagggagatagcttagtcaataaagtgcttaccacacaagcatggagttcctagcagccacatgaaaaagctgaacatagtagccaacaccataatcttgatgcaggagaggcggaataggtgggttcctggggctttctggtcagccagcctgtccagcctaataggtgagttacaggtcccagtaaatgactccatctcaaaagatgatgtagataataactaaaaaggacacgagggctacctgctcacacacaagggtataaacaatgaggaaactcaccagcattgcttcttcactgtggaataagccttttggcagtgtagcctcccccatcactttgagaggtccaagtagaagtcatactgctctgaagggtacattctgatatattcccattcaacatggaatatgtgtctatggtactatgtgggctatccaactttgcatcttggtctcattgtcccacaccagtgtggggggaattgccctgggaagatgatgcaatgttccctgtcatcatcatcgccatataagctttgtatatggatgtacctggatgactctgcctggagcgggcgtaagtcaaaactttgagagtctagtgcttttgcatgggatggactgtggctgctcttggcttatggagtgcttggtctcttttccccttgtccctcccaaccactactggtttccacctagagaaaaccccaagtaacatctgattagctgacctgggtctccacttatccctaagcactgggctctcatacccacccttgtgtcctggttccaactcactagagtgccttcttgtgaactgcctcagacttccaccttggtagtgggacgtgcgcctgcccaggagcactcaactcccattggtttactggagttggtcatgttagcaaaggaaagagcaggggtgctgccagctctgcatccagcccactaccctccacaccactgagcttgcctgtcccaaactgccatctgaccatgtcacttcctctgctctagacatcttcccaaggttgcagacgctgacggatttgccccagagtcgaagtaactgccacctggaaattccacagccatgagtgggtttaactttggaggcaccggggctcctgctggcggctttacatttgggaccgcaaagactgcgaccaccacacccgccactggcttttccttctctgcttctggcaccggcaccggagggtttaattttgggactccctcccagccagctgcgaccaccccttccaccagcctcttctcacttgccacacagacctcaaccacacagaccccaggattcaactttggaacaacacctgcttctgggggaacaggcttctccctggggatcagcaccccaaagctcagcctaagtagcacagccgccacaccagccacagccaacactggcagctttgggcttggcagcagtactcttaccaatgccatctcaggtgccagcacctccagccaggggacagcccccactggctttgtctttggctcttctaccacctctgctccgtccaccggcaccacgggattctcattcaccagtggcagtgcatcccagcctggagcctccggcttcaacattggctctgtgggtagtttggcccagcccacagcactgtctggctctcccttcactccagccactctggcgacaactacggcaggagcaacacagccagctgctgctacacccactgctgccaccaccagtgcagggtctacactgtttgcttcaatagctgctgctcctgcctcatccagtactacagtgctttccctctcagctccagcgacaactgcagccactcctactgctgggactttgggcttcagcctcaaggcccctggagcagctcctggtgcctccaccaccagcaccaccactactactaccaccaccactactactgcctccacctcctcctccaccacgaccactggctttgccttaagcctgaaacccctggtgccagctggccccagcagcgtggcagctactgctctgcctgcctccagcacagcagttgggactacgacgggtccagcaatgacctacgcgcagctggaaagcctgatcaacaagtggagtctggagctggaggaccaggagcggcacttcctgcagcaggccacgcaggtcaatgcctgggaccgcacactgattgagaatggggagaagatcaccagcctgcaccgagaggtggaaaaggtgaagctggatcagaagcgtctggaccaggagctggactttatcctgtcacagcagaaggagctggaagaccttctgagcccgttagaggagtcagtgaaggagcaaagtggcaccatctaccttcagcatgctgatgaggagcgtgagaagacctacaagctggctgagaacatcgatgctcagctcaagcgcatggcccaggacctcaaggacattattgagcacctgaacatggctggtggccctgcagacaccagtgacccactgcagcagatctgcaagatcctcaatgcacacatggactcccttcagtgggtggaccagagctctgccctgctgcagaggagggtggaggaggccagccgtgtgtgtgagagccggcgcaaggaacaggaacgcagcctgcgcattgcctttgactagccatacatgagttgggggtgggggtacctcttttgttgtagggctgctggctttggggtggttgtattgttgagaaaaatgctctttggtttggttccctgttatcagaagtggtttgcgaaggcatgatgtcatggatgtaataacctgtgtgctctggagacaggtgtgaaggtcactgaactctaggccagcatttaaagaacaagggcaaactcatcctttagccactccaatacaactgtgacagtgggatggcatgctccagagattggaatggagacatggcttctgtgcttccctgcttctctaactcccatctaacccatgtcctccagagcctgtgctgcacaaagcagagtcaccaagggagactgagcttaacaccggtttgcactggctacccctctcacccctctcttgtgagcttctgtggcagggactgactgctgatagttctttgagaacagagtggctgcggatttgcttctgaatgtcccagtgtcaaaccttagattcatagatagtgttgaaggctggcagttatgtctggtctattttatttctccacactctactgtagcctctatggtccctgatcaaaacattgcttttctaaataaagaaaacattgtgaaatcagacttgctgtgaatgtgtgtgtagtgggtccaagatttggcaggacactgctggtgtgatactcttcctgtgccaccaggttggaagcgctggactgagtgagccacagagtctagtctctaccttctatggggtgggcaggctgcaggtacaagaagaaagtcctgtctaccagtgtgcataagtaataagtcatccattaccctaatagatacaggtgtcattgtgatgtcatcagcagtaggaaataggggaacactagaagggatttcactggaccagcagtagagccactaagttattttcttgggtcttgttgggctttgaagcacaagagaaagctgggggtggggtgagggtatagaggtaagtagctcggcgggtaagagcactggttagctgctgctctttcaaggacccaggtttattcacagcacccacgtggtagcttacaaccaccctataaccagtccaggttatctggtgt

SEQ ID NO: 3027 - DNA, 853 bp, Rattus norvegicus
  Genbank Accession No. M63983
ggcacgagggacttacctcactgcttttcctagcggtacgacctcctccgccagcttcctcctcagaccgcttttcccgcgagccgaccggttctgtcatgtcgaccctcagtcccagcgtcgtgattagtgatgatgaaccaggttatgacctagatttattttgcatacctaatcattatgctgaagatttggaaaaggtgtttattcctcatggactgattatggacaggactgaaagacttgctcgagatgtcatgaaggagatgggaggccatcacattgtggccctctgtgtgctgaaggggggctataagttctttgctgacctgctggattacattaaagcgctgaatagaaatagtgataggtccattcctatgactgtagattttatcagactgaagagctactgtaatgaccagtcaacgggggacataaaagttattggtggagatgatctctcaactttaactggaaagaacgtcttgattgttgaagatataattgacactggtaaaacaatgcagactttgctttccttggtcaagcagtacagccccaaaatggttaaggttgcaagcttgctggtgaaaaggacctctcgaagtgttggatacaggccagactttgttggatttgaaattccagacaagtttgttgttggatatgcccttgactataatgagcacttcagggatttgaatcatgtttgtgtcatcagcgaaagtggaaaagccaagtacaaagcctaaaagacagcggcaagttgaatctacaagagtcctgttgatgtggccagtaaagaactagcagacgttctagtcctgtggccatctacttagtaaagctt

SEQ ID NO: 3028 - DNA, 7286 bp, Rattus norvegicus
  Genbank Accession No. M64780
tgcttatctcctaccatgaacctggagggctggggagaggacctggtgctcccctagccataactggctaaactttgagatcacagctgcatctgctgctccagagcacccagcatggggggagtagctccgaagaggcctaagggcactccataagaactcccacacacacccaggaattgggctcgagctgtatgtatcatgcctcctctgccactggaacacagacccaggcaggagcctggtgcctccatgctggttcgatacttcatgatcccctgcaacatctgcttgatcctgttggccacttccacattgggctttgcggttctgcttttcctcagcaactacaaacctggaatccacttcacaccagcgcctcctacgcctcctgatgtatgcaggggaatgttatgtggctttggtgctgtgtgtgaacctagtgttgaggatccaggccgtgcctcctgtgtgtgcaagaagaatgcttgccctgctacggtggctcctgtgtgtggctcagatgcctccacctatagcaacgagtgtgagctgcagcgcgcgcagtgcaaccagcaacggcgcatccgcctgcttcgccaagggccatgtgggtcccgggacccctgtgccaacgtgacctgcagtttcggtagtacctgtgtaccttcggctgacggacagactgcctcatgtctgtgtcctacaacctgcttcggggcccctgatggcacagtgtgtggcagtgacggtgttgactaccctagtgaatgccagctgcttagtcatgcctgtgccagccaggagcacatcttcaagaagttcaatggtccttgtgatccctgccagggcagcatgtcagacctgaaccacatttgccgtgtgaacccacgtacacggcacccagaaatgcttctgcggcctgagaactgccctgcccagcacacgcctatctgtggagatgatggggtcacctatgaaaacgactgtgtcatgagccgtataggtgcaacccgtggcctgcttctccagaaagtacgctctggtcaatgccaaactcgagaccagtgcccggagacctgccagtttaactccgtatgcctgtcccgccgtggccgtccccactgttcctgcgatcgtgtcacctgtgatgggtcttacaggcctgtgtgtgcccaagatgggcacacatacaacaatgactgttggcgccaacaggctgagtgtcgacaacagcgggccattcctcccaagcaccagggcccgtgtgaccagaccccgtccccatgccatggagtgcaatgtgcatttggggcagtatgcacagtgaagaacgggaaagccgagtgcgagtgccagcgggtgtgctccggcatctacgatcctgtgtgcggcagtgacggtgtcacttacggcagtgtgtgcgagctggaatccatggcctgtacccttgggcgggaaatccaagtggcccgcagaggaccctgtgacccatgtgggcagtgccgttttggatccctgtgcgaggtggaaactggacgctgtgtgtgcccctctgagtgtgtggagtcagcccagcccgtatgcggttctgatggacacacatacgctagtgaatgtgagctgcatgtccacgcctgtacgcaccagatcagcctatacgtggcctcagctggacactgccagacctgtggagaaaaagtttgtacttttggggctgtgtgctcagctggacagtgtgtatgtccccgttgtgagcaccctccacctggccctgtgtgtggcagtgatggtgtcacctacctcagtgcctgtgagctacgcgaagctgcctgtcagcagcaggtacaaattgaggaggcccatgcagggccatgtgagccggctgagtgtggctcagggggctctggttctggggaggacgacgagtgtgaacaggagctatgccggcagcgtggtggtatctgggacgaggactcagaagatgggccatgtgtctgtgactttagctgccagagtgtccctagaagcccagtgtgtggctcggatggagtcacctatggcaccgagtgtgatctgaagaaggccaggtgcgaatcacagcaagaactgtacgttgctgctcagggagcctgccgtggccctaccttggctccactgctacctgtggccttcccacactgtgcccaaaccccctatggctgctgccaggacaatttcactgctgcccagggtgtgggcttggctggctgtcccagcacctgccattgcaacccccatggctcctacagtggcacttgtgacccagccacagggcagtgctcctgccgaccaggtgtaggaggcctcaggtgtgatcgctgtgaacctggcttctggaacttccgtggcatcgtcaccgatggacatagtggttgcactccctgcagctgcgaccctcggggtgccgtaagggatgactgtgaacagatgactggattgtgttcctgtaggcctggtgtggctggtcccaagtgtggacagtgtccagatggtcaagtcctgggccatctaggctgtgaagcagatcccatgacacctgtgacttgtgtggagatacactgcgagttcggggcctcctgcgtagagaaggctggttttgcccaatgtatctgcccaaccctcacatgtccagaggctaactctaccaaggtctgcggatcagacggtgtgacatatggcaatgaatgccagctgaaggccattgcctgccgccagcgtctggacatctccactcagagtcttggtccctgccaggagagtgttactcctggggcttccccaacatctgcatctatgactaccccaaggcatatcctgagcaagacgctgccatttccccacaacagccttcctctgtctcccggcagtactacccatgattggcccaccccattacccatatcacctcacaccacagtcagcatccccagaagcaccgcgtggcctgtgctgaccgtgccccctacagcagcagcctctgacgtaaccagtctcgcaacatcaatcttcagtgaatccggcagcgccaatgggagtggcgacgaggaactgagtggagatgaggaggccagtgggggcgggtctgggggacttgagcccccggtgggcagcattgtggtgacccatgggccacccatcgagagggcttcctgctacaactcacctttgggctgctgctcagatggcaagacaccctcactggactccgaaggctccaactgtcctgctaccaaggcattccagggcgtgctggagcttgagggggtcgagggacaggaactgttctacacacctgagatggctgaccccaagtcagagttgtttggggagaccgcaaggagcattgaaagcacgctggacgacctgttccggaattcagacgtcaagaaggacttctggagtgtccgcctacgggaactggggcctggcaagttggtccgcgccattgtggacgttcactttgaccctaccacagccttccaggcatcagatgtgggtcaggccttgctccgacagatccaggtatctaggccatgggccctggcagtgaggaggcctctgcaggaacatgtgcgattcttagactttgactggtttcccactttctttacgggagctgcaacaggaactacagctgctatggccacagccagagccaccactgtgagccgactgccggcctcttccgtcaccccacgagtctaccccagtcacaccagccggcctgttggcagaactacagcaccaccaaccactcgccggccaccaaccactgccaccaacatggaccggcctcggaccccaggccatcaacagccctcaaagtcctgtgattcccaaccttgcctccatggaggtacctgccaggaccaggattctggcaagggtttcacctgcagctgtactgcaggcaggggtggctctgtctgtgagaaagtacaacccccctccatgccagcttttaagggccactccttcttggccttccccaccctccgagcctaccacacactgcgcctagcactggaattccgggctttggagacagagggactgctactctacaatggcaatgcacgtggcaaagatttcctggctctggctctgttggatgggcgtgtgcagttcaggtttgacacaggctcagggccagcagtgctaacgagcttagtgccagtggaaccaggacggtggcaccgcctcgagttgtcacggcattggcgtcagggcacactttctgtggatggcgagactcctgttgtaggtgaaagtcccagtggcaccgatggcctcaacttggacacgaacctctatgtgggtggtatcccagaagaacaagttgccatggtgcttgatcggacctctgtgggcgttggcctgaaaggatgcattcgtatgctggatatcaacaatcagcagctggagcttagcgactggcagagggctgcggttcaaagctctggtgtgggagaatgtggagaccatccgtgcttacctaacccctgccatggtggggccctatgccaggcactggaggctggcatgttcctctgtcagtgcccgcctggccgctttggcccaacttgtgcagatgaaaagagcccctgccagccgaacccctgccatggggcagccccctgtcgtgtgctttccagcggtggggccaagtgcgagtgccccctgggacgcagtggtaccttctgtcagacagtcctggagactgctggctcccggcccttcctggctgactttaatggcttctcctacctggaactgaaaggcttgcacaccttcgagagagacctaggggagaagatggcgctggagatggtgttcttggctcgtgggcccagtggcttactcctctacaatgggcagaagacagatggcaagggggactttgtatccctggccctgcataaccggcacctagagttctgctatgaccttggcaagggggctgcagtcatcaggagcaaagagcccatagccctgggaacctgggtcagggtattcctggaacgaaatggccgcaagggtgcccttcaagtgggtgatggtccccgtgtgctaggggaatctccgaaatcccgcaaggttccgcacaccatgctcaacctcaaggagcctctctatattgggggagctcctgacttcagcaagctggccaggggggctgcagtgtcctctggcttcagtggtgtcatccagctggtgtctctaagaggccatcaactgctgactcaggagcatgtgttgcgggcagtagatgtctcaccttttgcagaccacccttgtacccaggccttgggcaacccctgccttaatgggggctcgtgtgtcccgagggaagccacttatgaatgcctgtgtcctgggggcttctctgggctgcactgcgaaaaggggctagttgagaagtcagtgggggacctagaaacactggcctttgatgggcggacctacatcgaatacctcaatgctgtgattgagagtgagaaggcactgcagagcaaccactttgaactgagcttacgcactgaggccactcaggggctggtgctgtggattggcaaggctgcagaacgtgcagattacatggccctggccatcgtggacgggcacctgcaactgagctatgacctaggttcccagccagttgtgctgcgctccactgtgaaggtcaacaccaaccgctggcttcgaatcagggctcacagggagcacagggaaggttcccttcaggtgggcaatgaagcccctgtgactggatcttccccattgggtgccacgcaactggacacagatggagccctgtggcttggaggcctgcagaagcttcctgtggggcaggctctacccaaggcctatggcacaggttttgtgggctgtctgcgggacgtggtagtgggccatcgccagttgcatctgctggaggacgctgtcaccaaaccagagctaagaccctgccccactccctgagctgccaccagagctgccaccttccctactgtaattattttctatttttgtaaacttgttgcatttttatatgatttttttgactgcacgttggccagaaggactgctggcctggcctcctttccgtccggcagctgtgctacagagacaaagtggtgctaagggaactcttaagtagaccgtagcacctagagccctgggctttgaaaggcagccttaggacacactcctctgcctaaggtaccgtgcctcagccccttgcactgtatgttcctacctgtccacttgtattggtcctttgggtctcctggcccattgctaggccctgtttgtgtgttattaatgtgttattggatgagaactgtatccctgagcaggagggtgctgttggggttgagggggcccttcattaaaccaagtaacattgggtcctttgtaggttcccacttaagctgctctcctgtgtgtgctaagggccagcctcaccccaagctagcctggacccctagtgctccctgtgacaatactgtgatataaaaaacctgataattggggcatcatcttacttcccaaaatgtgtttgcctgtccctggaggctgtaaacagaagccaggctccatctaggttgtcctggctggtcctcagttggccttccccacctactcagttaccctgaacatggtcatcctttccccaaaacatcaggccacttaggaatccctaagagggagtgcgtcactacgggatgtggttgacctccattgcttacctgcctaagcagccagctacatctgtctctcaaagatgtccagccagactcctaactatattcttcaaccattgattttgtttgatttctgatgtggaagtgcggtcattcctgttctaacgcacagcaaactttaattggtctaacgtgagggcaacccacagttggtccactgtaacgatggtcatccttgtttgagtgacagttactgccgggtgtccagccaagggcaggtactagaatggcagagatgactatagagccaaaaatgactgaaactgaagcaactgtctgctcctccatcccctatctttaatgtccagcacagtcatctcgggagaaaaaccagacaaatctgggatgggggcagtctgaccttcttcctgcttcggtgatcaaggctagagggaactgcatggtatcttgttactaactccagtatgtgtcaatgtcaaataccatgaaataaagtctgaaaaccttaaaaaaaaa

SEQ ID NO: 3029 - DNA, 2386 bp, Rattus norvegicus
  Genbank Accession No. M75148
gggtcggggtgaggatgctgcggggcggctgcggaggcgtcgcttgctgctgaggcggctgggctctgcgcggcctcggcccgtgacagcgcgacgagcgcggcgcttccgatcggacgaatgcatgacaacatgtccacaatggtgtacatgaaggaagagaagctggagaagcttacgcaggatgaaatcatttctaagaccaagcaggtgatccaggggctggaggccctgaagaatgagcacaactccatcctgcagagtctgctggagacgctgaagtgcttgaagaaggacgatgagagcaacctggtggaggagaagtccagcatgatccgcaagtccttggagatgctggagctcggcctgagcgaggcgcaggtgatgatggccctgtctaatcacctgaatgccgtggagtccgagaagcagaagctccgagctcaggttcgacgtctgtgccaggagaaccagtggctgcgggatgaactggccaacacacagcagaagttacagaagagcgagcagtccgtggctcagctggaggaggagaagaagcacctggagttcatgaaccagctgaagaaatacgacgacgacatctctccctcggaagacaaagactctgattcttccaaagagccgttggatgacctcttcccgaatgatgaggatgacccaggacaaggaatccagcagcaacacagcagtgctgcggccgccgcccagcagggcggctacgagatccctgcccggctgcgcacgctccacaacctggtgatccagtatgcctcgcaggggcgttacgaggtggcggtgccactctgcaagcaggccctggaggacctggagaagacttccggccacgaccaccctgatgtggccaccatgctcaacatcctggccctggtgtacagggatcagaacaagtataaagacgcagcaaacctcctgaacgatgccctggctatccgtgagaaaaccctgggccgagatcaccctgcggtggctgcgaccctcaacaacctagcagtgctgtacggtaagcgtggcaagtacaaagaggccgagccgctgtgcaaacgggccctggagatcagggagaaggttctgggaaaggatcaccctgatgttgctaagcaactaaataatctggccttgctgtgccagaaccagggcaagtacgaggaggtggagtattactaccagagggccctggagatctaccagacgaagctcggacccgatgatcccaacgtggccaagacgaagaataacctggcttcctgttatctgaaacaagggaagttcaaacaagcagaaacattgtacaaggagattctcacccgcgcacatgaacgggagtttggatctgtggatgatgaaaacaagcccatatggatgcacgcggaggagagagaggagtgcaaaggaaagcagaaggacgggtcgtcttttggagagtatggcggctggtataaggcctgcaaagtggacagtcccaccgtcacaaccaccttgaaaaacctgggagcactttaccgccgccaggggaagtttgaagctgcggagacactggaggaagctgccctgaggtcacgtaagcagggtcttgacaatgttcacaaacagagagtggctgaagtgctaaatgaccctgagaacgtggagaagcggaggagccgggagagcctcaatgtggacgtggtcaagtacgagagtggccctgacggaggggaggaagtgagtatgagcgtagagtggaatgggatgagaaagatgaagctcgggctggttaaatgacttgctcagcgtccatggcctagccacccggtgcctcccctctgctcctgcatgacgggcagcgcctcctccggcccctccagtgctgtccgctgtctagcagccctaggagcttgtcagccgcacctctgggactggcccctcctttcggtgctgtcgtcctatggggtcttgatttctggatacatgtagctttgccagatatgtacttagaaatatcaaccgtgttaataagcccattaatgtgtaacacacaagtttaacagttaagagagagtagctgttcatcttgaggacaggcgttagtgtcacacaggtttattacagtggcatgatagtgacctgtgcagtcactgagctgtaggagtgaggcatgtgctgcacgtccctgtcgtacttagagacctggcagtgccctgctccgggcctccccaggacacactgacgtagatttgctgtgtagtcttggtgtggaaatttgaattctgcttttctctactaatctgaagtgctccgtgatgtgtgtatgtgtctttctaacttctaataaactcactccagctgaaaaaaaaaaaaaaaaaaa

SEQ ID NO: 3030 - DNA, 1341 bp, Rattus norvegicus
  Genbank Accession No. M76740
ggcaccaccactgttgatttcacgaccactgctgagttcaccaccactcctgatgtcaccaccactcctgatgtgaccaccacccctggtgtcaccaccactgctggtgtcaccaccactcctgatgtcaccaccactgctggtgtcaccaccactcctgacgtcaccaccactgctgatgtcaccaccactcctgatgtgaccaccactgctgatgtcaccaccactgctggtatcaccaccactcctgatgtgaccaccactgctggtgtcaccaccactcctgatgtcaccaccactcctgatgtcaccaccactcctgatgtcaccaccactcctgatgtcaccaccactcctgacgtcaccaccactcctgatacaaccaccactcctgatacaaccaccactcctcaggtcaccaccactgttgatgtcacgaccactgttgatgtcaccaccactgctgaggtcaccaccactactgaggtcaccacctctcctgatgcaaccaccactactgacgtcaccaccactcctgaggcaaccaccactgatggtgtcaccaccactcctgatgtcaccaccacttctgatgtgaccaccactgctgatgtcaccaccactgctagtgtcaccaccactcctgatgtcaccaccactcctgatgtcaccaccactcctgatgtgaccaccactgctggtgtcaccaccactcctgatgccaccaccactcctgatgcaaccaccactcctcaggtcaccaccactgctgatgtcaccaccactgctggtgtcaccaccactgctggtgtcaccaccactccagatgtcaccacgactcctgatgtgaccaccactcctgacgtcaccaccactgctagtgtcaccaccactgctgatgtcaccaccactcctgaagtcaccaccactcctgaggtcaccaccactcctgctgtcaccaccacgcctcgtgtcactaccactcctgctgtcactacgacacgtgtcatcaccaccatgcctgtcatcactactacgcctgtcatgaccaccactccagtgaattgcctgaacggagggtactggtcaggtgcgatgtgcgtctgccccaatggcttctcaggggatcgctgtcagaacagagtccctgtggtcgactgccagaacggaggcacgtgggatgggctcaaatgtcagtgtaccggcctcttctatggcccaaggtgtgaggaagtgatggagagcgtagagataaagccgacggtctctgcatctgtggaagtgagtgtgacagtaaccagtcaagaatatagtaatgagctacaggaccgaaactccaca

SEQ ID NO: 3031 - DNA, 912 bp, Rattus norvegicus
  Genbank Accession No. M80601
ccgctcgccttcctgctgcaagtgtacgcaccgcttccgggtcgggacgacgccttccaccgtagcctctttctcttctgctgtcgagagccgctgtgttgcgccggcctgcgagtttttcgtaatcagctaccaaggaaaaatgcattttactcatatgagcccccttctgaaacgggagcttcggatacagaatgtgtgtgcctccaacttaagtctggagctcatctctgcagggtttgtggttgcttggcccctatgacatgctctaggtgcaaacaggcacattactgcagcaaggaacatcagacattagactggcagctcggccacaagcaggcttgtacacagtcagaccatttagaccatatggttccagaccataacttgctgtttccagaatttgaaattgtaacagaaacagaagacgagattgggcctgaggtggtggaaatggaggattactctgaagttataggaagcatggagggagtacctgaggaagaactagattccatggcaaagcatgaatccaaggaagatcacatattccaaaagtttaaatccaaaatagcccttgaaccagagcagattctcaggtatggaagaggtattaaacccatctggatttctggtgaaaatattcctcaagaaaaagatattccagattgctcatgtggtgttaagagaatatttgaattccaggtcatgcctcagctgttgaaccacctaaaggcagacagactgggtacaagtgtggactggggcatcttggctgtcttcacctgtgctgagagctgcagcctgggcatcgggttcacagaagaatttgtgtggaaacaggatgtgacagagacaccatgaaaggtgttaaattcttaaaaataaatgttccttatgcctcactacctc

SEQ ID NO: 3032 - DNA, 485 bp, Rattus norvegicus
  Genbank Accession No. M81183
gaattcatttctctactgaaaccttaaagtagtatttggtcattcattgtatgtgtcttatatacccacccacacacagacacaaaggaaatctatcaaattaatcctgatgtattcgaagtggttattcaattcatttatggcagagcaatatcagtcctaatgactcgtgaaagtgttactaactgaatcattatcttacatttactgtttagtaagcatattttgaaaaatgtatggctagagtgtcataataaaatggtatatctttctttagtaattacattaaaattaatcatgtttgattaactggttcctctgatgtagtgtgtcatttcttaacatatagagaactgtagagcatttttttatttaatggcagtgtttgcaactcacaggcacagaaacactcagactaatcatttatcatagagatatagaacttacaggttaaagtattcacaatgtatgtaagagagttatga

SEQ ID NO: 3033 - DNA, 197 bp, Rattus norvegicus
  Genbank Accession No. M82855
ctttatttcccacaggaaaacggatgtgtttgggagagagcctggcccgcatggagctgtttctattcctgacaaccattttacagaatttcaaactaaaatctctggttgacccaaaggacatcaatacaaccccaatatgttcttcactttcttcagttcctcccactttccagatgcgcttcatccctctgtaa

SEQ ID NO: 3034 - DNA, 678 bp, Rattus norvegicus
  Genbank Accession No. M83676
atcggctcccgcggcgtgggcaagaccagcctgatggagcgcttcaccgacgacacgttctgcgaggcctgcaagtccaccgtgggtgttgactttaaaatcaagactgtagaactaagagggaagaaaattagattacagatctgggacacagcagggcaggagcgattcaacagcattacctcagcctattacagaagtgccaaggggatcatactcgtgtatgacatcaccaagaaagagacgttcgatgacttgccaaagtggatgaagatgatcgataagtatgcttcagaagacgctgagcttctcctggctggaaataagctggactgtgaaacagacagagaaatctccaggcagcaaggagaaaagtttgcacagcagataaccgggatgcggttgtccgaaccgagtgccaaggacaatttcaacgtggatgagatctttctgaaactcgttgatgatattttgaaaaagatgcctctcgatgttttgagaagcgagttatccaatagcatcctctctctacaaccagagcctgagatcccaccagagctgcctccacccagaccacacgtccgatgctgttgatttgatactttggagatggtgcaagccattgctagaaggggaaagcattcttgctctgcactacaatcacgtgacaacttcctt

SEQ ID NO: 3035 - DNA, 857 bp, Rattus norvegicus
  Genbank Accession No. M83678
accatcggaattgatttcaagatccgaactgtggaaatagaggggaagagaatcaaactgcaagtctgggacacagctggccaagaacgattcaagacaataaccacctcctattaccgtggagccatgggcattatcctagtatatgacatcacagatgagaaatccttcgagaatattcagaactggatgaaaagcatcaaagagaacgcgtctgctgaagtggagcgccttctgctggggaacaaatgtgacatggaagccaagcggaaggtgcagagagagcaggctgagaggttggcccgagagcacagaatccgattttttgagacaagtgccaaatccagtgtgaatgtggatgaggctttcagttccctggcccgtgacatcttgctcaagacaggaggccggagatcgggaaacagcagcaagccctcaagcactgacctgaaagtatctgacaagaagaacagcaacaagtgctccttgggctgagggacatttcttgcctcctattcaccctgaacctggaggctagacctgagggaggtggactgaggtagactgatggaaaacagaggggaggagctgtggtggtgcctggaggggtggatgacaggggaggaaggaaagatgaaatgggcagggaaaggagggcgaggaaccaaggacgtgaaaagtgaagagaaggggtttgagaagagaaaaagaagaaggtctcaggtctcggaccgtccaacattaatgtcagtatgctgatctctccattcctggttcagggttcgggtcccgagaggctggctcggccctactctgagggtctctcactccacagatgtttgttagtattaaaggcc

SEQ ID NO: 3036 - DNA, 949 bp, Rattus norvegicus
  Genbank Accession No. M83740
gaattccggttttatagcaaggacattacattttcaggtacctaaagtcaaaattcaacacactgatataaaacttctatttaaaccaatagggttctgttatgatattgatctgttcacagtaacatttacaaaaagaggcagaggcagggggatctctgccccgcccccgcggtggcctgctgcctgccagccgctctccctcgctgacgccacctgcttcccgcactggacatggctggcaaggcacacaggctgagtgctgaggaacgggaccagctgctgccaaacctgcgggccgtggggtggaatgaactggaaggccgagatgccatcttcaaacagttccattttaaagacttcaacagggcttttggcttcatgacaagagtcgccctgcaggctgaaaagctggaccaccatcccgagtggtttaacgtgtacaacaaggtccatatcaccttgagcacccacgaatgtgccggtctttctgaacgggatataaacctggccagcttcatcgaacaagttgccgtgtctatgacatagatctaccctgcctcctatttccttaggggaaaggagaaggagtgactggaggaggaacccagggagggaaccaaggaggctggcccttgctccctgactcttgcggtgaccaccatctccgtcaggaggggtatgagtccctccctgtgcagaacgatgcccatgttcctggtgccagcctcctcactgggctctgccatgtttataatttgaataagctctcccattttctatagagttcctagcctcagttgtgtcccaggctgcctcttgctccttgtctaccggttctagttaattttccaagtagctgtgataaagcatgacagaaagtccaattcagaccctactaaaacaaaccccaatatattatggaaacagtgcttttatgccggaattc

SEQ ID NO: 3037 - DNA, 1131 bp, Rattus norvegicus
  Genbank Accession No. M91234
gaattctttacttttctcgctgatcatcattaacatggagagtgcctttggtcctatccccacagcagcccagtttcctgcccctatggttaaaatgactccccaggttgggggacaaaaagagcccctaaaatagtttcaaagaatctacaactgtgaagaactttgttttgccagtcaggattaatgttttcttttccatgggctatagcccactgagacagtttggtaaagggctgttactaaagtcctgaaagccccaggtgaactggttacaattcttttgtcagctgcttagtatttagcacccaggttctaaccatctctccatccttttgttattagttgttactagaagcctagtgtcatttggaggctggttctcttgagagcaaagccaccaagctgacactgaagggaggtaggtactccttaagggaaaatctaagcccagagagacagccggtaacagctaggctgcctctctgctcgcctttctgtttcatagacaaagcttgtgcttatatttacagtggcctttttgtccaaaaaaaggcctcctggtttagctgtgtgactaaatgctatttgtcctcttcagtggacctctctcctctagattcccttcttgttttctcaccatcccacgtgagatgcttgttagtaactgttacaggtcttctttaccaccgaggaaagacagaatcctactagaggcctgaaagaatgttccagacatggctagaaggcccctcacttgtgcctgctctcttcagacgctgaaggtagggagtgccaggtctgcccccaggctccaagggtgggtctcctaggggctggaaaagccccaccaatctggctaagatcaaggaaagggtatgaagagaaagttacagaaatttgaagggttaagctaagttgctgagagttagtataagttacagagaaagtaaggttaaacaaagagaaagagaaaagaaggtaaaaaggcagaagctagggaagaaaagagacaaaaagaagaggaagctagagagctaaagagagataaaagacaagagaggaacatatactggccacagtagttagggaacctaagaagacagttacctggcaacagaagagaattcg

SEQ ID NO: 3038 - DNA, 2072 bp, Rattus norvegicus
  Genbank Accession No. M91235
gtctgttgtgtcttgtcctgtgaacgatcgatcaataggctcagatctggggactatctgggcgggccagagaaggagctgacgagctcggacttctcccccgcagccctagaagacgttccaagggtggttggaggagagggagatccggatccgtggcacctccgtccgttttcggagggatccgcacccttgatgactccgtctgaattttttggtttcagtttggtaccgaagctgcgcggctctgcttgttacttgtttgactgttggaattgtttgtcttctttgtgacctgactgtggttttctggacgtgttgtgtctgttagtgtctttttgacttttgtttcgtgtttgaatttggactgacgactgtgtttaaaatcttggaccgacgactgtgtttgaaatcatgaaactgtttgctttgttcgtcgaagagttttacttggtccccttaacgcttagtgagtaagaaacttaattttgtagagaccccgctctagtggcagtgtgttggttgatagccaaagttaatttttaaaacatagtgttttgggggttggggatttagctcagtgatagagctcttgcctagcaagcgcaaggccctgggttcgggccccagcctagtgaaaaaaggaaagaaaaacaaaacaaaaacatatagtgttttattctgtgcttatgctcgcagccagctgtgatgaactgggaaagatttaaattttccttgggagtaaggaatcttaaaggcggagtttcacccggtatggcacttagtcgatagctgcctaaaagatcagaaatgctgttaacaggctataaaaaaaggacaggctgtgttagaaatcgtcaaggaagaatgactaaaaaggctggagagctagtggggctataggaaaacagaacaggaaaggaatttcgctcaagtaggagagcgctcattaagagtcttaagaagcctccttatctgctgtcctatccaaggaggagtagtctccaacatcaaaattacttttctccactgatcatcattaacatggagagtgcctttggtcctatccccacagcagccagttcctgcccctatggttaaaatgcccaggttgggggacaaaaagagccccctaaaatagtttcaaagaatctacaactgtgaagaactttgtttttgccagtcaggattaatgttttcttttccatggcctatagcccactgagacagtttggtaaagggctgttactaaagtcctgaaagccccaggtgaactggttacaattcttttgtcagctgcttagtatctagcacccaggttctaaccatctctccatccttttgttattagttgttactagaagcctagtgtcatttggaggctggttctcttgagagcaaagccaccaagctgacacatggaagggaggtaggtactccttaagggaaaatctaagcccagagagacagccgggtaacagctaggctgcctctctgctcgcctttctgtttcatagacaaagcttgtgcttatatttacagtggcctttttgtccaaaaaaaggcctcctggtttagctgtgtgactaaatgctatttgtcctcttcagtgacctctctcctctagattcccttcttgttttctcagaccatcccacgtgagagtcttgttagtactgttacagatcttctttaccactgaggaaagacagatcctgctagaggccagaaagaatgttccagacatggatggaaggctcctgactgttgacttcaatgcccctgaaggtagggagtgctccaggtctcccccaggctccgagggtgggtctcctaggggctggaaaatcccccgccaatctggatctggctaagataaggaaaggatatgaagagaaagttacagaaacttgaagggtaaagctaagtcactgagagagttattgtaagttgcagagaaaataagttgatgcgtggttcagggtctgtgcagaaaagtggacagcacctaatagctgtagaagaagatgcagagagactgttttttttttttttttttttttttttttttt

SEQ ID NO: 3039 - DNA, 2648 bp, Rattus norvegicus
  Genbank Accession No. M91599
catcaataacgaggaccccaagaccctcagcagctcctcgagtgggcactcctacctgcagcaagcaccttactggacacacccccaacgcatggagaagaaactgcacgcggtacctgccgggaacactgtcaaattccgctgtccagctgcagggaaccccatgcccaccatccactggctcaagaacggacaggccttccacggggagaatcgtatcggaggcattcggctgcgtcaccaacactggagcctcgtgatggagagcgtggtgccctcagaccgtggcacgtacacgtgtcttgtggagaactctctgggtagcattcgctacagctatctgctggatgtgctggagcggtccccgcaccggcccatcctgcaggcgggactcccagccaacaccacggctgtggttggcagcaacgtggagctgctgtgcaaggtgtacagtgacgcccagccgcacatccagtggctgaagcacatcgttatcaacggcagcagtctcggcgctgatggtttcccctacgtacaagtcctgaagacaacagacatcaatagctcagaggtggaggtgctgtatctgaggaacgtgtcggctgaggatgcaggggagtacacctgcctggcgggcaactccatcggcctctcctaccagtcagcgtggctcacagtgctacccgcagaggaagaagacctcgcgtggacaacagcaacatcggaggccagatatacagatattatcctatatgtccatggctcactggctttggttttgctcctgctgctggccggggtgtatcaccgacaagcaatccacggccaccactctcgacagcctgtcactgtacagaagctgtcccggttccctttggcccggcagttctccttggagtcgaggtcctctggcaagtcaagtttgtccctggtgcgaggtgtccggctctcctccagtggcccgcccttgctcacgggccttgtgagtctagacctacctctcgatccactttgggagttcccccgggacaggctggtgctcggaaagcccctgggtgagggctgctttgggcaagtggtttgtgcagaagcccttggcatggattcctcccggccagaccaaaccagcatcgtggctgtgaagatgctgaaagacaatgcctccgacaaggatttggcagacctgatctctgagatggagatgatgaagctaatcggaagacacaagaacatcattaacctgctgggtgtctgcactcaggaagggcccctgtatgtgattgtggaatatgcggccaagggaaaccttcgggaattcctccgtgcccggcgtcccccaggccctgatctcagccctgatgggcctcggagcagcgaaggaccgctctccttcccggccctggtctcctgtgcctaccaggtggcccgaggcatgcagtatctggagtctcggaagtgcatccaccgggacctggctgcccgaaacgtgctggtgaccgaggatgacgtgatgaagatcgctgactttggtctggcccgtggtgtccaccacatcgactactataagaaaaccagcaatggccgcctgccagtcaagtggatggctcctgaggcgttgtttgaccgtgtatacacacaccagagtgacgtgtggtccttcgggatcctgctgtgggaaatcttcaccctcgggggctccccataccccggcatcccagtggaggagctgttctcactgctgcgagaggggcacaggatggagcggcccccaaactgcccctcagagctgtatgggctaatgagggagtgttggcacgcagctccttctcagaggccgacttttaagcagctggtggaagctctggacaaggtcctgctggctgtctctgaagagtaccttgacctccgcctgacctttggaccctattcccccaacaatggggatgccagcagcacgtgctcctccagcgactcggttttcagccacgaccctttgcccctcgagccaagccccttcccatttcctgaggcgcagaccacatgagcctgggaacgatgttgcatgggctcgtaggcccgtggccgtgggactccaacctgtttcatcagcatttgacgttggcactgtcatcaggcctctgactcgaggctactgctggcccagatcctctctctggccctgttttggggaggcccattcttggtcttggggttcacagttgaggccttctgttccaaacttatgttcccagctcagagttcaactcctcgtctcaagatcatggtcgtgcccttggactcatcctcaaaggagcgaagcattaaggccttgacacttagcctccaccccaggggctctccgggcctgactgcaaatctttggtcctaaacatttctagctccccaaacaacctagaggcctcgggacttcactgcacccccgcccccgcagcccacaagcctcgccaccctggtccccaactccccactgcttgttctagcatcttgttgaaggagcctcagctctggtgtccttgagagagggaagcctgtggaaaagacagaagaacaaggcattttataaattattattattttttaaaaaaaaaaaaaaaaatctagaattctgcagaaggatcccgcgccat

SEQ ID NO: 3040 - DNA, 3053 bp, Rattus norvegicus
  Genbank Accession No. M92340
ccgtcctgttggggtacagcccatcttgaataaggagcatcccttgcaagatgtccgcactaaggatctggctaatgcaagctttgcttattttcctcactactgagtctataggtcaacttgtggaaccatgtggttatatctaccctgagtttccagttgtccagcgtggctctaacttcactgccacttgtgtgctaaaggagaagtgtctgcaggtgtactccgtgaatgccacttacatcgtgtggaagacaaaccatgttgccgttcctaaggagcaggtcacagtcatcaacagaacggcatccagtgtcacattcacagacgtggtctttcagaacgtccagctcacctgcaatatcctgtcatttggacagatcgagcagaatgtgtatggaatcaccatactttcaggctatcctccagatatacctacaaatttgagttgcattgtgaatgaggggaagaacatgctgtgtcagttggacccaggaagggagacataccttgaaacaaactacactttgaagtcagagtgggcaacagagaagtttcctgattgtcgaacaaagcatggcacgagctcctgcatgatgggctatacccccatctattttgtcaacatcgaggtctgggtggaggccgagaatgcccttgggaatgtctcctcagagcctatcaattttgaccccgtggataaagtgaaacccagcccacctcataatttgtcagtgaccaactcagaagaattatccagtatattaaaactagcatgggtcaattcaggtttggacagtattttaaggctgaagtcggacatccaatataggaccaaagatgcctcaacttggattcaggtccctcttgaagatacagtgtctccccggacttcgttcactgttcaggatctcaagccttttacagaatatgtgtttaggattcggtccattaaggagaatgggaagggctactggagtgactggagtgaggaggcgagcgggaccacatatgaagacagaccatccaaagcgccaagtttctggtataaggtaaatgcaaaccatccacaggagtataggtctgcacggctcatatggaagacattgcccctttctgaagccaatgggaagatcttggattatgaagtggttcttacacagtccaagtcagtttcgcaaacttacacagttaacggcacagagttgatagtaaacctcaccaataaccgctatgtagcgtctctagcagcaagaaatgtggtcggcaagtcccctgcaaccgtcctcaccatccccggctcccacttcaaagcttctcaccccgtagtggatcttaaagcatttccaaaagataacctgctctgggtagaatggacaccgccatctaaacctgtgaacaaatacatactagagtggtgtgtgttgtcagagaactcaccctgcatcccagactggcagcaagaagatggcactgtgaatcggacccacttaagaggaagcctactggagagcaagtgctatctgatcacagtaaccccagtgtttcccggtgggcctggaagccctgagtccatgaaggcgtacctcaaacaagcagctccttctaaaggaccgactgttcggacaaagaaagtggggaaaaatgaagctgtcttagagtgggaccatcttcctgttgatgtccagaacggattcattagaaactactccatatcttatagaaccagtgttggaaaagaaatggttgtgcgtgtggattcttctcacacagaatacacactgtcctctttgagtagcgatacactgtacatggtccacatggcagcatacacagaagaaggtgggaaggatgggccggaattcacttttacaacactaaagtttgctcaaggagaaatcgaagccatagtcgtgcctgtgtgcttagctttcctcctgacaacgctgctgggagtcttgttctgctttaataaacgagacctaattaaaaaacacatctggccgaatgtcccagatccttcaaagagtcatattgcccagtggtcacctcacacccccccaaggcacaattttaactccaaagatcagatgtactcagatgccaatttcactgacgtaagcgttgtggaaatagaagcaaacaacaaaaagccttgtccagatgacctgaaatccttggacctgttcaagaaggagaaaataagtacagaagggcacagcagtggcattggggggtcctcgtgcatgtcctcttctaggcccagcatctccagcagtgaggagaatgagtctgctcagagcaccgcaagcaccgtgcagtactccaccgtggtgcacagcggctacaggcaccaggtgccgtcagtgcaagtgttctcaaggtctgagtccacccagcccctgctagactccgaggagcggccagaggacctgcagctggtggatagtgtggacagcggtgacgagatcttacccaggcaacagtatttcaaacaaagctgcagtcagcctggagccagtccagatgtttcacacttcggaaggtcaagccaggttccgtcaggcagtgaggaggattttgtcagactgaaacagcagcaggtttcagatcacatttcagagccctatggctccgagcaacggaggctgtttcaggaaggttctgtggcagatgctcttggcacagggactgatggacagatagagagattcgaatctgttggaatggagacagcgatggatgaagacatttccaaaagttacttgccacagactgtaagacaaggtggctacatgccacagtgagggaaccggctcctgcgggacctcagcgggactgcgaagtaaagctaaaatgctcgtgacttcagatcggaaataagcttcagtccctgataaccattgcctttaagaacaaaagtcacaactgggccatctccattccagagtatctggaattctccttccaagcactaccatgaacctgactttatcctctgaatagctggaggacgctgcgctgtttcagaatgtttgcactgctgaaaacta

SEQ ID NO: 3041 - DNA, 507 bp, Rattus norvegicus
  Genbank Accession No. M93297
tttagatttatttgtttactttgagtgttttgcctacctgtatgtatgcaccatgtgggtgctgggagtcaaacgcagagctctgggaaagcagcaagtattccagactgctaagccgtctctcccacccctcataattaattctcaacaggcagttgccaaacaaatagaaagaagctattaaaactcctgtttcttttgtagcgtgctcttcaggatcccaatgttgctgctttcatggtggagcccatccagggtgaagcgggtgttatcgttccagatccaggatacctgacgggagttcgagaactttgcacccggcaccaggttgtcccactcactttgcagtgacgccaggctcgcctgcacttgtttggactctgctgacaggctagatgatggattccaaggcttgaggaacatgctaatgcttgcaccttctgaggaacacgctaatgcttgcaccctctgaggaacatgctaaatgcttgcaccttctgaggaaca

SEQ ID NO: 3042 - DNA, 604 bp, Rattus norvegicus
  Genbank Accession No. M94557
aggcttgcgcgtcaggaaaagcctaaagattaggttataagaaaaaccaaagccatgtttcgaagacctgtgttacaggtatttcgtcagtttgtaagacaggagtctgaagtagccagcagtttggttcttgaacgatctttgaatcgtgttcagttacttgggcgagtaggtcaggaccctgtcatgagacaggtggagggaaaaaacccagtcacgatattttctctagcaacaaatgagatgtggcgatcaggggacaatgaagcataccaaatgggtgacgtcagtcaaaagacaacatggcacagaatatcagtgtttcggccaggcctcagagatgtggcttatcagtatgtgaaaaagggggctcgtatatttgtggaaggcaaagtggactatggtgaatacatggataaaaacaatgtgaggcggcaagcaacaacaatcatagctgataacattatatttctgagtgaccaggcaagagaaaagccattgaacggatgattcatcgttgatcattgtttggtacagtctcctttgcaaatcatgtacagtctatagtttaaagacaaaaattaaaatttttatataaaatgag

SEQ ID NO: 3043 - DNA, 609 bp, Rattus norvegicus
  Genbank Accession No. M96626
gaattcagattgtcattgtccaatttggagggaagcccttcagctgttccccactgtccacagaacagtggctctggtgtctttttgttggtgttggggagctggtctggggacaggtcattgccactatccccaccagccagctcaagtgcctgaaggaagcagggcatgggcctgggaaggatgagatgactgatgaagagttggcggaaggggaagaagaaattgaccatgctgagcgagagctccgcagaggccagatcctctggtttcggggcctcaaccggatccagacacaggtgtgttgggacggaaaaaaaatgttgagaactaccgaagtaggataaggaagtattgccaaacacagatggaggtagtgagtaccttcaagagaagcgggtcatttcagggtgctgtgcgccggcggtcttcggtcctcagccagctccatgacgtaaccaatctttctacccctactcacgtaactctctctgccgccaagcccaccagcgctgctggcagtgagtcttgacttcccttttctctcataaatggcacctgggggaagataaagcctccccgactctgccttctcttttccagtcttgc

SEQ ID NO: 3044 - DNA, 1875 bp, Rattus norvegicus
  Genbank Accession No. M96674
gaattcgcggccgccgccgggccccagatcccagtgcgcgaggagcccagtcctagacccagcaacctgaggagaggtgcacacacccccaaggacccaggcacccaacctctgccagatgtgggggggtggctacccagaggcatgctcctcacccagctccactgtccctacctgctgctgctgctggtggtgctgtcatgtctgccaaaggcaccctctgcccaggtaatggactttttgtttgagaagtggaagctctatagtgaccagtgccaccacaacctaagcctgctgcccccacctactgagctggtctgcaacagaactttcgacaagtactcctgctggcctgacacccctcccaacaccactgccaacatttcctgcccctggtacctaccttggtaccacaaagtgcagcaccgcctagtgttcaagaggtgtgggcctgatgggcagtgggttcgagggccacgggggcagtcatggcgcgacgcctcccaatgtcagatggatgatgacgagatcgaggtccagaagggggtagccaagatgtatagcagctaccaggtgatgtacactgtgggctacagtctgtccctgggggccttgctcctggcgctggtcatcctgctgggcctcaggaagctgcactgcacccggaactacatccacgggaacctgttcgcgtccttcgtgctcaaggctggctctgtgctggtcattgattggctgctcaagacacgctatagccagaagattggagatgacctcagtgtgagcgtctggctcagtgatggggcggtggctggctgcagagtggccacagtgatcatgcagtacggcatcatagccaactactgctggttgctggtggagggtgtgtacctgtacagcctgctgagcatcaccaccttctcggagaagagcttcttctccctctatctgtgcatcggctggggatctcccctgctgtttgtcatcccctgggtggtggtcaagtgtctgtttgagaatgtccagtgctggaccagcaatgacaatatgggattctggtggatcctgcgtatccctgtactcctggccatactgatcaattttttcatctttgtccgcatcattcatcttcttgtggccaagctgcgtgcccatcagatgcactatgctgattacaagttccggctagccaggtccacgctgaccctcattcctctgctgggagtccacgaagtggtctttgcctttgtgactgatgagcatgcccagggcaccctgcgctccaccaagctcttttttgacctgttcttcagctcctttcagggtctgctggtggctgttctctactgtttcctcaacaaggaggtgcaggcagagctactgcggcgttggaggcgatggcaagaaggcaaagctcttcaggaggaaaggatggccagcagccatggcagccacatggccccagcagggacttgtcatggtgatccctgtgagaaacttcagcttatgagtgcaggcagcagcagtgggactggctgtgagccctctgcgaagacctcattggccagtagtctcccaaggctggctgacagccccacctgaatctccactggactccagccaagttggattcagaaagggcctcacaagacaacccagaaacagatgcctggccaaggctgaagaggcaaagcagcaagacagcagcttgtactatccacactcccctaacctgtcctggccgggtacaggccacattgatggagtaggggctggatatgatggagtagccatgctatgaactatgggtgttcccatgagtgttgccatgttccatgcacacagatatgaccttcagtaaagagctcccgtagg

SEQ ID NO: 3045 - DNA, 4595 bp, Rattus norvegicus
  Genbank Accession No. NM_012488
aggaccagatctctggcggggagtagggtgcaaggcagccaggtctccgatcctttccgcagcatggggaagcacaggctccggagcctggccctgctgccactgctgctgcggctgctgctgctgctgctgcccaccgatgcctcagctccacaaaaaccaatctacatggtgatggttccctccctgctccacgcaggaacccccgagaaggcctgcttcctgttcagccatctaaacgagacagtggctgtgagagtgtccttggagtctgtccatgggaaccaaagcctcttcactgaccttgtagttgacaaggacctattccactgtacctccttcaccgtcccacagtcttcatctgatgagctgatgtttttcactgtccaagtaaaaggagcaactcatgagttcaggaggcagagcacggtgctggttaagaagaaagagagcctggtctttgctcagactgacaagcccatctacaaaccaggacagacagtgagatttcgtgttgtctcattggacgaaagtttccatccccttaatgaattgattcctctactgtacattcaggatcccaaaaacaatcgcattgcacaatggcagaatttcaatttagagggtggcctcaaacagctgtccttccccctctcctcagagcccactcagggctcctacaaggtggtgatacgtacagaatcaggcaggaccgtcgagcaccctttctctgtggaggaattcgtgcttcccaagttcgaagtgagagtgacagttccagaaacaatcaccatcctggaggaagagatgaatgtgtccgtgtgtggaatatacacctatgggaagcctgttccaggacgtgtgactgtaaacatttgcagaaagtacagtaatccttctaactgcttcggcgaagagtccgtggctttctgtgagaaactcagccaacagttagacggccgtggctgcttctcacagctagtgaaaaccaagtccttccagctaaagagacaagagtatgagatgcagctcgatgtacatgccaagatccaagaagaaggaacaggtgtggaagaaactggaaaggggctcactaagatcacaagaaccataaccaaactatcatttgtgaacgtggattcacatttcagacaaggaattcctttcgttggacaggtgctcctggtggatgggagaggcacccctattccgtatgaaacgatcttcattggggcggatgaagcaaacctgtacataaatacaaccactgataagcacggcctggcgaggttctccatcaacaccgatgacatcatgggcacgtccctaactgtcagggccaaatacaaggatagcaacgcctgctatggattcagatggttgacagaagagaatgtagaggcttggcacactgcctacgctgttttctcaccaagcagaagcttcctgcacctggaatccctgcctgataaactgcgctgtgaccaaaccctggaggtccaggcacattacattctaaatggcgaggccatgcaggagctgaaggagctcgtcttctactatctgatgatggccaagggaggcatcgtacgggcggggactcacgttctgcccctgaagcagggacaaatgagaggtcacttttccatactcatctcgatggagacagacctggctcccgtggctcgactggtcctctatgccatcctacccaatggagaagtggttggagacactgctaaatatgagattgagaactgcctggctaacaaggtggatttggtcttccgcccgaatagcggtcttccagctacccgtgccctccttagtgtcatggcttctcctcagtccctttgtggcctgcgagctgtggaccaaagcgtgctgctcatgaaacctgagactgagctctccgcatccctgatttatgacctgctaccagtgaaagacctcactggcttccctcagggtgcggatcaacgggaagaagacactaatggctgcgttaagcaaaatgacacttacattaatggaatcctgtactcgccagtgcagaatacaaatgaagaggacatgtacggcttcctaaaggatatgggcttaaaggtatttaccaactcgaacatccgtaaacccaaagtctgcgaacggctcagagacaataaaggaataccagctgcgtaccacctcgtaagccaaagccacatggacgcttttctagagtcttcagagtctcccacagagactaggcgaagctacttccctgagacgtggatctgggacttggtggtggtggactcagcaggagtggctgaagtggaagtgacagtccccgacaccatcactgaatggaaggccggggccttctgcctgtctaatgacactggtctgggcctgtctcctgtggtccaattccaagccttccagcccttcttcgtggagctcacaatgccctactccgtgatccgtggagaagccttcacgctcaaggccactgtgctgaactacctccctacatgcatccgggttgccgtgcagctggaggcctctcccgattttctggctgccccagaggagaaggaacaaaggtctcactgcatctgtatgaaccagcggcacaccgcgtcctgggcagtgatccccaagtcattaggaaatgtgaatttcacagttagtgccgaggcactgaactctaaggagctgtgtgggaatgaggtaccggtggtccctgaacagggcaaaaaagacacgatcatcaagtccctgctggttgaacccgaaggtctagagaacgaagtgacatttaacagtctgctttgtccaatgggtgctgaggtatctgaactgatagccctgaagctgccatcagacgtggtagaggaatctgccagagcctctgtcacagttttgggagatatattgggttctgccatgcagaatacacaggatctcctcaagatgccctatggctgtggagaacagaacatggttctctttgctcctaatatctatgtcctggactatctgaatgaaacacagcagctgacacaggagatcaagaccaaggccattgcctatctcaatacgggctaccaaagacaattaaactacaagcaccgggatggctcctacagcgcctttggggataaacctggcaggaatcatgccaatacctggctcacagcctttgtactgaagagttttgctcaggctcgaaaatatatcttcatcgatgaagtacacatcacccaagccctcttatggctctctcagcagcagaaggacaatggttgtttcaggagctccgggtcactgctcaacaatgccatgaagggaggagtagaagatgaagtcaccttgtctgcctacatcaccatagctctcctggagatgtctcttcctgtcactcatcctgttgtccgcaatgccctcttttgcctggacacagcctggaagtcagcaaggggaggagctggtggcagccatgtctacactaaggcgctgttggcctatgcatttgcccttgctggtaaccaggacacgaagaaggagatcctgaaatcactcgatgaggaggctgtaaaagaagaagattctgtccactggaccagacctcagaaacccagcgtgtcagtgggcctctggtaccaaccccaggctacctcggctgaggtagagatgactgcatatgtgctcctggcttatcttaccactgagccagctccaacccaagaggacctaacggctgccatgctcatcgtgaagtggctcacaaagcagcagaattcccacggtggcttctcttccacccaggacactgtagtggctctccacgctttgtccaaatacgggtccgccactttcacaagagctaagaaagctgcacaggtgaccatccgttcttcgggcacattttctacaaaattccaagtcaacaacaacaaccaattattactccagagagtcacattgccgactgtgcctggggattacaccgtgaaggtgacaggagaaggctgtgtctacctccagacatccttgaaatacagtgttctcccgagagaggaggagttccccttcgctgtggtggtgcagactctgcctgggacatgtgaggatcccaaagctcacaccagcttccagatctcactcaacatcagttacactggaagccgttctgaatccaacatggcaattgctgacgtgaagatggtgtccggcttcatccccttgaaaccaacagtgaaaatgcttgaaagatctgtgcatgtgagccgaacagaagtcagcaataaccatgtcttgatttacctggataaggtgtcaaatcagacggtgaacttgtccttcacggttcagcaagatattccaataagagacctgaagccagccgtagtgaaagtctacgattactatgagaaagatgagtttgcagttgcaaaatacagcgctccctgcagcacagattatggaaatgcctgaggacgcagtgaataagaagtgtttcgccagagccctgacctcaggacttcccaagaaaaacagtgtatttgtatttccagagatttgatcaataaaccatttttttcatatct

SEQ ID NO: 3046 - DNA, 1619 bp, Rattus norvegicus
  Genbank Accession No. NM_012489
actttcaggcctcgtgaggtagagggctggcctgcgcctgcgcctgccatcattttggtttgttaagcaaggcagagcatgagcgagtcggtgggacgcacctccgcgatgcatcggctgcaggtagtgctgggccacctggccggccgacccgagtcgagctccgcgctgcaagccgcgccctgctccgctaccttcccgcaggcttcggcctccgacgtggtggtggtgcacggacggcgcacccccatcggccgcgcgggccgcggcggcttcaaggacaccacccccgacgagcttctgtcggccgtgttgaccgcggttctccaggacgtgaagctaaagcctgagtgtttgggagacatctctgtgggtaacgtacttgagccaggagccggagcagtcatggcgcgcattgcccaatttctgagtggcatcccagagaccgtgcctctgtcagcagtcaacagacagtgttcatcgggactgcaggcagtggccaacattgctggtggcatcagaaatgggtcttacgacattggcatggcctgtggggtggagtccatgtccctgtctaacagagggaaccctgggaatatttcctcccgcctgctggagagtgacaaagccagagactgcctgattcctatggggataacctcggagaatgtggctgagcggtttggcatctcacggcagaagcaagatgccttcgcgctggcctctcagcagaaggcagcaagtgcccagagcaaaggctgcttccgtgctgagatcgtacctgtgacaaccactgtcctcgatgacaagggtgacaggaaaaccatcaccgtgtctcaggatgagggtgtccgccccagcaccaccatggagggcctggccaagctgaagcctgccttcaaggatggaggctctaccacggctggaaactccagtcaggtgagtgatggagcagccgccgtcctgctggcccggaggtccaaggctgaagaactgggcctccccatccttggcgtcctgaggtcctatgcagtggtcggggtccctcctgacatcatgggcatcggacctgcctatgccatccctgcggccttgcagaaagcagggctgactgtgaatgacatagacatctttgagatcaatgaggcctttgcaagtcaggccctctactgtgtggagaagctgggaattcctgcagagaaggtgaaccccctggggggtgcaatagccctgggccaccccctgggctgcaccggagcaaggcaggtggtcacgctgctcaatgagctgaagcgccgaggcacacgggcttatggcgtggtgtccatgtgcattgggactgggatgggagccgctgctgtctttgaataccctgggaactgaggccctgactgcaggcactacccagagagtcctatagtagtgtctggagagggatggtacaggagccatcttcgtgggacactcagcagtggagggatttgtcacagcacttcaattcagaagatgtagtcgatgttggaacaggaggtggaactgccctgtcaagtaccccaagccatgctaaagtgagcatgggacacccaggttgcaaagccatctgtacctctgacggatgc

SEQ ID NO: 3047 - DNA, 1092 bp, Rattus norvegicus
  Genbank Accession No. NM_012494
atgaaggacaacttcagttttgctgccaccagcagaaacatcaccagcagtcttccttttgataatctcaacgcaactggcaccaatgagtccgcatttaactgctcacacaaaccggcagataagcatttggaagcaattcctgttctctactacatgatttttgtgattggttttgctgttaacattgttgtggtctcactgttttgttgtcaaaagggccctaaaaaggtgtccagcatttacatcttcaatctggctgtggctgacttactccttttggcaacccttcctctctgggcaacctattactcttatagatatgactggctctttggacctgtgatgtgcaaagtgtttggttcttttctgaccctgaacatgtttgcaagcattttttttattacgtgcatgagtgttgataggtaccaatcggttatctacccttttctgtctcagagaaggaatccctggcaagcatcttatgtagttccccttgtttggtgtatggcttgtctgtcctcattgccaacattttatttccgagatgtcagaaccattgaatacttaggtgtgaatgcttgtattatggctttcccacctgagaaatatgctcagtggtctgctgggattgccttaatgaaaaatattcttggctttatcattcctttaatattcatagcaacgtgttactttggaatcagaaaacatctgctgaagaccaatagctatgggaagaacagaattacccgtgaccaagtcttgaagatggcagctgctgttgtgttggcattcatcatttgctggcttcccttccatgttctgaccttcttggatgctctgacctggatgggtatcattaatagctgtgaagttatagcagtcattgacctggcacttccttttgccatcctcctgggattcaccaacagctgtgttaatcccttcctgtattgtttcgttggaaaccgcttccaacagaagctccgtagtgtgtttagagttcccattacttggctccaaggcaagagagagactatgtcttgccgaaaaagcagttctcttagagaaatggacacctttgtgtcttaa

SEQ ID NO: 3048 - DNA, 1442 bp, Rattus norvegicus
  Genbank Accession No. NM_012495
gtcccccccaccccagctgaataggctgcgttctcttggaacgcgccgcagaacgaggttctgtgaccctagccgcgttccctccttagttcctttcgcctacccacccgcgtacccgacagacccaccccgtcctgtgccaggaaagcgctgccaccggcaccatgccccacccatacccagcactgaccccggagcagaagaaggagctggctgacatcgctcaccgaattgtagctccgggcaagggcatcctggctgcagacgagtccactggaagcattgccaagcgcctgcagtccattggcaccgagaacaccgaggagaacaggcgcttctaccgccaactgctgctgactgccgatgaccgtgtgaatccctgcattggaggggtgatccttttccacgagacactgtaccagaaggcagatgatggccgtcccttcccccaagttatcaagtccaagggtggtgttgtgggcattaaggtagataagggtgtagtgcccctggctggaaccaatggcgagaccactactcaagggctggacgggctgtctgagcgctgtgcccagtataagaaggatggagccgactttgccaagtggcgctgtgtgctaaagattggggagcatactccctcgtccctcgccatcatggaaaatgccaatgttctggcccgttacgctagcatctgccagcagaatggcattgtacccattgtggagcctgaaattctccctgatggggaccatgacttgaagcgctgccagtatgtaactgagaaggtactggcagctgtctacaaggctctgagtgaccaccatgtctatctggaaggcacactgctgaagcccaacatggtcacccctggccatgcttgcacccagaaattttccaatgaggaaattgccatggcaaccgtcacagcacttcgtcgaacagtgccccctgccgtccctggggtcactttcctgtctggagggcagagtgaggaagaggcatccatcaacctcaatgctatcaacaagtgtcccctgctgaagccatgggccttgactttctcctatggccgagccctgcaggcctctgctctaaaggcttggggtgggaagaaggagaacctgaaggcagcccaggaggagtacatcaagcgagccctggccaacagcctcgcttgtcaaggaaagtacactccaagtggccagtctggagccgcagccagtgaatctctcttcatctctaaccatgcctactaaccagagctgatctaaggctgctccatcgacactccaggcccctgcctacccacttgctattgaagaggggccttcaggctctttcccatcactcttgctgccctcgtgtgtgcagtgttgtctgtgaatgctaaatctgccatcccttccagcccactgccaataaacagctatttaaggggg

SEQ ID NO: 3049 - DNA, 1581 bp, Rattus norvegicus
  Genbank Accession No. NM_012497
atttactccagcttggactgagctactgtctgttgctaaccagaccaaagtgagctgtgcctgtggctccggccgctgactgactgagtatagacaactgtcaccatgccccactcatacccagccctttctgctgagcagaagaaggagttgtcggatattgctctgaggattgtggccccaggcaagggcattctggctgcagatgagtccgtgggcagcatggccaaaaggctgagccaaattggggtagagaacactgaggagaatcgccgactgtaccgccaggtcctgttcagtgctgatgaccgtgtgaaaaagtgcattgggggggtcatcttcttccacgagacactctaccagaaagatgacaatggtgtcccctttgtccgcaccatccaggagaagggcattctcgtaggcatcaaggttgacaagggtgtagtgcctctagctgggactgatggagaaaccaccactcaagggctggatggactcttggaacgctgtgctcagtataagaaggacggtgctgattttgccaaatggcgctgtgtgctgaaaatcagtgatcgcacaccctcggcactggccatactggagaatgccaatgtgctggcccgctatgccagcatctgccagcagaatggtatcgtgcccatcgtggagcctgagatcctgcctgatggagaccatgacctcaaacgttgccagtttgttacagagaaggtcctggctgctgtgtacaaggccttgagtgatcatcacgtatacctggaagggactctcctcaagcccaacatggtgacccctggccatgcctgtcccatcaaatatagcccagaagagatcgccatggcaactgtcactgccctgcgtcgaactgtgcccccagctgtcccaggggtgactttcctgtctgggggtcagagtgaagaggaggcatcactcaacctcaatgccatcaaccgatgctcacttccccggccctgggccctcaccttctcctacggacgtgccctgcaggcatctgcactcagtgcctggagaggacaaagggataatgctggggctgctactgaggagtttatcaagcgggccgagatgaacgggcttgcagcccagggcaaatatgaaggcagtggagatggtggagcagcagcacagtccctctacgtggccaaccatgcctactgaggcacgcttacacgacctgtagcccttggcctagcaatgcacatcccattttgcctatagtcacagccagggccaaatagccgtgctgaacagagatatcttcatccagcaccaagtcatctcgcatcccacaatgcctcacattgctgcactggagaccacaggatgggagggtagagaggcccgtccatgtctgaggatggagaaactatttagaagtcagaacagaacctttcccctgtctccaccagtccttacagtgtcccttgatggtgtagtttgtccttgggctctgcttgctgaccttctctcttgggatcgggatgtgaaccctggcccagactcacgctctgagtacatagtgaataaacgggagcaaaacac

SEQ ID NO: 3050 - DNA, 2381 bp, Rattus norvegicus
  Genbank Accession No. NM_012500
cgactatggagcgtcaggtgctgctgagtgagccccaggaggcggcagcgctgtaccggggccttagccgccagccttcgctgagcgccgcctgcctgggtccggaggtcaccacgcagtatgggggcctctatcggaccgtgcacactgagtggactcagagggacttggagcgaatggagaacatccgattctgccgccagtacctagtgtttcatgacggagactcggtggtgtttgccgggcctgcaggcaacagtgtggaaacccggggggagctgctgagcagagagtctccttcaggcaccatgaaagctgtgcttcgcaaggccggaggcacagtctcaggagaggaaaaacagttcttggaggtctgggagaagaaccggaagctcaagagtttcaacctgtcagcgctggagaagcatgggcctgtctatgaggatgactgctttggctgcctttcctggtcacactcagagacacacttgttgtatgtggcggagaagaagcgtcccaaggctgagtccttctttcagaccaaagccttggacatcagtgccagcgatgatgagatggccaggccgaagaagccagaccaggccatcaagggggaccagtttgtattttatgaagactggggagaaacgatggtttccaaaagcatccctgtgctctgcgtgctagatatcgacagtggcaacatctctgtgcttgagggagtccctgaaaatgtgtcacctggtcaggctttttgggcccctggagacacgggggtggtgtttgtgggctggtggcatgaacccttcaggctcggcatccgctattgcaccaatcgcagatcagctctgtactatgtggacctgagcggagggaagtgtgaactactctcggatggttccctggccatctgttctcctcggctcagcccagaccagtgtcgcatcgtctacctacagtatccatgtctagcccctcatcaccaatgcagccagctctgcctgtacgactggtacaccaaggtcacctcagtggtggtggacattgtaccccggcagctgggagagagcttctctggaatctactgcagtcttcttcctttgggatgctggtcagctgacagccagagagtagtctttgactctgcccagcgcagtcggcaggacctgtttgctgtggacacccagacgggcagcatcacctccctgacagctgcggggtcagcaggaagctggaagctgcttacaattgacaaagaccttatggttgcccagttctccacacccagtttgcccccaagcctgaaagttgggttcctgcctcctcctgggaaggagcagtctgtgtcatgggtgtccctggaggaggctgaacctattcctggcatccactggggcgtccgtgtgctacacccacctccagaccaagagaatgtacaatatgctgaccttgactttgaagcaatccttttgcagcccagcaatcctccagataagacccaggtccccatggtagtcatgccccatgggggaccccattcgtccttcgtcactgcctggatgctgttcccagccatgctctgcaagatgggctttgcagtacttctggtgaactatcgtggctccactggctttggccaagacagcatcctttctctcccaggcaatgtgggccaccaggatgtgaaggatgtccagtttgcagtggagcaggtactccaggaggaacactttgatgcaagacgcgtggcccttatgggtggttcccatggtgggttcctctcctgccacctgattggtcaatacccggagacctacagtgcttgtatagcccggaacccagtgatcaacattgcctccatgatgggctccactgacatccctgattggtgtatggtggagactggcttcccttatagcaacagctgcctcccagatctgaatgtgtgggaggagatgctggataagtcacccatcaaatacatccctcaggtaaagacaccagtgttactgatgctgggccaggaggaccgacgggtacccttcaagcagggtatggagtattaccgtgccctcaaggcccggaatgtgcctgtccggctcctgctgtaccccaagagcaaccacgcgctgtcagaggtggaggcggagtcagacagcttcatgaacgctgtgctttggctgcacacacacttgggcagctgaagccctatgttcttcttgagctgggcagcccgtcttgcactttgctcttggtaagctccaggatctgaccgaacagccaaacagtctcctaggctgtggactcagtgaatgggcagaggactaagaactatgttatcataataaaggaagacacagaaaaaaaaaaaaaaaaaaaaa

SEQ ID NO: 3051 - DNA, 306 bp, Rattus norvegicus
  Genbank Accession No. NM_012501
atgcagccccgaatgctcctcatcgtggccctcgtggctctcctggcctctgcccgagctgatgagggagagggatccttgctgctgggctctatgcagggctacatggaacaagcctccaagacggtccaggatgcactaagcagcatgcaggagtctgatatagctgtggtggccagcaggggctggatggacaatcgcttcaaatccctgaaaggctactggagcaagttcactgataagttcactggcctctgggagtctggccctgaggaccaactaacaacaccaactcttgagccgtga

SEQ ID NO: 3052 - DNA, 855 bp, Rattus norvegicus
  Genbank Accession No. NM_012503
atgacaaaggattatcaagatttccagcacttggacaatgagaacgaccaccatcaactccagagagggccacctcccgctccaaggctcttgcagcgactctgctctggattccgtctcttcctgctttccctgggcctcagcatcctgctgctggtggttgtctgtgtgatcacatcccaaaattcccaactccgggaagatctgcgggttctaaggcagaatttcagcaactttaccgtgagcactgaggaccaggtcaaggccctgaccacccagggagagagagtgggaagaaagatgaagttagtcgagtcacagctggaaaaacatcaggaggatctgagggaagaccactctagattgctactgcatgtaaagcagttagtgtctgacgtgcgaagcttgagctgccagatggccgcacttcggggcaatggctctgaaaggatctgctgccccatcaactgggtggagtatgaaggcagctgctactggttctccagctctgtgaagccttggacggaagctgacaagtactgccagctggagaacgcccacctggtggtggtgacttcctgggaggagcagagattcgtccagcaacacatgggccccttaaatacttggattggcctaactgaccagaacggaccctggaaatgggtggatgggacagactatgagacaggcttcaagaactggagaccagggcagccagatgactggtacggacatgggcttggagggggtgaagactgtgcccacttcaccaccgatggccactggaatgatgacgtctgcaggaggccctaccgctgggtctgtgagacagagttgggcaaggccaattag

SEQ ID NO: 3053 - DNA, 3636 bp, Rattus norvegicus
  Genbank Accession No. NM_012504
ggagcctcggcgggaggaggcggacacgtggcagcggcggcggcagcggcagcagcagcggcggcagcagcggcggcctcggtccggggcgccggccgtcctccctctttcctccggcggcagccctagttcccgcctctcggctcccccggctccactctcccagccgggagctgctctctcctctttctagtctccagccacaggacccggcgcggggcccgcagcgccgccaccatggggaagggggttggacgagacaagtatgagcccgcagctgtatcagaacatggggacaagaagagcaagaaggcgaagaaggaaagggacatggacgaactcaagaaggaagtgtctatggacgaccataaactcagcctggatgaactccatcgtaaatacggaacagatttgagccgaggcctaacacccgcaagggccgctgagatcctggctcgggatggccccaacgccctcacgccccctcccactactcccgagtgggtcaaattctgtcggcagctgttcggtggcttctccatgttactgtggattggagccattctttgtttcttggcttatggcatccgaagtgctacagaagaggaaccaccaaatgatgatctgtacctcggggtcgtgctgtctgctgtcgtcatcataactggctgtttctcctattatcaagaagcaaaaagctccaagatcatggaatccttcaagaacatggtccctcagcaagccctcgtgattcgaaatggagagaagatgagcatcaacgcagaggatgtcgtcgttggtgatctggtggaggtgaagggcggagaccgaatccctgctgatctcagaatcatatctgcaaatggctgcaaggtggataactcctcactcactggtgaatcagaaccccagactcggtccccggatttcacaaacgagaaccccttggagacaaggaacattgccttcttctcaaccaactgtgttgaaggaactgcacgtggcatcgttgtgtacactggggatcgcaccgtgatgggcaggatcgccacccttgcttctgggctggaaggcggccagacccccattgctgaagaaatcgagcacttcatccacctcatcacgggtgtggccgtgttcctgggggtgtctttcttcattctctctctgatccttgagtacacctggctcgaggctgtcatcttcctcattggtatcatcgtagccaacgtgccggaaggtttgctggccaccgtcacggtatgtctgacgctcactgccaagcgcatggcgaggaagaactgcctggtgaagaacctggaagctgtggagaccttggggtccacatccaccatctgctccgacaagactggaactctgactcagaaccggatgacagtggctcacatgtggtttgacaatcaaatccatgaagctgacaccacagagaatcagagtggggtctcctttgacaagacgtcagccacctggttcgctctgtccagaattgctggtctctgtaacagggcagtgtttcaggctaaccaagaaaacctgcctatccttaagcgtgcagtagcgggagatgcttccgagtcggcgctcttaaagtgcatcgaggtctgctgtggctccgtgatggagatgagggagaagtacaccaagatagtggagattcctttcaactccaccaacaagtaccagctctccattcacaagaacccaaacgcatcggagcctaagcacctgctagtgatgaagggcgccccagaaaggatcctggaccgatgcagttctatcctcctccacggcaaggagcagcccctggacgaagagctgaaggacgcctttcagaatgcctacctagagctggggggccttggagagcgtgtgctaggtttctgccacctccttctgcctgacgaacagtttcccgaaggcttccagtttgacactgatgaagtcaatttccccgtggataacctctgcttcgtgggtcttatctccatgattgaccctcctcgagctgctgtccccgatgctgtgggcaaatgccgcagcgctgggattaaggtcatcatggtcacaggagaccatccaatcacagccaaagccattgctaagggggtgggcattatctcagaaggtaacgagaccgtggaagacattgctgcccgcctcaacattccagtgaaccaggtgaaccccagagatgccaaggcctgtgtagtacatggcagtgacttgaaggacatgacctctgaggagctggatgacattttgcggtaccacacggagattgtctttgctaggacctctcctcaacagaagctcatcattgtggagggctgccagcggcagggtgccatcgtggctgtcacaggggatggtgtcaatgactctccagctttgaaaaaggcagatattggggttgccatggggattgttggctcggatgtgtccaagcaagctgctgacatgattcttctggatgacaactttgcctccatcgtgactggagtagaagaaggtcgtctgatatttgataacttgaagaaatccattgcttacaccctaacaagtaacattccggaaatcacccccttcttgatatttattattgcaaacattccactgcccctgggcaccgtgaccatcctctgcattgacttgggcactgacatggttcccgccatctctctggcctatgaacaggctgaaagtgacatcatgaagaggcagcccagaaatcccaaaacggacaaacttgtgaacgagcgtctgatcagcatggcctatggacagatcggtatgatccaggccctgggaggcttcttcacttattttgtgattctggctgagaacggtttcctgccctttcacctgttgggcatccgagagacctgggatgaccgctggatcaatgatgtggaggacagctacgggcagcagtggacctacgagcagaggaagattgtggagttcacctgccacacggccttctttgtcagtatcgtggtagtgcagtgggctgacttggtcatctgcaagaccagaaggaattctgtcttccagcagggaatgaagaacaagatcttaatatttggcctctttgaagagacagctcttgctgctttcctgtcctactgccctgggatgggtgcagcccttaggatgtatcccctcaaacctacttggtggttctgtgccttcccctactcccttctcatcttcgtgtatgacgaggtgcggaagctcatcatcaggcgacgccctggcggctgggtggagaaggaaacctactactagcccactgccctgcacgccgtggaacattgtgccacacactgcacctacccctaccccccctttgtgtacttcaagtcttggagctcggaactctaccctggtaggaaagcaccaaagcatgtggggatccagacgtcctggaatgaagcatgtagctgtaatggggggcggggggagggctgcccgaaaaacaccgtggacggggacgacagcggggaaggtttatatgtgcctttttgtttttgtaaaaaaggaaaacctggaaagactgaaagattacgttttatatctggatttttacaaataaagatggctattataacggaa

SEQ ID NO: 3054 - DNA, 1764 bp, Rattus norvegicus
  Genbank Accession No. NM_012507
gccttaatcggccacctgccgcgttccactgcctctttacatctcggatttcggggcggctccctcccccatctttccctgcttctttgcaccccgctttttctgcgtttgcctcgaattttggagccgtctggttttgcacccctttttgttttgcttttaggcggtgtgtggggtgaaggtgccttggactcccttcctctggttatctttccctgttttgacagcccccctttctatcgcagtcgggggacctagcctcggtgcacctccgccgcactgccagcagaccacagcgcgtggctgtgcaccccggaatttgcaacagctgcatatctgtgatcggagtctccctcgcctcgctcccgcgctcattcggtgcgtggagggcttcagcgcgcaacgccccggcttctccgcagcccccagcagcgcgccgggactcgccccgtgcctccaagatggtcatccaaaaagagaagaaaagctgcgggcaggtggttgaggagtggaaggagttcgtgtggaatcctcggacgcaccagttcatggggcgcaccgggaccagctgggccttcatcctcctcttctacctcgtcttctatggtttcctcacggccatgttcaccctcaccatgtgggtaatgctgcagaccgtctctgaccatacccccaagtaccaggatcgactggccacaccaggcttgatgattcgacccaagactgagaaccttgatgtcattgtcaacattagcgacactgaaagctgggatcagcatgttcagaagctcaacaagttcttggagccttacaacgactccatccaagctcaaaagaatgatgtctgccgtcctgggcgatattatgagcaacccgataatggggttctgaactatccaaaacgtgcctgccagttcaaccggacccagctgggcaattgctctggcattggggaccctactcactatggttacagcaccgggcagccctgtgtcttcatcaaaatgaaccgggtcatcaacttctatgcaggggcaaaccagagcatgaacgttacctgtgttgggaagaaagatgaagatgctgagaatcttggacacttcatcatgttccctgccaatggcaacatcgacctgatgtattttccctactatggcaaaaagttccatgtaaactatacacagcccttggtggctgtgaagttcctgaatgtgacccccaatgtggaggtgaatgtagaatgccgaattaacgctgccaatattgccacggatgacgagcgggacaagtttgctgcccgcgtggccttcaagcttcgaatcaacaaagcctgaggctccccaccccctctcacccataccctcctgtggatgcttctggaatgtccttgaccctgcctgatccctccctcacccgccccaaaggtattttttataacagagctatgacttgtctgagcctcacacccttgcctcaacttctctacctagcctgacgtccacacgatttccaacatcttccaaccgtagcttagccagagacagagaggagtaggagttttctagttcaggagctggagttgttaccgggcgacagatgacttacccagcatgcacaagggcctctgcactgatggagttgttctagtctgagttgatgaatgagatgcccttacagctcctgtttcagtttctactcccatcccccgagagttatagagaagcggtcccatccacccggcctctgccgccacatatcccacgc

SEQ ID NO: 3055 - DNA, 1085 bp, Rattus norvegicus
  Genbank Accession No. NM_012513
cgccttggacagagccagcggatttgtccgaggtggtagtacttcatccagttccaccaggtgagaagagtgatgaccatccttttccttactatggttatttcatacttcggttgcatgaaggctgcgcccatgaaagaagcaaacgtccacggacaaggcaacttggcctacccagctgtgcggacccatgggactctggagagcgtgaatgggcccagggcaggttcgagaggtctgacgacgacgtccctggctgacacttttgagcacgtgatcgaagagctgctggatgaggaccagaaggttcggcccaacgaagaaaaccataaggacgcggacttgtacacttcccgggtgatgctcagcagtcaagtgcctttggagcctcctctgctctttctgctggaggaatacaaaaattacctggatgccgcaaacatgtctatgagggttcggcgccactccgaccccgcccgccgtggggagctgagcgtgtgtgacagtattagcgagtgggtcacagcggcagataaaaagactgcagtggacatgtccggtgggacggtcacagtcctggagaaagtcccggtatcaaaaggccaactgaagcaatatttctacgagaccaagtgtaatcccatgggttacacgaaggaaggctgcaggggcatagacaaaaggcactggaactcgcaatgccgaactacccaatcgtatgttcgggcccttactatggatagcaaaaagagaattggctggcggttcataaggatagacacttcctgtgtatgtacactgaccattaaaaggggaagatagtggatttatgttgtatagattatattgagacaaaaattatctatttgtatatatacataacagggtaaattattcagttaagaaaaagataattttatgaactgcatgtataaatgaagtttatacagtacagtggttctacaatctatttattggacatatccatgaccagaaagaaacagtcatttgcgcacaactttaaaagtctgcattacattcctcgataatgttgtggtttgttgccgttgccaagaattgaaaac

SEQ ID NO: 3056 - DNA, 781 bp, Rattus norvegicus
  Genbank Accession No. NM_012515
tgtggatctttccagaacagcagttgcaatcactatgtctcaatcctgggtacccgccgtgggcctcactctggtgcccagcctggggggcttcatgggagcctactttgtgcgtggtgagggcctccgctggtatgctagcttgcagaaaccctcctggcatccgcctcgctggacactcgctcccatctggggcacactgtattcggccatggggtatggctcctacataatctggaaagagctgggaggtttcacagaggaggctatggttcccttgggtctctacactggtcagctggctctgaactgggcatggccccccatcttctttggtgcccggcagatgggctgggctttggtggacctcatgcttgtcagtggggtggcaaccgccactaccctggcttggcaccgagtgagcccaccggctgcccgcttgctgtatccttacctggcctggctggcctttgccaccatgctcaactactatgtatggcgtgataactctggtcggcgagggggctcccggctcacagagtgaggacacctagccatcaggaatgcagccctgccagccaggcatcatgggttgaggtcatcctgctttcatgaccattgggcctgctggtctacctggtcttagtccaggaagccaccaggtaggtcaaggtggtcagtgctaagtcccatgcggggacagttgtacctgcttttctgcactgctgcaggcgtgccctaggagcatggggcctttaaagctaaataaagtctttaactt

SEQ ID NO: 3057 - DNA, 1882 bp, Rattus norvegicus
  Genbank Accession No. NM_012516
gggcccttgtctacgttctgcagagcctccggtccaactttgttccaaatgagcctcactgctgctctttgggttgctgtattcggaaaatgtggcccaccacctgatttaccctacgccctgccagcaagtgagatgaaccagacagactttgaaagtcacactaccctgagatacaattgtcgccctggctatagtagagcgagctcaagccagagtctctactgtaaacctctggggaaatggcagattaatatcgcctgcgtcaaaaagtcatgcaggaatccaggagacttacaaaatggaaaggtggaagttaagacagatttcttgtttggatcacagatagaattcagctgctcagagggatatatcttaattggctcatccactagttattgtgagatccaaggcaaaggagtttcctggagtgatcctctcccagaatgtgtaattgccaagtgtgggatgcctccagacatcagcaatgggaagcacaatggtagagaggaagaattcttcacatatcgttcctcagtcacctataagtgtgatcctgacttcacactccttggcaatgcctccattacctgcactgtggtgaacaaaacagtaggtgtttggagcccaagccctcctacctgtgaaagaatcatctgtccttggccaaaagttttgcatggaacaattaattctggattcaagcatacctataaatacaaagactctgtgagatttgtctgccagaaagggtttgtcctcagaggcagcggtgtaatccattgtgaggctgatggcagctggagtcccgtaccagtgtgtgagctcaatagttgcactgatattccagacattcctaatgctgccctgataaccagtcccaggccaagaaaggaagatgtatatccagtgggtactgtgctccgttacatctgtcgtcctggctatgaacctgctacgagacagcccatgactgtgatttgtcagaaagatctcagctggagcatgcttagggggtgtaaggagatatgctgtccagtaccagacccaaagagtgttagagtcattcaacatgaaaaggcacatcctgacaacgactgtacttacttctttggtgacgaagtgtcatacacatgtcaaaatgatataatgcttacagctacttgcaagtcagatggcacctggcatccccggacaccatcatgtcatcagagttgtgattttccgcctgccattgctcacggacgttatacaaaatcttcttcatactacgtcagaactcaggttacatatgaatgtgaagaaggatacagactggttggagaggcaaccatctcctgctggtattcacaatggacaccagcagctccacagtgtaaagctctatgtcggaaaccagagataggaaatggagtactgtctactaataaagatcaatatgtcgaaactgaaaatgtcaccatccaatgtgactcgggctttgtcatgctaggttcccaaagcatcacttgttcggagaatggaacctggtacccaaaggtgtccagatgtgagcaggaggtccctaaagactgtgagcacgtgtttgcaggcaagaagctcatgcaatgtctgccaaattcaaatgacgtgaaaatggccctggaggtctacaagctgactctggagattaaacaattacagctccagatagacaaggcaaagcacgttgaccgggagttatgagcgggtgttctctcaaggaggaagaagtacctcatgggctttctgacttcagtgccaagcagaacgtctgcatttttagcaacctttgtaactttggcaccaatgttcatggtaataaatatctgcttagaataattcattaaagcataatgtaagc

SEQ ID NO: 3058 - DNA, 691 bp, Rattus norvegicus
  Genbank Accession No. NM_012518
aaaagagtgtggagccgagacgcgcggcagagctcgagctgctgcagctgctgccgccgccagagtaacctcgatccccgagctccggatacgtgccccgccatggctgaccagctgaccgaagaacagattgcagagttcaaggaagccttctccctctttgacaaggatggagatggcaccattaccaccaaggagctggggactgtgatgagatcgctggggcaaaaccccactgaggcggaactgcaggacatgatcaatgaggtggatgctgatggcaatgggaccattgacttcccagagttcctgaccatgatggccagaaagatgaaggatacagacagcgaggaggagatacgagaggccttccgtgtctttgacaaggatgggaatggctacatcagtgctgctgagctgcgtcacgtcatgacgaacctgggggagaagctgactgatgaggaagtggatgagatgatccgagaggcggacattgatggagacggccaggtcaattatgaagagtttgtacagatgatgactgcgaagtgaaggcccgggcagctggccatgcccgttctcctgatctcttcttgcgctctcctctcttcaacactcccctgcgtacccggttctagcaaacgccaattgattgactgagaatctgataaagcaacaaaagatttgtccc

SEQ ID NO: 3059 - DNA, 2495 bp, Rattus norvegicus
  Genbank Accession No. NM_012520
attgcctaccccgggtggagaccgtgctcgtccggccctcttgcctcacgttctgcagctctgcagctccgcaatcctacaccatggcggacagccgggacccagccagcgaccagatgaagcagtggaaggagcagcgggcccctcagaaacccgatgtcctgaccaccggaggcgggaacccaataggagataaacttaatatcatgactgcggggccccgagggcccctcctcgttcaagatgtggttttcaccgacgagatggcacactttgacagagagcggattcctgagagagtggtacatgcaaagggagcaggtgcttttggatactttgaggtcacccacgatattaccagatactccaaggcaaaggtgtttgagcatattgggaagaggactcctattgccgtccgattctccacagtcgctggagagtcaggctcagctgacacagttcgtgaccctcgtgggtttgcagtgaaattctacactgaagatggtaactgggacctcgtgggaaacaacacccctattttcttcatcagggatgccatgttgtttccatcctttatccatagccagaagagaaacccacaaactcacctgaaggaccctgacatggtctgggacttctggagtctttgtccagagtctctccatcaggttactttcttgttcagcgaccgagggattccagatggacatcggcacatgaatggctatggctcacacaccttcaagctggttaatgcgaatggagaggcagtgtactgcaagttccattacaagactgaccagggcatcaaaaacttgcctgttgaagaggcaggaagacttgcacaggaagacccggattatggcctccgagatcttttcaatgccatcgccagtggcaattacccatcctggactttttacatccaggtcatgactttcaaggaggcagaaaccttcccatttaatccatttgacctgaccaaggtttggcctcacaaggactaccctcttataccagttggcaaactggtcttaaacagaaatcctgctaattattttgctgaagttgaacagatggcttttgacccaagcaacatgccccctggcattgagcccagcccggacaagatgctccagggccgcctttttgcttacccagacactcaccgccaccgcctgggaccaaactatctgcagatacctgtgaactgtccctaccgtgctcgcgtggccaactaccagcgcgatggccccatgtgcatgcatgacaaccagggtggtgctcccaactactaccccaacagcttcagcgcaccagagcagcagggctcggccctggagcaccatagccagtgctctgcagatgtgaagcgcttcaacagtgctaatgaagacaacgtcactcaggtgcggacattctatacgaaggtgttgaatgaggaggagaggaaacgcctgtgtgagaacattgccaaccacctgaaagatgctcagcttttcattcagaggaaagcggtcaagaatttcactgacgtccaccctgactacggggcccgagtccaggctcttctggaccagtacaactcccagaagcctaagaatgcaattcacacctacgtacaggccggctctcacatagctgccaagggaaaagctaacctgtaaagcacgggtgctcagcctcctcagcctgcactgaggagatccctcatgaagcagggcacaagcctcaccagtaatcatcgctggatggagtctcccctgctgaagcgcagactcacgctgacgtctttaaaacgataatccaagcttctagagtgaatgatagccatgcttttgatgacatttcccgagggggaaattaaagattagggcttagcaatcacttaacagaaacatggatctgcttaggacttctgtttggattattcatttaaaatgattacaagaaaggttttctagccagaaacatgatttgattagatatgatatatgataaaatcttggtgattttactatagtcttatgttacctcacagcctggtatatatacaacacacacacacacacacacacacacacaccaaaacacacatacactatacacacacacacacacacacactaaaacacacatacacaacacacacatacactacacacacagaacacacaacacaaacatacacacataggcacacacacacacacacacacacacacacacacacacacacacacacatgaatgaagggattataaagatggcccacccagaatttttttttatttttctaaggtccttataagaaaaaccatacttggatcatgtcttccaaaaataactttagcactgttgaaacttaatgtttattcctgtgtagttgattggattccttttccccttgaaattatgtttatgctgatacacagtgatttcacatagggtgatttgtatttgcttacatttttacaataaaatgatcttcatgg

SEQ ID NO: 3060 - DNA, 406 bp, Rattus norvegicus
  Genbank Accession No. NM_012521
gagacctcacctgttcctgtctgactctggcagcactcactgacagcaagcagcacagaaaaatgagcgctaagaaatctcccgaagaaatgaagagcatttttcaaaaatatgcagccaaagaaggcgatccaaaccagctgtccaaggaggagctgaagctgctgattcagtcagagttccccagcctcctgaaggcttcaagtactctagacaatctctttaaagagctggataagaacggtgatggagaagttagctatgaagaattcgaagttttcttcaaaaagttatcacaatgaagccagaagaaggagctccgacaccacctactgattgaatcctatccaatcccaaagatctagctgtgagagcaagatactgttaataaagcaaattctgagac

SEQ ID NO: 3061 - DNA, 1531 bp, Rattus norvegicus
  Genbank Accession No. NM_012531
atgccgttggctgcagtctcattgggtctcctgttgttggccctcctcctgctcttgcgacacctgggctggggcttggtgactattttctggtttgagtacgtgctgcagccagtccacaacctgatcatgggtgacacaaaggagcagcgcatcctgcgctacgtgcagcagaatgcaaagcctggagaccctcagagcgtcctggaggccatcgacacctactgcacacagaaggaatgggccatgaatgtgggtgacgcgaaaggccaaatcatggatgcagtgattcgggagtacagcccctccctggtgctggaactgggagcttactgtggctactcagcagtgcgaatggctcgcctgctgcagcctggagccaggcttctcaccatggagatgaaccctgactacgctgccatcacccagcaaatgctgaactttgcaggcctacaggacaaagtcaccatcctcaatggggcatcccaggatcttatcccccagctgaagaagaagtacgacgtggacacactagacatggtctttcttgaccactggaaagaccgctaccttccagacacacttctcctggagaaatgtggcctgctgcgcaaggggacagtgctcctagctgacaacgtcatcgtcccgggaacccctgacttcctggcgtatgtgagagggagcagcagcttcgagtgcacacactacagctcatacctggagtacatgaaagttgtagacggcttggagaaggcaatctaccagggtccaagtagccctgacaagtcttgatccctcagcctgcccccctgctccccttccagcttctctctgcgagatgacacacattcaatctgaccctttctatgctcctggggcttgtcctcgggggctgtggttccagactgtcatacactggcacattttaaaggtagtgagcccactatgcaaaatcacttcaataaccctgaaaagcacctatggatgaaaggctgaattgaggccaaaggtacactagatcacagcctgcccagcatgcaaaaggcctcaaggttaatcctctgcacccgagcctcatggtctcgctaactagaagaggagatcttcacggggtttcagtgtgggatcactaggcattgtatcaccagttaggcccagcaggaagtcagcaaactgtaaatgtccagacgccaaataacagcagaggctcagagacagtactgtcacttactgtccccagcagctcacaccacatctcatctgaagaatgagtcacaagctttccaggtatggtggtgcacgcctgtcatccccagtatccaggaggcagaggcatcggagttcagcgccagcctggtctacataagtgagttccaagacagccagggctacgtagaaatacatttttaaaaaagttataaccttggggttggggatttagctcagtggtagagcgattgcctagcaagctctaccactgagctaaatccccagccccaacctcttttatattataaaagaaattaaa

SEQ ID NO: 3062 - DNA, 3700 bp, Rattus norvegicus
  Genbank Accession No. NM_012532
ccaagaggaagaaacatgaagtttttgctgcttagtgcacttttatttttgcatagttccttagcttggacaagagaaaagcattattacatcggaattactgaagcagtttgggactatgcttctggcagtgaagaaaaggaacttatttcagttgacacggaacagtccaatttctatcttcgaaatggtccagatcgtattggaagaaagtataagaaggccctttattctgagtacacagatggcacctttacgaagactatagacaaaccagcctggctagggtttttaggccctgtcatcaaagctgaagttggagacaaagtttctgttcacgtaaagaactttgcctctaggccctacacttttcatgctcatggggtaacttacaccaaggcgaacgagggggccatctaccctgacaacaccactgattttcaaagagccgatgacaaactgtttcctggacagcagtatttgtacgtgctgcgtgccaatgagccaagtcctggcgagggagacagcaattgtgtgaccaggatttaccactctcatgtggatgctccaaaagatattgcatcaggactcataggaccgttgatactctgtaaaaaaggttctctgcataaggaaaaagaggaaaatattgaccaagaattcgtactgatgttctctgtggtggatgaaaatctcagctggtacctagaagataacatcaaaaccttctgctctgaaccagagaaagtcgataaagacaatgaagacttccaggaaagcaacaggatgtactctataaatggatatacatttggaagcctcccagggctctcgatgtgtgcagaagacagagtgaagtggtacctttttgggatggggaatgaagttgacgtgcattcagagctctttcatggtcaagccctgaccagcaagaactatcatactgatataatcaacctgttccctgccactctaattgatgtttctatggtggcccagaatcctggagtctggatgctcagttgccagaacctgaaccatctgaaagctggtttgcaggcctttttccaggttcgtgactgcaacaagccctcaccggacgacgatatccaagacagacatgtgagacattattacatcgctgccgaggagaccatttgggactatgctccgtctgggacagacaccttcactggagagaacttcaccagtctgggaagtgattcaagggtcttttttgagcaaggtgctacaagaattggtggctcttataaaaaattggtttatcgtgagtacacagatgattccttcacaaaccggaaggaaagaggccctgatgaggaacatcttggaatccttggtcctgtcatttgggcagaagtaggagacatcattagagtcacctttcataacaaaggacaatttcctctcagcattcagccaatgggggtaagattcaccaaggaaaatgagggaacatactatggcccagatggccgttcctcaaagcaagcctcccatgtggctcccaaagaaacctttacgtatgaatggactgtccccaaagaaatgggacccacttatgcagatcctgtgtgcctatctaagatgtattattctggagttgacctcaccaaagatatatttactgggcttattgggccaatgaaaatatgcaagaaaggcagcttacttgcagatgggagacagaaagatgtagacaaggagttctacttgtttgcaacagtgtttgatgagaatgagagtttactcttggatgataatatcagaatgttcacaactgcacctgagaatgtggacaaggaagatgaagactttcaggagtccaacaagatgcactccatgaatggattcatgtatggcaatctgcctggcctcaatatgtgcctaggagaatccatcgtgtggtatttgttcagcgctggaaatgaggcagacgtgcatgggatatacttttcaggaaatacctatctgtccaaaggagaaagaagagacactgcaaatctgtttcctcataaaagtctcacccttctcatgacacctgacacagaagggtcttttgatgttgagtgtcttacaacagatcactacaccggcggcatgaagcaaaagtacactgtgaaccagtgcaaggggcagtttgaagatgtcactctctaccagggagaaaggacctactatattgcagcagtggaggtggaatgggattattcaccaagcagggactgggaaatggagctgcaccatttgcaagagcaaaatgtttcaaatgcatttttggataaggaagagtttttcataggctcaaagtacaagaaggttgtgtatcgagagtttactgacagcacattcagagaacaggtgaagagaagagctgaagaggagcacttgggcatgctcggtccactgattcatgcagatgttggagccaaagttaaagttgtctttaaaaatatggcaacaaggccatattcaatacatgcccacggagtgaaaacaaagagttctacagttgctccaacgttgccaggtgaagttcgcacttatatatggcaaattccagaaagatcaggtgctggaacggaggattcaccttgtatcccatgggcttattactcaaccgtggatcgagttaaggatctctacagtgggctaataggcccattgattgtttgtcggaaatcttatgtgaaagtattcaatcctaaaaagaaaatggagttttcccttttgtttctagtttttgatgagaatgaatcttggtacttagatgataacatcaatacataccccgatcaccctgagaaagataacaaagacaacgaggaattcatagaaagcaataaaatgcatgctatcaatgggaaaatgttcggaaacctccaaggtctcacgatgcacgtgggagatgaggtcaactggtatgtgatggctatgggcaatgaaatagacctgcacactgtacacttccacggccacagcttccaatacaagcacaggggaattcatagttctgatgtctttgactttttccctggaacataccaaaccctagaaatgtttccccaaacgcctggaacctggttactccactgccatgtgactgaccatattcatgcggggatggtaactacctacactgttttaccaaatcaagagactaagtctggctgaaagaaataaattggtgataagtggaatacgagcacaatgacgttgttttaaacatttaaaaaaatcaaagccacacaaatgttcatttgtgagggaattggtaatgccgatggacagatgaacagactgtatcatgacatgtatttgtttgctgggtaacagaatcgctttacatagtccacttacacctgcactgaaaggactctgaaaagtggaaaaaaataagcaaaaccgtatgatcagatgctgtccttgactgtcctcacaggatcactataaagtccactaaactgtctccaactcttctcatcaagtcctctaacaaaccatggggtaagagggtatagaaaagaaggaaagatgaagataccaagatgcactttgtaaaaatctgaaaaacagttgaaggatgctctcggaaaatagagaaagtcaggatccaattatgttacattttgaaaaaatgaaatggagataataaagtaataaattttaaaatgccaat

SEQ ID NO: 3063 - DNA, 1056 bp, Rattus norvegicus
  Genbank Accession No. NM_012534
gaattccggaacatggacgtcaccatccagcacccttggttcaagcgcgccctggggcccttctaccccagccgactgttcgaccagttcttcggcgagggcctttttgaatacgacctgctgcccttcctgtcttccaccatcagcccctactaccgccagtctctcttccgcacagtgttggactccggcatctctgaggtccgatctgaccgggacaagtttgtcatcttcttggatgtgaagcacttctctcctgaggacctcaccgtgaaggtactggaagatttcgtggagatccatggcaaacacaacgagaggcaggatgaccatggctacatttcccgtgaatttcaccgtcgctaccgtctgccttccaatgtggaccagtccgccctctcctgctccttgtctgcggatggcatgctgaccttctctggccccaaggtccagtctggcttggatgctggccacagcgagagggccattcccgtgtcacgggaggagaagcccagctcggcaccctcgtcctgagcaggcctcgccttggttgtcccctgaggcccctgatccatccagcccaggggccacagcaaagagtctgccttcctgacttcttttctttctctttgtttcctttccactttctcagagggctgaggatttgagagagtggcttaaagagcttggggggtcttggcctgagatggctgcgggttcagggtgacccaggctcaacaccagccggtcagagggaatgatggcattgaactcttaagatttcctgtcctcctggaaagtggcatcgagctctgctccaaaggcagagtgaatggtggctaaccaaccccaagagccctctgccaagcccctggatggcagcctcccaccccctttgcccacacttaccgcaggcgtatatgctgggctccaacagtccgcttctctcatgccctcttcctgtgactttctctactatgtagtatcgctcctggggaccctggtcacccatgagaatggagcccctggcagacaataaagagcaggtgcgaattc

SEQ ID NO: 3064 - DNA, 1575 bp, Rattus norvegicus
  Genbank Accession No. NM_012540
atgccttctgtgtatggattcccagccttcacatcagccacagagctgctcctggccgtcaccacattctgccttggattctgggtggttagagtcacaagaacctgggttcccaaaggtctgaagagtccacccggaccctggggcttgcccttcatagggcacgtgctgaccctggggaagaacccacacctgtcactgacaaagctgagtcagcagtatggggacgtgctgcagatccgtattggctccacacccgtggtggtgctgagcggcctgaacaccatcaagcaggccctggtgaaacagggggatgacttcaaaggccggccagacctctacagcttcacacttatcgctaatggccagagcatgactttcaacccagactctggaccgctgtgggctgcccgccggcgcctggcccagaatgcgctgaagagtttctccatagcctcagacccaacactggcatcctcttgctacttggaagagcacgtgagcaaagaggccgaatacttaatcagcaagttccagaagctgatggcagaggttggccacttcgaccctttcaagtatttggtggtgtcagtggccaatgtcatctgtgccatatgctttggcagacgttatgaccacgatgaccaagagctgctcagcatagtcaatctaagcaatgagtttggggaggttactggttctggatacccagctgacttcattcctatcctccgttacctccctaactcttccctggatgccttcaaggacttgaataagaagttctacagtttcatgaagaagctaatcaaagagcactacaggacatttgagaagggccacatccgggacatcacagacagcctcattgagcattgtcaggacaggaggctggacgagaatgccaatgtccagctctcagatgataaggtcattacgattgtttttgacctctttggagctgggtttgacacaatcacaactgctatctcttggagcctcatgtacctggtaaccaaccctaggatacagagaaagatccaggaggagttagacacagtgattggcagggatcggcagccccggctttctgacagacctcagctgccctatctggaggccttcatcctggagaccttccgacattcatcctttgtcccattcaccatcccccacagcaccataagagatacaagtctgaatggcttctatatccccaagggacactgtgtctttgtgaaccagtggcaggttaaccatgaccaggaactatggggtgatccaaacgagttccggcctgaaaggtttcttacctccagtggcactctggacaaacacctgagtgagaaggtcattctctttggtttgggcaagcgaaagtgcattggggagaccattggccgactggaggtctttctcttcctggccatcttgctgcagcaaatggaatttaatgtgtcaccaggcgagaaggtggatatgactcctgcctatgggctgactttaaaacatgcccgctgtgagcacttccaagtgcagatgcggtcttctggtcctcagcatctccaggcttag

SEQ ID NO: 3065 - DNA, 1542 bp, Rattus norvegicus
  Genbank Accession No. NM_012541
atggcgttctcccagtatatctccttagccccagagctgctactggccactgccatcttctgtttagtgttctgggtgttgagaggcacaaggacccaggttcccaaaggtctgaagagtcctcccggaccctggggcttgcccttcattgggcacatgctgaccctggggaagaacccacacctatctctgacaaagctgagtcagcagtatggggacgtgctgcagatccgcattggctccacacccgtggtggtgctgagcggcctgaacaccatcaagcaggccctagtgaagcagggggatgacttcaaaggccggccagacctctacagcttcacacttatcactaatggcaagagcatgactttcaacccagactctggaccggtctgggctgcccgccggcacctggcccaggatgccctgaagagtttctccatagcctcagaccccacatcagtatcctcttgctacttggaggagcacgtgagcaaagaggctaaccatctaatcagcaagttccagaagctgatggcagaggttggccacttcgaaccagtcaaccaggtggtggaatcggtggctaacgtcatcggagccatgtgctttgggaagaacttccccaggaagagcgaggagatgctcaacctcgtgaagagcagcaaggactttgtggagaatgtcacctcagggaatgctgtggacttctttccggtcctgcgctacctgcccaacccagccctcaagaggtttaagaacttcaatgataactttgtgctgtttctgcagaaaacagtccaggaacactatcaagacttcaacaagaacagtatccaggacatcacaggcgccctgttcaagcacagtgagaactacaaagacaacggtggtctcatccctcaggagaagattgtcaacattgtcaatgacatctttggagctggatttgaaacagtcacaacagccatcttctggagcattttgctacttgtgacagagcccaaggtgcagaggaagattcatgaggagctggacacggtgattggcagagatcggcagccacggctttctgacagaccccagctgccatatctggaggccttcatcctggagatctaccgatacacatcctttgtccccttcaccatcccccacagtacaacgagggacacctcactgaatggcttccacattcccaaggagcgctgcatcttcataaaccagtggcaggtcaaccatgatgagaagcagtggaaagacccctttgtgttccgcccagagcggtttcttaccaatgacaacacggccatcgacaagaccctgagtgagaaggtgatgctcttcggcttgggaaagcgccggtgcattggggagatcccggccaagtgggaagtcttcctcttcttagccatcctcctgcatcagctggagttcactgtgccaccgggcgtgaaggtggacctgacacccagctatgggctgaccatgaagcccagaacctgtgaacacgtccaggcctggccacgcttctccaagtga

SEQ ID NO: 3066 - DNA, 4142 bp, Rattus norvegicus
  Genbank Accession No. NM_012544
cgccgcaccgcgcgcaccgcgccatgggggccgcgtccggccagcgggggcggtggccgttgtcaccgccgctcttgatgctgtcgctgctgctgctgctgctgctgccgccgtcgcccgccccggcgcttgaccctggattgcagccgggcaacttttccgcggacgaggcaggggcgcagctcttcgctgacagctataactcgagtgccgaggtggtgatgttccagagcaccgcagccagctgggcgcacgacaccaacatcacggaggagaatgcgcggctccaggaggaagcggccctgatcaaccaggagtttgcagaggtctggggcaagaaggccaaggagctgtatgagtccatctggcagaacttcactgaccaaaagctgcgaaggatcatcggatccgtacagaccctaggacctgccaacctgcccctgacccagcggctgcagtacaactctctgctaagcaacatgagcagaatctactccaccggcaaggtctgcttccccaacaagactgccacctgctggtccctggacccagagctcaccaacatcctggcttcctcacgaaactatgccaaggtgctgtttgcctgggaaggctggcatgatgctgtgggtatcccactgaagcccctctatcaggactttactgccctcagtaatgaagcctacagacaagatggcttctcagacacaggagcctactggcgctcctggtatgagtccccctcctttgaagagagtttggagcatctctaccaccaagtcgagcccctctacctgaacctccatgcctttgtccgtcgcgcactgcaccgccgctatggggacaaatacatcaatctcagaggtcctattcccgctcatctgctgggagacatgtgggcgcagagctgggagaacatttacgacatggtagtgcctttcccggacaaacccaacctcgatgtcaccagtacaatggtacagaagggctggaatgccacgcacatgttccgggtcgcagaggaattctttacctcgctggggctctcccccatgcctccagagttctgggcggagtcgatgctggagaaaccagctgatggacgggaggtggtgtgccatgcctctgcgtgggacttctacaacaggaaggacttcaggattaagcagtgcacgcgggtcacgatggaccagctgtccacagtacaccacgagatgggccacgtgcagtactatctccagtacaaggacctgcacgtctctctgcgtcgaggtgccaaccctggcttccacgaggccatcggggatgtactcgctctctctgtctctaccccagcacatctgcacaaaattggcctgctagaccgtgttgccaatgacatagaaagtgacatcaattacttgctaaagatggccctagagaaaattgccttcttgccctttggttacctggtggaccagtggcgctggggggtcttcagtggacgtaccccaccctctcgctacaactacgactggtggtatcttcgaaccaagtatcaggggatctgcccaccagttgctcggaatgaaacccattttgacgctggggccaagtttcacatcccaagcgtgacaccatacatcaggtactttgtgagtttcgtgctacagttccagttccatcaagcgctgtgcaaggaggcaggccaccagggtccactacaccagtgtgacatctaccagtccaccaaggcaggggccaagctccaacaggtgctgcaggctggctgctccaggccctggcaggaggtgctgaaggacctggtgggttcagatgcgctggatgccagtgcgctaatggagtacttccaaccagtaagccagtggctgcaggagcagaatcagcggaatggcgaggtcctaggctggccggagtatcagtggcgtccaccgttaccagacaactatccagagggaattgacctagagactgatgaagccaaggctaacaggttcgtggaggagtatgaccggacagccaaggtgttgtggaacgaatacgcagaggccaactggcattataacaccaacattaccatagagggcagcaagatcctgcttcagaaaaacaaggaagtgtccaaccataccttgaaatatggcacctgggccaagacatttgacgtgagcaacttccagaactctaccatcaagcggatcataaagaaggttcagaacgtggaccgggcagtgctgcctcccaacgagttagaagagtacaaccagatcctgctagacatggagacgacttacagtgtagccaatgtttgctacacaaatggcacttgtctgtcactggagcctgatctgacaaatataatggccacgtcccggaaatacgaagaattgctttgggtgtggaagagctggcgagacaaggtggggagagccatccttccctttttcccaaagtacgtggacttctccaacaagatcgccaagctcaacggctactctgatgcaggggattcctggagatcctcatatgagtccgacgacttggagcaagacctggaaaaactataccaggagctgcagccgctctacctgaacctgcatgcctatgtgcgccgctccctgcaccgccattatgggtctgagtacatcaacctggatggtcccattcctgctcacctgctagggaacatgtgggcacagacttggtccaacatctatgacttggtggcacccttcccttccgcccccagtatagatgccacggaggccatgataaagcagggatggacacccagaaggatatttaaggaagctgacaatttttttacctccctggggctgttacctgtgccccctgagttctggaacaagtcaatgttagagaagccaaccgatgggagggaggtggtgtgccatgcctcagcctgggacttctacaacggcaaggacttcaggatcaagcagtgtacctctgtgaacatggaggaattggtgatagcccaccacgaaatgggccacatccagtatttcatgcagtacaaagacttgcctgtgacctttcgggagggcgccaaccccggttttcatgaggctattggagatgttttggctctgtctgtgtctacacccaagcatctacacagtctcaacctgctcagcagtgagggcagtggctacgagcatgacatcaactttctaatgaagatggcccttgacaagatcgccttcatccccttcagctacctcattgaccagtggcgctggagggtctttgacggaagcatcaccaaggagaactacaaccaggagtggtggagtctcagactgaagtaccagggtctctgccctccagtgcctagatcccaaggtgactttgacccagggtccaagttccacgttcctgcgaatgtgccatacatcaggtactttatcagcttcatcatccagttccagttccacgaggcactatgtcgcgcagccgggcacaccggccccctgtacaagtgtgatatctaccaatccaaggaagcagggaagctgctggcagatgccatgaagttgggctacagtaagcagtggccagaagccatgaagataatcacaggccaacctaacatgtcagcctctgccattatgaattacttcaagccactgactgaatggctcgtcacagagaacaggagacatggagagacactgggctggccggagtacacctggacaccaaacacggctcgtgcagaaggctccctcccagagtccagtcgcgtcaacttcctgggtatgtacctggaaccacagcaggcccgtgtgggccagtgggtgctgctcttcctaggcgtcgccctgctggtggccaccgtgggtctcgcccaccgactctacaacatccataaccatcacagcctccgccggccccaccgtgggccccagtttgggtccgaggtggagctcagacactcctgaggtgaccctgccgtcaaggccaacagaggagtgtcccattaaaaaaaaattagatgggggacatggtgtttgagtggaacatacccaagctgggccttcttcctttgctgttcccatccactctgccccccagcccagcccccattctctagatacccagcatctaacctggaattc

SEQ ID NO: 3067 - DNA, 3112 bp, Rattus norvegicus
  Genbank Accession No. NM_012551
cgcagaacttggggagccgccgccgcgattcgccgccgccgccagcttccgccgccgcaagatcggcccctgccccagcctccgcggcagccctgcgtccaccacgggccgcggccaccgccagcctgggggcccacctacactccccgcagtgtgcccctgcaccccgcatgtaacccggccaacatccggcgagtgtgccctcagtagcttcggccccgggctgcgcccaccacccaacatcagctctccagctcgcacgtccgggatggcagcggccaaggccgagatgcaattgatgtctccgctgcagatctctgacccgttcggctcctttcctcactcacccaccatggacaactaccccaaactggaggagatgatgctgctgagcaacggggctccccagttcctcggtgctgccggaaccccagagggcagcggcggcaataacagcagcagcagcagcagcagcagcagcgggggcggtggtgggggcggcagcaacagcggcagcagcgctttcaatcctcaaggggagccgagcgaacaaccctacgagcacctgaccacagagtccttttctgacatcgctctgaataacgagaaggcgctggtggagacaagttatcccagccaaactacccggttgcctcccatcacctatactggccgcttctccctggagcctgcacccaacagtggcaacactttgtggcctgaaccccttttcagcctagtcagtggccttgtgagcatgaccaaccctccaacctcttcatcctcagcgccttctccagctgcttcatcgtcttcctctgcctcccagagcccacccctgagctgtgccgtgccgtccaacgacagcagtcccatttactcagctgcacccacctttcctactcccaacactgacatttttcctgagccccaaagccaggcctttcctggctctgcaggcacagccttgcagtacccgcctcctgcctaccctgccaccaagggtggtttccaggttcccatgatccctgactatctgtttccacaacaacagggagacctgagcctgggcaccccagaccagaagcccttccagggtctggagaaccgtacccagcagccttcgctcactccactatccactatcaaagccttcgccactcagtcgggctcccaggacttaaaggctcttaataacacctaccagtcccaactcatcaaacccagccgcatgcgcaagtaccccaaccggcccagcaagacacccccccatgaacgcccgtatgcttgccctgttgagtcctgcgatcgccgcttttctcgctcggatgagcttacacgccacatccgcatccatacaggccagaagcccttccagtgtcgaatctgcatgcgtaatttcagtcgtagtgaccaccttaccacccacatccgcacccacacaggcgagaagccttttgcctgtgacatttgtgggagaaagtttgccaggagtgatgaacgcaagaggcataccaaaatccacttaagacagaaggacaagaaagcagacaaaagtgtcgtggcctcctcagctgcctcttccctctcttcctacccatccccagtggctacctcctacccatcccccgccaccacctcatttccatccccagtgcccacctcttactcctctccgggctcctctacctacccgtctcctgcacacagtggcttcccatcgccctcggtggccaccacctatgcctccgtcccacctgctttccctgcccaggtcagcaccttccagtctgcaggggtcagcaactccttcagcacctcaacgggtctttcagacatgacagcaaccttttctcctaggacaattgaaatttgctaaagggaatgaaagagagcaaagggaggggagcgcgagagacaataaaggacaggagggaagaaatggcccgcaagaggggctgcctcttaggtcagatggaagatctcagagccaagtccttctagtcagtagaaggcccgttggccaccagccctttcacttagcgtccctgccctccccagtcccggtccttttgacttcagctgcctgaaacagccacgtccaagttcttcacctctatccaaaggacttgatttgcatggtattggataaaccatttcagcatcatctccaccacatgcctggcccttgctcccttcagcactagaacatcaagttggctgaaaaaaaaaatgggtctgggccctcagaaccctgccctgtatctttgtacagcatctgtgccatggattttgttttccttggggtattcttgatgtgaagataatttgcatactctattgtactatttggagttaaattctcactttgggggagggggagcaaagccaagcaaaccaatggtgatcctctattttgtgatgatcctgctgtgacattaggtttgaaacttttttttttttttgaagcagcagtcctaggtattaactggagcatgtgtcagagtgttgttccgttaattttgtaaatactgctcgactgtaactctcacatgtgacaaaatacggtttgtttggttgggttttttgttgtttttgaaaaaaaaattttttttttgcccgtccctttggtttcaaaagtttcacgtcttggtgcctttgtgtgacacaccttgccgatggctggacatgtgcaatcgtgaggggacacgctcacctctagccttaagggggtaggagtgatgtttcaggggaggctttagagcacgatgaggaagagggctgagctgagctttggttctccagaatgtaagaagaaaaatttaaaacaaaaatctgaactctcaaaagtctatttttttaactgaaaatgtagatttatccatgttcgggagttggaatgctgcggttacctactgagtaggcggtgacttttgtatgctatgaacatgaagttcattattttgtggttttattttacttcgtacttgtgtttgcttaaacaaagtgacttgtttggcttataaacacattgaatgcgctttactgcccatgggatatgtggtgtgtatccttcagaaaaattaaaaggaaaataaagaaactaactggt

SEQ ID NO: 3068 - DNA, 4991 bp, Rattus norvegicus
  Genbank Accession No. NM_012555
gaattcggcacgaggcgccggccagccgagagagtgagcgagcgcccgggacagaggagcgagcgggcgaggcgcgggcgaggctgggacccaagctcgctctctgctccgccaagtgccaacttcgcgccgactggctgggcgcgcacctttctgccgggcgatcagcgggaatttgagattttagggctgcgctctgtccccttcccctgagttcaaaatccctattaaaaagcaaaacaacagttacagcaaacttgctctcatcccgccggccccctcaactccggcaccatgaaggcggccgtcgatctcaagccgactctcaccatcatcaagacagaaaaagtggatttggagcttttcccatccccggatatggaatgcgcagatgtcccactgttaactccgagcagcaaagaaatgatgtcccaggcactgaaagctaccttcagtggtttcacaaaagagcagcagcgactgggaatccccaaagacccccggcagtggacagaaacccatgtccgggattgggtgatgtgggctgtgaatgagttcagcctgaagggtgtggacttccagaagttctgtatgaatggagcagcactgtgcgccctgggtaaagaatgcttcctcgagctggctccagactttgtgggggatatcctgtgggagcatctagagatcctgcagaaagaggatgtgaaaccgtatcaggttaatggagtcaaccctacctacccagaatcccgttacacctcggattacttcattagctatggtatcgagcatgctcagtgtgtccctccctcagagttctcagagcccagcttcatcacagagtcctatcagacgctgcatcccatcagctcggaagaactcctgtccctcaagtatgagaacgactacccttccgtcattctccgggaccctctccagacagacaccttgcagacagactactttgccatcaagcaagaagtgttaactccagacaacatgtgcatggggagagccagtcgtggtaaactcgggggccaggactcttttgagagcatagagagctacgatagttgtgaccgtctcacccagtcctggagcagccagtcatctttcaacagcctgcagcgtgtcccctcctatgacagcttcgactccgaggactatcccgctgccctgcccaaccacaagcccaagggcaccttcaaggactatgtgcgtgaccgtgctgacctcaacaaggacaagcctgtcattcctgctgctgccctggctggctacacaggaagtgggccgatccagctgtggcagtttcttctggaattactcactgataagtcttgtcagtcttttatcagctggacaggagacggctgggaattcaagctttccgacccagatgaggtggccaggagatggggaaagaggaaaaacaagcctaagatgaattatgagaaactgagccgcggccttcgctactattacgacaaaaatatcatccacaagacggcgggcaagcgctacgtgtaccgctttgtctgcgacctacagagcctgctgggatacaccccagaggagctgcatgccatgctggatgtgaagccggatgctgatgagtaacggacacggaaggggctgggggggaccgctgagacctttcaaagaacaacccgtgttggttggactcttaatttttaattgttattctatgttttattttccagaactcatttttcacattcaggggtgggagctaagggagttgcagccacattccattggccattggcaaggccggaaagggaaagtcaggacctgtggggtgggtggggcaagaagttcctgaggagatttttcaggagcgagagggtcttctcagaagccgagcgacttgacttacagaggaaaaggtttatgtgtccagtattctgtttgcaatcaaaggaaagagttcatcttgagttgtggatcgactagcaggaggaattgtcacgttaagatgaaagtcagtcagcgttggtgggtgggaggaaaacagtttcttcaggggatgactaaacgcaagaatttattaacctttctactttttttgaaacaaagatggactttaatggaagggatccaaaactgtttttattgttgaagtttattttattaaattctgtgccagtattttttttcttaaaaaaaatcgtcttaagctctaaggtggtctcagtattgcagtattgtgagttcgttgtaatttgctggctgaggagtctcccacaatgaaaggcagctgtttatatagaccccatggaaaaatccaagtctgtactgagaacagagacccccgaactcttacagctaaaggacgtgaatgctgatttggggaccagggaactgtgtgaattccacctgcggtttgtaaaacaacatttccagtccttttacttactgtcaggctgcgggcttagtgttagttaaggggcattaagtctttgcactgaatgtatttttgcagctctgctttggaactgttgtcagcataggtgcactgtttaagtcttggaaaagaaatcgaaggaggaagttgaacctggtttttggttaaatcgctacccgaaacatagaagactcaaactaaatgctgtttgcatgggcattacccctcggatcttaaggcctaaatgcatgccgttccaaactaacattgtacaatttctcctttatggcttatttccccagttcaccacattgctgcccctccccaccttactaatcagtagagtggaatgtaatgtttcctgataggtgaatgaaagtgtaatttcagacatcacagcacaaatcaaagagtacagactttctagggttcagagagcatggaaacgaggaggctatttcaggagcatgggacatggcctcctttgggaagaggctttcctttgaagaattggagcttgtcaggtaggatttcaggtgaggctgtttgcagatgaagtggtagagagcactgggacttcgagcttgacctgttgctacctcggcagagttaagcgaaagtcagctgcggatgagaggaaaacttgatggagggaatacaacggcaggagctaagaacggagaataaggtggcccgtgacagtgaggtatagttttactttcctcaaagtttaaattcaaagacttaatcgaggcagccatcttcctgccagttgagagaggagactggaaagtaaggcattgtgggtaaaaacaaagtaaggaaacatgcctggtatcattagaatccctcccactgtttaccacgcctagttgagacagcgactgtggacttccatgagagaaaagaggcagttggttgaggtggacctctccaggctcacccttcggggattgtaactacctggtatcatcttcatgagagttgatggctgactcccagattcccttgaagactctgaattcctgcgaacataacttgtccatgggtgttctgtactgaccgattggagcatccccaccggaagcaaaggcaaaacatcccagctctatgttttgatcttaacaaatgcaggtgccttaatgaagctctcaaagtatttaggagctgctcagggagtgttaggtgggatcatttggattatgttgtttttctcttatattatgtgatctttgttgggcactggcagtgtgtgtgtgtgtgtgtgggtgtgtgtgtgtacatttgtataagcctgcagctgaaatagtactgacttttctacttaagtctgtccacatttccataacggcgaaagagtacatacagccagggctgatttcatttctcgctctttgcaacagggcttaaataaaaaaaaaatcacttccccaagtcgtcgtccttgcccctattcagttcatgctgaaaacgcccctctcgagagcctaccgcctgcagccagtagcagataagacgtaagaaagtgcctcccacacggctcagcttgctgacttgcttctccccaggtccaccactttcaggatttgtagataggatattagtcagcttggtggtccatctggccagacgctctttcccatgctgtccaaaggccagagaccatcccaggaagagtggcgggtggtttatacactggaaatgtagcggcattgctgcattgatgctctacaaaaacacgttcacttcagaggaaggatgagcacatctgatccagctgggtggctccattgttttcccagagagatgctttaacctgtgcggttggcttttggctcagagctcaggggaataaggatgctccctgcatagagctctgaccgttgcgccatggaaaccagtggaagcactctagatcagagacactcttcctcactttggagatcaacactctgggttttaaagcattaaccttcatggtgaaatcacaccttctctcttctagccatgctgtgcatgccgctttctctgtcggggggtctctataaatttgttgaactcttacgtacattccaaagaagtttcaaggaaccacaagtatatgtatacaaatacatatatgaagtatatatgttaaaatgaaattatctctatcaggaatactgcctcagttaattgaattttttttaaggatacttttttttaagcggagaattattggggtgtaaaagatgttatattgtgtttgactattttccagcttgtattttcacataatttatattttttaaatgctgaaaatttaaaagcgagatttaaaaaggaaaagcaggtgctttttttttaaaaaaaagaatcagaactgaggtagcttagagatgtagccatgtaagtgtcttaaatgttttgtttttaaaaaaaaaacaaatgcaaaaaaattcttatgggggagttttttgtttgtttcttttagtagctgatgctggcacattttgctggaaagttttttatatactgtagcctgatttcatattgtattttaaactgtgctcgtgccgaattc

SEQ ID NO: 3069 - DNA, 493 bp, Rattus norvegicus
  Genbank Accession No. NM_012556
ctgttggtggcagctgggaaaggaaacctcattgccaccatgaacttctccggcaagtaccaagtgcagagccaagagaactttgagcccttcatgaaggcgatgggtctgcctgaggacctcatccagaaagggaaggacatcaagggggtgtcagaaatcgtgcatgaagggaagaaagtcaaactcaccatcacctatgggtccaaggtgatccacaatgagttcaccttgggggaggagtgcgaactggagaccatgactggggaaaaggtcaaggcagtggttaagatggagggtgacaataaaatggtgacaactttcaaaggcataaagtccgtgactgaattcaatggagacacaatcaccaataccatgacactgggtgacatcgtctacaagagagtcagcaagagaatttagacaaggctgtatttcatattcttttacagtataaaattaatacaataaagttacctctgttttgaaataa

SEQ ID NO: 3070 - DNA, 1357 bp, Rattus norvegicus
  Genbank Accession No. NM_012558
gagcttctgcagacactgtatagcgttcagtcctcctgctgtgactatcacctgggggactcacctgcctgcacctttagccagcacctacagacagtacctgtgccagaccccagcaatggtggaccatgcgcccttcgaaacggatatcagcaccctgacccgcttcgtcctggaggagggcaggaaggctgggggcacgggcgagatgacccagctgctgaattcgctctgcaccgcgatcaaagccatctcgtcagcggtgcgccaggccggcatcgctcagctctatggcatcgctggctcaaccaatgtgactggggatcaagtgaagaagctggacatactttccaatgacctggtgatcaatatgctgaagtcgtcctatgctacctgtgtccttgtgtcggaagaagatacacacgccatcataatagagcccgagaagaggggcaaatatgttgtctgttttgatcccctcgatggctcatccaacatcgactgcctcgcgtccatcggaaccatctttggcatttacagaaagacatctgctaatgaggcttcggagaaagatgctctgcagccaggcaggaacctggtggcagcaggctatgcactctatggcagcgccaccatgttggtcctggccatgaattgtggcgtcaactgcttcatgctggacccgtccattggagaattcattttggtggacagggatgtgaagatcaagaagaaaggtaacatctacagcattaatgagggctatgctaaggactttgaccctgccatcaatgagtatatccagaggaaaaagttccctccggataattcagctccctatggtgcccggtatgtggggtccatggtggctgatgttcaccgcactctggtgtatggagggatcttcttataccctgccaacaagaaaaatccatctggaaagctgcggctgctgtacgagtgcaatcccatcgcttacgtcatggagaaggccggtggacttgccacgacggggaatgaagacatattagacatcgtccccactgagatccaccagaaggcaccagttatcatggggtccaccgaagacgtgcaggagttcctggagatctacaataaggacaaagccaaatcaaggccgtccctgcccctgccccagagcagagctcgtgagtcaccggtccattctatctgtgacgaacttttctagaaacaaacccaacagcgcggatagtttcagggccgaatgccttgcaatgcccaaggttgcctcgcctagatgctataatgccactgtatcaggtactatatatttcgaataggtgaaggagaaataaacatattcttccttcataaa

SEQ ID NO: 3071 - DNA, 1358 bp, Rattus norvegicus
  Genbank Accession No. NM_012559
agtgctggctgtaaggggctgggagcaccggtcacccagacactatgaattggtccttgcaactccggagtttcattctatgctgggcgcttttactactttctccaacgggcctggcacagtacactgctactagagataactgttgcatcctagatgagagattcggtagttactgcccaaccacttgtggcatctcagacttcctgaattcttaccaaaccgacgtggacactgacctccagactctggaaaacatcttacaacgagctgaaaacagaaccacagaagccaaggaactgattaaagccatccaggtttactacaacccggaccaacccccaaagccgggtatgatagagggtgccactcagaagtctaagaagatggtagaagaaatcttgaagtacgaagcactgttactaacccatgagtcgagtatccggtatttacaggacatctatacttcaaataagcagaagatcacgaacctgaaacagaaggtggcccagcttgaagctctgtgccaggagccttgcaaggactctgtgcgaatctatgacataaccggaaaagattgtcaggataccgccaacaagggtgccaaagaaagtggactttactccattcggcctttgaaagccacggagcagttcttagtgtactgtgaaaccgacggacctggaaatggctggaccgaattcaagaagaggcttgatggcagtgtggatttcttgaagaactggattcagtataaagaaggatttggacacctgtcacctactggcaccacagagttttggctgggcaatgagaagaatcatctgataagcatgcagtccaccatcccatacgcactgagaatacagctcaaagactggagtggcaggaccagcaccgcggactatgccatgttcagggtgggtcctgaatccgacaaataccgcctgacctatgcctacttcattggtggagatgccggggatgccttcgacggctacgattttggtgatgatcccagtgacaagtttttcacatcccacaacggcatgcacttcagtacctgggacaatgacaacgacaagttcgaaggcaactgtgctgagcaggatggatctggctggtggatgaacaagtgtcacgctggccacctcaatggagtttattaccaaggtggcacttactccaagtcatctactcctaacggttatgacaatggcattatttgggccacgtggaaaacccgctggtattccatgaaggaaaccaccatgaagataattcccttcaacagactctccattggagatgggcagcaacatcacatgggaggatccaaacaggttggagacatgtaa

SEQ ID NO: 3072 - DNA, 1035 bp, Rattus norvegicus
  Genbank Accession No. NM_012561
atggtctgcgccaggcaccagcccggcgggctctgcctcctgctgctgctactctgccaattcatggaagaccgcagcgcccaggctgggaattgctggctccgccaagccaagaacggccgctgccaggtcctgtataagacagaactgagcaaggaagagtgttgcagcaccggccggctgagcacctcgtggaccgaggaggatgtgaacgacaatactctcttcaagtggatgattttcaacgggggcgcccccaactgcatcccttgtaaagaaacgtgtgagaatgtggactgtggccccgggaaaaagtgccgaatgaacaagaagaacaaaccccgctgcgtctgtgccccagactgttccaacatcacctggaagggtccagtgtgtgggctcgatgggaaaacctaccgcaacgaatgtgcgctcctcaaggccagatgtaaagagcagccggaactggaagtccagtaccagggcaaatgtaaaaagacttgcagggatgttttctgtccaggcagctccacttgtgtggtggatcagaccaataatgcctactgtgtgacctgtaatcggatttgcccggaaccctcatcttcagagcagtccctttgcgggaacgatggtgtgacttactccagtgcctgccacctgagaaaggccacctgcttgctgggcagatccattggattagcctatgagggaaagtgtatcaaagcaaagtcttgtgaagacatccagtgcggtggtggaaaaaaatgcctatgggatttcaaggttggcagaggtcgctgctctctctgcgatgagctgtgcccggacagtaagtcggatgagcccgtctgtgccagcgacaatgccacgtacgccagcgagtgtgccatgaaggaagctgcctgctcctccggcgtactgcttgaagtgaagcactccggatcttgcaactccatctcggaagaaacggaggaagaggaggaagaggaagaccaggactacagcttccctatctcttccactctagagtggtaa

SEQ ID NO: 3073 - DNA, 2326 bp, Rattus norvegicus
  Genbank Accession No. NM_012565
ctcagccagacagtcctcacctgcaacaggtggcctcaggagtcaggaacatctctacttccccaacgacccctgggttgtcctctcagagatggctatggatactacaaggtgtggagcccagttgttgactctggtcgagcagatcctggcagagttccagctgcaggaggaagacctgaagaaggtgatgagccggatgcagaaggagatggaccgtggcctgaggctggagacccacgaggaggccagtgtaaagatgttacccacctacgtgcgttccaccccagaaggctcagaagtcggagactttctctccttagacctgggaggaaccaacttcagagtgatgctggtcaaagtgggagagggggaggcagggcagtggagcgtgaagacaaaacaccagatgtactccatccccgaggacgccatgacgggcactgccgagatgctctttgactacatctctgaatgcatctctgacttccttgacaagcatcagatgaagcacaagaaactgcccctgggcttcaccttctccttccctgtgaggcacgaagacctagacaagggcatcctcctcaattggaccaagggcttcaaggcctctggagcagaagggaacaacatcgtaggacttctccgagatgctatcaagaggagaggggactttgagatggatgtggtggcaatggtgaacgacacagtggccacaatgatctcctgctactatgaagaccgccaatgtgaggtcggcatgattgtgggcactggctgcaatgcctgctacatggaggaaatgcagaatgtggagctggtggaaggggatgagggacgcatgtgcgtcaacacggagtggggcgccttcggggactcgggcgagctggatgagttcctactggagtatgaccggatggtggatgaaagctcagcgaaccccggtcagcagctgtacgagaagatcatcggtgggaagtatatgggcgagctggtacgacttgtgctgcttaagctggtggacgagaaccttctgttccacggagaggcctcggagcagctgcgcacgcgtggtgcttttgagacccgtttcgtgtcacaagtggagagcgactccggggaccgaaagcagatccacaacatcctaagcactctggggcttcgaccctctgtcaccgactgcgacattgtgcgccgtgcctgtgaaagcgtgtccactcgcgccgcccatatgtgctccgcaggactagctggggtcataaatcgcatgcgcgaaagccgcagtgaggacgtgatgcgcatcactgtgggcgtggatggctccgtgtacaagctgcacccgagcttcaaggagcggtttcacgccagtgtgcgcaggctgacacccaactgcgaaatcaccttcatcgaatcagaggagggcagcggcaggggagccgcgctggtctctgcggtggcctgcaagaaggcttgcatgctggcccagtgaaatccaggtcatatggaccgggacctgggttccacggggactccacacaccacaaatgctcccagcccaccggggcaggagacctattctgctgctacccctggaaaatggggagaggcccctgcaagccgagtcggccagtgggacagccctagggctctcagcctggggcagggggctgggaggaagaagaggatcagaggcgccaaggcctttcttgctagaatcaactacagaaaatggcggaaaatactcaggacttgcactttcacgattcttgcttcccaagcgtgggtctggcctcccaagggaatgcttcctggaccttgcaatggcctggcttccctgggggggacacaccttcatggggaggtaacttcagcagttcggccagaccagaccccaggagagtaagggctgctagtcacccagacctggctgttttcttgtctgtggctgaagaggccggggagccatgagagactgactatccggctacatggagaggactttccaggcatgaacatgccagagactgttgccttcatatacctccacccgagtggcttacagttctgggatgaaccctcccaggagatgccagaggttagagccccagagtccttgctctaaggggaccagaaaggggaggcctcactctgcactattcaagcaggaatcatctccaacactcaggtccctgacccaggaggaagaagccaccctcagtgtccctccaagagaccacccaggtccttctctccctcgttcccaaatgccagcctctctacctgggactgtgggggagtttttaattaaatatttaaaactacttca

SEQ ID NO: 3074 - DNA, 4526 bp, Rattus norvegicus
  Genbank Accession No. NM_012569
gaattccgcggacgcccacgccccgagcatcctcttctgacgagcgggcgccggcggcatgatgcggctgcgaggctcggcgatgctgcgggagctgctcttgaggccgcctgccgccgtcggaggcgtcttgcggcgcacgcagcccctcggcacgctgtgccggcgcccccggggcgggagccggccggccgctggcctggtggccgctgcgcgactccacccgtggtggggcgggggcggccgcgcgaagggcccgggctcgggcggcctgtccagctcgccctcggagatcctgcaggagctgggcaaggggggcacgccgccacagcagcagcagcagcagcagcagcagccaggggcgtcgccacccgcagccccgggccccaaggacagcccgggggagacggacgcgttcggcaacagcgaaggcaaggagatggtggctgcgggcgacaataaagtaaagcagggtctgttacctagcttggaagatttgctgttctatacaattgcagaaggacaagaaaagatacctgttcacaagtttattacagcactcaaatctacaggattgcgaacatctgatcccaggttgaaagagtgtatggatatgttaagattaactcttcagacaacgtcagatggtgtcatgctagacaaagatctttttaaaaagtgtgttcaaagcaacatcgttttgttaacacaagcatttagaagaaagtttgtcatccctgactttatgtcttttacctcacacatcgatgagttatatgaaagtgctaaaaagcagtctggagggaaggttgctgattatattcctcaactggccaaattcagtcctgatttgtggggtgtatctgtttgtaccgtagatgggcaaaggcattctattggagataccaaagttcccttttgtcttcagtcctgtgtaaagcccctgaaatatgcaattgctgtcaatgacctgggaactgagtatgtgcatcgctatgttgggaaggagccaagtggattaagattcaacaagctctttttgaatgaagatgataaaccacataatccgatggtaaatgctggagcaattgttgtgacttcactaataaagcaaggagtaaataatgctgagaaatttgactatgtgatgcaatttttgaataagatggctggtaatgaatatgtcggattcagtaatgcaacgtttcaatctgaacgagaaagtggagaccgaaattttgcaataggatattacttaaaagaaaagaagtgttttccagaaggcacagacatggttgggatactagatttttatttccagctctgttccattgaagtgacgtgtgagtcagcaagtgtgatggctgcaaccttggctaatggcggtttctgcccaattactggtgaaagagtgctcagtcctgaggccgttcggaacaccctgagcttaatgcactcctgtggcatgtatgacttctcagggcagtttgcatttcatgttggtcttcctgcaaaatctggagttgctgggggtattcttttagttgtccccaacgtcatgggcatgatgtgttggtctcctcctcttgacaagatgggcaacagtgttaaaggaattcacttttgtcacgatcttgtttctctgtgtaacttccataactatgataatttgagacactttgcaaaaaaacttgatcctcggagagaaggaggtgatcaaagggtaaagtcggtgataaacctcctgtttgctgcgtacactggagatgtgtctgccctccgaaggtttgctctgtcagccatggacatggaacagagagattacgactccagaacagccctgcatgttgctgctgcagaaggtcatgttgaagttgtgaagtttttgctggaagcttgcaaagttaaccccttccccaaggacaggtggaataacacccccatggatgaagcactgcactttggacaccatgatgtttttaaaatcctccaggaataccaagttcagtatacacctcaaggggattctgacgatggaaaagaaaaccagactgtccacaagaatcttgacgggttgttataatggtctgaatcgtgagacttacattacttacctagccattgtggaacatggctatggagaacatgtgtgtttctatctggtagtaatgtgtatttacaacatctgtccctgcagtgttaccggagcctccttcattgtgcgcacacgacaaatctgagttctttgggaaaaaaaatagaaatgaagtagcctcccttcacaatgtgagcaatagttacctcgtgcgttgtacaatttgatgtaaaagagtagttaccaatgctagctgaactgtgtggtttccacggtttgtgttttgtacattttcaagccctggtgatgatatatgctcatatgcattaggattgagctttgttgtacagtctgtccatagggtcgatgctgtcattagacgaaaatagtgctacctttaagaactttacacatagatttagtttgagtgtttgagagaccattgcacttgtgtggttgagtgtttaaaatgtctatcacctcacttcacagtgtgactctttaaatattaaaataattactactaactgttcatagaatatgctgattctgattagattttatcagggaatctattaagatatgtttggtgaccaaaatatatgtgtgactgtggttctagcactttgaaacttttcctttccatacaaggcttaggccagcctctctgtggtgtgtagctgtcggtccccctcagctgggaaagagagcactggcttactatgcagttttcaggtctcctcagcaagccatcaagcctcccatttctgccatcagagatagagcttggctgtttatctgaggaagatgagccaaaattacatctcaattagtcatcagtcttaggagtaaagacagtgatgactgcaaggtcttctcagcttctacaataaagaaaaattcagaaatgcttccagttaccaaagttataatgatatatttaggaaaagctacaaataacatttacttttaatcctgatgtcaaatgtctgcatcaagatagcactcctttgtggcattccaggtatcttctcttcctctactgcttaactgttggtgggctagctatattgttcaataagaaaaggacactttattttaaatttagacccaccccttctttgttttggaaaaggcaatttatgattaacttggataataggtaaaaagcaaccttagataattgtaatattgtgagaacgtaattgtctaggagtcccacataacgtaccctattatacctccaagagatgaagggtatgttagtgaggacttttgatactaaccacacttttgcatgcacgcacacacacacacacacacacacacacacacacacacacacacacacacggatttcttggaaaatgctttatgaaattagcaacattctcaactgcacagatactactggttcccacagtaacacagcatcttctgtgaccctcactatctgcactgattgcatccaagctttatgtctggtggctcattattcactccagctgctttgatcctgtttcaaagtcagcttcggccatcccctccattccctagtgttccttcactaagacaaggcaccactaacgtgtttctaagctccagagtctgtggggaggatgtgagtggcagccagccctgtcactgtgttcctccttccacacccctcaggacaggtggtgggtactcggagcatcctccccaggaacctcctccaaggttcaggggtgagcgcgctgcagtcagcggacataccactgtgcagcagcagccggctttccggaattcagcgtgtgacttaaatattgccagtgactttaaggattccctccgataatggtcttgtatattatctgagacaaatgttttcatctctcctcagctcagtgctgcttcatactgtctctgtggcttggttgagtgcgctctttgtcctgggccaggtcttgctctggctgttcgctgctggctgataacagcaaggaccctgtaagtgtgtgaatgagccgctgactgctgccatcagtaaactccaaagacgtctgttctggctttacaaccctaggtgatggttctgtctctcagaaccattacatgatcgtgtggcttcaacgatctctgcataccgctgtccctgctgtcccggttctgacgcccctgtctgctgatgtgctacgcccactactgcctacactgctttagcggcagagctggactcactgtcgatccagacgtctgtcagggacctgataaccgatgtctgccctaggtccctgctggggagtccacagctatgaatgtatttacttctaacatttcccaaaatgaaatcttaaaactataaattgtaagtattctgaaattgggaaatacttattttaaatgagatcaggtagtgttgctttttacagcataataaatatgtgtattg

SEQ ID NO: 3075 - DNA, 2874 bp, Rattus norvegicus
  Genbank Accession No. NM_012570
gtccaggcctgcaagctctgatcttctgtgctcccgccgctctcgcctcagcccgccgccatgtaccgccgtctgggcgaagtgctgctactgtcccgcgccgggcccgctgccctgggctctgcggctgcagactcagccgcactgctgggctgggctcgcggacaaccctctgctgtcccgcaacccgggctcacgccggtcgccaggcgccactacagcgaagcggccaccgaccgcgaagacgaccccaacttcttcaagatggtggagggcttcttcgaccgcggcgccagcatcgtggaggacaagctggtggaagacctgaagacccgggagaacgaggagcagaagcggaaccgagtgcgcggcatcctgcggatcatcaagccttgcaaccatgtgttgagcctctccttccccatccggcgcgacgacggctcctgggaggtcatcgaaggctaccgggcccagcacagccagcaccgcacgccctgcaagggaggtatccggtacagcactgacgtgagtgtggatgaggtgaaggcgctggcgtccctaatgacctacaagtgtgcagtggttgatgtgccatttggaggtgctaaagcaggcgttaagatcaatcccaagaactatacagataatgaattagaaaagattacacgaagattcaccatggagctggcaaagaagggttttattggtcctggcattgatgtgcctgccccagacatgagcacgggcgagcgggagatgtcctggatcgctgacacctatgccagcaccatagggcactatgatatcaatgcacacgcctgtgtcactggtaaacccatcagccaaggaggcatccacggacgcatctccgctactggccggggtgtttttcatgggattgagaacttcatcaatgaagcttcctacatgagcatcttagggatgaccccggggcttggcgataagacgtttgttgttcagggatttggtaatgtgggcctgcactctatgagatatttacatcgttttggtgctaagtgtgttggtgttggagaatctgatgggagtatatggaatccagatggtattgacccaaaagaactggaagatttcaagttgcaacatggatcaattctgggcttccccaaagccaaggtctatgaaggaagcatcttggaggctgactgcgacattttaattcctgcagccagcgagaagcagttgaccaaatccaatgcacccagagtcaaagccaagatcattgctgaaggagccaatggcccaaccactccagaggccgataagattttcctagaaagaaacatcatggttattccagatctctacctgaatgctggaggagtgacagtatcttactttgagtggctaaagaatctaaatcacgtcagctatggccgattgaccttcaaatatgaaagggactcgaactaccacttgctcatgtccgttcaagagagtttagagagaaagtttggaaagcacggcgggactatccctgtggtccccacagcagagttccaggacagaatatcgggtgcatctgagaaagacatcgtgcactctggcttggcctacacaatggagcgatctgccaggcaaattatgcgcacagccatgaagtataacctgggattggacctgagaacagctgcctacgtcaatgccattgagaaagtcttcaaggtgtacaatgaggctggcgtgaccttcacatagacaggtcacagctgacttctttaccaccctcttcacctataatttctgcagacctgtcacaagtttacatgtaaccacagaaatctgttcttgtgactcattagttaatggacactgttctcaacaagtcagttggaatcagccccttaagagaaagattaagttagcggatcatgtaccagctgatggtgtaaaggtaggaatcacgtgtatcctgccagttaggtgtttcgcttttaagtaaagtttctgctcctggccatgctgccttgctctggactcttcccaacagggttagtgctgttgccagggaaggcagtcaagagtcagtcacttcctgacaagtctgggtacttgagcacataagaagtaggcgtgtggcatttgcaaaggtggcatggtcttcgagtgagttattgctgctttacatcagcaaaataactcagtctctaagtcgcaaacaaataaaagctatttctcatgtattttattctttcagaataaaccagttcatgctgctgtaataaaattgccttcaaccacttaagcctaacctttactcaagcagtgaacgcctaaaatataggaaatggaagaagctagtttttataacataaaacagtataatttagcttatcggccctgcagcatagtccagcagaaataaagtagcacctgggggcaggcgtacctgcaagtgacacgggagggacacttgggaacttgttatgcagtccagagagtgaagtaaccactttaccaatttggagatctattatgttgagtaattgaaccatacttcaaatagagtgtcccagaagaaaagactggctccctgtttggaggctggcagacttcagactcagcctgtgtgtcccttctccaaggctttgccgtctacacagcacctcgctatccacaggctggagactgcctggggttgacttctgtttggggagttactggccagggcttttgaacaggagtgttccacagaagtaccagacattatttatataagaatgagcgcttctttttaacagtaccctttcagaaatttctaactactttgtaactgcatgattaacttggtgataaaagcagttattaaaagtctaccttttccaaaaaaaaaaa

SEQ ID NO: 3076 - DNA, 1937 bp, Rattus norvegicus
  Genbank Accession No. NM_012571
ccgacgtcccctcagattccatcgcgatggcccctccatcattctttgcccaggttccacaggccccgccggttctggtctttaagctcattgcggacttccgggatgatcccgatccccgcaaggttaacctcggcgtgggagcgtaccgcacagatgactctcagccctgggttttgccagtagtgacgaaggtcgaacagaagattgctaacgaccacagtctcaaccacgagtacttgcccatcctgggcctggcggagttccggagctgtgcttctcagctagtacttggggacaacagcccagctctcagggagaatggggttgggggtgtgcagtctttgggagcgaccggtgcacttcgaattggagctgacttcttagcgcgatggtacaatggcacagacaacaagaacacgcccgtctacgtatcatcgccgacctgggagaaccataatggcgtgttttctgccgctggttttaaagacattcggtcctatcgctactgggatgcagagaagagaggacttgatctccagggtttcctgaatgatctggagaatgctcctgagttctccatctttgtcctccacgcctgtgcacacaacccaacggggaccgacccaactgaagaggagtggaagcagatcgccgccgtcatgaagcgccgttttctgttccccttctttgactcagcctatcagggctttgcatctggagacctagagaaagatgcctgggctattcgctattttgtgtctgaaggcttcgagctcttctgtccccagtccttctccaagaacttcgggctctacaatgagagagtggggaatctgaccgtggtcggaaaagagcatgacagcgtcctgcgggtcctttcccagatggagaagattgtacgaatcacctggtccaatccccctgcccagggagctcggatcgtggccaccaccctctccaaccctgagctctttaaggagtggaaaggaaacgtgaagacaatggctgaccggattctgaccatgagatccgaactcagggcgcgactagaagctctcaagactcccgggacttggtctcacatcactgagcagattggaatgttcagctttactgggttgaaccccaagcaggtcgagtatttggtcaacgagaagcacatctatctgatgccgagcggtcggatcaacatgtgcggcttgaccaccaagaacctagattatgtggctacctccatcaatgaagctgtcaccaaattccagtgaagaaacaccgagtagttcataccccaaagcagttcctgtcacagctttcctgcctgcgcaaacctagccgtacatgttgtttattagagatgaccaccatggggaggcagccgctgtttagctggccccacaagagaagacatttcttgaaatgaacctgggtcgggtggggggatgactggggttagggccttttggaaaccagagcagattaaagttatttaagaataaaaaaaccctttgatatgagatgtaatcatcttgccttcctctgtagtattctgcaggagtgttgcccacgaagccgtgggcttctgcacgttgcttgagtctgtacagagtcctgtccccaaaatcaagttgtctgaggagccggctgtgactgtggatgttggcattaaaactcaccatttccatcgtctctgtctctcggccccctgatctttccgcatggttgtgaccctggtcttggaacattagttttttaaggccactgtggccagtatttatatcatgacacacaagtggatttacatatttaactgagatgaaagttccgctaaacggtatttgctcttgtgatacgtggcacattgtgacattttcttagtctcttctgtcgtgttctgtttcatttaaaaaaataaaaatgctgatcaagacaaacgg

SEQ ID NO: 3077 - DNA, 3312 bp, Rattus norvegicus
  Genbank Accession No. NM_012572
cttttctggttcttgttgtcccggagcgttatgtcatgcccagaccagcagagggctccatgaggagttatagaagatgccccgtgtctctgctcctctggtgctgcttcctgcttggctcttgatggtggcctgtagcccacactccctgaggatcgctgctatcttggatgaccccatggagtgcagcagaggggaacggctctccatcaccctggccaagaaccgcatcaaccgcgcaccagagaggctgggcaaggcaaaagtcgaagtggacatctttgagcttctcagagacagcgagtacgaaactgcagaaaccatgtgtcagatcctccccaagggagtggtcgctgtcctgggaccgtcgtccagcccagcctccagctccatcatcagcaacatctgtggagagaaggaggtccctcatttcaaagtggccccagaggagtttgtcaggttccaactccagagattcaccaccctgaaccttcaccccagcaacaccgacatcagcgtggctgtggctgggatcctgaacttcttcaactgcaccaccgcctgcctcatctgtgccaaagcagaatgccttttaaacctggagaagctgctccggcaattccttatctccaaggacacactgtcggtccggatgctggatgacacacgggaccccactccgctcctcaaggagatccgggatgacaagacagctactatcatcatccatgccaacgcctccatgtcgcacaccatcctcctgaaggcagctgaactggggatggtgtcagcctattacacctacatcttcaccaatctggagttctccctccagagaatggacagccttgtggatgatagagtcaacatcttaggattttccattttcaaccaatcccatgctttcttccaagagttctcccagagcctcaaccaatcctggcaggagaactgtgaccacgtgcccttcaccggccctgcgttgtcctcagccctactgtttgacgctgtctacgctgtggtgacagcggtacaggaactgaaccggagccaggaaattggcgtgaagcccctgtcctgtggctcggcccagatctggcagcatggcaccagcctcatgaactacctgcgcatggtagaattggaaggtcttaccggccacattgaattcaacagcaaaggccagaggtccaactatgccttgaaaatcttacagttcaccaggaatgggtttcggcagattggccagtggcatgtggcagagggcctcagcatggacagccgcctctacgcctccaacatctctgacagtctcttcaacaccaccctggtcgtcaccaccatcctggaaaacccatacctaatgctgaaggggaaccaccaggacatggaaggcaatgaccggtacgagggattctgcgtggacatgctcaaggagttggctgagatcctacggttcaactacaagatccgcctcgttggggatggtgtttacggcgtacctgaggccaacggcacctggacgggcatggttggggagctgatcgctcggaaagcagatctggctgtggcgggcctcaccatcacagctgaacgtgagaaagtgattgatttctccaagccgttcatgacgctgggaattagtattctttacagagttcatatgggacgcagaccgggctatttctcctttctggaccccttttctccaggagtctggctcttcatgcttctagcttatctggctgtcagctgtgtcctcttcctggtggctcggttaactccttatgagtggtacagtccacatccttgtgcacagggccggtgtaatctcctggtcaaccagtactctctgggcaacagcctctggtttccagtgggaggcttcatgcagcaaggctccaccatcgccccgcgggctttgtccacacgctgcgtcagtggtgtctggtgggccttcacgttgatcatcatctcatcgtacacagccaacctggcagccttcctgacggtgcagcgcatggaagtgcccatcgagtctgtggatgacctggctgaccagaccgccattgagtatggcacgattcacggaggctccagcatgaccttcttccaaaattcccgctaccagacctaccagcgcatgtggaattacatgtactccaagcagcccagtgtgtttgtgaagagcacagaggagggaattgccagggtgttgaattccaactacgccttcctgctggagtccaccatgaacgagtactaccggcagaggaactgcaacctcactcagattgggggcctgctggacaccaagggctatgggattggcatgccagtcggctcagtgttccgggatgagttcgacctggccattctccagctgcaggagaacaaccgcctggagattctgaagcggaagtggtgggaagggggaaaatgtcccaaggaggaggaccacagagccaaaggcctgggaatggagaatattggtggaatctttgtggttcttatttgtggcttaatagtggccatttttatggctatgctggagtttttatggactctcagacactcagaagcatcagaggtgtctgtgtgtcaggagatgatgactgagctgcgcagcatcatcctgtgccaggacaatatccatccccggaggcggcgctctggaggcctgccaccccagcccccggtcctggaggagcgccggcccaggggtacagcgacgctcagcaatggcaagctatgtggcgccggggagccggaccaactggcgcagagactggctcaggaggccgccctggtggcccgaggctgcacgcacatccgcgtgtgcccggagtgccgccgcttccagggcctgcgggctcgaccgtcgccagcgcgcagcgaggagagcctggagtgggacaagaccaccaacagcagcgagcctgagtagtggcggcgaaggaccgtggagccaggcggggaggcgggagggctaatgttacaacctccttctctccgattgaagattcagtgactttacaaagtcactgatggcccagctagggcggatcccgccctatctgagacttgcaaacacgtggcagagacattgtccctcttgggcacaaggacccatctcctccagagggtctttccctcacattcaaaaacatggattctgggtagtggggccctgctgagagagcagtccaagaaattgatggtatcatcagttggattaccccctaggaaggggccattgtaccctgggtctagttcttacaggaaaaaaaaaattaaactcaacagggaagg

SEQ ID NO: 3078 - DNA, 5259 bp, Rattus norvegicus
  Genbank Accession No. NM_012574
gctgaagactccttaaatatatatatatatatatatattcgggctactaacctcacatgcacatgggataatgactctggattctgcattgtgagctgctctccacaccctgagatcccctcttacattacattttttcctttgaatttgcatctcgtcaagacacaagattaaaaccaaatttacactacactggattttaaattttcttccgttcctttatcctccgtctttcttatgtggatatgcaagcgagaagaggaccctggatattcccaacatgctctctcccttaatctgtccgcctagaggtttggcgtctacaaaccaagagagccgactagctgaagatgaagcccagcgcagagtgctgttcccccaagttctggttggtgttggccgtcttggccgtatcaggcagcaaagctcgttcccaaaagagcccccccagcatcggcatcgctgtcatcctcgtgggcacttcagacgaagtggccataaaagacgcccacgagaaagatgacttccatcatctctcagtagttccccgggtggagctggtagccatgaacgaaactgacccaaagagcatcatcacccgtatctgcgatcttatgtctgaccggaagatccagggggtggtgttcgcggatgacaccgaccaagaagccatcgctcagatcctcgacttcatttctgctcagactctcacccccatcctgggcatccatgggggctcatctatgataatggcggataaggatgagtcctccatgttcttccagtttggcccgtctatcgaacagcaagcttccgtcatgctcaacatcatggaagaatatgactggtacatcttttccatcgtcaccacctacttccctggctaccaggactttgtgaacaagatccgcagtaccatcgagaacagcttcgtgggctgggagctcgaggaagtcctcctgctagacatgtctctggacgatggcgactctaagattcagaatcagctgaagaagctccaaagccccatcattctcctttattgcacgaaggaggaagccacctacatttttgaagtagctaactcagttgggctgactggctacggctacacgtggattgtgccgagtctggtggccggggatacggacacggtgccttcagagttccccacggggcttatctctgtgtcttatgatgaatgggactatggccttcctgccagagtgagagatggaattgccatcatcaccactgctgcctcggacatgctgtccgaacacagtttcatccctgagcccaagagcagttgctacaacacccacgagaagaggatctaccagtctaacatgttgaataggtatctgatcaatgtcacttttgaagggagaaacctgtccttcagcgaagatggctaccagatgcatccgaagctggtgataatccttctgaacaaggagaggaagtgggagagggtggggaaatggaaggacaagtccctgcagatgaagtattatgtgtggcctcggatgtgtcctgagactgaggagcaagaggatgaccatctgagcattgtcaccttggaggaggcgccatttgtcattgtggaaagcgtggaccctctcagtggaacctgcatgaggaatacagtcccgtgccagaagcgcatcatctctgagaataaaacagatgaggaaccaggctacatcaaaaaatgctgcaaggggttctgtattgacatccttaagaaaatttctaagtctgtgaagttcacctatgacctttacctggtgaccaatggcaagcacgggaagaagattaatgggacctggaatggcatgatcggtgaggtggtcatgaagagggcctacatggcagtgggatcactaactatcaatgaagaacggtcagaggtggttgacttctctgtacccttcatagaaactggcatcagtgtcatggtatctcgcagcaatgggactgtgtcaccttctgccttcttagagccattcagcgctgacgtgtgggtgatgatgtttgtgatgctgctcattgtttctgcggtggctgtctttgtctttgaatacttcagccctgtgggttacaacaggtgcctagccgatggcagagagccaggaggcccatctttcaccatcggcaaagcaatttggttactctggggtctggtgtttaacaactccgtacctgtgcagaacccaaaggggaccacctccaagatcatggtgtcagtgtgggccttctttgctgtcattttcctggccagctacactgccaacttagcagccttcatgatccaagaggagtatgtggaccaggtttctggcctgagtgacaagaagttccagagacctaatgacttctcaccccctttccgctttgggactgtgcccaatggcagcacagagaggaatatccgtaataactatgcagaaatgcatgcctacatgggaaagttcaaccaaaggggtgtagatgatgcattgctctccctgaaaacagggaagcttgatgcattcatctatgatgcagctgtgctcaactacatggctggaagggacgaaggctgcaaactggtgaccattggcagtggcaaggtctttgcttctaccggctatggcattgctatccaaaaggactccgggtggaagcgccaggtggacctggctatcctgcagctgtttggagatggggagatggaagaactggaagctctctggctcactggcatttgccacaatgagaagaatgaggtgatgagcagccagctggacatcgacaatatggcaggtgtcttctatatgttgggggcagccatggccctcagcctcatcaccttcatctgtgagcatctgttctattggcagttccggcattgcttcatgggtgtctgttctggcaagcctggcatggtcttctccatcagcagaggtatctacagctgtatccatggggtagccatagaggagcgccaatccgtgatgaactcccccactgccaccatgaacaacacccactccaacatcctacgcttgctccgcacggccaagaacatggccaacctgtctggagtaaacggctcccctcagagtgccctggacttcatccgccgagagtcctccgtctacgacatctctgagcatcgtcgcagcttcacgcattcagactgcaagtcttacaataacccaccctgtgaggaaaacctgttcagtgactacattagcgaggtagagagaacatttggtaacctgcagctgaaggacagcaatgtgtaccaagaccactatcaccatcaccaccggccacacagcatcggcagcaccagctccattgatgggctctatgactgtgacaacccacccttcaccacccagcccaggtcaatcagcaagaaacccctggacatcggcctgccctcctccaaacatagccagctcagcgacctgtatggcaagttctctttcaagagtgaccgctacagtggccacgacgacttgattcgatcggatgtctccgacatctccacgcacactgtcacctatgggaacatcgagggcaacgcagccaagaggaggaaacagcagtataaggacagtctaaagaagcggccagcctcggccaaatcgaggagggagtttgatgaaatcgagctggcctaccgtcgccgaccaccccgctccccggaccacaagcgctacttcagggacaaagaagggctccgagacttctacctggaccagttccgaacaaaggagaactcgcctcactgggagcacgtggacttgactgacatttacaaagaacgcagtgacgacttcaagcgagattcggtcagtggaggtgggccctgtaccaacaggtctcacctcaaacacggaacgggcgagaagcacggagtggtaggcggggtgcctgctccttgggagaagaacctgaccaatgtggattgggaggaccggtctgggggcaacttctgccgcagctgtccttccaagctgcacaattactcctcgacggtggcagggcagaactcgggccggcaggcctgcatcagatgtgaggcctgtaagaaggctggtaacctgtacgacatcagcaaggacaactccctgcaggaactggaccagccggctgcccccgtggctgtgacatccaacgcctccagcaccaagtaccctcaaagcccgactaattccaaggctcagaagaagaatcggaacaaactgcgccggcagcattcctacgacaccttcgtggacctgcagaaggaggaggccgccttggccccacgcagcgtgagcctgaaagacaagggccgattcatggatgggagcccctacgcccatatgtttgagatgccagctggtgagagctcctttgccaacaagtcctcagtgcccactgccggacaccaccacaacaaccccggcagcggctacatgctcagcaagtcgctctaccctgaccgggtcacgcaaaaccctttcatccccacttttggggatgaccagtgcttgcttcacggcagcaaatcctacttcttcaggcagcccacggtggcaggggcgtcaaaaacaaggccggacttccgggcccttgtcaccaataagccagtggtgtcagcccttcatggggctgtgccaggtcgtttccagaaggacatttgtatagggaaccagtccaacccctgtgtgcctaacaacaaaaaccccagggctttcaatggctccagcaatggacatgtttatgagaaactttctagtattgagtctgatgtctgagtgagggaagagagagaggttaaggtgggtacgggagggatagggctgtgggccgcgtggtgcgcatgtcatggaaagagtcgggggtgaacttggctcccattcgctttttcttcttcttttaatttctctatgggatcctggagttctggttccttactgaaggcaaccctcgtggccagcaccatttctcctccctcgcgcagttctctccttcccgcatctgtccaccattcctgtttccatgagagaatagaacggggcctcagtgtgggaggatggagaggagaccaaagcgctgcctgtgtgcttctttctagcgcagaagggctcttagcagttcactttgagcgaggctttcctgatgctgctctctttgttcaggtgaggaagcgaaggtgttctgaggaaggccattgaacctcctgttcataagagagaagaggctttcactgaattc

SEQ ID NO: 3079 - DNA, 1779 bp, Rattus norvegicus
  Genbank Accession No. NM_012578
ccggagcaggccggccaccatgaccgagaactccacctccaccccggcggcgaagcccaagcgggccaaggccgccaagaagtccacggaccaccccaagtattcagacatgatcgtggctgccatccaggcagagaagaaccgcgccggctcctcgcgccagtccatccaaaagtatatcaagagccactacaaggtgggtgagaacgccgactcccagatcaagttgtccatcaagcgcctagtgaccaccggtgttctcaagcaaaccaaaggggtgggcgcctcggggtccttcaggctggccaagggcgatgagcccaagaggtcggtggctttcaagaagaccaagaaggaagtcaagaaagtggccactccaaagaaggcagccaagcccaagaaggctgcttccaaagccccaagcaagaaacccaaagccaccccggtcaagaaggccaagaagaagccggctgccacgcccaagaaagccaaaaagcccaagattgtcaaagtcaagccagtcaaggcatccaaacccaagaaggccaaacccgtgaagcccaaagccaagtcgagtgccaagagagccagcaagaagaaatgacaatgaaggctttgcttggggacactccttcctccctcctgttttctgtaaatacatttctctcttgatcccatctgcaaccctttgcccattctatttggactctatatagaggacagagtttggcttcctcagacagactttgtggaatattttccttaacccattgttcaaggacagcaaacagacctcatctttataatgatggagatgtacttttttcttgatttgatattaaccttatggggttgtgggggggggcgttgtgtgtttccttcggtggtttgtttactatgaaggtaaatggaactggcaaagttctgggtaggtgaggacccaggaactaggttgcttgtccctagtgagcgtttcagaacctttgatgagcaggtgatacccatctacctggccaaggggggttgttggggagaagagaataaactccctgggctgccctaccaatggtggtaagttgggggacctgatttctttttctcttctgccctagtgcctctccaagtgacagctggttagagaagccatagcttctcacaaccgggatttagccattgggaaggaagggtcttctcagcagtctccggttaaatgggagtggacttaggggaggggtgcagagtcagccaagtgcctcagtgtgtctatggaaacttgggtctttccacacggttgatggattgtgtcctaggaggacgttgttcgtttcctttcccctcttcctgtgtaagatgtggcattgcttggtgccacttcagttctaccagcggccacttaaaacccctccaagcttttgagtcttttctaagtagccgaggagggggagaggcagggagtggactgtgggatatactcccgtggattcgaatttgcctaggtagctttagagaagcggattgtgtgcatgtgtgtatatgtatatatccatatctaagactagtacttagtctcacctcgggagctgggagaaaaactctgtacagttgtcctcttattttaataaagtaggaaactcgggtaccctaccccactttttaaacaagtgtaactagtgccgggaaaaaattactgtggttgtaattttaaaactttaaaataaaactggaaaggaaaaaaaaaaaaaaaaaaaaaaaaaaaaaaaaaaaaaaaaaaaaaaaaaa

SEQ ID NO: 3080 - DNA, 1947 bp, Rattus norvegicus
  Genbank Accession No. NM_012584
tgccttcagggtctccaacccttggaaacaaaacgaccaccacacatctactgttctctcaactatctgcttcctgtgttgaccatgcctgggtggagctgcctggtgacaggagcaggaggatttctgggccagaggattgtccaaatgttggtgcaagagaaagagctgcaggaggtcagagtcctgtataggaccttcagtccaaaacacaaagaggaactgtccaagctgcagacaaaagccaaggtgacggtactgaggggagacattgtggatgcccagttcctgaggagagcgtgccagggcatgtccgtcatcatccacaccgctgctgcccttgatatcgcaggcttcctgcccaggcagaccatcctagatgtcaatgtgaaaggtactcagctcctgttggatgcttgtgtggaagccagcgtaccagccttcatctacagcagctcaacaggtgtggctggaccaaactcctacaaggagaccatcctgaacgaccgtgaggaagagcatcgtgaaagcacatggtcaaatccatacccatacagcaaaaggatggccgagaaggcagtgctggcagccaatgggagcatcctgaaaaatggtggcacttttcatacatgtgccttaagactcccattcatctatggggaagaaagccaaatcatttcaaccatggtaaatagagcactcaagaacaacagcataattaaaagacatgccacattctccatagccaacccagtgtatgtgggtaatgcagcctgggcacacattctggctgccaggggccttcgagaccccgagaagtcacaaagcatccaaggacagttctactacatctcagatgacacccctcaccaaagctatgatgatttaaattataccctgagcaaagaatggggcttctgccttgattccagttggagccttcctctgcccctgctctactggcttgccttcctgctggaaactgtgagcttcctgctgcgtccattttacaactataggccaccctttaaccgcttcatggtcacgatcttaaatagcgtgtttaccatttcctacaagaaagctcagagagatctgggctatgagccacttgtcagctgggaggaagccaagcaaaaaacctcggagtggatcgggacactagtggagcaacacagggagacactggacacaaagtctcaatgatgggaagagggcagggacatggccccgggtgttaccccgtcctccagccaggaactcagaaataatccaactcttacagttttattttatacactctccaactggtcttcaggtcaccagaaaccttaagagtcactggcccagtcacctgaacaaggtgcaggggacatcatgtagaaggaataaaactgcctgcctcttgtgacacctgggtgttcattcacctgccatgtggtatcacaaacagaagtaggatctcagctggcatcaaaacttcttctttcttacttaccccatattaagtaatgtttataggaagtaatgtttgtaggtggggcttgagctcccacactagagtcaggaggcaaaaccatgctgaagttctatatagcaaaccaaacctgagagtactttcctgatcactacaatagcaagagagcaagagcgagagtgagagcaagagcgagagagggagggaggaagggaggaaaggggatggagggagggaggaagggaaggagagagagagagagagagagagagagagcatcaccatttcacatagggtgtgaacagagtaggaaatcactttgtttctcatttaccaagagaccatctgaaagaatctgcctttctttgcccctgtcataccaagaaaccttattttcgcttattggacaatgttctatggtataaaaaataagagttgtctggttctgggaataaaactaaattccaagg

SEQ ID NO: 3081 - DNA, 1269 bp, Rattus norvegicus
  Genbank Accession No. NM_012585
atggatgtgttcagttttggccagggcaacaacaccacagcgtcccaggagccctttgggaccggcggcaacgttactagcatctccgacgtgaccttcagctaccaagtgatcacctctctgttgctgggtactctcattttctgcgcggtgctcggcaatgcctgcgtggttgctgccatcgccctggagcgctccctccagaatgtggccaactatctcatcggctccttggcggttactgatctcatggtatcagtgctggtgctgcccatggctgctctgtaccaggtgctcaacaagtggaccctgggccaggtcacctgcgacctgtttatcgccctggatgtactgtgctgcacctcgtccatcctgcacctgtgcgccatcgcgctagacaggtactgggctatcaccgaccctatagactatgtgaacaaaaggacgccccggcgcgccgctgcgctgatctcgctcacttggctcattggctttctcatctccatcccgcccatgctgggctggcgcaccccggaagaccgatcggaccccgacgcgtgcaccatcagcaaggaccacggctacaccatctactccactttcggcgctttctatatcccgctgttgctcatgctggttctctacgggcgcatcttcagagccgcacgcttccgaatccgcaagactgtcaggaaggtggaaaagaagggagcaggcaccagcttaggaacttcgtcggcaccgccccccaagaagagcctgaacggacagccaggtagtggggactggaggcgctgtgctgagaacagggcggtggggactccgtgcactaatggggcagtgaggcagggtgacgacgaggccaccctggaggtgatcgaggtgcaccgagtgggcaactccaaagagcaccttcctctgcccagcgagtcaggatctaactcctatgcccccgcctgcttggagagaaaaaatgagcgcaatgctgaagcaaagcgcaagatggccttggcccgtgaaaggaagacggtgaagactctgggcatcatcatgggcaccttcatcctctgctggctgccgtttttcattgtggctctggtcctgcctttctgtgaaagcagctgccacatgcctgcgttgttgggtgccataattaactggctaggctactccaactccctgctcaatccggttatttatgcttatttcaacaaagactttcaaaacgcttttaagaagataatcaagtgcaagttctgccgccgatga

SEQ ID NO: 3082 - DNA, 2078 bp, Rattus norvegicus
  Genbank Accession No. NM_012591
ctcgacgaaggagtaggacgagctctcactgtctgagccaaaccgaaccgggccgagctgagccgaggtcagcggtggccagaggaacccagcatctcgggcatcattcgctccgtgcacgcatcgtgtacctacaccgcaactccgtgcctcattcccgggtaccctctgtgactcgctcctgcagcaaagccaccatgcctatcactcggatgcgaatgagaccctggctagagatgcagattaattccaaccaaattccagggctgagctggatcaataaagaagagatgatcttccagatcccatggaagcatgctgccttgcacggttgggatatcaacaaggatgcctgtctgttccggagctgggccattcacacaggccgatacaaagctggggaaaaagagccagatcccaagacttggaaggcaaacttccggtgtgccatgaactccctaccagacatcgaggaagtgaaggaccagagcaggaacaagggcagctctgctgtacgcgtgtaccggatgctgccacccctcaccaagaaccagaggaaagagagaaagtccaagtccagccgtgacactaagagcaaaaccaagaggaagctgtgcggagattctagccctgacaccttatctgacggactgagcagctctactctgcctgatgaccacagcagttacacagctcagggatacctgggtcaggacttggacatggacagggacattaccccagctctgtcaccgtgcgtcgtcagcagcagtctctctgagtggcatatgcagatggacatcatgccagacagcaccactgatctgtacaacttgcaggtgtcgcccatgccctccacctctgaagctgcaacagatgaggatgaggaagggaagttacctgaggacatcatgaagctctttgaacagtctgagtggcagccgacgcacgtggatggcaagggatacttgctcaatgaaccaggagcccaactctctactgtctatggagacttcagctgcaaggaggaaccagagatcgacagccctggaggggacatcgagataggcatacagcgtgtcttcacagagatgaagaatatggaccccgtcatgtggatggacaccctgctgggcaactctaccaggccgccctccattcaggctattccttgtgcaccataatttgggtccctgacccgttcttgccctcctgagtgagctaggtccagcatcatggtggctgtgatacaacataaagctaaacttccgtggaccccttgatgtggcaaaacataatcccattgccaagcagggaagggaccaaaccatcctccttgggtcagtggactgactcttcagagcttaggaggcagggtctaagtttttcaagctggtcctgactcctaggaagatggattggcgttctgaggttagtgtgaggcagaggacctggacggaagttaccttctagctctttgaaagcttcattgcttagagagggtctcaccactgggctggcctgggggatagaccagcgcccacagaagagcattgcactggccttagggctggctccacactgggagacaattgcactaagtcctattcccaaagaactgctgcccttcccaaccgagccctgggatggttctagagccagtgaaatgtgaaggaaaaaatggggtcctgtgagggttgtctcccttagcctcagagggattctgcctcactccctgctccagctgtggggctcaggaaaaaaaaatggcactttctctgtggactttgccacatttctgatcagaagtgtacactaacatttctcccaagtcttggcctttgcatttatttatatagtgccttgccctgtgcctgctgtctctcctcaggcctcagcagtcctcagcaggcccagggagggggttgtgagcgccttggcgtgactctgaacattggaaacgccacctaactactaagttgtgtctgatctcgtgtggatctgtgtaaatatgtatattcatctttttataaaaacctaagttgtttaaaaaaaaaaaaaaaaaaaaaaaaaaaaaa

SEQ ID NO: 3083 - DNA, 2104 bp, Rattus norvegicus
  Genbank Accession No. NM_012592
tggtatacagcggagatggcgactgcagtccggctgctggggcggcgagtttccagttggagactgcggcctttaccgtcgccccttgctgtcccgcagcgggcccactcgatgttgcctgtggatgatgatatcaacgggctaaacgaggagcagaagcagcttcgtcatacgatatctaagttcgttcaagagaacctggcccccaaggcccaagagattgatcaaagcaatgacttcaagaacctgagagagttctggaagcagctgggaagcctgggagtcctgggcatcacagcccccgttcagtatggtggctctggcctgggctacctagaacatgtgttggtgatggaagagatatcccgggcttcagcagctgtggggctcagctatggcgctcactccaacctctgcatcaaccagattgtccgcaatgggaatgaggcacagaaagagaaatatcttcccaagctcatcagtggtgagttcatcggagccctggccatgagtgagcccaacgctggctctgacgttgtctccatgaggctgaaagcagagaagaaaggagatcactacgttctgaatggcaacaagttctggatcaccaatggccctgacgctgatgtcctagttgtctatgccaagacagacttgactgctgtgcctgcgtctcggggcatcacagccttcattgtggaaaaggatatgcctggtttcagcacctcgaagaagctggacaagctaggcatgaggggctccaacacctgtgagctagtctttgaagactgcaaggttcctgctgctaacatcctgagccaagagagtaagggtgtctacgtactgatgagcgggctggacctagaacgcctggtgctggcaggtggaccccttgggatcatgcaggctgtcctggaccacaccattccctatttgcatgtgagggaagcctttggccagaagatcggccaattccagctgatgcagggaaagatggctgacatgtacacccgcctcatggcatgtcgacagtatgtctacaatgtcgccagggcctgtgacgagggccacatcactgccaaggactgtgctggtgtgattctgtatacagccgagtgtgccacacaagtagccctggatggcattcaatgtttaggtggaaatggctacatcaatgacttccccatgggccgctttcttcgagatgccaaactgtacgagatcggaggtgggaccagtgaggtgaggcggctagtcattggcagagctttcaacgcagacttccgctagcctggggccatcaccctgctcccagcagcaggaggcctttggaagcagagacgtggcagccctctgacttggctaaggaagctctgctgctcaactgccctcttgccagccctctgctcttcgtgaagtcggattctccagccgtgccagccagtcaatcaagaaagcctaaaattcggtccccagctccgaaaaaaaaaaaaaaaaaaaagaaccaaaagaaagcctaaaatggctgctaaaaggactttggcttttctggggtttgcagggagggtaacagtgtctgcgcccttgttctctacttctgaatgtagtaacctcaccctctggggtagcatatgacaggtacccaactccttttcgtgggcaagcctctggcaggggagctctttctgttgcaatgtaacagaggcattgcctctttcaattgtcagatacttgtggtctcttttcttgaggaaaaggcaaaaaccatgtccttcttagctgtttccccaagagctagctagacagttccagaatgcctgtgtggcagacccatgaagggcagagtccacagtctagccaagacaacttggagattggctccctggtgtggctgagtgtctacatcactccgtcacaggctagcactgggcctgctcacgtgaccttctgcagctgcctgactccggtggcccagcttaggttgcctggctcaactccagccttgctgtctatgtatatttctctagacgccctgtggctaattttgttacaaccacacaggctctgctgccattttgtattaaacatactgcaaagtaaaaaa

SEQ ID NO: 3084 - DNA, 3650 bp, Rattus norvegicus
  Genbank Accession No. NM_012596
tggggcaattgggctgacctttcttatgctgggatgtgccttggaggactatgggtgtctatctctgaagtaagatgacgtgtcagaaattctatgtggttttgttacactgggaatttctgtatgtgataactgcacttaacctggcctatccaacctctccctggagatttaagctgttttgtgcgccaccgagtacaactgatgactcctttctctctcctgctggagtcccaaacaatacttcgtctttgaagggggcttctgaagcacttgttgaagctaaatttaattcaactggtatctacgtttctgagttatccaaaaccattttccactgttgctttgggaatgagcaaggtcaaaactgctccgcactcacaggcaacactgaagggaagacgctggcttcagtggtgaagcctttagttttccgccaactaggtgtaaactgggacatagagtgctggatgaaaggggacttgacattattcatctgtcatatggaaccattacttaagaaccccttcaagaattatgactctaaggttcaccttttatatgatctgcctgaagttatagatgatttgcctctgcccccactgaaagacagctttcagactgtccagtgcaactgcagtgttcgggaatgcgaatgtcatgtaccagtacccagagccaaagtcaactacgctcttctgatgtatttagaaatcacatctgctggtgtgagttttcagtcacctctaatgtcactgcagcccatgcttgttgtgaagcccgatccaccgctgggtttgcgtatggaagtcacagatgatggtaatttaaagatttcatgggacagccaaacaaaagcaccatttccacttcaatatcaggtgaaatatttagagaattctacaatcgtaagagaggctgctgaaatcgtctcggatacatctctgctggtagacagcgtgcttcctgggtcttcatacgaggtccaggtgaggagcaagagactggatggctcaggagtctggagtgactggagtttacctcaactctttaccacacaagatgtcatgtattttccacccaaaattctgacgagtgttggatccaatgcttccttttgctgcatctacaaaaatgagaaccagactatctcctcaaaacaaatagtttggtggatgaatctagccgagaagatccccgagacacagtacaacactgtgagtgaccacattagcaaagtcactttctccaacctgaaagccaccagacctcgagggaagtttacctatgatgcagtgtactgctgcaatgagcaggcatgccatcaccgctacgctgaattatatgtgatcgatgtcaatatcaatatatcatgtgaaactgacgggtacttaactaaaatgacttgcagatggtcacccagcacaatccaatcactagtgggaagcactgtgcagttgaggtatcacaggcgcagcctgtactgtcccgataatccatctattcgtcctacatcagagctcaaaaactgcgtcttacagacagatggcttttatgaatgtgttttccagccaatctttctattatctggctatacaatgtggatcaggatcaaccattctttaggttcacttgactctccaccaacgtgtgtccttcctgactccgtagtaaaaccactacctccatctaatgtaaaagcagagattactataaacactggattattgaaagtatcttgggaaaagccagtctttccagagaataaccttcagttccagattcgatatggcttaaatggaaaagaaatacaatggaagacacacgaggtattcgatgcaaaatcaaaatcggccagcctgccagtgtcagatctctgtgcggtctatgtggtacaggttcgctgccggcggttggatggactagggtattggagtaattggagcagtccagcctacactcttgtcatggatgtaaaagttcctatgagagggcctgaattctggagaataatggatggggatattactaaaaaggagagaaatgtcaccttgctttggaagccactgatgaaaaatgactcactgtgtagtgtgaggaggtatgtggtgaagcatcgtactgcccacaatgggacatggtcacaagatgtgggaaatcagaccaatctcactttcctgtgggcagaatcagcacacactgttacagttctggccatcaattccatcggtgcctcccttgtgaattttaaccttacgttctcatggcccatgagtaaagtgaatgctgtgcagtcactcagtgcttatcccctgagcagcagctgcgtcatcctttcctggacactgtcacctaatgattatagtctgttatatctggttattgaatggaagaaccttaatgatgatgatggaatgaagtggcttagaatcccttcgaatgttaacaagtattatatccatgataattttattcctatcgagaaatatcagtttagtctttacccagtatttatggaaggagttggaaaaccaaagataattaatggtttcaccaaagatgatatcgccaaacagcaaaatgatgcagggctgtatgtcattgtaccgataattatttcctcttgtgtcctgctgctcggaacactgttaatttcacaccagagaatgaaaaagttgttttgggacgatgttccaaaccccaagaattgttcctgggcacaaggacttaatttccaaaagcctgaaacatttgagcatctttttaccaagcatgcagaatcagtgatatttggtcctcttcttctggagcctgaaccagtttcagaagaaatcagtgtcgatacagcttggaaaaataaagatgagatggtaccagcagctatggtctcacttcttttgaccactccagattccacaaggggttctatttgtatcagtgaccagtgtaacagtgctaacttctctggggctcagagcacccagggaacctgtgaggatgagtgtcagagtcaaccctcagttaaatatgcaacgctggtcagcaacgtgaaaacagtggaaactgatgaagagcaaggggctatacatagttctgtcagccagtgcatcgccaggaaacattccccactgagacagtctttttctagcaactcctgggagatagaggcccaggcatttttccttttatcagatcatccacccaatgtgatttcaccacaactttcattctcagggttggatgagcttttggaactggagggaaattttcctgaagaaaatcacggggaaaaatctgtgtattatctaggagtctcctcaggaaacaaaagagagaatgatatgcttttgactgatgaggcaggggtattgtgcccattcccagctcactgtctgttcagtgacatcagaatcctccaggagagttgttcacactttgtagaaaataatttgaatttagggacctctggtaagaactttgtaccttacatgccccagtttcaatcctgttccactcacagtcataagataatagaaaataagatgtgtgacttaactgtgtaatcttgtccaaaaacttccaggttccattccagtagagtgtgtcatgtataatatgttcttttatagttgtgggtgggagagaaagcc

SEQ ID NO: 3085 - DNA, 1605 bp, Rattus norvegicus
  Genbank Accession No. NM_012597
cgcatgggaaatcacctccaaatctccgtttccctggtgctgtgcatctttatccagtcaagtgcctgtggacaaggcgtgggaacagagccctttggaagaaaccttggagctactgaagaaaggaaaccgttacagaagccagagatcagattcctgctcttcaaagatgaaagtgaccgcctgggttgtcagctcagacctcagcacccggaaacactgcaggagtgtggcttcaacagctcccatccacttgtcatgatcatccacgggtggtcggtggatggcttgctagaaacctggatctggaagatagtgggtgccctgaagtcccgacagtcccaacccgtgaacgtgggattagtggactggatctccctggcataccagcactatgctattgccgtgcgcaacacccgtgttgtgggccaggaggtggctgctcttctcctatggctggaggaatctatgaagttttctcggagcaaagttcacttaattgggtacagcctgggagcacacgtttcaggattcgcaggcagctccatgggtgggaagcgcaagatcggaagaatcacagggctggaccctgcaggacctatgtttgagggaacttcccccaatgagcgcctttctccagatgatgccaattttgtggatgctattcatacctttaccagggagcacatgggtctgagtgtgggcatcaaacagcccattgcccactatgacttctaccccaacgggggctccttccagcctggctgccacttcctggagctctacaaacacattgcagagcatggcttaaatgccataacccagaccatcaactgtgcccatgagcgttctgtgcacctcttcattgactccttgcaacacagcaacctgcagaacacaggcttccagtgcagcaacatggacagcttcagtcagggtctatgtctgaactgcaagaagggccgttgcaacagtctgggctatgacatccgcaggatcggccacgtcaagagcaagacactcttcctcatcacccgagcccagtcccccttcaaagtttatcattaccagttcaagatccagttcatcaatcaaatggagaagccaatggagcctacttttaccatgacactgctggggacaaaagaagaaataaagaaaattcccatcaccctgggcgaaggaattaccagcaataaaacctattccttacttatcacactgaacaaagacatcggcgagttgatcatgctcaagttcaagtgggaaaacagcgcagtgtgggccaatgtctggaacacagtgcagaccataatgctatgggacacagagcctcactacgcgggcctcattgtgaagaccatctgggtcaaagctggagagacgcagcaaagaatgacattttgccctgataatgtggatgatctccagcttcaccccacccaggagaaagtcttcgtgaaatgtgacctgaagtcaaaagactgaagaagcaaaagagcagatgagtcaagagacccaagcacaaaataaatagactattctttatctgtaatggttgccttattcggaagccaaattacacaaaggatcatgcataaactt

SEQ ID NO: 3086 - DNA, 717 bp, Rattus norvegicus
  Genbank Accession No. NM_012599
atgctcctgcttccactgctcgtccttctctgtgtagtgagcgtgtcctcatcagggtcacaaacctgtgaggaaaccctgaagacttgctctgtgatagcctgcggcagagacgggagagatgggcccaaaggggagaagggagaaccaggtcaagggctcaggggcttgcagggccctccagggaaactggggcctccaggaagtgtaggagcccctggaagtcaaggaccaaaaggccaaaaaggggatcgtggagacagcagagccattgaggtgaagctggcaaatatggaggcagagataaacaccctgaagtcaaaactggagctaaccaacaagttgcatgccttctccatgggtaaaaagtctgggaagaagttctttgtgaccaaccatgaaaggatgcccttttccaaagtcaaggccctgtgctcagagctccgaggcactgtggctatccccaagaatgctgaggagaacaaggccatccaagaagtggctaaaacctctgccttcctaggcatcacggacgaggtgactgaaggccaattcatgtatgtgacaggggggaggctcacctacagcaactggaaaaaggatgagcccaatgaccatggctctggggaagactgtgtcactatagtagacaacggtctgtggaatgacatctcctgccaagcttcccacacggctgtctgcgagttcccagcctga

SEQ ID NO: 3087 - DNA, 1761 bp, Rattus norvegicus
  Genbank Accession No. NM_012600
atggatccccgagccccccgccgccgacacacccaccagcgcggctacctgctgacgcgggacccgcatctcaacaaggacttggcttttactctggaagagaggcaacagctgaagattcatggcttgttgccaccctgcattgtcaaccaggagatccaggtccttagagtaattaagaatttcgagcgtctgaactctgacttcgacaggtatcttctgttaatggatctgcaagataggaatgagaagctcttctacagtgtgcttatgtctaatgttgaaaagttcatgcctatcgtttacactcccaccgtgggtcttgcatgccagcaatacagtttggcattccggaagccaagaggcctctttatcagtatccacgacaaagggcatattgcttcagttcttaacgcatggccagaagatgttgtcaaggctattgtggtgactgatggagagcgaatcctcggcttgggcgaccttggttgtaacgggatgggcatccctgtgggtaaactggccctgtacacagcgtgcggaggggtgaatccacaacagtgtctacccatcactttggacgtcggcacagaaaatgaggagttacttaaagatcccttgtatattgggctgcggcacaggcgagtgagaggccctgaatatgatgcgtttttggatgaattcatggaggcagcgtcttccaaatatggcatgaattgccttattcagtttgaagattttgccaatctgaatgcatttcgtctcctgaacaagtatcgaaacaagtattgcacatttaacgatgatattcaaggaacagcgtctgtggcagttgccggccttcttgctgctcttcggataaccaagaacaagctctctgatcagacagtgctgttccagggagccggcgaggctgccttggggattgctcatctgattgttatggccatggagaaggaaggtttatcaaaggagaaagctagacaaaagatatggttggttgactcaaaaggattaatagttaaggggcgtgcttctctcacagaagagaaagaggtgtttgcccatgaacatgaagaaatgaagaacctagaagccattgttcagaagataaaaccaaccgctctcataggagttgctgcaattggtggtgctttcacagaacaaattctcaaggatatggctgccttcaacgagcggcccatcatctttgctttgagtaatccgaccagcaaagctgagtgttctgcagaggagtgctataaagtgaccaagggccgtgcgatctttgccagcggcagtccttttgatccagtcactcttccagatggacggactctgtttcctggccaaggcaacaactcctatgtgttccctggagttgctcttggggtagtggcctgtggactgagacacatcaatgattcggtcttcctcaccacggctgaggtcatatcccagcaagtgtcagataaacacctagaagaaggccggctctatcctcctttgaataccatccgagatgtttccttgaaaatcgcagtaaagattgtgcaagatgcatacaaagaaaagatggccactgtttatcctgaaccccaaaacaaagaagaatttgtctcctcccagatgtacagcactaattatgaccagatcctacctgattgttattcgtggcctgaagaagttccagaaaatacagaccaaagtcaatcagtaacacaacagctagaatttttaactttattaataagatcttga

SEQ ID NO: 3088 - DNA, 2168 bp, Rattus norvegicus
  Genbank Accession No. NM_012603
actcgctgtagtaattccagcgagagacagagggagtgagcgggcgggttggaagagcccagtgtgcagagccccactccgggcttcctaggaaggcagctctggagtgagaagggctttgcctccaggcttgctgcctcctcgacccaatcctcccgctgacccaacatcagcggtcgcaaccctcgccgcctctgggaaactttgcccattgcaacgggcagacacttctcactggaacttacaatctgcgagccaggacaggactccccaggcgcaggggagggaatttttgtctatttggggacagtgttctctgcctctgcccgcgatcggctcccctgaaaagagctcctcgcgttatttgaagcctgaatttcctttgggaggtggaaaacccgacagtcacgacgatgcccctcaacgtgagcttcgctaacaggaactatgacctcgactacgactcggtgcagccctatttcatctgcgacgaggaagagaatttctatcaccagcaacagcagagcgagctgcagccgcccgcacccagtgaggatatctggaagaaattcgagctgctgcccaccccgcccctgtcccccagccgccgctccgggctctgctctccgtcctatgtcgcggtcgctacgtccttctccccaagggaggacgatgacggtggcggtggcaacttctccaccgccgatcagctggagatgatgaccgagctacttggaggagacatggtgaatcagagcttcatctgcgatcctgacgatgagaccttcatcaagaacatcatcatccaggactgtatgtggagcggcttctcggccgctgccaaactggtctccgagaagctggcctcttaccaggctgcgcgcaaagacagcaccagcctgagccccgcccgcgggcacagcgtctgctccacctccagcctgtacctgcaggacctcaccgccgcagcgtccgagtgcatcgacccctcagtggtcttcccctacccgctcaacgacagcagctcgcccaaatcctgtacctcgtccgattccacggccttctcttcttcctcggactcgctgctgtcctccgagtcctccccacgggccacccctgagcccctagtgctgcatgaagagacaccgcccaccaccagcagcgactctgaagaagaacaagatgatgaggaagaaattgatgtggtgtctgtggaaaagaggcaaccccctgccaagaggtccgagtcagggtcatccccatcaagaggccacagcaaacctccacacagcccactggtcctcaagaggtgccatgtctctactcaccagcacaattatgcagcacccccctccacaaggaaggactatccagctgccaagagggccaagttggacagtggcagggtcctgaaacagatcagcaacaaccgcaaatgctccagccccaggtcctcagacaccgaggaaaacgacaagaggcggacacacaacgtcttggaacgtcagaggagaaacgagctgaagcgtagcttttttgccctgcgcgaccagatccctgagttggaaaacaacgaaaaggcccccaaggtagttatcctcaaaaaagccaccgcctacatcctgtccgttcaagcagatgagcacaaactcatctcagaaaaggacttactgaggaaacggcgagaacagttgaaacacaaactcgaacagcttcgaaactctggtgcataaactgaccggaagtgaggaggagctggaatctcgagtgtaaggagaacggttccttctgacagaacttggacttcaaaaaatgcatgctcaaagcctaacctcacaaccttggctggggctttgggacttcagccataatgttaactgcctcaaagttaaggcataaaagaacttttttttatgcttcccatcttctttctttttcctttaacagatttgtatttaattgttttttttaaaaaaatcttccggtgtacatagggcctttaaatgtaaataactttaataaaacgtttataacagttatacaagattttaagacatgtatgataaaccataattttttttatttaaagaccttttcatttttaaagttgatttttttctattgtttttagaaaaaataaaataattggaaaaaatataattgagcca

SEQ ID NO: 3089 - DNA, 3243 bp, Rattus norvegicus
  Genbank Accession No. NM_012608
gcggagatgtgcaagtggcgaagctggaccgagtgcaggcgcaagctgctgagcggctgaggcgagggattttaggtgatgggaagatcagaaagtcagatggatattactgatatcaatgctccaaagccgaagaagaaacagcgatggactccactggagatcagcctttctgtgctcgtcttgctcctgactatcatagctgtgacaatgattgctctctatgcaacctatgatgatggtatttgcaaatcatcagactgcataaaatcagctgctcgactgatccagaacatggatgcctctgctgagccatgtacggacttcttcaaatatgcttgtggaggctggttgaaacgcaatgtcatccctgagaccagttcccgatacagtaattttgacattctaagagatgaactagaagtcattttgaaagatgtccttcaagaacccaaaactgaggacatagtagcagtgcagaaagcaaaaactttgtacagatcatgtataaatgaatctgctattgatagcagaggtgggcaacctctgctcacactgttaccagatatatatgggtggccagtagcatcacaaaactgggaacaaacatatggtacttcttggacagctgagaaatctattgcacaactgaattctaaatatgggaaaaaggtcctcattaatttttttgttggcactgatgataagaattctacccagcatataattcattttgaccagcctcgacttggcctcccttccagagactactatgagtgtacaggaatatataaagaggcttgcacagcatatgtggattttatgatttctgtggccagactgattcgtcaggaacaaagattgcctattgatgaaaaccagctctctttggaaatgaataaagttatggaattggaaaaagaaattgccaatgccacaactaaaccagaagaccgaaatgacccaatgctgctttataacaaaatgacattggccaagctccaaaataacttctctctggagatcaatgggaagccattcagctggtcaaatttcacaaatgaaatcatgtcaactgtgaatattaatattcaaaatgaggaagaagtggttgtttatgctccagaatatttaaccaaacttaagcctattcttaccaaatattctcccagagatcttcaaaatttaatgtcctggaggttcataatggatcttgtaagcagcctcagccgaaactacaaggagtccagaaatgctttccgcaaggccctttacgggactacatccgaaactgcaacctggagacggtgtgccaactacgtcaatgggaacatggagaatgctgtggggaggctttatgtggaagcagcttttgctggagagagcaagcacgtggttgaagatttgattgcacaaatccgtgaagtttttattcagactttagatgacctcacttggatggatgctgagacaaaaaagaaagctgaagagaaggccctggcaattaaagaaaggattggctatcctgatgacatcatctccaatgagaataaactgaataatgagtatcttgagttgaactacaaggaagaggaatactttgagaacataattcaaaatttgaaattcagccaaagcaagcagctaaagaagctccgagaaaaggtggacaaagatgagtggataagtggcgcggcggtagtcaatgcattttattcctcaggcagaaatcagatcgtcttccccgccggcattttgcagcccccattctttagtgctcggcagtccaactcattgaactatgggggcatcggcatggtcatcggacatgaaatcacacatggctttgatgacaatggcagaaattttaacaaagatggagacctcgttgactggtggactcagcagtctgcaaataatttcaaagaccaatcccagtgtatggtgtaccagtatggaaactttacatgggacctagcaggtggacagcatctcaatggaattaacacactaggagaaaatattgctgataatggagggattggccaagcatacagagcctatcagaattatgttaaaaagaatggtgaagaaaaattactccctggacttgacctcaatcacaaacaactattcttcttgaactttgcccaggtgtggtgtggaacctaccggccagagtatgcagtcaattccattaaaacagatgtacacagtcctggcaatttcaggatcattgggactttgcagaactctgctgagtttgcggatgcctttcattgccgcaagaactcatacatgaatccagaaaggaaatgtcgggtttggtgatcttcacaggaagtggagcatccatggcaggactcgccaaagccacagaaacaggaagtcttccctcagagaacgtgggccccggaagtttcttcagcttcttgggggaaattcacagagatgagcacgagctaacaaaaatgaaattagattattaaaaccgctgtgaatgaaaggggagaaaacctacgatctagcaaatcaatcacttcactgtgtaaataattaccttccaacggtaatattaccgttcacttctggttctcacacagactgcagctttcatgctgtctgtagagaacagtgttaacacttaaagcaggttatgacttctgatcaagaggaggaagacgctgaatacagttgggcaccaaagtacagatttgcctctcagcactcacttttgtttgcaacattcagctccttcaaaattctcccaaagaacccccatgcatactgtggccttcaggctcctgcagtgtggaactcattttaccatgcataaattattcattcattccacatcattttagtttgagcactcttagagcttaaactagagagtctgaaatggttccgccatttacccacttgagtggtgttgagactcttcagccccctacagatttttgagcaatttcttgctctcgctgcccctcagacttagtcttttaaaggatttgtagtaatgtataaaaaacattctatatttaattattaactacacatgaccaaataaaccattgctataggtaatcattgaatattgacattatatggccaagatagatagttaagaagatctgtaacatgatgtgcagatgaaaatttgaaactttttaagcctgtaaatcatattgctgaaaatcttcaaacacaaactctggggtgagcattaccattgaacagttg

SEQ ID NO: 3090 - DNA, 790 bp, Rattus norvegicus
  Genbank Accession No. NM_012612
ggctgagagagaaaccagagagtgagccgagacagcaaacatcagatcgtgccccgacccacgccagcatgggctccttctccatcaccaagggcttcttcctcttcctggccttttggctcccaggccatattggagcaaatcccgtatacagtgcggtgtccaacacagatctgatggatttcaagaacctgctagaccacctggaggagaagatgccggtagaagatgaggtcatgcctccgcaggccctgagcgagcagaccgatgaagcgggggcggcacttagctccctctctgaggtgcctccctggactggggaagtcaacccgtctcagagagatggaggtgctctcgggcgcggcccctgggacccctccgatagatctgccctcttgaaaagcaaactgagggctctgctcgctggccctcggagcctgcgaaggtcaagctgcttcgggggtaggattgacaggattggagcccagagcggactaggctgcaacagcttccggtaccgaagataacagccaaatctgctcgagcagatcgcaaaagatcccaagccttgcggtgtgtcacacagcttggtcgcattgccactgagaggtggtgaataccctcctggagctgcagcttcctgtcttcatctatcacgatcgatgttaagtgtagatgagtggtttagtgaggccttacctctcccactctgcatattaaggtagatcctcacccctttcagaaagcagttggaaaaaaataaatccgaataaacttcagcaccacggac

SEQ ID NO: 3091 - DNA, 539 bp, Rattus norvegicus
  Genbank Accession No. NM_012614
caagctcattcctcgcagaggcgcccagagcagagcacccgctgcgcagagaccacagcccgcccgccatgatgctaggtaacaaacgaatggggctgtgtggactgaccctcgctctatccctgctcgtgtgtttgggcattctggctgaggggtacccctccaagccggacaatccgggcgaggacgcgccagcagaggacatggccagatactactccgctctgcgacactacatcaatctcatcaccagacagagatatggcaagagatccagccctgagacactgatttcagatctcttaatgagagaaagcacagaaaatgcccccagaacaaggcttgaagacccttccatgtggtgatgggaaatgaaacttgctctcctgacttttcctagtttccccccacatctcatctcatcctgtgaaaccagtctgcctgtcccacccaatgcatgccaccaccaggctggattccgacccatttcccttgttgtcgttgtatatatgtgtgtttaaataaagtatcatgcattc

SEQ ID NO: 3092 - DNA, 2442 bp, Rattus norvegicus
  Genbank Accession No. NM_012615
gacagaaaacctagagatggaattaaattatggccagctctcacaaggtcaactttgatgtattacgtgaatgatggagtgtatgggtcatttaactgcattctttatgaccatgcacatgtcagtccctgcagccgccgccgccggccgccttcagtcagcagctcggcgccacctccggtcggcgactgcggcgggctcgacgaggcggctgacggggcggcggcgggaagacggccgggtgcgccttggggtttagtggcggcttctccatgggtccagccagccgcttccctgtgctgtgagtgtttccaccactccaggagacagcattcagagttgaccttgtgagagctggccataatttaattccatctctaggttttctgtcttattgtttcagaggcacatcgagaaccaaccatgggcagctttactaaggaagagtttgactgccatatcctcgatgaaggtttcactgctaaggacattctggaccaaaaaatcaatgaagtttcttcctctgatgataaggatgctttctatgttgcggacctcggagacgttctaaagaagcatctgaggtggctgaaagctcttccccgtgttactcccttctatgctgtcaagtgtaatgacagcagagccatagtgagcaccctggctgccattgggacaggatttgattgtgcaagcaagactgaaatacagttggtgcaggggcttggggtgcctccagagaggattatctatgcaaatccttgtaagcaagtgtctcagatcaagtatgctgccagtaatggagtccagatgatgacttttgacagtgaaattgagttgatgaaagttgccagagcacatccaaaggcaaagttggttttgcggattgccactgatgattccaaagcagtttgtcggctcagtgttaagtttggtgccacactgaaaaccagcaggcttctcttggaacgggcaaaagagctaaatattgatgtcattggtgtcagcttccatgtgggcagtgggtgtactgaccctgagaccttcgtgcaggcagtgtcagatgcccggtgtgtctttgacatgggaacagaagttggtttcagcatgtatctgcttgacattggtggtggctttcctgggtctgaagacacgaagcttaaatttgaggagatcaccagtgtaatcaacccagctctggacaagtacttcccatcggactctggagtgagaatcatagctgagccaggcagatactacgtcgcatcagctttcacacttgcagtgaatatcattgccaaaaaaaccgtgtggaaggagcagaccggctcggacgatgaagatgagtcaaacgagcaaactttgatgtattacgtgaatgatggagtgtatgggtcatttaactgcattctttatgaccatgcacatgtgaaggccctgctgcagaagagacccaagccagatgagaagtattactcatccagcatctggggaccaacatgtgatggccttgatcggatcgtcgagcgctgtagcctgcctgaaatgcatgtgggtgattggatgctgtttgagaacatgggtgcatacactgttgctgctgcttctactttcaatgggttccagaggccaaacatctactacgtaatgtcacggtcaatgtggcaactcatgaagcaaatccagagccatggcttcccgccagaagtggaggagcaggatgttggcactctgcccatgtcttgtgcccaggagagcgggatggaccgtcaccctgcagcctgtgcttctgctagtatcaatgtatagatgccattcttgtagctcttacctgcaagtttagcttgagttcacggcatttggggggaccatttaacttaattactgctagtttggaatgtctttgtaagagtagggttggcaccaatgcagtatggaaagactaggagatgggggtcacacttactgtgttcctatggaaactttgaatattttatatggatttttattcacttttcagacctgatactaatgagtgcccctcggctgctgagcaagcatttgtagcttgtacattggcagaatgggctaaaagcttatgttgtgacccattttgaaaataaagtatcttgaaatgattggacattggagaatgtgtgcaagtatcccttacagaaggcacaaacttctgcacaggctgtgtgttacagcagtgagtctagcccagcagagatgtggatgatacaaagctgtgccccctctgtacagcatcaatgtgcttagcccatctcaagtgtttactgtgaacttggtgcccaaagtctcttaagagtgtcatctgcctagtggcctcttgacttggccacttcctaaggagagggcatctgaggctctttgaaccttgcctgcagaaaccctgactgctccctcaacccttggccg

SEQ ID NO: 3093 - DNA, 1998 bp, Rattus norvegicus
  Genbank Accession No. NM_012619
agccctcccatcctgagtgccaacctttcccaaccccgctgctaagctagacacctcactcactgagagccagcatggcagctgttgtcctggagaatggagtcctgagcagaaaactctcagactttgggcaggaaacaagctatattgaagacaactccaatcaaaatggtgccatatctctgatattctcactcaaagaggaagttggtgccctagccaaggtcctgcgcttatttgaggagaacgatatcaacctgacacacattgaatccagaccttctcgtttaaacaaagatgagtatgagttcttcacttatctggataagcgtacgaaacctgttctgggcagcatcatcaagagcctgaggaatgacattggtgccactgtccacgagctttcccgagacaaggaaaagaacacagtgccctggttcccaaggaccattcaggagttggaccgattcgccaatcagattctcagctatggagccgaactggatgcggaccacccaggctttaaagatcctgtgtaccgggcgagacgaaagcagtttgctgacattgcctacaactaccgccatggccagcccatccctcgggtggaatacacagaggaagagaagcagacctggggaacggtgttcaggaccttgaaggccttgtataaaacacatgcctgctacgagcacaaccacattttcccacttctggaaaagtactgcggtttccgtgaagacaacattccacagctggaagatgtttctcaatttctgcagacttgtactggtttccgcctccgacctgttgctggcttactgtcatctcgagatttcttgggtggcctggccttccgagtcttccactgcacacagtacattaggcatggatcgaagcccatgtacacacctgaacctgacatctgccatgaactcttgggacatgtgcctttgttttcagatcgcagctttgcccagttttctcaggaaattgggcttgcatcactgggggcacctgatgagtacattgagaaactggccacaatttactggtttactgtggagtttgggctttgcaaggaaggagattctataaaggcatatggtgctgggctcttgtcatcctttggagaattacagtactgtttatcagacaagccaaagctcctccccctggagctagagaagacagcctgccaggagtattctgtcacagagttccagcccttgtactacgtggcggagagtttcagtgatgccaaggagaaagtgaggacttttgctgccacgatccctcggcccttctcggttcgctatgacccttacactcaaagggttgaggtcctggacaatactcagcagttgaagattttagctgactccattaatagtgaggtcggaatcctttgcaatgccctgcagaagataaagtcgtgagcagaaaatgacgtcatgggcagaacttaggaggtcaaccagaaatcggtcgatagaagtatagtaactgcctttgttcccctgaagaaaaaaagttttatttgaaacgtcagcttttattatttttgctaacacagtggagcatcaccaaataaatcaaagttctctgaaatgaaagtgtgttaaaaccctccaggggtagatctttcagaatcacatttgatttagataatctcatagcttcaatttggtttaaaatgtaattttctcagctctcatcaacattcatcaaatttggggcttgtgtcattggggcttcatccgttcatttttaacctctcaggtaagctctgaaggaacacatttggctgagtgtaaaatgtaagactgccatcagggatgaatcattccgttcagtacagattgtaatctacaaagggtagttttcaccttcgttcattatggctctgagaactgctttgttagcctgcttacataaatctcccctgatcggagaccctattaagatagttacaagcaataaagttttagagcattatat

SEQ ID NO: 3094 - DNA, 1898 bp, Rattus norvegicus
  Genbank Accession No. NM_012621
cgcccacttgtacatctgggagcagaagaaaaagagggagctggagataatctgtgagaggctccgaagcccagtacatccccctgactcagccctcgcccacctcgctgctgtgactacagcaacagacaagacagctaggaagataggaagtgaggtccaataccttgtgggcagtggtgtcattagctgcaacgctaagatgtctcgagagatgggagaactcactcaaaccaggttacagaagatctggattccacacagcagcagtagcagcgtgctgcaacggcgaaggggctcctccataccacagttcactaattctcccacgatggtgatcatggtgggtttaccagctcgaggcaagacctacatctctacgaagctcacacgctatctcaactggataggaacaccaactaaagtgtttaatttaggtcagtatcgacgagaggcagtgagttacaggaactatgaattctttcgcccagacaacacagaggcccagcttatcaggaagcagtgtgctctagcagccctaaaggatgtccataagtatctcagccgcgaggaaggtcatgttgcggtttttgatgccaccaactataccagagaacggagatcgttgattctacagtttgctaaggaacatggttataaggttttttttattgagtctatttgtaatgaccccgaaattattgcagaaaacatcaagcaagtgaaacttggtagtcctgattacatagactgtgaccaagaaaaggttttggaagactttctaaagagaatagagtgctatgagatcaactaccaacctttggatgaggaattggacagccacctgtcctacatcaagatcttcgacgtgggcacacgctacatggtaaatcgagtgcaggaccacgttcagagccgtacagcctactacctcatgaacatccatgtcacacctcgatctatctacctatgccgccatggtgagagtgaactcaaccttagaggccgcattggaggtgactctggcctctcagctcggggcaagcagtatgcctatgcactagccaacttcatccggtctcaaggcatcagctccctgaaagtatggactagccacatgaagaggaccattcagaccgctgaagccctaggtgtcccctatgaacagtggaaggccctgaatgagattgatgcgggtgtctgtgaagagatgacctatgaagaaattcaggaacactaccctgaggaatttgcactacgggaccaggataaatatcgttaccgctatccgaagggagagtcctatgaggatctggttcagcgtcttgaaccagttataatggagctagaacggcaagaaaatgtactggtgatctgtcaccaggctgtcatgcggtgcctcctggcatacttcctggataaaagttcagatgagctgccctatctcaagtgtcctctgcatactgtgctcaaactcacacctgtggcttatggctgcagagtggagtccatctacctgaatgtggaggctgtgaacacacaccgggacaagcctgagaatgtggacatcacccgtgaagctgaggaagccttggacactgtacctgcccattactgagccttttcaagtgatcagattgtctctgtgctcacccccttcctcctgtaggagctgctgcccttgttctcgcttaagcagactctggctatggcctgagagtgccctacctccagtgaagaagtccgtagcagctcccaaacaggtctcaattcctagccacaactaaggcacctacctagttgtggataaagttccgttttaaatattctctgataaataaagatgtttatttctgcctataggacaggaagaggttataaagcttctttcattgcgg

SEQ ID NO: 3095 - DNA, 1635 bp, Rattus norvegicus
  Genbank Accession No. NM_012630
ggtcaagcgagctggattctagggaaacatagaagagtaatcatccagagaggggctctggtggagctcactagccattgactgttcttttcagaagtctggactccctgacctacaaggcctctcaagctaaaggacacttctctgtgaagggagcctctgatacattgcctatagcaagaagaaggggccaacctgaagaaaaacatgccatctgcacttgctttcgtcctacttgttctcaacatcagcctcctgaagggacagtcaccaccagggaaacctgagatccacaaatgtcgctctcctgacaaggaaacattcacctgctggtggaatcctgggacagatggaggacttcctaccaattattcactgacttacagcaaagaaggagagaaaaccacctacgaatgtccagactacaaaaccagtggccccaactcctgcttctttagcaagcagtacacttccatctggaaaatatatatcatcacagtaaatgccacgaaccaaatgggaagcagttcctcggatccactttatgtggatgtgacttacatcgttgagccagagcctcctcggaacctgacattagaagtaaaacagctaaaagacaaaaaaacatatctgtgggtaaaatggtccccacccaccataactgatgtgaaaactggttggtttacaatggaatatgaaattcgattaaagcctgaagaagcagaagagtgggagatccattttacaggtcatcaaacacagtttaaagtttttgacctatatccagggcaaaagtatcttgtccagactcgctgcaagccagaccatggatactggagtagatggagccaggagagttccgttgaaatgccaaatgacttcaccttgaaggacacaaccgtgtggatcattgtggccattctctctgctgtcatctgtttgattatggtctgggcagtggctttgaagggctatagcatgatgacctgcatctttccaccagttcctgggccaaaaataaaaggatttgatacccatctgctggagactggttctccaagcaaatacaaggtggatctgtacctggcccttcctggaggattccagaaactggacaatgcaggggaacttgactactgaagctgcagactcaaataggagcctctcaaaatgggttctaccaccatcgcaacaaatgctgagaacaagacagaaatttcccagtgccaataatctagtatccaggacgcctgcctggttagactttaaatttgctcaatgacaaacgagatcagtgttaattgtgtttcttgagcagctctcgtttgtttttctcttttgtcagcctcagccatctgccatcttgatccctcagtctcacgtggtgatatctatctttctgtgtgtgtgtgtatctctgtgtgtctctctgtgtcatctctctgtctctatgtgtctctgttcctctgtgtcttcctttgtcctttgtgttctctctctctctctctctctctctctctctctctctctctctctctctccaacttgcttcatgcttttctgggcttgagtgtgcttaagaaaacacattttacgatcatcagaataaccccccctttaaataaaaaactgtcc

SEQ ID NO: 3096 - DNA, 765 bp, Rattus norvegicus
  Genbank Accession No. NM_012631
atggcgaaccttggctactggctgctggccctctttgtgactacatgtactgatgttggcctctgcaaaaagcggccaaagcctggagggtggaacactggtggaagccggtaccctgggcagggaagccctggaggcaaccgttacccacctcagagtggtggtacctgggggcagccccatggtggtggctggggacaacctcatggtggtggctggggacaacctcatggtggtggctggggtcagccccatggcgggggctggagtcaaggagggggtacccataatcagtggaacaagcccagcaagccaaaaaccaacctcaagcatgtggcaggggctgccgcagctggggcagtagtggggggccttggtggctacatgttggggagtgccatgagcaggcccatgctccattttggcaacgactgggaggaccgctactaccgagaaaacatgtaccgttaccctaaccaagtgtactacaggccggtggatcagtacagcaaccagaacaacttcgtgcacgactgtgtcaatatcaccatcaagcagcatacagtcaccaccaccaccaagggggagaacttcacggagaccgacgtgaagatgatggagcgtgtggtggagcagatgtgcgtcacccagtatcagaaggagtcccaggcctattacgacgggagaagatctagcgccgtgcttttctcctcccctcctgtgatcctcctcatctccttcctcatcttcctgatcgtgggatga

SEQ ID NO: 3097 - DNA, 4127 bp, Rattus norvegicus
  Genbank Accession No. NM_012637
agccgctgctggggaggttggggctgaggtggtggcgggcgacgggcctcgagacgcggagcgacgcggcctagcgcggcggacggccgagggaactcgggcagtcgtcccgtcccgccatggaaatggagaaggaattcgagcagatcgataaggctgggaactgggcggctatttaccaggatattcgacatgaagccagtgacttcccatgcagaatagcgaaacttcctaagaacaaaaaccggaacaggtaccgagatgtcagcccttttgaccacagtcggattaaattgcatcaggaagataatgactatatcaatgccagcttgataaaaatggaggaagcccagaggagctatatcctcacccagggccctttaccaaacacgtgcgggcacttctgggagatggtgtgggagcagaagagcaggggcgtggtcatgctcaaccgcatcatggagaaaggctcgttaaaatgtgcccagtattggccacagaaagaagaaaaagagatggtcttcgatgacaccaatttgaagctgacactgatctctgaagatgtcaagtcatattacacagtacggcagttggagttggagaacctggctacccaggaggctcgagagatcctgcatttccactacaccacctggcctgactttggagtccctgagtcacctgcctctttcctcaatttcctattcaaagtccgagagtcaggctcactcagcccagagcacggccccattgtggtccactgcagtgctggcattggcaggtcagggaccttctgcctggctgacacctgcctcttactgatggacaagaggaaagacccgtcctctgtggacatcaagaaagtgctgttggagatgcgcaggttccgcatggggctcatccagacggccgaccaactgcgcttctcctacctggctgtgatcgagggtgcaaagttcatcatgggcgactcgtcagtgcaggatcagtggaaggagctttcccatgaagacctggagcctccccctgagcacgtgcccccacctccccggccacccaaacgcacattggagcctcacaatggcaagtgcaaggagctcttctccaaccaccagtgggtgagcgaggagagctgtgaggatgaggacatcctggccagagaggaaagcagagccccctcaattgctgtgcacagcatgagcagtatgagtcaagacactgaagttaggaaacggatggtgggtggaggtcttcaaagtgctcaggcatctgtccccactgaggaagagctgtccccaaccgaggaggaacaaaaggcacacaggccagttcactggaagcccttcctggtcaacgtgtgcatggccacggccctggcgactggcgcgtacctctgttaccgggtatgttttcactgacagactgctgtgaggcatgagcgtggtgggcgctgccactgcccaggttaggatttggtctgcggcgtctaacctggtgtagaagaaacaacagcttacaagcctgtggtggaactggaagggccagccccaggaggggcatctgtgcactgggctttgaaggagcccctggtcccaagaacagagtctaatctcagggccttaacctgttcaggagaagtagaggaaatgccaaatactcttcttgctctcacctcactcctcccctttctctggttcgtttgtttttggaaaaaaaaaaaaaagaattacaacacattgttgtttttaacatttataaaggcaggtttttgttatttttagagaaaacaaaagatgctaggcactggtgagattctcttgtgccctttggcatgtgatcagattcacgatttacgtttatttccgggggagggtcccacctgtcaggactgtaaagttcctgctggcttggtcagcccccccacccccccaccccgagcttgcaggtgccctgctgtgaggagagcagcagcagaggctgcccctggacagaagcccagctctgcttccctcaggtgtccctgcgtttccatcctccttctttgtgaccgccatcttgcagatgacccagtcctcagcaccccacccctgcagatgggtttctccgagggcctgcctcagggtcatcagaggttggctgccagcttagagctggggcttccatttgattggaaagtcattactattctatgtagaagccactccactgaggtgtaaagcaagactcataaaggaggagccttggtgtcatggaagtcactccgcgcgcaggacctgtaacaacctctgaaacactcagtcctgctgcagtgacgtccttgaaggcatcagacagatgatttgcagactgccaagacttgtcctgagccgtgatttttagagtctggactcatgaaacaccgccgagcgcttactgtgcagcctctgatgctggttggctgaggctgcggggaggtggacactgtgggtgcatccagtgcagttgcttttgtgcagttgggtccagcagcacagcccgcactccagcctcagctgcaggccacagtggccatggaggccgccagagcgagctggggtggatgcttgttcacttggagcagccttcccaggacgtgcagctcccttcctgctttgtccttctgcttccttccctggagtagcaagcccacgagcaatcgtgaggggtgtgagggagctgcagaggcatcagagtggcctgcagcggcgtgaggccccttcccctccgacacccccctccagaggagccgctccactgttatttattcactttgcccacagacacccctgagtgagcacaccctgaaactgaccgtgtaaggtgtcagcctgcacccaggaccgtcaggtgcagcaccgggtcagtcctagggttgaggtaggactgacacagccactgtgtggctggtgctggggcaggggcaggagctgagggtcttagaagcaatcttcaggaacagacaacagtggtgacatgtaaagtccctgtggctactgatgacatgtgtaggatgaaggctggcctttctcccatgactttctagatcccgttccccgtctgctttccctgtgagttagaaaacacacaggctcctgtcctggtggtgccgtgtgcttgacatgggaaacttagatgcctgctcactggcgggcacctcggcatcgccaccactcagagtgagagcagtgctgtccagtgccgaggccgcctgactcccggcaggactcttcaggctctggcctgccccagcacaccccgctggatctcagacattccacacccacacctcattccctggacacttgggcaagcaggcccgcccttccacctctggggtcagcccctccattccgagttcacactgctctggagcaggccaggaccggaagcaaggcagctggtgaggagcaccctcctgggaacagtgtaggtgacagtcctgagagtcagcttgctagcgctgctggcaccagtcaccttgctcagaagtgtgtggctcttgaggctgaagagactgatgatggtgctcatgactcttctgtgaggggaacttgaccttcacattgggtggctttttttaaaataagcgaaggcagctggaactccagtctgcctcttgccagcacttcacattttgcctttcacccagagaagccagcacagagccactggggaaggcgatggccttgcctgcacaggctgaggagatggctcagccggcgtccaggctgtgtctggagcagggggtgcacagcagcctcacaggtgggggcctcagagcaggcgctgccctgtcccctgccccgctggaggcagcaaagctgctgcatgccttaagtcaatacttactcagcagggcgctctcgttctctctctctctctctctctctctctctctctctctctctctctctctaaatggccatagaataaaccattttacaaaaataaaagccaacaacaaagtgctctggaatagcacctttgcaggagcggggggtgtctcagggtcttctgtgacctcaccgaactgtccgactgcaccgtttccaacttgtgtctcactaatgggtctgcattagttgcaacaataaatgtttttaaagaac

SEQ ID NO: 3098 - DNA, 2524 bp, Rattus norvegicus
  Genbank Accession No. NM_012639
gcccggctccctcaggtataagtatgttgaaattgcatcaatggagcacatacagggagcttggaagacgatcagcaatggtttcggactcaaagatgctgtgtttgatggctccagttgcatctcccctacaattgttcagcagtttggctatcagcgtcgggcctctgatgatggcaaactcacggattcttctaagacaagcaatactatccgggttttcttgccgaataagcaaaggactgtggtcaatgtgcggaatgggatgagcttgcacgactgccttatgaaagctctgaaggttagaggcctgcagccagagtgctgtgcagtgttcagacttcttcaggagcacaaaggtaagaaagcacgcttagattggaacaccgacgccgcctctctgattggagaagaactgcaagtggattttttggatcacgttccactcacaactcacaactttgctcggaaaacgttcctgaagcttgcattctgtgacatctgtcaaaagttcctgctaaatggatttcgatgtcagacttgtggctacaagtttcatgagcactgtagcaccaaagtacctactatgtgtgtggactggagtaatatcagacagctcttgctgtttccaaattccactgcaagtgacagtggagtcccagcaccaccctctttcacaatgcgtcggatgcgagaatctgtttcccggatgcctgctagttcccagcacagatactccacaccccatgccttcactttcaacacctccagcccttcctctgaaggttccctgtcccagaggcagaggtcaacgtccactcccaatgtccacatggtcagcaccaccctgcctgtggacagcaggatgattgaggatgcaattcgaagtcacagtgaatcagcctcaccttcagccctgtccagcagccccaacaacctgagcccaacaggctggtcacagcccaaaacccctgtgccagcacaaagagagagggcgccaggatctgggacccaggaaaaaaacaaaattaggcctcgtgggcagagagattcaagttattactgggaaatagaagccagtgaggtgatgctgtctactcggattggctcgggctcctttggcactgtgtacaagggcaagtggcatggagatgttgcagtaaagatcctaaaggtggttgacccaactccagagcaacttcaggccttcaggaacgaggtggctgttttgcgcaaaacacggcatgttaatatcctgctgttcatggggtacatgacaaaggacaacctggcgattgtgacccagtggtgtgaaggcagcagtctctacaaacacctgcatgtccaggagaccaaattccagatgttccagctaattgacattgcccggcagacagctcagggaatggactatttacatgcaaagaacatcatccacagagacatgaaatccaacaatatatttctccatgaaggcctcacggtgaaaatcggagattttggtttggcaacagtgaagtcgcgctggagtggttctcagcaggttgaacagcccactggctctgtgctgtggatggccccagaagtaatccgaatgcaggataacaacccgttcagcttccagtccgatgtctactcctatggcattgtgctgtatgagctgatgactggggagcttccctactcccacatcaacaaccgagaccagatcatcttcatggtgggccgtgggtacgcctccccagatcttagcaggctctacaagaactgccccaaggcaatgaagaggttggtggctgactgtgtgaagaaagtcaaagaagaaaggcctttgtttcctcagatcctgtcttccattgagctgcttcagcactctctgccgaaaatcaacaggagcgcctctgagccttccctgcatcgggcagctcacactgaggacatcaatgcttgtacgctgaccacatccccaaggctaccagtcttctagctgacgttatagctgttcttaggccaccaggggacgaagaagagtcagcaggcaccactttctgtttccttgggggcagaatgcatgtttccggaaaagctgctgctaaggacctagactactcacagggccttaacttcatattgccttcttttctacccttcctgccctggaaatggaagctgtccgccaagccagcctgctccagaggtatacaagtcagcgagtatttttagggcaaatggccttggagagagaaggcagggcactccggctactgcagggacatgcagttgggaacttggctcattgagctgtacagacagtggtgcagtgccagttttgcacatggagtcctggccacctgggggagcctgctttggtactacagaacttcactttgtggacacaccttcctcttactgagtctaagatgtcctgtgcagaggatgctttccaagcacggtgctccaccttctggcagcctcccacacgctgaatctgtcttccaggagctgccctatggggtgctgcagc

SEQ ID NO: 3099 - DNA, 1540 bp, Rattus norvegicus
  Genbank Accession No. NM_012645
ggatcgcacatgggggcgatggcaccgcgcacgctgctcctgctgctggcggcggtcctggcccccacccagacctgggcgggctcacactcgctgcggtatttccacaccgccgtgtcccggcccggcctcggggagccccggttcatttctgtcggctacgtggacgacacgcagttcgtgcgctacgacagcgacgcggagaatccgagatacgagccgcgggcgcggtggatggagcgggaggggccggagtattgggaggagcagacactggtcgccaagggacaggagctggattaccgagtgagcctgaggaacctgctaagctactacaaccagagcgagggcggctctcacaccatccagaggatgtatggctgtgacgtggggtccgacgggagcctcctccgcgggtatgagcagcacgcctacgacggccgcgattacatcgccctgaacgaagacctgaaaacatgggctgtggcagactttgcagcatggatcacccggagcaagtggcagcggaatggtgctgcagagagaagcagggcctatctggagggcacgtgtgtggagtggctcctcagatacctggagcgcgggaaggagacgctgctgcgctcagatcccccagaggcacatgtgacccttcaccccagacctgaaggtgatgtgaccctgaggtgctgggccctgggcttctaccctgctgacatcaccctgacctggcagttgaatggggaggacctgacccaggacatggagcttgtggagaccaggcctgcaggggatggaaccttccagaagtgggcatctgtggtggtgcctcttgggaaggagcagaattacacatgccgtgtggagcatgaggggctgcctgagcccctttcccagagatgggagccttctccatccaccgactccaacttacttctgttgttcttggagctgtggcagtttttgtagttttggccatcattggagctatggtggttgttgtgaggaggaggaggagaaacacaggcaggtacagctcccagagctccgttgtgtctctcccagattgtgaagcatgaagacagctgcctggagtggactgagtgacagacgatgtgttcaggtctctcctgtgacatccagagccctcagttctctttagacaccagtgtctgaagttccctgtgattctatggcttcagtgtgaagaactgtggagtccagcctgccctacacaccaggaccctgtccctgcactgcctgtgttgcctaccacattcagccttgctggtccagcctgggggtggagggtggggacatctgcatcctgtccccctgtgccaccctgagcttcagcccctcactccacactgagaataagaatctgagtgtgaacttgattgttcacatccttgacacagtgtggatagctttttaaattactggatggaatacttagaggttttttgttttggggttttgctttgtttccttttgtttttgaaaaaataaatggcagatggagaagcttccagaaaaa

SEQ ID NO: 3100 - DNA, 2025 bp, Rattus norvegicus
  Genbank Accession No. NM_012656
tctgctgcctgcccaactgcctgcctgcctgtgccgagagttcccagcaccatgagggcctggatcttctttctcctttgcctggccgggagggccctggcagcgcctcagacggaagctgcagaagagatggtggcggaggaaaccgtggtggaggagacagggttacctgtgggtgccaacccagtccaggtggaaatgggagagtttgaagaaggtgcagaggaaactgtcgaggaggtggtggctgaaaacccctgccagaaccatcattgcaaacatggcaaggtgtgtgagctggacgagagcaacacccccatgtgtgtgtgccaggaccccaccagctgcccagctcccattggcgagtttgaaaaggtgtgcagcaatgacaacaagaccttcgactcttcctgccacttctttgcgaccaagtgcaccctggagggcaccaagaagggccacaagctccacctggactacatcggaccatgcaaatacattgccccctgcctggattctgagctgaccgaattccctctgcgcatgcgtgactggctcaaaaacgtcctggtcaccttgtacgagagagatgagggcaacaacctcctcactgagaagcagaaactgcgtgtgaagaagatccacgagaacgagaagcgcctggaggctggagaccaccctgtggagctgctggcccgagactttgagaagaactacaacatgtacatcttccctgtccactggcagtttggccagctggatcagcacccgattgatgggtacctgtcccacacggagctggccccactgcgcgctcccctcattcccatggaacattgcaccactcgcttctttgagacctgtgacctagacaatgacaagtacattgccctggaggaatgggccggctgcttcggcatcaaggagcaggacatcaacaaggatctggtgatctaagttcaagcctcctgcagcagtcctggactctctccccctgatgtccccacccacttccactacccccttgtttaaaatgtttggatggttggctgttctgcctggggataaggtgctaacatagatttaactgaatacattaacggtgctaaaaaaaaacaaaaaacaaaaaaaacagaaagaaagaaaccagatcccaagtcacagcattttcccacgttactcgactctgaggccatagcctatccacagcctcctcgtcccctgcaccgcccagtgtctcactggctgtgttggaaacgggaattgcataagcttgccttcctcaagcaagaaatatctctagctttcatttccattttgactcttaacactcacccagactctgtgcttatttcatttgggggggggtgtgggcttcctggggtcttcccctggtagtttggaggtaggcagagggaagttacagacacagatacaaaacttgggcaaggacgctgtgaggccagtcagaaccagatggcaagtcttggtagcctaggtcaacgactgacagaataatccagagctctgatgcacaaaacagactcccagcagcccgggaccttgctgtctcctccactcttcaggcagtttctttccatgtttggctgttggttttaattttggtgagccaaggggaggcatgggcagaccaatacctcactagggattctcttactcaactgctatagggctttcaggctcttgctgggagctctaggcactgggctacaggaaagtgagactcaagaggaagacagagaaggttgtaacgtagagagagtgagtcataaagtttcaagcatgccccccccacctctccccaccctttgccagttgaaacttactaatcaagagaaacttccaagccaacggaaggaatggtcggatcccacaggctgagaatttgttcccctccaagcatttcatgaaaaagctgcttctcattaaccatgcgaactctcacagtgatgtgaagagcttgacagatctttcaaaataaaaagtaatgacttagaaatggcc

SEQ ID NO: 3101 - DNA, 1664 bp, Rattus norvegicus
  Genbank Accession No. NM_012657
aacacaccagggcaccctgaacatcaggagtcggcaaacacagaggctagtagctggctggtatcacctctgcagccaggaggacagagaagatggccttcattgcagctttggggctcttgatggcagggatctgccctgctgtcctctgtgatggcatactgggaagggacactctaccccatgaagaccaaggcaaggggagacaactgcacagtctcacattggcttccatcaacactgacttcacattgagcctctacaagaagctggctttgaggaatccagataaaaatgttgtcttctcccctcttagcatctcagctgccttggccattttgtctctgggagcaaaagacagcaccatggaagagattctagaagtactcaagttcaatctcacagagatcactgaggaagaaatccaccagggctttgggcacctcctacagaggctcagccagccagaggaccaggcagagatcaatacaggtagtgccctgtttattgacaaagagcagccgatactgtcagaattccaggagaagacaagggctctgtaccaggctgaggccttcgtagctgacttcaagcagtgcaatgaggccaaaaagttcatcaatgactatgtgagcaatcagacccaggggaagatcgcagaactgttctcagaactggatgagaggacatccatggtgctggtgaactatctcctctttaaaggcaaatggaaggtaccatttaaccccaatgacacatttgagtctgagttctacttggatgagaagaggtctgtgaaggtgcccatgatgaaaattaaggatctcaccacaccctacatccgggatgaggagctgtcctgctctgtgctggaactgaagtacacaggaaatgccagcgccctgtttatcctccctgaccagggcaagatgcagcaggtggaatccagcttgcaaccagagaccctgaagaagtggaaggactctctgaggcccaggattataagtgagcttcgcatgcccaagttctccatctccacagactacaacctggaggaggtccttccagacctgggaattaggaaaatcttctcccagcaagctgatctgagtaggatcacagggaccaagaacctgcatgtctctcaggtggtccacaaagctgtgctggatgtggatgagacaggcacagaaggagccgctgccacagcagtcacagcagccctaaaaagtttaccgcaaactatacctcttctgaatttcaaccggccattcatgctggttatcactgacaataatggtcagtctgtcttctttatgggcaaagtcactaaccccatgtgatctgaagctccccaaaatctgacaattctgcccaggatcctggaacagagcctggatgctgatctctgtatatgccctgacatacatgctctgattggctattgcaaagttggcttagacagtgacatcaactatctctatggctcccatgtgcactggagcctttggattgtcagtgtgcaggcacttaggacccttgggagcatctacacatgtttctgaacttggaatctttctttattcttcttccctggtgactcctctttctgtgttcataccccaaaccaagccattgataagtcccagtaaaggttctgagaa

SEQ ID NO: 3102 - DNA, 2071 bp, Rattus norvegicus
  Genbank Accession No. NM_012663
gaattcgggctacccccgccatgtcggctaccgctgccaccgtcccgcctgccgccccggccggcgagggtggcccccctgcacctcctccaaatcttaccagtaacaggagactgcagcagacccaggcccaggtggatgaggtggtggacatcatgagggtgaatgtggacaaggtcctggagcgagaccagaagctatcggaactggatgatcgcgcagatgccctccaggcaggggcctcccagtttgaaacaagtgcagccaagctcaagcgcaaatactggtggaaaaacctcaagatgatgatcatcttgggagtgatttgcgccatcatcctcatcatcatcatcgtttacttcagcacttaagtccctgaggagtctgccctgcctaagaagggcctctcccccaccctcagcccgtcctccacctctcagccatatctttcagccccctcccttggatccgtgtgtgtgtgtgtccgtgtgtgtgccccctgtaaatagccagctgttatttatacatatataatattatatatatttggtctgtttgtagttttattactagaagattttttccggttgtccttaacaccccttcctgaggttcccatcacctctctctctcaccctctgccccctttcctctttcctgttcagccccaagtcccttcatttgcatctgctatgcaatagcccctctcctccttcccttggatttaaccaatccttcccctatcttccctgtacaattccagaccctccccaaacagagcaaaccccacagaaacaaacaaaacaccccacctgtctaggcttccataggttgcatctttgtatcccttgggagcctctaagactggtcctacttggtcctaagaatcccaaggatttctgggagcttccaacatgttgattagcatatcatttgcatacactgtcttttttttccctcggtttcttcctttctgttccattactcttcactcttctgtgtttttttttttttctttctttcttttcggaagagttagtttccattggtcctcttatcacacttttatttgcacgacattatctgcaggtggtggggagcctgggcttttggggaactaggaccccaaagttgcctcctcccagcccctctagtctagtttgcttcccttaccccatttccacacctcttgtaccctcctctccctcccccagctggtgtgtaagtgtcttggagttcagtgtgttatgatgggaccaataattctgccacttggggtctctccctacattcctgctccccagttttcgtgtggggcattcagctgacatttcccgggggtctccctccctcccatctgcctgatctgctgcctcctcccaccaggagaactggaggctgaccacaatctggttctttgaggaggggtggctctagtgtgtgtgggggtcatcactgccttggggaggagtaggacaaaacagaaccccccctaattcctgcctgaaatctctggcctcatccttgctagaggttggactgaaaactttcctccccaatcctggggggtattaccccccatcactgcccagctcctctgactgcccccctgtattcagggtgggggtactagtcactgccaatatgtgtatgggacttgctggaggatggggatccttgtccttctctagggctgctgagccctgagagagagagagagagagagagagagagagagagagagagagagagaagcaagctatttccctgttgggtacaatgatagagaaaggatctaatcgggaaaaatggcacagttttaggggtctgagggtacagccccttaacctgcctcttgggggggggtgttccccaaactcttcccccacacacaccaggttttctgtgtggaggggaaccaaggagatgtaaactgtggtgtgaaagggtaggagagatgctgggggtgggggtgcttgtgttttacacccccaatattatcccagtgtcccctgccttccttcttcccctgccccatgcccccaattctgtggcgcatccagccgaattc

SEQ ID NO: 3103 - DNA, 2362 bp, Rattus norvegicus
  Genbank Accession No. NM_012668
atcatcagaggacttggtggaggagagcttataggtttggctgctgggaggctgctttgcctggacttggaagattttcctgtaggcttcgagaggcatggactcctacgtgattcagacggatgtcgacgacagcttgtcctcagttctggatgtgcatgtcaatattggtgggagaaactcggtacaaggaagaaagaaaggcaggaaggccagatgggacgtgagaccctctgacatgtccaataagaccttcaatcccatccgagccatcgtggacaacatgaaggtgcagcccaatccgaacaagaccgtgatttctctgtcaattggggaccctactgtgtttgggaacctgcctacagaccctgaagttacccaagccatgaaagatgccctggactcggggaagtacaatggctatgccccgtccatcggctacctatccagtcgggaggaggtcgcttcttactaccactgtcatgaggctcctctggaagctaaggatgtcattctgacaagcggctgcagtcaggccattgagctatgtctagctgtgttggccaatcctggacaaaacatcctcattccaaggcccgggttttccctctataggactttggctgagtctatgggaattgaggtcaagctctacaatctcctgcctgagaagtcttgggaaattgacctaaaacaactggaatctctgatcgatgaaaaaacagcgtgtcttgttgtcaacaacccatccaatccctgtggctccgtgttcagtaagcgacaccttcagaagattttggcagtggctgaaaggcagtgtgtccccatcttagctgacgagatctatggtgacatggtgttttcagattgcaaatacgaaccactggccaacctcagcaccaatgttcccatcctgtcctgtggtgggctggccaagcgctggctggttcctggctggaggttgggctggatcctcattcatgatcgaagagacatttttggcaatgagattcgagacgggctggtgaaactgagtcagcggatcctgggaccatgcaccatagtccagggtgctctgaagagcatccttcagcgaacccctcaggagttctatcacgacacgttaagcttcctcaagtccaatgcggacctctgctatggggcactggctgccatccctggactccagccggtccgcccttctggagccatgtaccttatggtgggaattgagatggagcatttcccggaattcgagaacgacgtggagttcacagagcggttgattgcggagcaggctgtccactgtctcccagcaacgtgcttcgagtacccaaatttcttccgagtggtcatcacagtccccgaggtgatgatgctggaggcttgtagccggatccaggagttctgtgaacagcactaccactgtgctgaaggcagccaggaggagtgtgacaaataagccctcacccgtcctcctgaagacatgtcccacgcaaggacggttggactggaccgctcctcctcagggagccaaatgtctctgatgggagaggaacctctaaagcaccgcatgaagacttgaagatcatttctccttcccccagtttcacccaacgcacgcctggaaacccagacccctccctactcagttctgctggagccatgagctcactgccccccaccccccacttccttatcctgagggtatcagaccaatttaccagaaagaagctgggccaagaaaagagagagctcaggatgagagaagcagaagacggaggatgcctctcccacccatttcctcgtgctgacatcctcttcagtcaggtcggaagtcacctcagttgctgcctcacttcaggcaaacctcactcctcgtggtacagctacaccagagagaagtcgaggacttgtgaattcagttaattgtattctaaacacatcaggaaacttgatgtttaaaggatccctgacagaatttttatttttattttttgtaaaggattattttgcggtgcaaataaataccagcttcctaaactgatcaacttcctaactgattagatagatctacttgtatcaggttttcctaaaataggaggacacctcactgaaggagaaagaagggaccggaggcctctctagagactttgctgtgtacaggacagcatcttcctccttgtcttctcgtagaatcatatatagccacttttgctatcatgtgaatattgatttattgatatttgtaatattaacttttcatatattttcctaagaaacatttatattataaggccttttattttgtcaagggcataaattattttttctttatttttgaaataaaaatttatcaaat

SEQ ID NO: 3104 - DNA, 3538 bp, Rattus norvegicus
  Genbank Accession No. NM_012669
ggtgcccacagggcttgactagtgggatttgggggagcagtgggtgcagcgagcctggtccgttgactgccagcagtagacaccggccgtgtgtgggggaggcggctagctcagtggccttgggccgcgtggcctggcggtagaggagccatggtttctaagttgagccagctgcagacggagctcctggctgctctgctcgagtcgggcctgagcaaagaggctctgatccaggctctgggggagcccgggccctacctgatggttggagatggtcccctggacaagggggagtcctgcggtgggactcgaggggacctgaccgagctgcccaatggcctgggggagacgcgtggctcggaagatgacacggatgacgatggggaagacttcgcgccacccattctgaaagagctggagaacctcagcccagaggaggcagcccaccagaaagccgtggtggagtcacttcttcaggaggacccatggcgcgtggcaaagatggtcaagtcgtacctgcagcaacacaacatcccccagcgggaggtggtggacactacgggtctcaaccagtcccacctgtcccagcacctcaacaagggcacccccatgaagacgcagaagcgggccgcgctgtacacctggtacgtccgcaagcagcgagaggtggctcagcaattcacccacgcggggcagggcggactgattgaagagcccacaggtgatgagctgccaaccaaaaaggggcggaggaaccggttcaagtggggccccgcatcccagcagatcctgttccaggcttacgagaggcagaagaaccccagcaaggaagagcgagagaccttggtggaggagtgcaatagggcggagtgcatccagagaggggtgtcaccatcgcaggcccaggggctaggctccaaccttgtcaccgaggtgcgtgtctacaactggtttgccaaccggcgcaaggaagaagcctttcggcataagctggccatggacacgtataacgggcctccacccgggccaggccccggccctgcgctacctgcccacagttccccgggcctgcccacaaccaccctctctcccagtaaggtccacggtgtgcggtatggacagtctgcaaccagcgaggcagctgaggtgccctccagcagcggaggtcccttagtcacagtgtctgcggccttacaccaagtgtcccccacaggcttggagcccagcagcctgctgagcaccgaggccaagctggtctcagccacggggggtcccctgcctcccgtcagcaccctgacagcactgcacagcttggagcagacgtctccaggtctcaaccagcagccgcagaaccttatcatggcctcgctgcctggggtcatgaccatcggcccaggggagcccgcctccctgggtcccacgttcactaacacgggtgcctctaccctggtcattggtctggcctccacacaggcacagagcgtgccagtcatcaacagcatggggagcagcctgaccaccctgcagccggtccagttttcccagccactgcacccttcctatcagcagcctctcatgccccctgtacagagccacgtggcccagagtcccttcatggcaaccatggcccagctgcagagcccccacgccctgtacagccacaagcctgaggtggcccagtacacgcatacaagcctgcttccgcagaccatgctgatcacagacaccaacctcagcacccttgccagcctcacgcccaccaagcaggtcttcacctcagacacagaggcctccagtgagcctgggcttcatgagccgtcgtctccagccacaaccattcacatccccagccaggacccgtcaaacatccagcacctgcagcctgctcaccggctcagcaccagtcccacagtgtcctccagcagcctggtgttgtaccagagttctgactccaacgggcacagccacctgctgccatccaaccacggtgtcatcgagacttttatctccacccagatggcctcctcctcccagtaaccatggtgactgcctcccaggagctgggctcccagagcctgcacagggggagaggagggccacagccatgctgcctggagggtgttggagcctgccacctgccacaggctgctggccttcccagaactctatgccttcatgctgcagctgctcctccatcatcagaaagggatggctctgaggtgtctcctcagcctgaggggcaagcctcaaggagccggaggacagcccaatctggaccgccatccctgctggttagaatagaaaacttaatgcttggaacagaagggggaagcctgtattgctggcaccctccagtcagagcttgcaggccctgaaggatctctgctgagctcggaggccctacatcaacatggctgccatctgtctcctgtgcctcccaggccactccaccctgcgccagagacccatgtgcctcttggtgggttaccctccctccacaggatcttccaggcagttctctggctaggcttgggagcctagggagcagggctctcctaggctttcccctactaagtcgctcttcctcccggccccaggacctcatttgtttccgtgaccgtatcttctgatgccagcttggcatcttgcctgcactagaaaggctgcttcagggctaagattgtcacccttgttccttagggcacgtaactcatgccaaggtcacatcctaggcaatcacctcctctggctgcagggccctacaacttccttcctggtgtgagagacgtgtagaactcggaagacaaggcctgagcaatgtctagtggagagagtgctgagaccagcagagagaagccacccaaggggctaggggctggcagctattctgatctctggcctgctgcagagagcctggccctcagtgggctcccccctcagcctggaaagagccagcgccccctgcagcctacggccggtcatgggcaagcctagatgtttatttaacttttagtaaagccagtaagaagtgtgtagtagcttcctgattacctaggcatctgtggccaggagggacggtggagggaaggcagagggaagcagggtgaaggcaggggcctgagctgtcggcaggctcatgggatatgtgtttacacatctttttgttcaactggaaatgaggtgaggtgactgcctggatttctgtgtcctcctcggtactgcaagaaacccacccagtccaggtgtggtgccattcccagagtcttaagctggggtgacaaagcgtatccggggtgtgggtggaaggatcccactgtggttttatgagacgtccccctaacattgagcacagaggatgtgcctcggtggcacaatgcctgcctggtaagtgtaaagccacgggtttgatccccggcactcaaacaacaacgcactgacagctccttgtaactacgcaggaggcaaaccaggagactggccaggttgagctacagagacacagacaaacaataaacaaaaagggttggtactgaccagg

SEQ ID NO: 3105 - DNA, 1831 bp, Rattus norvegicus
  Genbank Accession No. NM_012670
ggccgctatccggtctcagagcggagctatcgcttagttgtctgcgttggtagtgagatttgcttcgtttcctgaagatggagggtcctttgtccgtgttcggggaccgcagcactggggaagcgatccgctcccagaacgttatggctgcagcctctattgccaacattgttaaaagttctcttgggccagttggcttggataaaatgttggtggatgatattggtgatgtaactattactaatgatggggccaccattctgaaattattggaggtggaacatcctgcagccaaagttctgtgtgaactggctgacctgcaagacaaagaagttggagatggaactacctcagtggtaatcattgcagcggagcttctgaaaaatgctgatgagctagtcaagcagaaaattcatccgacatcagttattagtggctatcgtcttgcctgcaaggaagcagtgcgatatatcaatgagaacctaattatcaacacagacgaacttggaagagactgtctgatcaatgctgctaagacatccatgtcttccaaaattattggaataaatggtgatttcttcgctaatatggtggtagacgctgtgcttgctgttaaatacacagatatacgaggccagcctcgctatccagtcaattctgttaatattctaaaagcccacgggagaagtcagatagaaagcatgctgatcaatggctatgcactcaactgtgtggttggatctcagggcatgctcaagagaatagttaatgcaaaaattgcttgtcttgacttcagcctgcagaaaacaaaaatgaagcttggtgtacaggtggttattacagaccctgagaaactggaccagattagacagagagaatccgatatcaccaaggagagaattcagaagatcctggcaactggtgccaacgttattctaaccaccggtgggattgatgacatgtgtctgaagtattttgtggaagctggtgccatggctgttaggagagttttaaaaagagacctcaaacgtattgcaaaagcttctggagcaagtatcctgtctacactggccaatttggaaggtgaagagacttttgaggcaacaatgttgggacaagcggaagaggtcgtacaggagaggatttgtgacgatgagctgatcttaatcaaaaatactaaggctcgtacgtcagcttcaattatcttacgaggggcaaacgacttcatgtgtgatgaaatggaacgctccttacatgacgctctttgtgtggtgaagagagttttggagtcaaagtctgtggtcccaggtggaggtgctgtagaagcggccttgtctatataccttgaaaactatgcgaccagtatgggatctcgggaacagcttgctattgcagagtttgcaagatctctgcttgtgattcctaatacactggcagtgaatgctgcccaagactccactgacctggttgccaagttaagagcttttcacaatgaggctcaagttaacccagaacgtaaaaatctaaagtggattggtcttgatttggtccatgggaaaccacgagacaataagcaagcgggggtgtttgaaccaaccatagttaaagtaaagagcctgaagtttgcaacagaggctgcaatcaccatacttcggattgatgatctgataaaattacacccagaaagcaaagacgacaaacacggaggttatgaaaatgctgttcactctggagcccttgatgactgattggacttcccttttatttatgacagtgttgggtgtaatgtcttagccttgggtgtctcacattaaagtacaacgagctgtcg

SEQ ID NO: 3106 - DNA, 650 bp, Rattus norvegicus
  Genbank Accession No. NM_012673
ctgcaagctaggggagcccagacccaggacggagctattggcaccatgaacccagtcatcagcatcactctcctgctttcagtcttgcagatgtcccgaggacagagggtgatcagcctgacagcctgcctggtgaaccagaaccttcgactggactgccgtcatgagaataacaccaacttgcccatccagcatgagttcagcctgacccgagagaagaagaagcacgtgctgtcaggcaccctgggggttcccgagcacacttaccgctcccgcgtcaaccttttcagtgaccgctttatcaaggtccttactctagccaacttcaccaccaaggatgagggcgactacatgtgtgaacttcgagtctcgggccagaatcccacaagctccaataaaactatcaatgtgatcagagacaagctggtcaagtgtggtggcataagcctgctggttcaaaacacttcctggctgctgctgctcctgctttccctctccttcctccaagccacggacttcatttctctgtgactggttgggcccaaggagaaacaggaaacctcaaggtctgctgaagaggtcttgcttctcccggtcagctgactccctccccaagaccttcaaatatctcaaaacgcggggagaaatgg

SEQ ID NO: 3107 - DNA, 2338 bp, Rattus norvegicus
  Genbank Accession No. NM_012674
tctacaaccatgaaggtagcaattatctttcttctcagtgctttggccctgctcagtttagcaggtaaccctccagctgaggtgaatggaaaaacgcctaattgccctaagcaaattatgggatgtcccaggatttatgaccctgtgtgtgggactaacggaattacttaccccagtgaatgcagtctgtgctttgaaaacaggaaattcggaacatctatccacattcagaggagagggacttgctgaatgtcctgattttgaaatcttttagggctaccataatgtttagcaagaaggtttgctgaataaatgcatctgaacatattttgttcttcccaaagcttttgctcaaaggcatatatgagtatattgagaatagggatctgagaagaaaaccagagtagagcaagctttaccacttagttcttcatgctcatacttcaaaaattgcagatgatgacaacacatagttgagcatgaacatgtgtaatgaatagagtttgggttaggatgaagaaggtagcctatctgtgcacaagaaagaagtagactgacttggatctttcttaggggagtttaccaaaggaaagactgccttgtatatctacagtgtttcacttgtgagacaccacaactctgcagatttactcttgttctgtgaggaaacttagaagagtcaaattgtttgactaatagtccaacatacatgatgccagggtgttcttttagatcaagctgacctcttccttcatccatatgagcactccttcttttaaccacaatcttctcttgtggatcatgccttgactttcttcaatgggaatcctagataatattccctactgtaagatcttgcatgtctatattcagtgatagaatatagacgtgatataataggatataaccaaatgaattagaaacaaggaaatattctcaaaagggaaagtatcaacaactacttttaaaaaaggaatcattttaagatcctgagtttctaaagaaaatcttagtctaagatggaaagagagtaaagagctaacacaggtgagtctgggcaaggaaccctagtacagtggggttgggtcagcacctttgccagaaataaccaagctattcagaaatacactaggaaaggagagttgcctagtaacccacttctggtcatattcagtattcatgccttgaactgaactcttgctcctagaggatgctataactaacaaaccgagcaacttaaacagcctgacagctctcaccaaataccttgctatctcaagttatggatgcaagatggctcccagtgtctatctgtgattctagaggacacttgaagggcaccaacacttaacaaattctgtgggggtaaatttattttaatcactggatgctggaagacacacacagagacacaaacacacaaagagagacagagagagagaaagagagagagagaggtagagagagagagagagagagagagggagagagagggagagagagagtgttttgggttttgttgttgttgttgttgttgatttggaattatatcaagatataagataatctcaaatgtatctttagtagttctgctccctggacccatgagaagacaggaatgaggattctgtgcatgtggtacttacatttcaaaaggagtatctaataaactggaaactgcttaaaagaatgagactatcagcactgataagaatataaagcttcaagctatgaagagtgattcaaagaaggaaaagaattccctcagaactgggaggaccttttaaaaaattctgagtccccgtttctaaagtttcaccttcctaacttcatgtattttttaatagctcaaagagtccaattactgctgctcatatactcatgagtgtgacaccatgcactgttactgccaatatatgaaaggccatacccctaaagaaaattgacttaagaactccttgtttagggttgggtacttctgtgaccctcccacattcatgctggaatgttgactggcttcatttttataaggcaaaagatcttcccactctcttctgagagagaataaatcagttttgctcaatggagtgattctgagtatactaatcacgatcccaggacaggccccattctcacaagcagttagctaacacaaatagaactccatattttatagcagtttttatcttttgttcttggttttagttcttattttcaagacagagaaaaacacatgaagttggaagggtagaagtgggggggggcgtgggtctgggaggagttgggggatagagaaaaatataataaaaatatatgaaattctcgagaatgaataaat

SEQ ID NO: 3108 - DNA, 900 bp, Rattus norvegicus
  Genbank Accession No. NM_012678
cgcgagcccagtggagcgagtgagctatggccggcctcaactcactggaggcggtgaagcgcaagatccaggccctgcagcagcaggcggacgacgcagaggaccgtgcgcagggcctgcagcgcgagctggatggcgagcgcgaacggcgcgagaaagctgaaggagatgcggccgctctcaaccgtcgcatccagctggtggaggaagagctggaccgggctcaggagcgactggccacagccctgcagaagctggaggaggcagagaaggctgctgacgagagtgagagaggcatgaaggtgatagagaaccgagccatgaaagacgaggagaagatggagatccaggagatgcagctcaaagaagccaagcacatcgctgaggaggctgaccggaagtatgaggaggttgctcgtaagttggtcatcctggagggtgagctggagagagcagaggagcgggcggaggtgtctgaactaaagagtagcgacctggaagaggagctcaagaacgtaactaacaatctgaaatcactggaggctgcttctgaaaagtactctgaaaaggaggataaatatgaagaagaaatcaagcttctgtctgacaaactgaaagaggctgagacccgagctgagtttgcggaaaggacagtttctaaactggagaagacaatcgatgacctggaagaaaaacttgcccaggccaaagaagagaacgtgggcttgcatcagacactggaccagacactaaacgaacttaactgtatataaaccaaaccagaagagtcctgtcttgataccaactccactccagagagtgcaccctgtcttcctctcttataagaagttccgcttactaccatgtctccaccttgctggaaaggccaagcagaaaaat

SEQ ID NO: 3109 - DNA, 1638 bp, Rattus norvegicus
  Genbank Accession No. NM_012679
acccgcgtcaccaggaggagcgcactggagccaagccgcagacgggactccagactccaaagaggccacaccatgaagattctcctgctgtgtgtggcactgctgctgacctgggacaatggcatggtcctgggagagcaggagttctctgacaatgagctccaagaactgtccactcaaggaagtaggtatgttaataaggagattcagaacgccgtccagggggtgaagcacataaagaccctcatagaaaaaaccaacgcagagcgcaagtccctgctcaacagtttagaggaagccaagaagaagaaagagggtgctctagatgacaccagggattctgaaatgaagctgaaggctttcccggaagtgtgtaacgagaccatgatggccctctgggaagagtgtaagccctgcctgaagcacacctgcatgaagttctacgcacgcgtctgcaggagcggctcggggctggttggtcgccagctagaggagtttctgaaccagagctcacccttctacttctggatgaacggggaccgcatcgactccctgctggagagtgaccggcagcagagccaagtcctagatgctatgcaggacagcttcactcgggcgtctggcatcatagatacgcttttccaggaccggttcttcacccatgagccccaggacatccaccatttctcccccatgggcttcccacacaagcggcctcatttcttgtaccccaagtcccgcttggtccgcagcctcatgcctctctcccactacgggcctctgagcttccacaacatgttccagcctttctttgatatgatacaccaggctcaacaggccatggacgtccagctccatagcccagctttacagttcccggatgtggatttcttaaaagaaggtgaagatgacccgacagtgtgcaaggagatccgccataactccacaggatgcctgaagatgaagggccagtgtgagaagtgccaagagatcttgtctgtggactgttcgaccaacaatcctgcccaggctaacctgcgccaggagctaaacgactcgctccaggtggctgagaggctgacccagcagtacaacgagctgcttcattccctccagtccaagatgctcaacacctcatccctgctggaacagctgaacgaccagttcacgtgggtgtcccagctggctaacctcacacagggcgatgaccagtaccttcgggtctccacagtgacaacccattcttctgactcagaagtcccctctcgtgtcactgaggtggtggtgaagctgtttgactctgaccccatcacagtggtgttaccagaagaagtctccaaggataaccctaagtttatggacacagtggcagagaaagcgctacaggaataccgcaggaaaagccgcatggaatgagacagaagcatcagttttctatatgtaggagtctcaaggagggaatctcccagctttccgaggttgctgcagacccctagagaactccacatgtctccagcgcctaggcctccaccccagcagcctctccttcctctgggttctgtactctaatgcctgcacttgatgctctcgggaagaactgcttcccccacgcaactaatccaataaagccaccttgcg

SEQ ID NO: 3110 - DNA, 595 bp, Rattus norvegicus
  Genbank Accession No. NM_012681
cctgacaggatggcttcccttcgcctgttcctcctctgcctcgctggactgatatttgcgtctgaagctggccctgggggtgctggagaatccaagtgtcctctgatggtcaaagtcctggatgctgtccgaggcagccctgctgtcgatgtggccgtgaaagtgttcaaaaggactgcagacggaagctgggagccgtttgcctctgggaagaccgccgagtctggagagctgcacgggctcaccacagatgagaagttcacggaaggggtgtacagggtagaactggacaccaaatcatactggaaggctcttggcatttccccattccatgaatacgcagaggtggttttcacagccaatgactctggtcatcgccactacaccatcgcagccctgctcagcccgtactcctacagcaccactgctgtcgtcagtaacccccagaactgagggacccagcccacgaggaccaagatcttgccaaagcagtagctcccatttgtactgaaacagtgttcttgctctataaaccgtgttagcaactcgggaagatgccgtgaaacgttcttattaaaccacctttatttcattc

SEQ ID NO: 3111 - DNA, 1849 bp, Rattus norvegicus
  Genbank Accession No. NM_012687
ggatgggatgtttgctcattacatattccttccttcactgcctacacacagctcaggactcctataagggcaggacacgctgatcaactctcctcctaggaagaacccctctggggtctcagaggaaaaatggaagtgttggggcttctcaagttcgaagtcagtggtaccgtagtgactgtgactctgtccgtggttctcttggccctcctgaaatggtactccacatcagcgttctcaagactgaggaagttgggcatcagacaccctgagccttctccttttgttggaaacttgatgtttttccgccagggcttttgggagagccatttggagctccgagagcgatatgggcctctgtgtgggtactatcttggccgtcggatgtacattgtcatttcagacccagacatgatcaaggaggtgttggttgagaacttcagtaacttttccaacagaatggcctcaggtctggaacccaagctgatagcagacagtgtcctgatgttacgtgacagaagatgggaggaagtcagaggtgccctgatgtctgcattcagtcctgaaaaattgaacgagatgacacctctcatcagccaagcctgtgaacttctcctgtctcacttaaaacactctgcggcatccggggacgcattcgacatccagaggtgttactgctgttttaccacaaatgtggtggccagtgtggcctttggcatcgaggtgaactcccaggatgctccagaagacccctttgtgcaacactgccagcgtgtttttgctttcagtaccccaaggcctctcctggctttaattttatcatttccatccataatggtcccattggcccggattctgcccaataagaaccgagatgaactgaatggcttttttaacacactcattaggaatgtgattgccttacgggacaagcaaacagcagaagagaggcggggagacttcctgcagatggtgctggatgcccagcgttccatgagctctgtgggtgtagaagcctttgacatggtcacagaagccctgtcctctgctgagtgcatgggggacccaccccaaaggtgtcatcctacatccacagctaagcctttaactgtggatgagattgccggccaggctttcctcttcctcatcgctggccacgagatcaccacaaacacgctctccttcatcacatacctgctggccacccaccctgagtgccaggagaggcttctgaaagaggtggacctcttcatggagaagcatccagcccctgagtactgcaacctgcaggaaggtctgccctatctggacatggtggttgcagagaccctgaggatgtacccaccagctttcagattcacaagggaggcagcacaggactgtgaggtgctgggacagcacatccctgcaggttctgtgctggagattgctgtgggtgccctacaccatgacccagagcactggccgaaccctgagacctttgaccctgaaaggtttacagcagaagcccggcttcagcagaagccattcacatacctgccttttggagctggtcccaggagctgccttggagtacggctggggctgctggtggtcaagctgacactgctccaggtcctacacaagttccgctttgaagcttgccctgagactcaggttccacttcagctagaatccaaatctgctctatgccccaaaaatggagtctacgtcaagattgtgtcacgctgacatagaaggcaggtgtgaaagaggaagcactttgtaatagtgacgtctgtgcatcactgttaggagggcgccatttatgtcacagttctaaatgttgaataaatgtttgtcatgcttc

SEQ ID NO: 3112 - DNA, 3912 bp, Rattus norvegicus
  Genbank Accession No. NM_012690
gcggccaacacgcgcgtgaagttcaggctgagatggatcttgaggcagcaagaaacggaacagcgcggcgcctggacggcgactttgaactaggcagcatcagcaaccagagcagagaaaaaaagaagaaagtgaatttaattggcccgttgacactgttccgatactctgattggcaggataaattgtttatgctcctgggcaccgccatggccatagctcacggatcaggtcttccccttatgatgatagtctttggagaaatgacagataagtttgtagataatgctgggaacttttccttgccagtgaatttttcattgtcaatgctaaatccaggaagaattctggaagaagaaatgactagatatgcatactactattcgggactaggtggtggagttcttttggctgcctatatccaagtctccttctggactttggcagctggccgacaaataaggaaaatcaggcaaaaattttttcacgccatccttcgacaagaaatgggctggtttgatatcaagggcaccaccgaactcaacacgcggctgacagatgacatctccaaaatcagtgaaggaattggtgacaaggttggaatgttctttcaagcaatagccacgttttttgcaggattcatagtggggttcatcagaggctggaaactcaccctcgtgatcatggccatcaccgccatcttggggctctctacagccgtttgggcaaagatactctcaacattcagtgacaaagaactagctgcctatgcaaaagcaggtgccgtggcggaagaggctctgggagccatcaggaccgtgatagctttcgggggccagaacaaagagctagaaaggtatcagaagcatttagaaaatgccaaaaagattggaattaaaaaggctatctcggccaacatctccatgggcattgcctttttgttaatatatgcatcctatgcactggccttctggtatggatccactctggttatatcaaaagaatatacaattggaaatgccatgacagtgttcttctcaatcctcattggggccttcagtgtggggcaggctgccccctgtattgatgctttccccaatgctagaggagcagcctatgtgatctttgacattattgataataatcctaaaattgacagtttttcagagagaggacacaagccagacagcatcaaaggaaatttggagttcagtgacgttcacttttcctacccatctcgggctaatatcaagatcttgaagggcctcaacctgaaggtgaagagcgggcagacggtagccctggttggcaacagtggctgtgggaaaagcacaactgtccagctgctgcagaggctctacgaccccacagagggtacgattagcatcgatgggcaggacatccggaactttaacgtcaggtgtctaagggaattcatcggcgtggtgagtcaagagccggtactgttctctaccacgattgctgaaaatatccgctatggccgtgggaatgtaacaatggatgagattaaaaaagctgtcaaagaggctaatgcctatgacttcatcatgaaactgccacagaaatttgacaccctggttggtgacagaggggcgcagctgagcgggggacagaaacagaggatcgccattgctcgtgccttggtccgcaaccccaagatcctcctgctggacgaggccacgtcagccttggacacagaaagcgaagctgaggtgcaggccgctctggataaggccagagaaggccggaccaccatcgtgatagctcaccgactgtcaactgtccggaatgcagatgtcatcgctgggtttgaggatggcgtcatcgtggagcaaggaagccacagtgagctgataaagaaggaagggatctacttcagacttgttaacatgcagacatcaggaagccagatcctgtcagaagaatttgaagttgagctaagtgatgaaaaggctgctggaggtgtggccccaaatggctggaaagcacgcatatttaggaattctacgaagaaaagtctgaaaagttcacgggcgcatcaaaataggctggatgtggaaaccaatgaacttgatgcaaacgtgccaccagtgtcttttctgaaggtcttaagactgaataaaacagagtggccctactttgtggtggggacactctgtgccattgccaacggggccctccagccggcattctccatcatcctgtcagagatgatagctatctttggccctggggatgacacagtaaagcaacagaagtgtaacatgttctcgctggtcttcttgggcctaggagtccactccttctttactttcttccttcagggtttcacattcgggaaagctggcgagatcctcaccacaaggctccggtccatggccttcaaagcaatgctaagacaggacatgagctggtttgacgatcataaaaacagtactggtgccctctctacaagactcgccacagacgctgcgcaggtccaaggagccacaggaaccaggttggctttaattgcacagaacacagccaaccttggaacgggtattattatatcatttatttacggttggcaactgacacttctgctcttatcagttgttccattcattgctgtagcgggaattgttgaaatgaaaatgttggctggcaacgccaagagagataaaaaggagatggaagctgctggaaagattgcaacagaggcaatagaaaatattcggactgttgtatccttgacccaagagagaaaatttgagtcaatgtatgttgaaaaattacacggaccttacaggaattcagtgcggaaggctcacatctacggcatcacttttagcatctcacaagcattcatgtacttttcttatgctggctgctttcgatttggttcttacctcattgtgaatggacacatgcgcttcaaggatgtcatcctggtgttctcagcaatcgtgcttggtgcagtggctctaggacatgccagctcatttgctccagactatgcaaaagccaagctgtctgcagcatacttattcagtctgtttgaaagacaacctctgattgacagctacagcagagaaggaatgtggccggataagtttgaaggaagcgtgacattcaatgaagttgtgttcaattatcccacccgggccaatgtgccagtgcttcaggggctgagcctcgaggtgaagaaggggcagaccctggccctggtgggcagtagtggctgcgggaagagcaccgtggtccagctgctcgagcgcttctacgaccccatggccggaacagtgctcctcgatggtcaggaagcaaagaaactcaatgtccagtggctccgagctcaacttggcattgtgtcccaggagcccatcctgtttgactgcagcatcgccaagaacatcgcctacggagacaacagccgtgtcgtgtctcaggatgagattgtgagggcggccaaggaggccaacatccaccccttcattgagacactgccccaaaagtatgaaacaagagtaggagacaaggggacacagctctctggaggccagaaacagaggattgctatcgcccgagccctcatcagacagcctcgggtcctactgctggatgaagccacgtcggctttggacactgagagtgaaaaggtcgtccaggaagcgctggacaaagccagggaaggccgcacctgcattgtgatcgcgcaccgcctgtccaccatccagaacgcagacttgatcgtggtgatcgacaacggcaaggtcaaggagcacggcacccaccagcagctgctggcccagaaaggcatctatttctccatggtcaacattcaagctggcacacagaacttatgaacttgttacagtatatttttaaaataaattccaatcgtttttt

SEQ ID NO: 3113 - DNA, 1687 bp, Rattus norvegicus
  Genbank Accession No. NM_012692
tcaatcctcactggccactatgctggacacaggactgcttctggtggtcatattggcctccctgagcgtcatgctcttggtgtccctctggcagcagaaaatcagggggagattgcctccaggacccactcctttgcctttcattggaaattatctgcagctgaatacaaaagacgtatacagttccatcacacagctcagtgagcgctatggtcctgtgttcaccatccaccttgggcctcgccgggttgtggtgctttatggatacgatgcagtcaaagaggctttggtggaccaagctgaggagttcagtggacgaggcgaacaggctacctacaatacactcttcaaaggctatggcgtggcattcagcagtggggagcgggcaaaacaactcaggcgcctctctatagccacattgagagattttggtgtgggcaagcgtggtgtagaggagcgtatcctggaggaggcaggctatttgatcaagatgttgcagggcacttgtggagcccccattgaccccaccatctacctgagcaaaacagtctccaatgttattagctccattgtcttcggggaacgcttcgactatgaggacacggagttcctgtcactgctgcagatgatgggtcaaatgaacagatttgcagcttcacccacagggcagctctatgacatgttccattcagtgatgaagtacctgcctggaccacagcaacagatcatcaaggttactcagaaactggaagacttcatgatagagaaagtgaggcagaaccatagtaccctggaccccaattccccaaggaacttcattgactcctttctcatccgcatgcaagaggagaaaaatggcaattcagagttccacatgaagaacctagtgatgacaacactaagcctcttctttgctgggtctgagacagtcagctccacactacgctacggcttccttctactcatgaagcatccagatgtggaggccaaggtccatgaggaaattgagcaggtgatcggcaggaaccgacagcctcagtatgaggaccacatgaagatgccctacacccaggctgtgatcaatgagatccaaagattttctaacttggctcccttgggcattcctcgaaggattatcaagaacacaaccttccgtggcttcttcctccccaaggccaccgatgtgttccctatattaggttctctgatgacagacccaaagttcttccctagccccaaagacttcgacccccagaacttcctggatgacaagggacagttgaagaaaaatgctgctttcctccctttctccactgggaagcgattctgcttgggagatggcctggctaagatggagctcttcctgctgctcaccactattttacagaacttccgtttcaagttcccaatgaaactagaagacatcaacgagtcccccaaacccttggggtttaccaggatcataccaaagtacaccatgagcttcatgcccatctgattctgagttgaatcaaggtggggcaagagggagagagagcctgaagtggggccagggtgcaggtggagagaacaggggaggtgaagatgagggttaagaagggaccacacccatggaagaaacacaaaagacttctcactttggtaaaattgtaacagtcctaataaaaagaaagaaatactcagtcgg

SEQ ID NO: 3114 - DNA, 2259 bp, Rattus norvegicus
  Genbank Accession No. NM_012693
ctggctactatgctggacacaggactgctcctggtggtcatactggcctccctaagtgtcatgttcttggtgtccctctggcagcagaaaatcagggagagattgcctccaggacccactcctttgcctttcattggaaattatctgcagctgaatatgaaagacgtatacagttccatcacacagctcagtgagcgctatggtcctgtgttcaccattcaccttgggcctcgacggattgttgtgctttatggatacgatgcagtcaaagaggctttggtggaccaagctgaggagttcagtggacgtggcgaactgcctacctttaatatactcttcaaaggctatggtttttcattgagcaatgtggaacaggccaagcgtatcaggcgcttcaccatagccacattgagagattttggtgtgggcaagcgtgatgtacaggagtgtatcctggaggaggcaggctatttgatcaagacgttgcagggcacttgtggagcccccattgacccttccatctacctgagcaaaacagtctccaatgtcattaactccattgtcttcgggaaccgcttcgactatgaggacaaagagttcttgtcactgttggagatgatcgatgaaatgaatatatttgcagcctcagccacagggcagctctatgacatgttccattcagtgatgaagtacctgcctggaccacagcaacagatcatcaaggttactcagaaactggaagacttcatgatagagaaagtgaggcagaaccatagtaccctggaccccaattccccaaggaacttcattgactcctttctcatccgcatgcaagaggagaaatatgttaattcagaattccacatgaacaacctagtgatgtcatcattaggcctcctctttgctgggactgggtcagtcagctccacgctataccatggtttcctgctactcatgaagcatccagatgtggaagccaaggtccatgaggaaattgagcgagtgatcggcaggaaccgacagcctcagtatgaggaccacatgaagatgccctacacccaggctgtgatcaatgagatccaaagattttctaacttggctcccttgggcattcctcgaaggattatcaagaacacaaccttccgtggcttcttcctccccaagggcaccgatgtattccctataataggttctctgatgacagaaccaaagttcttccctaaccacaaagacttcaacccccagcacttcctggatgacaagggacagttgaagaagaatgctgcatttctccctttttccattggaaagcgattctgcttgggagatagcctggctaaaatggagctcttcctgctgctcaccaccatcttgcagaacttccgttttaagttcccaatgaatctagaagacatcaacgagtaccccagtcccatagggtttaccaggatcataccaaattacaccatgagcttcatgcccatctgattctgagttgaatcaaggtggggcaagagggagggagagcctgaagtggggccagggtgcaggtggagagaacagagaagatgaagatgagggttaagaagggaccacacccatggaagaaacacaaaagacttctcagtttggtaaaattgtaacagtcctaataaaaagaaagaaacacccagtaggcagcagtaacaacaactgagactcatggggcaaaggtggctcacctctgcagaagctgtcctgcccttctctcactcagtcctctacacaagagcagcatgtccccaagcccaacgtacaggttcaaaagatagaacttaaaaaatttgaacctaaactgaggtggaaaagacacagttagctaggattgacacattggactctatcaccagcattcaggagggagggaacatggctccctaggaggcctgccagaattacaaagtgaaactcatctcaaaaaaggaacaacagaaaataaaatttcaaattgatttctcttagaccataagagtccagatctgtatccaaagctatttggttatattttttgttattgttgttttgtttacacattgtgtttttctttcggtttgtaagtctgtttgggatatttaatttacatttactgattagtgtgggtggtagggcataccatggctcaaatgtggaaaccaaagaaaagcttttggaagtgtcatctcccttacaatacgtgtgtccaagaactcaaattcagacaataaagcttgatagcaagca

SEQ ID NO: 3115 - DNA, 1000 bp, Rattus norvegicus
  Genbank Accession No. NM_012695
ctggaatcctaacaggacctacacagagctatttataatgccagactatacttggtttgaaggaataccttttcctgcctttgggattccaaaagaaactttgcaaaatgtttgtaataagtttgtggtgaaagaagaagatttgatcttattgacttatcccaagtcaggaacaaactggctgattgaaattgtctgcttgattcagaccaagggagatcccaagtggatccaatctgtgaccatctgggatcgctcaccctggatagagactgatttaggatatgatatgttaatcaaaaagaaaggaccacgactcataacctcccatcttcccatgcatcttttctccaagtctctcttcagttccaaggccaaggtgatctatctcatcagaaatcccagagatgttcttgtttctggttattatttctggggtaagacaactcttgcgaagaagccagactcactgggaacgtatgttgaatggttcctcaaaggatatgttccgtatggatcatggtttgagcacatccgtgcctggctgtctatgcgagaattagacaacttcttgttactgtactatgaagacatgaaaaaggatacaatgggaaccataaagaagatatgtgacttcctagggaaaaaattagagccagatgagctggatttggtcctcaagtacagttccttccaagtcatgaaagaaaacaacatgtccaattataatctcatggagaaggaactgattcttcctggttttactttcatgagaaacggcactactggggactggaagaatcacttcactgtagcccaagctgaagcctttgataaagtgtttcaggagaaaatggccggtttccctccagggatgttcccatgggattaaaatttcaaaagttttaaatattttatgaacattgatttttatgtttctgttgttctatgtctgaataagtgaatgtggtcattgaataaattctattctggcattgtg

SEQ ID NO: 3116 - DNA, 1417 bp, Rattus norvegicus
  Genbank Accession No. NM_012696
agagggaacctttaatcatgaagctaattactatcctgctcctctgctccaggctcctgccaagtttagcgcaggaagaaggcgcccaggaattgaactgcaatgatgagactgtatttcaggctgtggatactgctctgaagaaatataacgctgagttagaaagcggcaaccagtttgtgttgtaccgagtgactaagggcactaagaaggatggcgctgaaacattgtattccttcaagtatcaaatcaaggagggcaactgctctgttcagagtggcctcacctggcaggactgtgacttcaaggacgctgaggaagccgctactggcgaatgcacaacaactttggggaagaaagaaaataaattctccgtagccacccagatctgcaatattactccaggtaagggtcctaagaagacagaggaggacctctgtgtcgggtgtttccaacccataccgatggatagctcagacctgaagcctgttctgaaacacgctgtggagcattccaacaacaacacgaagcacacccacctctttgctctcagagaagtaaagagtgcccactcacaggtggtggctggcatgaattataaaattatctactccattgtgcaaacaaattgttcaaaggaggattttccttccctccgtgaagactgtgtaccccttccctatggcgatcatggtgagtgtacgggtcatacccacgtggatattcataacacaattgccggcttctcacagagctgtgacctttatccaggagatgatttgtttgaactacttcccaagaattgccgtggctgccccagggagatacctgtagacagcccggagctgaaggaggcacttggtcattccattgcacagcttaatgcacagcataaccatattttctatttcaagattgacaccgtgaaaaaggcaacatcacaggtggttgctggagtaatatatgtgattgagttcatagccagagaaactaactgttccaagcaaagtaaaacagaactgacagcggattgtgagaccaaacacctcggtcaaagcctcaactgcaatgctaacgtgtacatgagaccttgggagaacaaagtcgtcccgactgtcagatgccaagcactagatatgatgatttctaggcctccaggattttcacctttccggctggtgcgagtacaagaaactaaagaaggaacaactaggctcctaaactcatgtgagtacaagggcagactctcaaaggcaagggcaggcccagcacctgaccatcaggcagaagcttcaaccgtgacatcatagcctggcaaagacccggagtggaaggaccagaagactcctgggatgtgtgcagtatggaagcatgtttcttcatcacctgatcctgggtgaaataaagttcagactcg

SEQ ID NO: 3117 - DNA, 1882 bp, Rattus norvegicus
  Genbank Accession No. NM_012697
gcaggcctggctaaactggtgagggccctacccagccatgcccaccgtggatgatgtcctggagcaagttggagagtttggctggttccagaaacaagccttcctgttgctatgcctgatctcagcttctttagctcccatctatgtgggcatcgtcttcctgggcttcacccctggacattattgccagaatcctggggtggctgagctgagccagcggtgtggctggagccaggcagaggagctgaactacactgtgccgggcctgggaccttcggacgaggcctccttcctcagccagtgcatgaggtatgaggtggactggaaccagagcacccttgactgtgtggacccactgtccagcctggttgccaacaggagtcagttgccattgggcccctgcgagcatggctgggtatacgacactcccggctcctccatcgtcactgagtttaacctggtgtgtggagacgcctggaaagtggacctttttcagtcctgtgtgaacttgggcttcttcctgggctccctggttgtgggttacattgcagacaggtttggccgtaagctctgtctcttggtgaccacgctggtcacatctgtgtccggtgtgctaacagcggtggccccagactatacatccatgttgctctttcgcctgctgcagggcatggtcagcaagggcagctgggtgtccggctataccttgatcacagagtttgtcggctctggctacaggagaacgacggccattttgtaccagatggccttcacagtggggctagtggggcttgccggggtggcctatgccattccagactggcgctggctccagctagctgtgtccctgcctaccttcctcttcctgctgtattactggtttgtcccagaatccccccggtggctgttgtcccagaagagaaccacgcgagctgtcaggataatggagcaaattgcacagaagaacgggaaggtgcctcctgctgacctgaagatgctctgccttgaggaggatgcctcagaaaagcgaagtccttcgtttgccgacctgttccgcactcccaacctgaggaagcacaccgtcatcctgatgtatctatggttctcttgtgctgtgctgtaccagggtctcatcatgcacgtgggagccacaggggccaacctctacctggacttcttttattcttctctggtggaattccccgcggccttcatcatcctggtcaccattgaccgcattggccgcatctacccaatagcggcctcgaatctggtgacgggggcagcctgcctcctcatgatctttatcccgcatgagctgcactggttgaacgttaccctcgcctgtcttggccgtatgggggccaccattgtgctgcagatggtctgcctggtgaacgctgagctgtaccctacattcatcaggaatcttgggatgatggtatgctctgccctgtgtgacctgggtgggatcttcacccccttcatggtgttcaggctgatggaagtttggcaagccctgcccctcattttgtttggggttttgggcctgactgctggggccatgactcttcttctcccagagaccaagggtgtggctttgcctgagactattgaagaagcagagaacctggggaggaggaaatcaaaggccaaagaaaacacgatttaccttcaggtccaaacaggcaagtcctcaagtacctgacagggatgctgtgccaggagctgagtggcagagagaaaggaggacttgccacttggaggattcccagaagcctttgcctttccagactcttgtatatatgcaccaggttccaaatgaactaccaaccttaaagacttttctgaaagcccaaaaaaaaaaaaaaaaaaaaaaaaa

SEQ ID NO: 3118 - DNA, 453 bp, Rattus norvegicus
  Genbank Accession No. NM_012703
atgcaagtgctaacgaaacgctaccccaagaattgcctgctgaaggtcatggatcggtactcggctgtggtgcggaacatggagcaagtggtgatgatccccagccttctgagggatgtggagctgatggggtacggaggctcggtccaggacggagcccccgatctctatacctacttcaccatgctcaagagcatctgtgtagaagtagaccacgggctgctgccgcgggaggaatggcaggccaaggtggcaggcaatgaaggcagtgaggctgagaatgaggctgctgaaacagaggaggctgaggaagacaggctttcggaggagctggacctagaagcccagttccacctgcacttctccagcctccatcacatccttacccacctgacccagaaagcacaggaggtgacgcagaaataccaggaaatgacggggcaggtcctgtag

SEQ ID NO: 3119 - DNA, 1253 bp, Rattus norvegicus
  Genbank Accession No. NM_012704
cgccgtcctccagcgcgctccgctgcaaccccgcagctgagcccagaggctccggccctgtgcgccctaccgcggccccgccactatggccggcgtgtgggcgccggagcactcggttgaagcgcacagcaaccagtcaagtgctgccgacggctgcggctctgtgtccgtggccttccccatcaccatgatggtcactggcttcgtgggcaacgcgctggccatgttgcttgtgtcgcgcagctatagacgccgggagagcaaacgcaaaaagtctttcctgctgtgcattggctggctggcgctcaccgacttggtggggcagctcctgaccagtccggtggtcatcctcgtgtacctgtcgcagcgacgctgggagcaactcgacccatcggggcgcctgtgcaccttcttcgggctgaccatgacagtgttcggactgtcctcgctcttggtggccagcgccatggccgtggagcgcgccctggctatccgtgcgccgcactggtatgccagccacatgaagactcgcgccacgcgcgcggtactgctgggtgtgtggctgtctgtgctcgccttcgcgctgctgcctgtgctgggcgtgggccgctacagcgtgcagtggcccggcacgtggtgcttcatcagcaccgggccggcgggcaacgagacggactctgcgcgggagccgggcagcgtggcctttgcctccgccttcgcctgtctaggcttgctggctctggtggtgacctttgcctgcaacctggcgaccatcaaagccctggtgtcccgctgccgggccaaagccgccgcctcgcagtccagcgcccagtggggccggatcaccacggagacggctatccagcttatggggatcatgtgtgtactgtccgtctgctggtcgccgctattgataatgatgctgaaaatgatcttcaatcagatgtcagtagagcaatgcaagacgcagatgggaaaggagaaggagtgcaattccttcctaatcgccgttcgcctggcttcgctgaaccagatcttggatccctgggtttatctgctgctaagaaagatccttcttcgaaagttctgccagatgatgaacaacctgaagcggagtttcattgcaatacctgcttccctgagtatgagaatttcttcccccagggaaggataactgaatcattttggattgtatcttctttcggcctcatattttaagttttccttgccattaaacacaccgagacaagctt

SEQ ID NO: 3120 - DNA, 880 bp, Rattus norvegicus
  Genbank Accession No. NM_012708
gatctccgcactgctaggatgctgcaagccggagcacctaccgccggctctttccggacgggagaagtccacaccgggacaaccatcatggctgtggaatttgacgggggtgtcgtggtgggctctgattcccgagtgtcagcgggagcagccgtagtgaaccgcgtgtttgacaagctctcccctctgcaccagcgcatctactgtgccctctcgggttccgctgctgatgcccaagccatagccgacatggccgcctaccagctggagctgcacgggttggaactggaggagccgccccttgttctggctgctgcaaacatagtgaagaacatctcctacaagtaccgcgaggacttgttagcgcatctcatggtagctggttgggaccaacatgaggggggccaggtgtatggaaccatgggagggatgctaattcgacagccctttgcgatcggcggttccggaagcacctatatttacggttatgtggacgcagcttataaaccaggcatgacccccgaggagtgccggcgtttcaccacagacgccatcactctggccatgaaccgagatggctccagtgggggtgtcatctacctggtcaccattacagctgatggtgtggaccatcgcgtcatcctgggagacgagctgccaaaattctacgatgagtgaagtcccttctttgtttgcaataaactttatggagccagaggttggtgtaatgggcagaggtgaaatgggtatcagagaaacggagtgcgtggagggaagcttcctcccggccgagagatcagcaagcacctcccattcttttttaaaaaataaactttattattaaaataaaaaactcttataaataaaaaataagtaaaac

SEQ ID NO: 3121 - DNA, 2599 bp, Rattus norvegicus
  Genbank Accession No. NM_012713
gaattccgcctctccgggcttacagcccgcggtcccgccgccccggggccgccacctctcggggctccccccagtccccgcgcgcgcaagatggctgacccggctgcggggccgccgccgagcgagggcgaggagagcacggtgcgcttcgcccgcaaagggcccctccggcagaagaacgtgcacgaggtgaagaaccacaaattcaccgcccgcttcttcaagcagcccaccttctgcagccactgcaccgacttcatttggggcttcgggaagcagggattccagtgtcaagtctgctgctttgttgtacacaagcgctgccatgaattcgtcacgttctcctgccctggtgcagacaagggcccggcctctgatgacccacggagcaaacacaagtttaagatccacacctactccagccctaccttctgtgaccactgtggatcactgctgtatgggctcatccaccaggggatgaaatgcgacacctgtatgatgaatgtccacaagcgctgcgtgatgaacgtccccagcctctgtggcaccgaccacacagaacgccgtggccgcatctacatccaggcccacatcgacagggaggtcctcatcgttgttgtaagagatgctaaaaatctggtacctatggaccccaacggcttgtcagatccctacgtaaaactgaaactgatccctgatcccaaaagtgagagcaagcagaagaccaagactatcaaatgctccctcaacccggagtggaacgaaaccttcagatttcagctgaaggaatcagacaaagacagaagactgtccgtagagatctgggattgggacctgaccagcaggaatgacttcatgggatctctgtcgtttgggatttcagaactacagaaagccggagtggatggctggttcaagttactaagccaggaagaaggcgagtactttaatgtgccggtgccgccggaagaaagcgagggcaatgaagagctgcggcagaagtttgagagagccaagattggccaaggtaccaaggctccagaagaaaagacagcgaacactatatccaaatttgacaacaatggcaacagggaccggatgaaactgaccgattttaacttcctgatggtgctggggaaaggcagctttggcaaggtcatgctctcagagcggaagggtacagatgaactctatgccgtgaagatcctgaagaaagatgtggtgatccaagatgacgatgtggagtgcacaatggtggagaagagggtgctggccctgcctgggaagcccccattcctgactcagctccattcctgcttccagaccatggaccgcctctactttgtgatggagtatgtgaacgggggcgacctcatgtaccacatccaacaagttggccgtttcaaggagccccatgctgtattttacgctgcagagattgccatcggtcttttcttcttgcagagcaagggcatcatttaccgtgacctgaaacttgacaacgtgatgctggattccgaggggcacatcaaaatcgctgactttggcatgtgtaaagagaatatctgggatggggtgacaaccaagacattctgtggcactccagactacattgccccagagatcattgcttatcagccctacggaaagtctgtggactggtgggcgtttggagtcctgctgtatgaaatgttggctggccaggcaccttttgaaggggaggatgaggatgaactcttccagtcaatcatggagcacaacgtggcgtatcccaagtccatgtctaaggaagctgtggcaatctgcaaagggctaatgaccaaacacccaggcaagcgcctgggttgtgggcctgaaggggaacgagacattaaggagcatgcatttttccggtatatcgactgggagaaactcgaacgcaaggagattcagccaccttataaaccaaaagctagagacaagcgagacacctccaacttcgacaaagagttcaccaggcagcctgtggaactgactcccactgacaaactcttcatcatgaacttggaccaaaatgaatttgctggcttctcgtatactaacccagagtttgtcattaatgtgtaggtgaatgcagattccatcgctgagcctgtgtgtaaggctgcagcgtgaatgtctattatcaattccagtcttccaggattcatggtgcctctgttggcatccgtcatgtggagagcttgtcttagagggcttttctttgtatgtatagcttgctagtttgttttctacatttcaaaatgtttagtttagaataagtgcattgcccactgatagaggtacaattttccagacttccagaaactcatccaatgaaccaacagtgtcaaaacttaactgtgtccgataccaaaatgcttcagtatttgtaatttttaaagtcagatgctgatgttcctggtcaaagtttttacagttactctcgaatatctcctttgaatgctacctaagcatgaccggtatttttaaaagttgtgagtaagctttgcagttactgtgaactcttgtctcttggaggaactttttgtttaagaattggtatgattaaactgaattc

SEQ ID NO: 3122 - DNA, 1395 bp, Rattus norvegicus
  Genbank Accession No. NM_012715
gacactaggcagaacaactccagcctttaccgctcctggtttctcggcttctcatcgcagtcagtcttggactttgcgggttttgccgctgtcagaaggacgtctcggactttctgcttcaagtgcttgacaactcaccctttcagcagggtatcggagcatcgctacagaatgaagctggtttccatcgccctgatgttattgggttcgctcgccgttctcggcgcggacaccgcacggctcgacacttcctcgcagttccgaaagaagtggaataagtgggcgctaagtcgtgggaagagggaactacaagcgtccagcagctaccctacggggctcgttgatgagaagacagtcccgacccagactcttgggctccaggacaagcagagcacgtctagcaccccacaagccagcactcagagcacagcccacattcgagtcaaacgctaccgccagagcatgaaccaggggtcccgcagcactggatgccgctttgggacctgcacaatgcagaaactggctcaccagatctaccagtttacagacaaagacaaggacggcatggcccccagaaacaagatcagccctcaaggctatggccgccggcgccggcgttccctgccagaggtcctccgagcccggactgtggagtcctcccaggagcagacacactcagctccagcctccccggcgcaccaagacatctccagagtctctaggttataggtgcgggtggcagcattgaacagtcgggcgagtatcccattggcgcctgcggaatcagagagcttcgcaccctgagcggactgagacaatcttgcagagatctgcctggctgcccctaggggaggcagaggaacccaagatcaagccaggctcacgtcagaaaccgagaattacaggctgatactctctccgggcaggggtctgagccactgccttgcccgctcataaactggttttctcacggggcatacgcctcattacttacttgaactttccaaaacctagcgaggaaaagtgcaatgcttgttatacagccaaaggtaactatcatatttaagtttgttgatgtcaagaggttttttttttgtaacttcaaatatatagaaatatttttgtacgttatatattgtattaagggcattttaaagcgattatattgtcaccttcccctattttaagaagtgaatgtctcagcaaggtgtaaggttgtttggttccccgtgtgtgtgtgtgtgtgtgtgtgtgtgtgtgtgtgtgtgtgtgtgtaaggtggagagcgcctgattaccgcctgtggatgaagaaaaaacattgtgtcttctataatctatttacataaaatatgtgatctgggaaaaagcaaaccaataaactgtctcaatgctg

SEQ ID NO: 3123 - DNA, 2095 bp, Rattus norvegicus
  Genbank Accession No. NM_012717
gggaactcttttctactatctcagaaaatcaaattccctcctgagactattcacacagaatttccttaggagccgtgcggggccctatgatgatacaccaacatcttgtgctaccaactgtcaaaactttggatggtctaacactcaggtcatgacccttgtaattaagaaattctcgaagacaatattgagcatgattcaggagaaaatgtgatttgagtctggagacaattgtgcatgtatatcttttcttaagatcttaaaaagaaagagaaaacaaatccagggttgtcggtcactgattgatagaagagaaaacaatattcagacgattgcttatgattgacaagagcagctgcggccgctacccagcttgaacatatcgcacacttcagttggactctaatgatggataaaaagtgtacactatgttttctgtttctcttgcttcttaatatggctctcatcgcagcagagtcggaagaaggcgcgaaccaaacagacttgggagtcactaggaacaagatcatgacggctcagtatgaatgttaccaaaagatcatgcaggatcccattcaacaaggagaaggcctttactgcaacagaacctgggacggatggctatgctggaatgacgttgcagcaggaaccgagtcaatgcagtactgccctgattactttcaagattttgatccttcagagaaggttacaaagatctgtgaccaagatggaaactggttcagacatccagatagtaacaggacatggacaaactacaccttgtgtaacaacagcacgcatgagaaagtgaagacagcactgaatttgttctacctaactataattggacatggattatctattgcctctctgatcatctcactcatcatatttttttatttcaagagcctaagttgccaacggattacattgcataaaaacctgttcttttcatttgtttgtaattcgattgtgacaatcattcacctcacggcagtggccaataaccaggccttagtggccacaaatcctgtgagctgcaaggtgtcccagttcattcatctttacctgatgggctgtaactacttttggatgctctgtgaaggcatttacctgcacacactcattgtggtggctgtgtttgcagagaagcagcacttgatgtggtattattttcttggctgggggtttcctctgcttcctgcctgcatccatgccatcgccagaagcttgtattacaatgacaactgctggatcagctcagacactcatctcctctacatcatccatggtcccatttgtgctgctttactggtaaatctctttttcctattaaatattgtacgtgttctcatcaccaagttgaaagttacacaccaagcagaatccaatctctacatgaaagctgtaagagccactctcatcttggtaccactacttggcattgaatttgtgctttttccatggcggcctgaaggaaaggttgctgaggaggtgtatgactatgtcatgcacattctcatgcactatcagggtcttttggtgtctacaattttctgcttctttaacggagaggttcaagcaattctgagaagaaattggaaccagtataaaatccaatttggcaatggcttttcccactctgatgctctccgcagcgcatcctatacggtgtcaacaatcagcgatgtgcaggggtacagccacgactgccccactgaacacttaaatggaaaaagcatccaggatattgaaaatgttgccttaaaaccagaaaaaatgtatgatctagtgatgtgaaaatacagaaatctcacttgttttgtgtcacttgaacctatgattttatagtcggaagatttaatagcaaatgggtttcttgaataccatgaagaaagccctcaaatgaaatgagaattgtgtggataaatgtttaacgaccctctctctatgggggagaaaagcctcaatttttattgttggccagtaaatactcctaccatagctgatttcaagttaccaacctgacatcaccgaatgtggaattggaaagaaaataagcacaatcaactcttgggagctgacatgcgtcgtc

SEQ ID NO: 3124 - DNA, 1698 bp, Rattus norvegicus
  Genbank Accession No. NM_012730
ccttaaaagggggtaaagctgcactttaagggaccaggttcccagtctgttgtaagaggatctttcctgattctaagtgtctggacaagtattccttcaaaagcctgcaagccgtggggcagccatggggctgctgattggagatgacctctgggctgtggtcatattcacagccatcttcttgcttctggtggacctggtgcaccggcacaaattctggactgcccactaccctcccggccctgtgccactccctgggctgggaaacctgctgcaggtggactttgagaacatgccatatagcttatacaagcttcgaagccgctatggtgacgtgttcagcctacagatagcctggaagcctgtagttgtgatcaacgggctgaaggccgtgcgggaactgctggtgacctatggagaggacactgctgaccgccccctactgcccatctataatcacctgggctatggggacaaatcaaaaggtgtggtccttgcaccttacggacctgagtggcgagagcagagacgattctctgtgtccaccctgcgtgacttcggcgtgggcaagaaatcgctggagcagtgggtgacagaggaggccggccacctctgtgacaccttcgccaaggaggctgaacatcccttcaatcccagcatcctcctgagtaaggctgtgagcaacgtgattgcctcccttgtttatgctcgtcgatttgagtatgaggaccctttcttcaacaggatgctcaaaacattgaaggagagctttggagaggacaccggcttcatggcagaggtgctgaacgcaatcccaattctccttcagattcctgggctgcctggcaaagtcttccccaagctcaattcatttatagccttagtggataagatgttaattgagcacaagaaaagctgggatcctgcccagccgccccgagacatgactgatgccttcctagcagagatgcaaaaggccaaggggaatcctgagagcagcttcaatgatgaaaatctgcgcttggtggtgattgacctgttcatggcggggatggtgaccacctcaaccacactgtcctgggcccttctgctcatgatcctgcatccagatgtgcagcgccgagtccacgaggagattgatgaggtcatagggcaggtgcgtcgtccagagatggcagaccaggcacgaatgccgttcaccaatgctgtcatccatgaggtgcagcgctttgcagacatcgtcccgacaaatataccacatatgacatcccgagacattaaattccaaggcttcctcatccccaaggggacaaccctcatccccaacctgtcctccgtgctgaaggatgagactgtctgggagaagcccctccgcttccatccagaacacttcctggatgcccagggcaactttgtgaagcatgaggccttcatgccattctcagcaggccgcagagcatgcctgggggagcccctggcccgcatggagctcttcctcttcttcacctgcctcctgcagcgcttcagcttctcggtgctggccggccggccccggcccagcacccatggcgtctacgcattgccagttactccacagccttaccaactctgtgcagtggctcgctagcaggggcaggggctccattcttctccccggtttggtctgattgatgtccaataaacaacttctgtatcttc

SEQ ID NO: 3125 - DNA, 3144 bp, Rattus norvegicus
  Genbank Accession No. NM_012732
ccgtgactgaagaagccattgccaagggtatcgcaggattgttgctgtcacaggtgctgtagactgaggttgaaggactaccccggagacggctgcagtcgttcggttcctgtctcttccgtgtaggatttgatttctcctaaacttggtttaagacttttaaagaaggccctaatttatcgaggcctgtttgtgaagtaaaattcggctggctactctcaacggaagaaagatgcaactgctaggccgggtgatctgtttcgtcgttgggatcctgctttctgggggcccaacggggaccatatcagctgtggaccctgaagcaaacatgaatgtgactgagataatcatgcactggggatatccagagcactcagtacagacaggagatggctacattctgggtgttcaccgaatcccgcatgggcggaagaaccagtttgataaaggtcccaaaccagttgtgtatcttcagtggcgacatggcttcctggcagattctagtaactgggtcacaaacattgacaacaacagcctgggcttcatcctggcagatgctggctttgatgtgtggatgggaaacagcagaggaaacacctggtctcggaagcacaagactctgtcagtttctcaggatgaatactgggccttcagttttgatgagatggcaaaatatgacctccctgcttcaattaactacattttgaataaaactggccaagaacagctgtataatgtgggccactctcaaggctgcaccataggttttatagcattttcacagatgcctgaactggcaaagaaggttaaaatgttttttgccctggctcctgtgttgtctctcaattttgcttcgggcccgatggtcaaattgggacggttgccggatctgcttcttgaggacttgtttgggcagaagcaatttcttcctcagagtgcaatggtgaaatggctaagcactcacatttgcacgcacgtcatcatgaaggagctttgcgccaacatcttctttctgatatgtggcttcaatgagaagaatttaaacatgtctagagtggatgtgtatacaacacactgtcctgcgggaacctctgtgcaaaacatggtacactggacccaggttgttaaataccataagcttcaagcttttgactggggaagcagtgacaagaattattttcattacaatcagagttatccacccttgtacagcataaaagacatgcaactacccactgctttatggagcgggggcaaggactggctggcagacaccagtgacatcaatatcttactgactgaaatccccacgttagtgtaccacaagaacattcccgagtgggaccatctggattttatctggggtttggatgccccctggaggctgtataatgaagtagtcagtctaatgaagaaataccagtgagtgccaagacttgagatgcttccccttcactaggggaaaaaaggacagatgtttgcttaattcctgcaaaatactgtgttttcctggtctagatcatttgtattttttatgtgcaagaaaacgatgatgttgaagacatacatgggtctggtcagtaagaagcacgctggctgtcttctgcttcattctgactgacaagccagagtcacaaccagtgatgcctttgaagtttttagaaagtatgggtgttacgtgaaagaagccattgcaacctcttgtttactttttacggtcgttttcggtgtctgcatgctgtgcatatacatgcctatgtgtgtgccctgtgctggccagagcctccttgtgtggaggtaatggctcacatcagggtatcttccctcagacactggtctctcgacgaaccagtcagtagcttgctattccagttagactggctgaccagggagcctccagaatctgtccgtctctaccttccctcaccaggtctacggagggtgatgtcccagccagcattttacactggttctagggacaggaactcaggttctcatgcttgatagcaagccctttcttcaccaaaccattgcctcaaaccctctgtgatcgaaaagctgctcaattacctttatgttcccacccaatgcaagtgaacgagcacaagacatttcaagctgttgtttgtgagctaaaaatcaatctgccagtgacttgaacatgctagggagaaactcctggccctgagcttgacaaacctgcagtccaggttctccagagattgagacagggaggctgctgttacatttagggttcatttggagagtgagactttgtctctacaaaaccaaagacaaaggagaagaagaaaaaaaaaaccctaaagtactcagttctcatctgttagcctcagagggcttagagagttcctgtgtttacctatccgaacaacattttcatgtctttatgcagtagctacctagtgaaatccagtgttatcccagcttctccaggcgtaaacattctctcttcaatctcatcagacctcagtagcaagcatttagtgaatatttagatttttcaggccaagccaagacaaaaatgaatagaataaaagaaaaaagagcccagactcttgaaagcggtttgcactgatttaaaaataaaaaaaaagaatcttgaagaatgacatgataaactgtgttggttccgcatgtgtagtcggatcccttttctgtggagaacgttctgtggagggacaaaccactaatttgccccaagtgaatgtggctgtagtgacagcgacagtgcctctgatcctgagaagcagggctggctgccggtgacaagcatcccagttcctttccccagagatgaagaggatgttttcagacagagctcggctcagggaatttcgcttggagaatcagtggtttatgtgcacaatgttttagtgagcctgctctgcgcctgatatggggaagccctcgactgttcaccgggctcgtgggcgacggctgccgtcagctggacagtggataagttttctgagtagtcaccacagattcagggatatcgctttgtgtcgactcctaaggaaggcaggacgatatgacttggtaacattgtaaaggttcacatttaaacttttcaataaatctcagcctcacaggcctgaacatcaaaaaaaaaaaaaaaaaaaa

SEQ ID NO: 3126 - DNA, 695 bp, Rattus norvegicus
  Genbank Accession No. NM_012733
ccttcacccggagcgcattggcagccacagtcccagcggacgccacagccgctcccgccttctccgtgtcggcgatccccagtctgtccccaaaatgcctgtggacttcaacgggtactggaagatgctgagcaacgagaatttcgaggagtacctgcgtgcgctcgatgtcaacgtggccttgcgaaaaatcgccaacttgctgaagccggacaaagagatcgtgcaggatggcgaccacatgatcatccgcacgctgagcacttttcgaaactatatcatggacttccaagttgggaaggagttcgaggaggatctgacaggcatagatgaccgcaagtgcatgaccacagtgagctgggatggtgacaagcttcagtgtgttcagaagggagagaaggagggacgtggctggacccagtggattgagggtgatgaacttcacctggagatgagagcagagggtgtgacctgcaagcaagtgttcaagaaagtacactgagcggcccgagcagataaccttggtctcgaggaacaagtgggatggcccaatggtcaggagccctctctgcctagcacagggctgaaacacatagccaccccaggtttctgccagcagagtctgtctcattgccttgtctcttttccttttcttaaaatgaagctaccccaataaaaatgatctctgtttaaga

SEQ ID NO: 3127 - DNA, 3653 bp, Rattus norvegicus
  Genbank Accession No. NM_012734
cgccgatctgccgctggaggaccactgctcaccagggctactgaggagccactggccccacacctgcttttccgcatcccccaccgtcagcatgatcgccgcgcaactactggcctattacttcaccgagctgaaggatgaccaagtcaaaaagattgacaagtatctgtacgccatgcggctctctgatgagattctgatagatatcctgacacgattcaagaaagagatgaagaatggcctctcccgggattataatccaacagcctccgtcaagatgctgcccaccttcgtccggtccattccggacggctcagaaaagggggatttcattgccctggatctcggcgggtcttcctttcgaatcctgcgggtgcaggtgaaccacgagaagaaccagaacgtcagcatggagtctgagatctacgacaccccagagaacatcgtgcatggcagtggaacccagcttttcgatcatgtcgctgactgcctgggagacttcatggagaaaaagaagatcaaggacaagaagttacccgtgggattcacattttccttcccctgccgacaatccaagatagatgaggctgtactgatcacgtggacaaagcggttcaaagccagtggcgtggaaggagcggatgtggtcaagttgctgaataaagccattaagaagcgaggggactatgatgctaacattgtcgccgtggtgaatgacacagtagggaccatgatgacctgcggttatgatgaccaacagtgtgaagtcggcctgatcattggcacaggcaccaatgcttgctacatggaggaactgcgacacatcgacctggtggaaggcgacgaggggaggatgtgtattaacacggaatggggagcctttggggatgatgggtccctggaagacatccgaaccgagtttgacagagagttagaccgtggatctctcaaccctgggaagcagctgttcgagaagatggtgagcggcatgtacatgggggagctggtccggctaatcctggtgaagatggccaaggaaggcctcttattcgaagggcgcatcactccagagctgctcacgaggggaaagttcaacactagtgacgtgtccgccattgaaaaggataaggaaggcattcaaaatgccaaggaaatcttaacccgcttgggagtggagccgtctgatgttgactgtgtgtcggtccagcacatctgcacgatcgtctccttccgatcagccaacctggtggccgccacgctcggtgccatcttgaaccgcctgcgggacaacaagggcacaccacgcctgcggaccacggttggcgtggacggttctctctacaagatgcacccacagtactcccggcggttccacaagaccctgaggcgcctggtgcctgactccgacgtccgtttcctcctctcagagagtggcacgggcaagggggccgccatggtgacggcagtagcctaccgcctggctgagcagcaccggcagattgaggaaaccctggcccacttccgcctcagcaagcagacgctgatggaggtgaagaagaggctacggacagagatggaaatggggctgaggaaggagaccaacagcaaagctactgtcaaaatgctgccttcttttgtccggagcatcccggatgggactgaacacggtgacttcctggccttggatcttggaggaacgaatttccgggttctgctggtaaagatccgcagtgggaaaaagagaacagtggaaatgcacaacaagatctactccattcccctggaaatcatgcagggcaccggggatgagctgtttgaccacatcgtctcctgcatctctgacttcctggactacatggggatcaaaggcccccggatgcctctgggcttcaccttctcatttccctgccatcagacgaacctggactgtggaatcttgatctcatggacaaagggtttcaaagccactgactgtgagggccatgatgtagcctccttactgagggatgcggtgaagaggagagaggaatttgacttggatgtggtggctgtggtcaacgacaccgtgggcaccatgatgacctgtgcgtatgaagaacccacttgcgaaattggactcatcgtggggacgggcaccaatgcctgctacatggaggagatgaagaatgtggagatggtggaggggaaccagggccagatgtgcatcaacatggagtggggcgccttcggtgacaatgggtgtctggatgacatcagaacagactttgacaaagtggtggacgaatattctctaaactctgggaaacaaaggtttgagaaaatgatcagtgggatgtacctgggtgagatcgtccgtaacatcctgattgacttcaccaagaaaggcttcctcttccggggacagatctccgaaccactcaagacccgaggcatctttgagaccaagtttctctctcagattgagagtgaccggttagcgctgctccaggtgcgggccatccttcagcagctgggtttgaacagcacgtgtgacgacagtatcctggtcaagaccgtgtgtggggtggtgtccaagagggcggctcagctgtgtggtgccggcatggccgccgtggtggaaaagatcagagagaacagaggcctagaccatctgaatgtaactgtgggagtggatgggacgctctacaaacttcatccacacttctccagaatcatgcaccaaactgtgaaggaactgtcaccaaagtgtaccgtgtccttcctcctgtctgaagacggcagcggcaagggggccgcccttatcacagctgtgggcgtgcggctcagaggagacccttcgatcgcctaaaagccaggatcctcccagcccccagcccgccacccttccagcactcctctctagaaccgacgaccacacccccgtgttccacccagcaagccctgggagacccagccagcgcccactccgccgcagcagagggaggaaggggaccgcagtaacggagcaccacgtagaataccacccagagcgcgtgtgctgttgatctgatctctcgcctggacccctaatccctgccctgccactctgcatgattcaagttcgacctggccatgcattgcccatgagtgaacgtagcggcaccccggtgcgtctactgcagatgtccagctaggaaagagtcccctctcttggacagtcttctgggcccttccaagcccatccgtggagtcggcctctcctcccctctcccccgtgtgaagtgtgttatcaccagcagacactgccggactcctgcccacaggggcgtggcctgaaggcggagtgtggacatggcactgctgttccgttcccttcccctcccagcacccgccgcagcctgccatcccgtctggatgtatcgatgccacagaattgtgaattgtgtgtccgtccgtggagccagtcctagccacattattgacagtcttgcattttgttttgtctcctggtggtgggggtggaggtggtaggggtgcgctaaggtgggcagtcctgtgggagaacatcttgctagaaggaaccaacccacgaaacaacaccatcactggaatttccatcgcccgaattctttagtgagccattgttgtacgtctagtaaactttgtactgattc

SEQ ID NO: 3128 - DNA, 2400 bp, Rattus norvegicus
  Genbank Accession No. NM_012736
ggtgaggccgactgactccgttctagctggaggttcctgacttccctgctcgccgacccctggcgtgtgacgaccgatctcaggctgagcaatggcgtttcaaaaggtagtgaaagggactattcttatgggtggaggagctctggccactgttttgggactctctcagtttgctcactacagaaggaagcaagtaagcctggcgtatgtggaagcagcaacatgcttctcagagcccgtgaacagggagcctccttccagagaagctcagctcatgactctgcagaacacatcggaatttgacatcctcgtcattggaggaggagccacaggatgtggctgtgcgctagacgccgtcaccagaggactgaaaacagcccttgtagagagaaatgacttcgcatcagggactagcagcagaagcactaaattgatccatggtggcgtacgatacctccagaaggctatcacgaacttggatgttgaacagtataggatggtgaaagaggcccttcatgaacgtgccaacttactagaaatcgctccccatctatcagctccgctgcctataatgctgccactttataagtggtggcagttaccttattactgggtgggaatcaagatgtatgatctggttgcaggaagtcattgcctgaagagcagttatgtcctcagtaaatccagagcccttgagcatttccccatgctccagaaggacaagctggtcggagccattgtctactatgatggacagcacaatgacgcccggatgaacctcgccatcgccctcaccgctgccaggtacggggctgccacggccaattacatggaggtggtgagcttgctcaagaagacagaccccgaaactgggaaagagcgcgtgagtggtgcccggtgcaaggacgtgctcacagggcatgagtttaacgtgagagctaaatgcgttatcaatgccaccggccctttcacagactccgtgcgcaaaatggatgataacgatgttgttcccatctgccagcccagtgcaggggttcacattgtgatgcccgggtactacagccccgagaacatgggacttcttgatcctgcaaccagtgatggcagagttattttcttcttgccttgggagaagatgacaattgcgggtaccactgattcgccaacggacgtcacgcaccatcctattccttcggaagacgacattaacttcatcttaaatgaagtgcggaactacctgagttgcgacgttgaagtgagaagaggggatgtcctggcagcgtggagtggcattcgcccgcttgttaccgatcccaagtctgcaaacactcagtccatctctcgaaatcatgttgtggaagtcagcgacagtggcctcatcacaatagcaggtgggaagtggaccacatatcgctccatggcagaagatactgtgaacaaagctgtcaagcttcacaacttgaatgcaggacccagtaggaccgttgggctcttccttcaaggaggcaaagattggagccccacactctacatcaggcttgtccaggactatgggcttgagagtgaggttgcacaacacctggccaaaacctatggtgacaaggctttcgacgtggccaaaatggcaagtgtgactggaaaacggtggcctgttgttggagtgcgtcttgtgtcagaatttccgtacatcgaagcagaggtgaaatatgggattaaggagtacgcatgcaccgctgttgacatgatttcacgtcgcacccgcctggcctttcttaatgttcaggctgcagaggaagccctgcccaagattgttgagttaatgggaagagaattgaactggagtgaattgaggaaacaggaagaacttgaaacagccacgaggtttctgtactatgaaatgggctataagtctcgaacagaacaactcacagatagtactgaaatcagcctgctgcctccagacatcgatcggtacaagaagagatttcacatgtttgatgaagacgaaaaaggcttcattaccattgttgatgttcaacgtgtgctagagagtatcaatgtacaaatggacgaagacacactacatgaaattctctgtgaagtagacttgaacaagaatggtcaggttgagctccatgagtttctgcagctgatgagcgcagttcatacaggaagggtgtctggaagccggcttgccatcctcatgaagactgccgaggagaacttggaccgtagagttccaatccccgtggatcgtagttgtggaggattgtgagtctgaccaataaatccacaaccaacaagcctaggacagtcagcactatgtacaaccagagacgacttaaaccactctaaaatagtggccattgtagctgcctttttttttttttttttttaaaa

SEQ ID NO: 3129 - DNA, 1423 bp, Rattus norvegicus
  Genbank Accession No. NM_012737
aatcctcacagcgacacagtgaaccatttcttctgacgctaggaaacatccagtgtagctgaggctgtcccaacccagtgaggagcccaggatgttcctgaaggctgtggtgctgaccgtggccctggtggccatcaccgggacccaggctgaggtcacttccgaccaggtggccaatgtgatgtgggactacttcacccagctaagcaacaatgccaaggaggctgtggaacaactgcagaagacagatgtcactcaacagctcaataccctcttccaggacaaacttgggaacattaacacctatgccgatgacctgcagaacaagctggtgcccttcgccgttcaactgagtggacatctaaccaaggaaacagagagggtgagggaagagatccagaaggagctcgaggacctacgggccaacatgatgccccatgccaacaaagtgagccagatgttcggggacaacgtgcagaagttgcaggaacacctgaggccctatgccacggacctgcaagctcagatcaacgcacagacccaggatatgaaacgccagctgaccccctacatccagcgcatgcagaccacaatacaagacaatgtggaaaacctgcagtcctccatggtgccctttgccaacgagctaaaggaaaagtttaaccagaatatggaagggctcaaggggcaactaaccccccgtgccaacgagctgaaggccacgatcgaccagaacctggaagacctgcgcagcagactggcccctctcgcggagggtgtgcaggaaaaactcaaccatcagatggaaggcttggccttccagatgaagaagaacgctgaggagctccataccaaagtctccacaaatatcgaccagctgcagaagaatctggccccgctggtggaagatgtgcaaagcaagctgaaaggcaacacggaaggactgcagaagtctctggaagacctgaacaagcagctggaccagcaggtggaggtgttccggcgtgctgtggagcccctgggggataagttcaacatggctctggtgcagcagatggagaagttcaggcagcagctgggctccgattcgggggacgtggaaagccacttgagcttcctggagaagaacctgagggaaaaggtcagctcctttatgagcaccctgcaaaaaaaggggagcccagaccagcccctagccctccccctcccggagcaggttcaggaacaggtccaggagcaggtgcagcccaaacctctggagagctgagctgtccctgtgtcctcggcccatcacagcagcagacacctgccctgccccaccacctgtctgtcactctgttcccaagcacttctcgtaccagcttgaggacacatgtcctgtgggtgacgatacctcctctcgttactcaataaagcatctgag

SEQ ID NO: 3130 - DNA, 889 bp, Rattus norvegicus
  Genbank Accession No. NM_012738
agactgttggagagctccgggggaggtcgccacatccttcaggatgaaagctgcagtgttggctgtggccctggtcttcctgacaggttgccaagcttgggagttctggcagcaagatgagccccagtcccaatgggacagggtgaaggatttcgccactgtgtatgtggatgcagtcaaggacagcggcagagactatgtgtcccagtttgaatcctccactttgggcaaacagctgaacctgaatctcctggacaactgggacactctgggttcaactgttggtcgcctacaggaacagctaggcccagtgactcaggagttctgggctaacctggagaaagaaacagattggctgagaaacgagatgaacaaggacctggagaatgtgaaacagaagatgcagccccacctggatgaattccaggagaagtggaacgaggaggtcgaggcctaccgccagaagctggagcctctgggcaccgagcttcacaaaaacgcgaaggagatgcaaaggcatctaaaggttgtggccgaggagtttcgagaccgcatgcgtgtgaatgcagacgcgctgcgcgcaaagtttgggctctacagcgatcagatgcgcgagaacctggcccagcgcctgaccgagatcaagaaccaccctaccctgatcgagtatcataccaaggccagcgaccacctgaagacacttggtgagaaagccaaacccgcgctggatgacctgggccagggcctgatgccggtgctggaagcctggaaggccaaaatcatgagtatgatcgatgaggccaaaaagaagctgaacgcttagtgaggcgcccgtcaccactccccacccctgaattggctttcttacaataaacgtttccaaagtggg

SEQ ID NO: 3131 - DNA, 2218 bp, Rattus norvegicus
  Genbank Accession No. NM_012743
tctcccgggtattggctgcagctaagcggggcttcctgggccgactgaggtgggtagccagaaaaaggcctgaggtggctgacaaccagggcggccagacaacgcgagtcctgcgcgccttctgaggcctccctgggacttaactgtaacggggaggggcctctggagcagcggccagcgagttaaagtatgctgggagccgtgaagatggaagggcacgagccatccgactggagcagctactacgcggagcctgagggctactcttccgtgagcaacatgaacgccagcctggggatgaatggcatgaacacttacatgagcatgtccgcggctgcaatgggcagtggttccggcaacatgagcgcaggctccatgaacatgtcatcctatgtgggcgctggaatgagcccgtcgctggctggcatgtccccgggcgcgggcgccatggcgggcatgagcggctcagctggggcggccggcgtggcgggcatgggaccgcacctgagtccgagtctgagcccactcgggggacaggcggccggggctatgggtggccttgctccctacgccaatatgaactccatgagtcctatgtacgggcaggcgggcctgagccgcgctcgggaccccaagacgtaccggcgcagctacactcacgccaagcctccctactcgtacatctcgctcatcaccatggccatccagcagagccccaacaagatgctgacgctgagcgagatctatcagtggatcatggacctcttccctttctaccggcagaaccagcagcgctggcagaactccatccgtcattctctctccttcaacgactttctcaaggtgccccgcgcgccagacaagcctggcaagggctccttctggaccctgcaccctgactctggcaacatgttcgagaacggttgctacctgcgccgccagaagcgcttcaagtgtgagaacgaactggcgttgaaggaagcagcgggtgcgggcagtggcggaggcaagaagaccgctcctgggacacaggcttctcaggttcagctcggggaggccgcaggctcggcctctgagactccggcgggcaccgagtccccccattccagcgcttctccgtgtcaggagcacaagcgaggtggcctgagcgagctgaagggaacacctgcctctgcgctgagtcctccggagccggcgccctcgcctgggcagcagcagcaggctgcagcccacctgctgggcccacctcaccatcctggcctgccaccagaggcccacctgaagcccgagcaccattacgccttcaaccaccccttctctatcaacaacctcatgtcctccgagcagcaacatcatcacagccaccaccaccatcagccccacaaaatggacctcaagacctacgaacaggtcatgcactaccctgggggctacggttcccccatgccaggcagcttggccatgggcccagtcacgaacaaagccggcctggatgcctcgcccctggctgcagacacttcctactaccagggagtgtactccaggcctattatgaactcgtcctaagaagatggctttcaggccctgctagctctggccactggggagaaggacaagggaaatgacaggctgagtggaaacattgggggaactttgaggaaaaagtagccaccacacttaaggccccaaaggagcagtttcacctgtctgtgtccctaaatagctgggccacactgatctgtcattctaaatagggaagggaatggaaatatatatgtatacacataaacttgttttaatggaggacctttggttcccactatgtagactactgcttctcaaggcacctgcagattttgatttttgttcttgattctctctctattgctgtcgttgacagagaagtctgacttaaaaaaaaaacaaactaaacaaaaaaaaaaacttttgatgagtgacttgagtgtaaaaccatgtagttttaacagaaaaccagagggttgtattgatgtttaaaagagaaaaaaaaataatgatgtaagagtctggtataaatgaccaggagaaaggacaaaaatgcatccattctggacatggtgaaatccaggtctcgggtctgatttaatttatggtttctgcgtgctttatttatggcttataaatgtgtgttctggctagaatgccagagttccacaaatctatattaaagtattattgc

SEQ ID NO: 3132 - DNA, 3945 bp, Rattus norvegicus
  Genbank Accession No. NM_012744
cgcggcggccacggcttgaggcgacggggcgaagatgctgaagttccaaacagttcgagggggcctgaggctcctgggtgtccgccgatcctccacagcccccgttgcctccccaaatgtccggcgtctggagtacaagcccatcaagaaagtaatggtggccaacagaggtgagattgccatccgagtgtttcgtgcctgcacagagctgggtatccgcacagtggctgtctactcggagcaggacacaggccagatgcaccggcagaaagctgatgaagcctaccttattggccgtgggctggctcctgtgcaagcctacctgcacattccagacatcattaaggtggccaaggagaatggtgtagatgctgtgcaccctggctatgggttcctctcagagagagcagactttgcccaggcctgccaagatgctggagtccgattcattggtccaagcccagaggtggtccgcaagatgggagacaaggtggaagcccgggccattgccattgctgcaggcgttccagtggtccctggcactaattcccccatcaattccctgcatgaggcacacgagttctctaacacctatggtttccctattatcttcaaggctgcctatggaggtgggggccgtggcatgagggttgtgcatagctacgaggagctggaagagaattacacccgggcctaccctgaggccttggcagcctttgggaatggggcattgtttgtggagaaattcattgagaagccaagacacattgaggtgcagatcctaggggaccaatatgggaacatcttgcacttgtatgagcgggactgctccatccagcggcggcaccagaaggtggtagagattgcccctgctacccacctggacccccaacttcggtcacgcctcaccagtgactctgtcaaacttgccaagcaggttggctatgagaatgcaggcactgtggagttcctggtggacaagcatggcaagcactacttcatcgaggtcaattcccgcctgcaggtggagcacacggtcactgaggagattacagatgtggacctggtccatgctcagatccatgtgtccgaaggccggagcctgcctgacctaggcctgcggcaggaaaacatccgaatcaatggttgtgccattcagtgtcgggtcaccactgaggaccctgcacgcagcttccagccagacactggccgcattgaggttttccggagtggtgagggcatgggcatccgcctggacaatgcctcagcattccagggagctgtcatatccccccactatgactccctgctcgtcaaagtcattgcccatggcaaagaccaccctacagctgccaccaagatgagcagagccctggcggagttccgtgtccgaggtgtaaagaccaacatccccttcctgcagaatgtgctcaacaaccagcagttcctagcgggcattgtggacacccagttcatcgatgagaaccccgagctgttccagctgcggcctgcacagaaccgggcccagaagttgctacattaccttggacacgtcatggtcaatggccctaccactccaatccccgtcaaggtcagtcccagccctgtggaccccattgttcctgtggtgcccataggcccacccccagctggtttcagagacatccttctgcgagaggggccagagggctttgccagagctgtgcggaatcaccaggggctgctgctaatggacacaaccttccgggatgcccaccagtcactacttgccactagagtgcgcacacacgatctcaaaaagattgcaccctacgttgcccacaacttcaacaacctcttcagcatagagaactggggaggagccacatttgacgtggccatgcgcttcttgtatgagtgcccctggcggcggctccaggagctccgggagctcatccccaacatcccattccagatgctactgaggggggccaatgctgtgggctacaccaactaccctgacaacgtggtcttcaagttctgtgaggtggccaaagagaatggcatggacgtcttccggatctttgactcccttaactacctgccaaacatgctgctgggcatggaagcagctggcagtgctgggggtgtggtggaagctgccatctcctacacgggtgacgtggctgaccccagtcgcactaaatactcactggagtactacatgggcttagctgaagaactggtgcgagccggcactcacatcctctgcattaaggacatggcaggcctgctgaagcctgcagcatgcaccatgctggtcagctccctccgggaccggttccccgacctcccactgcacatccatacccatgacacatcagggtcaggtgtggcagccatgttggcctgtgcacaagctggggctgatgttgtggatgtggcagtcgactctatgtctgggatgacctcacagcccagcatgggggccctggtggcctgtaccaaagggactcctctggacacagaggtacccctggagcgtgtgtttgactacagtgagtattgggaaggggctcgggggctgtatgcagcctttgattgcacggctaccatgaagtctggcaactcagacgtgtatgagaatgaggatccagggggccagtacaccaacctacacttccaggcccacagcatgggacttggctccaagttcaaggaggtcaagaaggcctatgtggaggctaaccagatgctgggggacctcatcaaggtgacaccatcctccaagattgtgggggatctggcccagttcatggtgcagaacgggttgagccgggcagaggcagaagctcaggcagaagagctgtccttcccccgctctgtggtggagttcctgcagggctacattggcattccccatgggggtttccctgaacccttccgttctaaggtgctaaaggacctgccaaggatagaaggagggcctggagcctccctccctcccttgaacctgaaggagctggagaaggacctgattgataggcatggagaggaggtgaccccagaggacgttctctctgcagccatgtaccctgatgtctttgctcagttcaaagacttcacggctacctttggccccctggatagcctgaatactcgtctctttcttcaaggacccaaaattgcagaggagtttgaggttgagctggaacggggcaagaccttgcacatcaaagccctggctgtaagcgacctgaaccgtgctggccagaggcaggtgttctttgaactcaatgggcagcttcgatccattctggttaaagacacccaggccatgaaggagatgcacttccatcccaaggccttgaaggatgtgaagggccaaattggggcccctatgcctgggaaggtcatagacgtcaaggtggcagcaggagccaaggtggttaagggccagcccctctgtgtgctcagcgccatgaagatggagactgtggtgacttcgcccatggagggcactatccgaaaggttcacgtgaccaaggacatgactctggaaggcgatgacctcatcctagagattgagtgatcttactccagactggcagcctggccaaccctaccccaagcctctcaacagaagctgtgcagccagggcaggcccaggcagtacctgagggctaggccttgaggtcctgtcccatgggacagcacacacactacctgcaatggccctcccattcccttcagctatttgtccttgtcttgctggcaggcagttctcacatattcatctcttgccaaataagggtctgctcctcgtgggagaccacaggtgtacagtaggtggccttgtacctgggagaggggttctacctctgggggtagagggaagaagacctaattcataggtcctgggaaatttgctcaataaaagtggccttcccttgccctccacaaaaa

SEQ ID NO: 3133 - DNA, 2142 bp, Rattus norvegicus
  Genbank Accession No. NM_012749
atggtgaaactcgcaaaggccggcaaaacccacggagagtccaagaaaatggctcctcctccaaaggaggtggaagaagatagtgaggatgaagaaatgtcagaagatgaagatgacagcagtggagaagaggaggttgtcatccctcagaagaaaggcaaaaaggctaccacaactccagcaaagaaggtggttgtttcacaaacaaaaaaggctgcagttcccacaccagctaagaaagcagctgttaccccaggcaaaaaggcagcagccacaccagccaagaaagctgttacaccagccaaagtagttccaacacctggtaaaaagggagctgcacaagcaaaagcattggtaccaactcctggtaaaaagggagctgtcactccagccaagggggctaagaatggtaagaatgccaagaaggaagacagcgatgaggatgaagatgaagaggatgaagatgacagcgatgaggatgaagatgaagaggatgaatttgagccaccggtagtaaaaggagtgaaaccagcaaaagcagctcctgctgctcctgcctcagaggatgaggatgaggaagatgatgatgatgaagatgatgatgatgatgatgaagaggaggaggaggaagatgactctgaggaagaagttatggagatcacaccagccaaaggaaagaaaactcctgcaaaagttgttcctgtgaaagccaagagtgtggccgaggaggaggaagatgatgaggatgatgaagatgaagaggaggatgaagatgaagaagatgaagaggacgatgaagatgaggatgaggaagaagaggaagaacctgttaaagcagcacctggaaaacggaagaaggagatgaccaagcagaaagaagcccctgaagccaagaaacagaaaatagaaggctcagaaccaactacacctttcaacctgttcattggaaaccttaatccaaacaagtctgttgctgaattaaaagttgccatcagtgaactttttgctaaaaatgatcttgctgctgtggatgtcagaactggtacaaataggaaatttggttatgttgattttgagtctgctgaagacctagaaaaggccctggagctcactggtttaaaagtgtttggcaatgaaattaaactagaaaaaccaaaaggaagagatagtaagaaagttcgagctgcaagaacacttttagccaaaaacctctctttcaacatcactgaggatgaattaaaagaagtgtttgaagatgctgtggagatcagattagtcagccaggatgggagaagtaaagggattgcttatattgaatttaagtctgaggctgatgcagagaaaaacttggaagaaaagcagggggcagaaattgatggacggtctgtttcactctactacactggagagaaaggacaaaggcaagagagaactggaaagaatagcacttggagtggtgaatcaaagactttggttttaagtaacctttcctacagtgcaacagaagaaacacttcaggaagtattcgagaaagcaacctttattaaagtgccccagaacccacatggcaaatctaaagggtatgcatttatagaatttgcttcatttgaagatgctaaagaagctttaaattcctgtaataaaatggaaattgagggcagaacaatcaggctggagttgcaaggacccaggggatcacctaatgcgagaagtcagccatccaaaactctgtttgtcaaaggtctgtctgaggataccactgaagagaccttaaaagaatcatttgagggctctgttcgtgcaagaatagtaactgatcgggaaactggttcttctaaagggtttggttttgtagactttaatagtgaggaagatgccaaagctgccaaggaggccatggaagatggagaaattgatggaaacaaagttaccttggactgggccaaacctaagggtgaaggtggctttggtggtcgaggtggaggcagaggaggtttcggaggcagaggtggtggcagaggcggaagaggcggatttggcggaagaggccggggagggtttggaggcagaggaggcttccgaggcggcagaggaggcgggggagacttcaagccacaaggaaagaagacgaagtttgaatag

SEQ ID NO: 3134 - DNA, 1844 bp, Rattus norvegicus
  Genbank Accession No. NM_012755
gagctcctgggcccggccgcggaccaccggagccgccagggcctcgccggaggagggcggggagaggaccatgtgaatgtgctccggaaccgagcgccacgccacgcagtgtttgaaaggaacacaatgctgatctagtcgtggcaaaaggtcagtcctactgctggtttagaagacatgtggtgtatataacgtttgtgatagttggtggaaatttgggagcttggataatgggctgtgtgcaatgtaaggataaagaagcagcgaaactgacggaggagagggacggcagcctgaaccagagctctgggtaccgctatggcacagaccccacccctcagcactaccccagcttcggtgtgacctccatcccgaactacaacaacttccacgcagccgggggccagggactcacggtctttgggggtgtgaactcctcctctcacaccgggaccctgcgtactagaggagggacaggagtgacactatttgtggcactttatgactatgaagcacggacagaagatgacctgagttttcacaaaggagaaaaatttcaaatattgaacagctcggaaggagactggtgggaagcccgctccttgacaactggggaaactggttacattcctagcaactacgtggctccagttgactccatccaggcagaagagtggtactttggaaaacttggccgcaaggatgctgagagacagctcctgtcctttggaaacccaagaggtacctttcttatccgcgagagcgaaaccaccaaaggtgcctactccctctccatccgagactgggacgacatgaagggagaccatgtcaaacattacaaaatccgcaagcttgacaacggcgggtactacatcaccacgagggcccagtttgagacccttcagcagcttgtacagcattactcagagagagccgcgggtctctgctgccgtctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaagccaggcacaatgtccccggaatccttcctggaggaagcacagatcatgaagaagctgaagcacgacaagctggtgcagctctatgcagttgtgtccgaagagcccatttacattgtcacggaatacatgaacaaaggaagtttgctcgacttcttaaaagacggtgaaggacgggctctgaaattgccaaacctcgtggacatggcggcacaggttgctgcaggaatggcttacatcgaacgcatgaattatatccacagagatctgcggtcagctaacattctggtggggaacggactcatttgcaagattgctgacttcggattggcccggttgattgaagacaatgagtacacagccagacaaggtgcaaagtttcccattaagtggacagcccccgaagcggccctgtatggaaggttcacaatcaagtctgacgtgtggtcctttggaatcttactcacagagctggtcaccaaaggcagagtgccgtacccaggcatgaacaaccgtgaggtgctggagcaggtggagagaggctacaggatgccctgcccgcaggactgcccgatctccctgcacgagctcatgatccactgctggaaaaaggatccggaggagcgccccactttcgagtacttgcagggcttcctggaggactactttaccgccacagagccccagtatcagcccggtgaaaacctgtga

SEQ ID NO: 3135 - DNA, 8810 bp, Rattus norvegicus
  Genbank Accession No. NM_012756
agcttcgactcgctgttgcggcgcgatcgagacccaggcgcggctcggaacggccagccgccgtgagccccacgccacacgcgatgcgggccgttctgccgggacccgtgcctccggggccgcgcgtcgcgctcctgctgccgctcctgctgctgctgctcgtggcggccgcgggctccgcgcagggccaggccgtggacttggacgccttgtgcagttacacatgggaagctgttgattccaaaaataatgcagtttataaaatcaacccctgtggacatgtggataatcccaggtgtgggccgacaagtgctgtctgtatgtgtgacctaaagtcagaaaactgccggtcagtgggtgactcacttttgagaagttcagccaaatcactcctggaatttaacaccactacgggctgccagccttcagagcacagaatccagactagcattacatttctgtgtgggaagaccctgggaactcctgaatttgtaactgccacagactgtgtgcattacttcgaatggaggactactgcagcctgcaagaaagacatatttaaagctgataaggaggtgccatgctatgtatttgatgacaagttacagaagcatgatttgaacccactgatcaagctgaatggcggctacctggtggatgactctgacgctgacgcatctctgttcatcaatgtgtgtagagacatagactcccttcgggaccccagcacacagctgagagtctgccctgctggcactgctgcctgtctgctgaaggggaaccaggcatttgatgttggccggcccaaggaggggctgaagctattgagcaaggacaggctcgttctgacttatgttaaggaagaaggagaaaagccagacttctgtaatggtcacagccctgcagtgacagtaacatttgtgtgcccatctgagcggagagagggcaccattcctaaactcactgccaactgtcgctatgaagttgagtggatcactgagtatgccagccacagagattacttggagagtgaaacctgctccctcagcagtgagcagcatgatattgctattgaccttagtcccttggcccagcatgaagaagggtccccctatgtagctgatggaggagaatataggttttttatgaatgtctgtggggacacaaaggtctcactctgtaacaaagaggctgctgtttgtcaagagaaaaaggtggattccactcaagtcaaaatagcaggaagacaccagaaccagacactccggtactcagatggagatctcaccctaatctattctggaggtgatgagtgtagttccggcttccagcggatgagtgtcataaactttgagtgcaacaaaaccgcaggtcaagatgggagaggagagcctgtgttcacaatcgaggtggactgcacatacttcttcacgtgggacactaaatatgcctgtgtaaaagagaaggaagatctcctctgcggggccatcgacggcaagaaacgttacgacctgtctgtgctggctcgtcactcagaatcagaacagaattgggaagcagtggatggcagccaggctgagtcagaaaagaggaatttcttcatcaatgtctgtcaccgggtgctgcaggcgggaaaggccaagaactgtcctgaaggtgctgccgtgtgtgctgtggataagagtggaagtaaaaatctaggaaaatttgtctcttctcctacaaaagagaaaggacacattcagctctcttactctgatggcgatgactgtggtaatgataagaaaataacaactaacatcacatttgtgtgcaaaccaggtgatctggaaagtgctccagtgctgagagctgcagggcccgatggctgctcctatgagtttgagtggcacacagctgctgcctgtgtcctgtcgcagacggagggagaaaactgcactgtccttgatgctcaggcagggttttcttttgatttgtcactcctcacaaagaagaatggtgcatataaagttgagacagacaagtatgacttctacataaatgtttgtggccctgtatccgtgaacctgtgtcagtcaaactcaggagcctgccaggtagcaaaaagtggtaagtcttggaacttggggctgagtaatactaagcttacgtactatgatgggatgatccagctgagctacaggaatggcacgctgtataacaatgaaaagcacacaccgagatccacactgattaccttcctctgtgaccgtgatgctggagtgggcttcccagaatatcaggaagaggacaactctacctacaacttccggtggtacaccagttatgcttgcccggaagagcccctggagtgcatggtgacagacccctccatgatggagcaatatgacctctccagtctagtgaagtttgaaggtggccgtggaggaaactggtatgccatggaaaactcccgagaacatttcacacggaggaaatactacctcaacgtgtgccggcctctaaatcctgtgccaggctgtgatcgatatgcatctgcttgccagagtaaatacgaaaacaatgagggctccttggcagagactgtggccatcagtaacttgggagttgcaaagacaggccctgtggtggaggagagcggcagcctcctcttagagtatgtgaacggctctgcgtgcaccaccagtgatggccggctaaccacctacagcaccaggatccatcttgtgtgtggtcgaggaactatgaattcccatcccatattcactttcaactgggaatgtgtggtcagtttcttgtggaacacggaggctgcctgccccatccagacgatcacagattcagaccaggcttgctctataagggaccccaacagcggatttgtgtttaatctgagcccacttaactattctcaaggacacatggtcttaggcattgggaagacttttgtgttcaatatctgtggtacaatgcctgcctgtggaacggttgcagggaagccagcccttggctgtgaggcagaaactaagatcaaagacattaaggatctgaagccagaaaggccagtcgggatggagaagagcctccagttgtctgccgaggggttcctcactctgacctacaaaggctcttctccttctgacagaggcacagccttcatcatccgtttcatttgcaatggtgacatttacccagggacccccaagttcctgcatcaggacattgactctgcacgagggatccggaacaccttctttgagtttgaaactgcattggcttgtattccttctgtagtggattgtcaagtgactgacccagctgggaacgagtacgacctgagtgccctgagcatggtcaggaagccgtggactgctgtggacacgtctgtgcatgggaagaagaggcgcttctatctgagcgtgtgcaccccactgccttacattcctggctgcgatggcattgcaatggggtcctgcatggtgtcagaagacaaaagtcagaacttgggtgtggtgcagatcagtcctcaagctactggaaacggatctctcagcatcctgtatgtgaatggggataggtgtggaaaccagcgctactccaccaggatagtgttcgaatgtgcccagacgtcgggctcacctatgttccagctcctgaacaactgtgagtatgtgtttgtgtggcgaacagtggaggcctgccctgtggtcagagaggaaggagacaactgccaggtgaaagaccccagacacggcaatttgtatgacctgaagcccctggccctcaatgacaccatcatcagtgctggcgagtacacctactacttccgggtctgtggaaagctgtccttagatgtgtgctctgcccatgatgggtccaaggcagtctcatcatgccaggaaaagaaaggaccacaaggattccagaaagtggcagggctccttaatcagaagctgactttcgaaaatggactgttgaaaatgaactacagtgggggggacacctgccataaggtgtatcagcgctccacaaccatctatttctactgtgaccggacgactcagaagccagtgtttctgaaggaaactttggactgctcctatttgtttgagtggcgaacacagtatgcctgcccacctttcaatgtgacagagtgctctatccaggatgaggctggcaactccattgacctctcctcactgtcaagatacagtgacaactgggaggctgtgaccaggacaggggccactgagcattacctcatcaacgtatgcaagtctctgtctccacaggctggcacagatccatgccctccagaggcagctgtttgtctgctggatggctccaagcctgtgaacctcggcagggtgagggatggtcctcagtggacagctggtgtgactgtcctgaagtatgtggatggtgacttgtgccccgacaaaattcggaaaaggtcaaccattattcgcttcacctgcagtgacagccaagtgaactccaggcctctgttcatcagtgctgtacaggactgtgagtacacattttcctggcccacacctgctgcctgtcctgtgaagagcaacatacacgatgactgccaagtcaccaaccccagcacaggccacctgtttgacctgagctccctaagtggcaaagctggcatcacagcctcctacagcgagaaggggatggtcttcatgagcatctgtgaggagaatgtgaactgtagccctggagtaggggcctgctttggacagaccaggatcagtgtgggccaggccagcaagaggctgagctacaaggatcaggtcttgcagctggtgtatgagaatgggtccccatgcccctccaagtcaggcctgaggtacaagagtgtcatcagcttcgtgtgccggccggaggctggacccaccaacaggcccatgctcatctccttggacaagcagtcgtgtacactcttcttctcctggcacacgcccctggcctgtgagcaggcgacggaatgcaccgtgcggaatggaagctcgattattgacctgtcacctctcatccaccgcactggtggttatgaagcatacgatgagagtgaggacgacacctctgataccacccctgacttctacatcaacatctgtcagccactgaatcccatgcatggagtgccctgccctgcaggcgcctcagtatgcaaagtccccgtggacgggccccctatagatattgggagagtcacaggccctccaatattcaatcccgtggccaatgaggtctacctgaactttgagagcagcactccttgcttagcggacaaatatatgaactacacctcactaattgcgtttcactgcaggagagggatcagcatgggaactcctaagctgataaggaacaatgactgtgactttgtgtttgagtgggagactccgattgtctgtcctgacgaagtgaagacacagggctgtgctgtaacagatgagcagctgctctatagcttcaacctgacgagcctttccacaagcactttcaaagtcactcgggacgctcacacatacagtataggggtgtgcacaacggcagctgacttagaccaggaaggctgcaaggacggcggggtctgtctgctctctgggagcaaaggagcttcttttgggcgcctagcgtcgatgcagctggattacaggcaccaggatgaagcagtcatcctgagttatgtgaacggtgatccttgccctccagaaacggaagatggcgagccctgtgtcttccccttcatttacaaaggggagacctatgacgaatgtgtattagagggacgagcgaaactgtggtgtagcaaaactgcgaattacgatcgtgaccacgagtggggcttctgcagaccgagcaacagtcaccggatgtctgcgatcatatttacttgtgatgagaacgaagatattgggaggccagaagtgttcagtgaagatcgtgggtgtgaggtgacatttgagtggaaaacaaaagttgtctgccctccgaagaagatggagtgcaagtttgttcagaagcataaaacctatgacttgcgattgctctcatccctcacggggtcctgggattttgtgcatgaaggaaactcgtactttatcaatctgtgccaaagagtatataaaggtcccctggactgctctgagagagccagcatttgcaagaagagtgccactggtcaagtccaggttttggggcttgttcatactcaaaaactggaagtcatagatgaaacagtccttgtcacttactcaaaaggccattcttgtggtgggaataagactgcatcctcagtgatcgagttgacctgtgcaaagactgtgggcaggcctgcattcaagaggtttgatattgacagctgcacctactacttttactggtactcacgggctgcctgtgctgtgagacctcaggaggtgaacatggtgaatggaactcttaccaaccctgtgactggcaagagcttcagcctcggggaaatttattttaagctgttcagcgcctctggggacatgagaagcaatggggacaactatctgtatgagatccagctctcctctatctccagctcttctaaccctgcgtgctccggtgccaacatctgccaggtgaagcccaatgaccagcacttcagcaggaaagtgggcacctctgacatgaccaagtactacgtccaagacggtgatctggatgtggtgtttacctcttcctccacgtgtggcaaagataagaccaagtctgtgtcttccaccatcttcttccactgtgaccctctgctgaaggacggggtccccgagttcagccacgagactgctgactgccagtaccttttctcctggtacacttcagctgtgtgtcctctgggtgtggactttgatgatgagaatgctgtgccagagtataaagggctctcagagcggagtcaggccgttggggcagtcctcagtctcctcctggtggcactgactggctgtctgctggccttgctgcttcataagaaggagagaagggaaactgtgataaacaagctgaccaattgctgcagaaggagctcgggggtgtcctataagtactcaaaggtcagcaaggaggaggagacagatgagaatgagacagaatggctgatggaagagatccaggtgccagcccccagactaggcaaggacgggcaggagaacggccacattaccaccaagacggtgaaagcagaagctctcacttccctgcatggggatgaccaagacagtgaggatgaggtcctgaccatcccagaggtgaaagttcacacaggcagaggagccgaggtggaaagctcacagcccctgagaaatccccagcgcaaggtcctgaaggaaagggagggggagaggatggggctggtccgcggtgagaaggccagaagagggaagttcagacccggacagcgcaagccaacaacccctgccaagctggtgtccttccatgatgacagtgacgaggacctcctacacatctgactccgtggtgcctacaggagaaggtggcaccatggacagccaagcatctccaaccaaataagacttcagctcgatgatgcgtctgtcattttgcctttaacaaaactgcttcaaagggaagtttctgtaatgggggagaggatgggggaggtgggcaccactcttccatgatcgtttacagtcagtggaacaaggtgttgcttgaatcggccaaagggcgctacttggtgcccagggttttgccccaagtcctcacttacgatcatagctgctgtgtgcttccaacaggtgcccaggccacatgcatctcacaacagagggctgtgtttgaaaaaaacccttgctgctttagaccctatagggtgaccatttatatttttagcattgtaattctctccccctatttattgactttgacaattactactcaggtttgcgaaaaaggaaaaaaaaaaaaaaaccagtttcttctgccagcaagggcataaggtgaagctggcattatgctggagccttgtacgtggctcctgagctggtccttgatgcacactttagtgagctgcagtattctattcttcgctttgcgttttgtaagggcacacatacatgcacaggtccccgagtgcctcggtttgggaaggcccgcctgctccgtgccctacctcgtctctatagctgcagctctttgcacgaatccttctgggtgtcgcttttgcccgctggtgagcgccagcagctcacccagaggtgggtgtttgtgcatgcgatggagtagaggctcttggagaggagccgcacttcaggtttgggctgtaggtctcatctcttcaggttctcaatgccacctttactgtgctttttgcttttattttaagggggaaatgtttatcacccattcaacctataagaagccttaatttgcacagggtgacttacagacaccgtgaaatacggtgggccagtgttgtgtgtgggcttgtgcagggcagtgtcccgggatggaaggccaggcccggtccactggctgtggactcctttcctgatgtgttcaatgacttctcacattatagagttgtatataggtggtatttacatacccagaagcaaagtaccccgcagaatttcttggtttatgcctgattttgctagcttatttgatttcacattgagtgtatttttaaaaattgatttttttcttcattttttaatcaactttactgtaatatgaagtattcaatttcaataaaaataaattattaaaaaaaaaaaaaaaaaaaaaaaaaaaaa

SEQ ID NO: 3136 - DNA, 1843 bp, Rattus norvegicus
  Genbank Accession No. NM_012766
tctcactcacacgcgacgcgtcgcttctcctaggactcgctagcccgcactcctgctctcacccgtgagccatagcaggatggagctgctgtgttgcgagggcacccggctcgcgccccgggccgggcccgacccgcggctactgggggaccagcgtgtcctgcagagtttgctccgcttggaggagcgctacgtgccgcgaggctcctacttccagtgcgtgcaaaaggagatcaagccgcacatgcggaagatgctggcgtactggatgctggaggtgtgtgaggagcagcgctgcgaggaggatgtcttccctctggctatgaactacctggatcgctacctgtcctgcgtccccacccgaaaggcgcaactgcagcttctaggtaccgtctgcctgttgctggcctccaagctgcgcgaaaccacacccctgactattgagaagctctgcatctatacggaccaagctatggctccctggcagttgcgggaatgggaggtgctggtcctggggaagctcaagtgggacctggctgctgtgattgcgcacgacttcctggccttgattctgcaccgcctctctctgcccagtgaccggcaggcactggtcaaaaagcatgctcagacctttttggccctctgtgccacagattacacctttgcgatgtaccctccatccatgatcgccacgggcagcatcggggctgcagtgctaggcctgggtgcctgctctatgtctgcagatgagctcacagagctgctggcgggaatcacaggcactgaagtggactgcctgcgtgcctgccaggagcagcagatcgaagctgccctcagggagagcctcagggaagctgctcagacagcccccagccccgtgcccaaagcccccggggggtctagcagccaggggcccagtcagaccagcactcccacagatgtcacagccatccacctgtagtttgggacaggccccctcaggtggccaccaagcagaggaggggcccctgccaccccctccctccctctaggaacaattcatgccatatctgaagcccgagggggctctttttcccctcacaaagcccaaggggccaggtcctgcctatccccacagtgtgcactaaggggctgcttggtcatgagggtgtctacatggccagtcagttcctcttccttcccactcaaccagcttggctgtcctgggccatgatggtcagagagatacaaacaggtagaacccacacaccagcatttcttttgagtccctcctctgtctggggcgccgatcctttcagttgccaaaacgccccagtaccttccaaaggtgttgttgcccctcgcagggtcactgcatttggatctgggtccttcagaaatcccgatagacgcctatgaggagccaacctagatggctgctgtgtaatccctactccagctgctcttagcgggaaccagcctaggccttggctagaagagcaagcgcccgtaaactgttgctttgcttcctgctatgcttctgtggttgagggtcttgagggtgctgatggtcattttaatttattgctttgaatacaccgtaagagggtacagtgaggcctgtaccccacaagtggtggtaaccctggcggttgctctttccctcccctctgctaccgctttgtggcccaggagctgctacagcctgggagggggtcctgccttcctctccgtagccctccagctcatcttcagcggggagggtttaatagggatggatgccgtggaggtgactggactatccggagagagggcgagccccatggacacaggtgtttcctcaggccacaaggtttggggcgcc

SEQ ID NO: 3137 - DNA, 2683 bp, Rattus norvegicus
  Genbank Accession No. NM_012776
gaattcgggcgggcgacgagcgaggaccgggcggggcggcggcggcgccgaggccgacaagccgcgcgggccgggccgggccgagcgagcgggagcggagcggagcctcgggcggcgggaggaacagcgccgccgccgccaagatggccgacctggaggcggtactggccgatgtgagctacctgatggccatggagaagagcaaggccacgccggccgcgcgcgccagcaagaagatcctgctgccagagcccagcatccgcagcgtcatgcagaagtatctagaggatcgaggagaagtgacctttgaaaagatcttctcacagaagttaggatacctgcttttccgggacttctacctgaaccatctggaagaggccaagcccttggtggagttctatgaagagatcgagaaatatgagaagctggagacggaggaggaacgtgtggtccgcagccgggagatctttgactcctacatcatgaaagaactgctggcctgctcacatcccttttcaaagaatgccacggagcatgtccagggccacctggtgaagaagcaggtacctccagatctcttccagccatacattgaggagatttgtcagaacctccgaggggatgtgttccacaaattcattgagagtgacaagttcacacggttctgccagtggaagaatgtagagctcaacatccacctgaccatgaatgacttcagtgtgcatcgaatcatcgggcgtgggggcttcggtgaggtctatgggtgccggaaagcagacacaggcaagatgtacgccatgaagtgtctggacaagaaacgcatcaagatgaagcagggagagaccctggctctgaacgagcggatcatgctttccctcgtcagcactggggactgccccttcatcgtgtgcatgtcatatgcattccacacaccagacaagctcagtttcatcctggatctcatgaacggtggggacctgcactaccacttgtctcagcatggagtcttctctgaagccgacatgcgcttctacgcagctgagatcatcctgggccttgaacacatgcacaatcgctttgtagtctacagggacctaaagccagccaacattctcctggatgagcatggccatgtgagaatctcagacctgggcctagcctgtgacttctccaagaagaagcctcatgccagtgtgggcacacacgggtacatggccccggaagtcctacagaagggcgtggcctatgacagcagtgccgactggttctccctgggctgcatgctcttcaagttgttgcggggacacagccccttccggcagcacaagaccaaagacaagcatgagattgaccgcatgacattgacaatggctgttgagctgcctgactccttctcccctgaactccgatccctgctggaaggtttgctgcagagggatgtcaatcggagactaggctgtctgggccgtggggctcaagagataaaagaaagccccttcttccgttccctggactggcagatggtcttcttacagaagtaccctcctccactgatccccccacgcggggaggtgaatgcagcggacgcctttgacattggctcctttgatgaggaggacacaaaaggaatcaagttactggacagtgaccaggaactgtaccgcaacttccctctcaccatctctgagcggtggcaacaggaggtggcagagactgtctttgataccatcaatgctgagacagaccggctggaggcacggaagaaagccaaaaacaaacagctgggccacgaggaggactacgccctgggtaaggactgcatcatgcatggctacatgtccaagatgggcaaccccttcctgacccagtggcagcggcgatacttctacctgttccccaaccggcttgagtggaggggtgaagacgaggctccgcagagcctcctgaccatggaagagatccagtcggtggaagagacacagatcaaggaacgcaagtgtctcctgcttaagatccgaggtggcaagcagtttgtcctgcagtgtgatagtgaccctgagctggtgcaatggaaaaaagagctgcgcgatgcttaccgtgaggcccagcagctggtgcagcgagtgcccaagatgaagaacaagccacgctcacctgtggtggagctgagcaaggtgccactgattcagcgtggcagtgccaacggcctctgattcacccatctgctgcccgcctgcccacccgccttttataaacctctaatttattttgttgaatttttattatttgttttcgcaaagcggaaaaggttttattttgtaattattgtgatttcctgtggccccagccaggcccagccccagggaggggcctgcttgcctcagctcctgctgccaccaacccagccactgtctagcacccctgccccgcccccaccgcatgcccctagggtccttgctcccagtatcttcctactgggaagaggagcaaccctcagcagccctcttgcccctccatggggtgaagccacagtcggtgggtgtgtcacttcaggctctgtgggctacactcagcctgaggcccagctgggtggcccagcacccctaccctaggaaggtgcaacacagggatactacttgaactttcctatcatagctcccatgccacagagggacccgaattc

SEQ ID NO: 3138 - DNA, 2431 bp, Rattus norvegicus
  Genbank Accession No. NM_012780
tctcgaccatggcggcgactacagctaacccagaaatgacatcagatgtgccatcactgggtcccaccattgcttctggaaatcccggacctgggattcaaggtggaggagctgttgtccagagggctattaagcgacggtcagggctggattttgatgatgaaggagaagtgaacagtaaatttttgagatgtgacgatgagcagatgtgtaacgacaaagagcggtttgccaggtcggatgatgagcagagctctgccgataaagagagacttgccagggaaaatcatagtgaaatagagcggcggcgacggaacaagatgacagcttacatcacagaactgtcagacatggtacctacctgtagtgccctggctcgaaaaccagacaagctaaccatcttacgcatggctgtttctcacatgaagtccttgaggggaacgggcaatacatccactgacggctcctacaagccgtccttcctcactgatcaggaactgaaacatttgattttggaggcagcagatggttttctgtttattgtctcttgtgagactggccgagtggtgtatgtctctgactcggtgactcccgttttgaaccagccacagtctgaatggtttgggagcacactgtatgaccaagtgcacccagatgatgtggataaacttcgagagcagctttctacttcagaaaatgccctaacagggcggatcctggatctgaagactggaacagtgaaaaaggaaggtcagcagtcttccatgaggatgtgcatgggctcaagaagatcgttcatctgccggatgaggtgtggcaccagctctgtggaccctgtttccatgaatagactgagctttttgaggaacagatgcaggaatggacttggctctgtgaaggaaggagagcctcactttgtggtagtccactgcacaggttacatcaaggcctggccaccagcaggtgtctccctcccagatgatgatccagaggctggccaggggagcaaattctgcctagtggccattggcaggctgcaggtaaccagttctcctaactgtacagatatgagtaacatctgtcagccaacagagttcatctccagacataacattgaagggatattcacttttgtagatcatcgttgtgtggctactgttggctaccagccacaggagctcttaggaaagaatattgtagaattttgtcatcctgaagaccaacaacttctaagagacagctttcagcaggtggtgaaattaaaaggccaagtgctgtctgtcatgttccgattccgagctaagaaccgagaatggctgtggatgagaacaagctcctttactttccaaaacccgtattcagatgaaatgagtatatttatctgcaccaacaccaacgtgaagaactctagccaggaaccacggcctacattgtctaacacaatccagaggtcacagctaggtccgacaactaatttatccctagagatgggtacaggtgtcctggcatccaggcagcagcagcagcagcagcagcagcagcagcagcagcagcagcagcagacagaattggatatggtaccaggaagagatgggctggccagctatagtcattcccaggtttctgtccagcccgtggcaactgcaggatcagaacacagcaagccccttgagaagtcagaaggtctctttgtgcaggacagagatccgaggttttcagaaatctatcccaacatcagtgcagatcagagtaaaggcctctcctccagcactgtccctgccacccaacagctgttctcccagggcagctcattccctcctaacccccggccggcagaaaatttcaggaatagtggtcttacccctcccgtaaccattgtccagccgtcatcttctgcagggcagatattggcccagatttctcgtcactccaaccttacccagggatcagcaccaacttggacctctagcactcgcccaggtttctctgcccagctgcctactcaggctacagccaagactcgttcttcacaatttggtgtgaacaactttcagacttcgtcctccttcagtgccatgtctcttccgggtgctcccactgcctcacccagtactgctgcctaccctactcttcctaaccgtggatccaactttcctcctgagactggacagacaacaggacagttccagacccggacagcagagggtgtgggtgtctggccacagtggcaaggccagcagccccatcaccggtctagttccaatgagcaacatgttcagccaacatcagcacaaccaagtagccagcctgaggtctttcaagaaatgctgtccatgctgggggaccagagcaacacctacaacaatgaagagtttcctgatctaactatgtttccccctttttctgaatagaactattggggtgaggataa

SEQ ID NO: 3139 - DNA, 1443 bp, Rattus norvegicus
  Genbank Accession No. NM_012783
tgaaagtctccagtttctcagagctggttgtgagcaacaccagaaactgctgtaccacaccctggtagaagtgcgtcagtattcgcaactgggaacacatttttggtatggagtcctggaattctcggatcctcttgttctcttcctcttcctctgccgcagtcactccccactggccctcagtttcacgctgtttcttcttccttggacgaggcgacatggcggcggcgctgctgctggcgctggccttcacgttcctgagtggccaaggcgcctgcgcggcggcgggcaccatcgtaacctctgtccaggaagttgactccaagacacagcttacctgctttttgaacagcagtggcattgacatcgttggccaccgctggatgagaggtggcaaggtactgcaggaagacacgctgcccgatctacagatgaagtacacggtggatgcagatgaccgctctggagaatattcctgcatcttccttcctgagcctgtgggcagaggcaacatcaatgtggaggggccacccaggatcaaggtgggaaagaaatcggaacacgccagtgagggagagtttgtgaagctgatctgcaagtctgaggcgtcccaccctcctgtggatgagtgggtctggtttaagacctctgacactggggaccagactatctccaacggcactgaggccaatagcaagtacgtcattatatccacgcctgagctgtcagagctgatcatcagcgacctggacatgaacgtggaccctggcacctacgtgtgcaatgccaccaactcccagggcagtgctcgggagaccatctcactgcgtgtgcgcagccgcctggcagccctctggcccttcctgggcattgtggccgaggtcctggtgttggtcaccatcatcttcatctacgagaagaggcggaagccggaccagaccctggacgaggatgatcctggcgccgccccactgaagggcagcgggtctcacctgaatgacaaggacaagaatgtgcgccagaggaacgccacctgagcggcggggcaggcggggaggggaggtgccagggcacttgaccccagcccagcgtctgcctccactcctgtgtcccatcctgtcccgacctgagcctgcccaacccaacttcttatcccagcccaagtgaagacagagccttaccttacagaaaacccatctgggagaagcaggccacttgcagtacccctgtttctagtttaaactgaatgaggtttctatgcagacaatccattccttagggctacgtttttattttccttcccttctgaagtatgtcactacagccctgtggagtgggggagtggggtcatgagggaaaggccagggcacacatgctctgactttaccctgttggagggggctgggcctgctgggaccccacaaataaagacctacaccacca

SEQ ID NO: 3140 - DNA, 4835 bp, Rattus norvegicus
  Genbank Accession No. NM_012789
gagcagaggcgcaggacgtccgtctccgcgcgcgtgacttctgcctgcgctcaagcttcagagttcagtttcaaggagccgcccaaccatgaagacaccgtggaaggttcttctgggactgcttggtgtcgctgcgcttgtcaccatcatcaccgtgccagtggttctgctgaacaaagatgaagcggccgctgatagcgcgagaacttacacactagctgactatttaaagaatacctttcgggtcaagtcctactccttgcggtgggtttcagattctgaatacctctacaagcaagaaaacaatatcttgctattcaatgctgaacacgggaacagctccattttcttggagaacagtacctttgagatctttggagattctataagtgattattcagtgtcacccgacagactgttcgttctcttagaatacaattatgtgaagcaatggagacactcctacacggcttcatacagtatttatgacttgaataaaagacagctgatcacagaagagaagattccaaataatacacagtggatcacatggtcacaagaaggtcacaaattggcatatgtctggaagaatgatatttatgttaaaattgaaccacatttgcctagtcataggatcacatcaacaggaaaagaaaatgtaatatttaacggaataaatgactgggtttatgaagaggaaatcttcggtgcctactccgcactgtggtggtctccaaacggcacttttctagcttatgcccagtttaacgacaccggagtgcctctcattgaatactccttctactctgatgagtcactgcagtaccccaagacagtctggattccgtacccaaaggcaggagctgtgaatccaactgtaaagttctttattgtaaatacagactctctcagctcaactactactacgattcccatgcaaatcaccgctcctgcatctgtgacaacaggggatcactacttgtgtgacgtggcctgggtttcagaagacagaatctcgttgcagtggctcaggaggattcagaactattccgtgatggcgatctgcgactatgataagaccaccctagtatggaactgtccaacgacgcaggagcatattgaaacgagtgccacaggctggtgcggaagatttaggcctgcagaaccccacttcacctccgacggaagcagcttctataaaatcgtcagtgacaaagatggctacaaacacatctgccagttccagaaagataggaaacccgaacaggtctgtacatttattacaaaaggagcctgggaagtcattagtatcgaagctctgaccagcgattatctgtactacattagtaatgaatataaagaaatgccaggaggaagaaatctttataaaattcagcttactgaccacacaaataagaagtgccttagttgtgacctgaatccagaaagatgccagtattactcggtgtcacttagtaaagaggcaaagtactatcagctgggatgccggggccctggtctgcccctctacactctgcatcgcagcactgatcaaaaagagctgagagtcctggaggacaattctgctttggataaaatgctgcaagatgtccaaatgccttcaaaaaaattggacttcattgttctgaatgaaacaagattttggtatcaaatgatcttacctcctcattttgataaatccaagaaataccctctactaatagatgtatatgcaggtccctgtagtcaaaaagcagatgctgccttcagactcaactgggccacttaccttgcaagcacagaaaacatcatagtagctagctttgatggcagaggaagtggttaccaaggagataagatcatgcatgcaatcaacaaaagacttggaacactggaagttgaagatcaaattgaagcagccaggcaatttttaaaaatgggatttgtggacagcaagcgagttgcaatttggggctggtcatatggagggtacgtaacctcaatggtcctgggatcgggaagtggcgtgttcaagtgtggaatagccgtggcgcccgtgtcacggtgggagtactatgactcagtatacacagagcgttacatgggtctcccaactccagaggacaaccttgaccattacaggaactcaacagtcatgagcagagctgaaaattttaagcaagttgagtacctccttattcacggtacagcagatgataatgttcactttcagcagtcagctcagatctccaaagccctggtggatgctggcgtggatttccaagcaatgtggtacacggacgaagaccatgggatcgccagcagcacagctcaccagcacatctattcccacatgagccatttcctccagcagtgcttctccttacgctagcatggcaaggctctccgcagcttactcaagagcacacttgtcctcattatctcaaaactgcactgttaagatgacgattttaataatgtcgcctcgagaaattccagcctacttcccagttttatacctgcaatcctaactaaggatgcctgtcttcagaacagattattaccttacagcaatttggatttccccctctgttttgtttatcatttaaaaccatttccacatcagctgctgaaacaacaaatataaattatttttgcaagagctatgcatagatttcctgagcagaatttcaatttttttcccccttactaggctggtccaaatcttgttcccttatttaagggggtggcaagacgtgggtaatgatgtcattaggccagcaacaagagaagcgggaacagagaatatggctagaaacccaggtccaagcatacaaacccaaccaggctactgtcagctcgcctcgagaagagctgctcactgccagactggcaccgttttctgagaaagactattcaaacagtctcaggaaatcatatatgcaaagcactgacttctaagtaaaaccacagcagttgaatagactccaaagaaatgcaagggacgctgccagcaatgtaagggccccaggtgccagttatggctataggtgctacataaacacagcaagcctgatgggaaagcatgttaaatgtgcttttaaaaattaccaagtctcctagtgagaagaggcagcttggaacatagcgacttgccccgttaaaagttgaaaatatttgtgtcacaaattctaacatgaaggaatacttgcgtcagttcttcctacttcctttctttgagcattttcattaaagcattttaacttcattatctttctaatggaaaactgtatgagaatgttttgtgttattatttctattctacacactggaatgttgcctggtcatttagcaagtatgcttccattttttcaaaggtaatgggttatatcttgaatcaaacttaaactgcattgacatatggacacatttgttcaaaggttcttgtttaacttgtgtgaaatccaagactgtcttgtaaacatggaaagagttcaacttttaaaaaaaaatttagatacataaaactgtttaaagttatatgattcataagagtttatctaatacccccagaaatttctactcacatttatcacatagcttggtcatttacatactatggaactcataatattatttaacttaggggagcacgtgaggttcgtggcacgagatggaatgctatcagcagagtagacatgtttttccagggtcttgttttttgtttttgtttctggtctcttcctgtttgggcggagggtaatataatagataatatacataatagaatacactctgatacctgacttagccgtgttttgacaacttggaaacttgattcaattatttataacacagctgaaaatttaaaatggactccacacatttaaatgcagtttcaggccaattttctaggtacaattaccacagacaggtgagctacagcataaattccaaacatggcagaaatggaaattacctataaatataaatgagtttagatattgatgagcctgatgctatttcccgggcactccactgttcccctcaccttaaggaactctcaagtcctgctcttccactgcaagcacagctggtccttaaatctacaggcctctggctacagtccgaatttgaacacagttctgtcaccgtgtgcagcagcagcagccatgtgcaaagttctagatcaaggaacaaaggtagcacatgttcctgacagtgtggaaacataaacataaatgcgaattaaatagaaattatcccttctgaattctttttgttcctttcatttctaaataggttgttcctggagcctgaattaataaaaagaacacagcacacatttttcaggcgatgagggtttcacatggtgataatgtgaatacattcagtttttatttgattctcataggtcaagttttactgttcggtaagagttgtaaattagattaaaaccctgatgcataagttgtaaacaaacttaatttaagagcaagtttgaaaagcacaagagctaataacaccactgaggcatatagacaagtctcttatgggcatatgcagctccctgaagcgcatggatcaagctaccgcctcagagcacaccagcaccaggggcgcatgctaaaggaagagctcccctccccaccccccatgcttcacgatccatgttgacttcagtctgtgccattctgggcatcatagttctccttcagattattagcagttccacctcttggcacgtactacttttgctctaagttggagtgagagtactggtttataagattactggatttgtacaatatttaagattcaataaattctaagtg

SEQ ID NO: 3141 - DNA, 2840 bp, Rattus norvegicus
  Genbank Accession No. NM_012791
agagtctcaagttttcagagtggctttgctcttactgtgctttcattcgcagctgttatagttttgccgctggactcttccctcccttcccccaccccatcaggatgatatgagacttgaaagaagacgatgcatacaggaggagagacttcagcatgcaaaccttcatctgtccggctcgcaccgtcattctcattccatgctgctggccttcagatggctgcacagatgccccattcacatcagtacagtgaccgtcgccagccaaacataagtgaccagcaggtttctgccttatcatattctgaccagattcagcaacctctaactaaccaggtgatgcctgacattgtcatgttacagaggcggatgccccaaaccttccgtgatccagcaactgctcctctgagaaaactctctgtggacttgatcaaaacatacaagcatattaatgaggtttactatgcaaaaaagaagcgaagacaccaacagggccagggggacgattctagtcataagaaggagcggaaggtttacaacgatggttacgatgacgataactatgattacattgtaaaaaacggagaaaagtggatggaccgttatgaaatcgactccttaataggcaaaggttcatttggacaggttgtgaaagcatatgacagagtggaacaagaatgggtcgccattaaaatcatcaagaacaagaaggcgtttctgaatcaagcgcagatagaagtgcggctgcttgagctcatgaacaaacatgacactgagatgaagtactacatagtgcatttgaaacgccactttatgtttcggaaccatctctgtctagtgtttgaaatgctgtcctataatctctatgatttgttgaggaacaccaacttccgaggggtctctttgaacctgacacgaaagtttgcacaacagatgtgcacagcattgcttttccttgcgactccagaacttagtatcattcactgtgacttaaagccggagaacatccttctgtgtaaccccaaacgaagtgcaatcaagattgttgactttggcagctcttgtcagttggggcagaggatataccagtatattcagagtcgcttctatcggtctccagaggtgctactgggaatgccttatgaccttgctatcgacatgtggtcccttggatgtatcttggttgaaatgcacactggagagcctctgttcagtggtgccaatgaggtggatcagatgaataaaatagtggaagtcttgggcatcccacctgctcatattcttgaccaagcaccgaaagcaagaaagttctttgagaagttgcctgatggcacttggagcttaaagaagaccaaagatggaaaacgggagtacaaaccaccaggaacccgtaaacttcataatattcttggagtggaaacaggaggacctggcgggcggcgtgctggggagtcaggtcacactgtagctgactacttgaagttcaaagacctcattttaaggatgcttgattatgaccccaaaactcggattcaaccttattatgccctgcagcacagttttttcaagaaaacagctgatgaaggtacaaacacaagcaacagtgtgtccaccagccctgccatggagcagtcccagtcttcaggcaccacctccagcacctcctccagctcaggtggatcctcgggaacgagcaacagtgggagagccaggtcggatccgacgcaccagcatcggcacagtggcgggcacttcgctgctgctgtccaggccatggactgtgagacacatagtccccaggtgcgccagcagtttccggctcctctgggctggtcaggcactgaagctcctacacaagtcactgttgaaactcatcctgttcaagaaacaacctttcatgtagcccctcagcagaatgcattgcatcatcaccatggaaacagttcccatcatcaccaccaccaccatcaccaccaccaccaccatggacagcaagccttgggtaaccggaccaggccaagggtctacaattctccaacaaatagctcctctacccaggattctatggaggttggccacagtcaccactccatgacatccctgtcttcctcaacaacttcttcctcgacatcttcctcctctactggtaatcaaggcaatcaggcctatcagaaccgcccagtggctgctaacaccttggactttggacagaatggagctatggacgttaatttgaccgtctactccaatccccgccaagagactggcatagctggacatccaacataccaattttctgctaatacaggtcctgcacattacatgactgaaggacatctgacgatgaggcaaggggctgatagagaagagtctcccatgacaggagtttgtgtgcaacagagtcctgtagctagctcgtgactacattgaaacttgagtttgtttcttgtgtgtttttatagaagtggtgtttttttcccaaaaacaaaagtgcaaagctgcttgaatcagaaggagattaacacactgaaccgctacgagagggcaaagctgacttttttttttaacttgaaaagattgcaaagggacaatgaagtttttaagagccatgtccacccatcttcatggagcgctcagagtgtcctctttctgcctcccccatttaacttccatctcccggtcacagtgggttttgtctttctatccaacaaaagttaatgttcagctgttggtcttggtcatttgccaactaattttaaaataaaaaggcactgcacataatttgcataaagggccccatagggtgttttggttttttcatttttattttttcccctttt

SEQ ID NO: 3142 - DNA, 924 bp, Rattus norvegicus
  Genbank Accession No. NM_012793
cctggtggttccgcagccgtactctcctggcctggtgtgcacagcctcaccatgagttcttctgcagccagcccgcttttcgcgcctggcgaggactgcggccccgcgtggcgcgcggcccccgcggcctatgatacgtctgacacgcacctgcagatcctgggcaagccagtaatggagcgttgggagaccccctacatgcattcgctggcggctgctgctgcctccagagggggccgggtcctggaagtgggctttgggatggccattgcagcctccagggtgcagcaggcccccataaaggaacactggattattgaatgcaacgatggggtcttccagcgtctacaaaactgggccctgaagcagccacataaggttgttcccttgaaaggcctgtgggaggaggaggcacctacactgcctgatggtcactttgatgggattctatacgacacatatccactgtctgaagagacctggcacactcaccagttcaactttattaagactcatgctttccgtttgctgaagcctgggggtatcctcacttactgcaacctcacgtcctggggggaactcatgaagtccaagtacacagacatcactgccatgtttgaggagactcaggtgcctgcactgctggaagctggcttccagagagaaaacatctgtacagaggtgatggcgctggtgcccccagccgactgccgctactatgccttccctcagatgatcacacccctggtcaccaagcactgagcggctggcccagggctacaaggagaatatgtcctcctcagtgcctttgtagctggagtgtggctccagcctctccactatccctgcagtgtgacatcctaacctctgcctggtacggccatctccccagagctcaggagtaaaataaatgctaccaagact

SEQ ID NO: 3143 - DNA, 1258 bp, Rattus norvegicus
  Genbank Accession No. NM_012796
gggggaacgcgtcagacttggccaactgaggctgggctggacccctattgtggaatcgcggacacttcctacagttgtcgaacgcaatccgtctacaccaccttgtgtcactacctaccaccatgggtttggagctctacctggacctgctgtcgcagcccagccgcgcggtctacatcttcgccaagaagaatggcattccctttcagttgcgtaccgtggatttactcaaagggcagcacttgagcgagcaattctcccaggtgaactgcttaaagaaagtgcctgtcctcaaagacggaagcttcgtgttgaccgaaagcactgccatcttgatttacctgagttccaagtaccaggtggcagaccactggtacccggccgacctacaggcccgtgcccaagtccacgaatacctgggttggcatgccgacaacatccgtggcacctttggagtactcctgtggaccaaggtgttggggccactcattggggtccaggttcccgaggaaaaggtggaacggaacagaaatagtatggtcttggctctgcaacgtctggaggacaagttcctcagggacagggccttcattgctggccagcaggtgacgctagcggatctcatgtctctagaggagttgatacagccggtggctcttggctgtaatctgtttgaggggcggcctcaactgacagcgtggcgagagagggtggaggcgttcttgggtgctgagctatgtcaggaggcgcacaaccccatcatgagcgtcctgggacaggcagccaagaaaacattaccagtaccccctccggaggcccatgccagcatgatgcttcgaattgccaggattccctgagtggttttttttccctgagtatttttattgctataaagactcattttgtattttgcctctttgttttgttttgtttttgtttcttcttgtcccaacctttttttttttttttttttttctggctccttttctggctctgggaggagctttgctcaaaagggacaccacctatccttagcatgcttctcttgaggtacagtatgcacaaccaataggagacccaagtcaataatatataaaaggtgcttaaaaaaaaaaaagcaaacagtaacacacacgaagaaatcaaccaaaaattggtggacatctgttttttattataatatagattctgaatattttaaggaataaagagttattgttttattacattgccctctaatctgtatggaataaattat

SEQ ID NO: 3144 - DNA, 1124 bp, Rattus norvegicus
  Genbank Accession No. NM_012797
cggcacgagctaacaccctgttctcagactcctccgcgcctctccgcctgtcctcaggatcatgaaggtcgccagtagcagtgccgcggccaccgcaggccccagctgttcgctgaaggcaggcaggacggcgggcgaagtggtgcttggtctgtcggagcaaagcgttgccatctcgcgctgcgctgggacgcgcctgcccgccttgctggacgaacagcaggtgaacgttctgctctacgacatgaacggctgctactcacgcctcaaggagctggtgcctaccctgcctcagaaccgcaaagtgagcaaggtggagatactgcagcatgttatcgactacatcagggacctgcagctggagctgaactctgagtctgaagtcgcgaccgccggaggccgggggctgcccgtccgggccccgctcagcaccctgaacggcgagatcagtgccttggcggccgaggtgaggtccgagtcagagtattacattattctcctgtgggaaactaaggccacgggaggggggtgtcccccttacttctcaggagcatagttatttaggggcgaccaataggaaaaagctcgcgctttcatcgtgcctcctggagtagagaagtgggaatgcctctcccctccagttctttccagtgggtctcatgccttatctcgctctggtgttcacaggcggcatgtgttccagccgacgaccgcatcttgtgtcgctgaggcggcgcactgaggaaccagatggactccagcccttcaggaggcaagaggaaaaaaagtgctctcggttccccagagcaacccggggaaagacactaccgcggccacgggactcttgacggatctgtccagggggtagagggttgatcaacggagtctcgccctctccacctttcagcctccagagactttgaggagggggttattcaaccccgtgtgtttctgtttttttgaaaaagcagacattttttttaaatggtcacatttcgtgcttctcagatttctgagaaaatgttttgtattgtatattacaatgatcactggctgagaatattgttttacaatagttcttatgggggtgggttttttgttgttattaaacaaacactttagat

SEQ ID NO: 3145 - DNA, 1543 bp, Rattus norvegicus
  Genbank Accession No. NM_012803
cgaaattgcagtttctccttggcccacccctgtgtcagcagctccaggatgtggcagttcagaatcttcctgctgttcgcgtccacctgggggatttctggcgtatcagcccatcccgacccagtgttctccagcagcgagggtgcccaccaggtgcttcgggtcagacgagccaacagcttcctggaggaggtgcgggcaggcagcctggagcgggagtgtatggaggagatctgtgacttcgaggaggcccaggagattttccagaatgtggaagacacactggccttttggatcaagtacttcgatggtgaccagtgctcaactccgcccttggaccaccaatgcgacagcccatgctgcggccatggcacatgcatcgacggcctgggcggcttcagctgcagctgcgataagggctgggagggcaggttctgtcagcaggagatgggcttccaggactgtcgggtgaaaaatggcggctgctaccactactgcctggaggagaccagagggcggcgctgccgttgcgccccgggctatgagctggcagatgaccacatgcactgcaggcccaccgtgaattttccgtgtgggaaactgtggaagcggactgacaagaaacgcaagaacttcaaacgggacatagacccagaagacgaagaactagaactaggtccaaggatagtcaatggaacactaacaaagcagggtgacagtccctggcaggcgatccttctggactccaagaagaagctagcctgtggaggggtgctcatccacacctcctgggtgctgacggcagcccactgtctggagagcagcaagaagcttaccgtgaggcttggtgagtatgatctgagacgcagggacccctgggagttggacctggacatcaaggaggtcctcgtccaccctaactacacccggagcaacagcgacaacgacatcgccctgctccgcctgtcccagccagccacactctctaaaaccatagtgcccatctgtctgccgaacagcggcctggcgcaggagctcagtcaggctggccaggagacggtggtgacaggctggggctatcaaagcgacaaagtcaaggatggcagaaggaaccgcacctttattctcaccttcatccgcatccctttggccgctcgaaatgactgcatgcaggtcatgaacaacgtggtctcggagaacatgctctgcgccggcatcattggagacacgagagacgcctgcgacggcgacagtgggggacctatggtggtcttctttcggggtacctggtttctggtgggcctggtgagctggggtgagggctgtgggcacctcaacaactatggcgtctacaccaaagtgggtagctacctcaaatggatccacagctacataggggaaagggatgtttccctgaagagcccgaagctgtagcatccctccctgctcatctctggggcccagaggtcactcttagaataaggctgggctagtgagtaccaagacaggggacattaaaggggcaagcaacacctgaaaaaaa

SEQ ID NO: 3146 - DNA, 3324 bp, Rattus norvegicus
  Genbank Accession No. NM_012804
gaattccagtgcggctcgctcgccctgccggtgccatggcggccttcagcaagtacttgacggcgcggaactcctcgctggcgggggccgcgttcctgctgttctgcctgctccacaagcggcgtcgcgccctcggcctgcacggtaagaaaagtggaaaaccgccattacagaataatgagaaagaaggaaagaaagagcgagctgtggtggacaaagtgtttttatcaaggctctcacagatcctaaaaattatggtccctagaacattttgtaaagagacagggtacttgatacttattgctgttatgctggtatctcgaacatactgtgatgtttggatgattcaaaatggcacactgattgaaagtggcatcattggtcgtagcagtaaagatttcaagagatacttattcaacttcatcgctgccatgcctcttatctctctggttaataacttcttgaagtatgggttaaatgagctcaaactgtgcttccgtgtgcggctcactagatacctctatgaggagtatctccaagccttcacctactataaaatgggcaacctggataacagaatagcaaacccagaccagctgcttacacaagatgtagaaaagttttgtaacagtgtagttgatctttattcgaatcttagtaagccatttttagacatagttttgtatattttcaagttaacaagtgcaattggagctcagggcccggcaagcatgatggcctacttgcttgtttctgggctattcctaactcgactcagaagacccatcggtaaaatgacgattatggagcagaagtatgaaggagaatatagattcgttaattcacggcttatcactaatagtgaagaaattgccttttacaatgggaataaacgagaaaagcagacaatccactctgtcttccgaaaactggtggaacacctacataatttcattttcttccggttttctatgggtttcattgatagcatcattgccaaatatattgccactgtagttgggtacctggttgtcagtcgcccgttcctagacctggcgcatccgcgacaccttcacagcacccactcagagctgctggaggattactaccaaagtggaagaatgcttttgagaatgtctcaagctttggggcggatagttttggctgggcgtgaaatgactagattggctggttttacggctcggattacggaattaatgcaagtactaaaggatttaaatcatggcaaatatgaacgtacaatggtgtcacaacaggataagggtattgaaggagcacaagctagtcccttgatacctggtgctggagaaatcatcaatgcagacaacattataaagtttgatcatgttcctttagcaacaccaaatggagatatcttgatccaagaccttagttttgaagttcgatctggggccaacgttctcatttgtggtccaaatggctgtggaaagagctccctcttccgtgttcttggtgaattatggcctctctttggaggacatcttactaaacctgagagaggaaagttattttatgttcctcagcgaccctatatgaccctgggaacactgagagaccaagtaatatatccagatggaaaggaggatcagaagaagaaggggatatctgaccaagtgctgaaggggtacttggacaatgtacagttgggccatatccttgagcgggaaggaggctgggacagtgttcaggactggatggatgtactcagcggaggagaaaaacaaagaatggcgatggcaagattgttttatcataaaccccagtttgccattctggatgagtgcacaagtgcagttagtgtggatgtggaagactacatttacagccactgtcggaaggttggcatcaccctcttcactgtctcacacaggaaatccctttggaaacaccacgagtactacctgcacatggatggcagaggcaattatgaattcaaaaagatcacagaagacacagttgagttcggatcatagagaccatctggagaacttcacacttcacaagagaatgaatgaacagaatgcatttgtaaacaacgtgcattgtaaaataaagttaagcttgttttttttaaaaaaacaaagctacaaattgactagatataggataattgaaacatgttaaaacatttaatattgtataggatattgctaattgtgtatatgttggtttaattattaattatgtactaagaatgtccttattcttgtggttaaaaaacctgcctgaattaaattgggcttaaatcagtgtaacctgattcatgggatgtaaaccatttgaagtcagctaatttgacttttatagctctgtctttttctttaatgaagaaccctatttaaaactgggtcattagctgtttattctaacaaagtagtcttgagttcctttttgggtttttttttttttttttttttttttttttttgtgccccatggtagtgggaaccaaaccaatcacaatgttttattggaacatattccatcatcacaggatagcatttattaaacagtggcggatttctctagctgctacatttattctcattcctcatacataccttgaggtgcatttgattccaggagagccatttgggttttctttagctaaataataaatgtacccgtctcagtcttttggactgagtcgttctgaaggctctcgtgtggacagcagtgtgtgcagtctcttacagtccgtgcctgctccacatggtaccagtcttaccagtgcttgagagctcagacacaccctgctgcatgaagttggaggtctcgggagggttttagattttgtgacgggaaccggaaaggctcgtcagagtgtggctgtgtcatggtgagcaccacgtggctgtagaggcccgacatgaggtaatgcactgagcacacaacgccactgctgctgtctgtggctgtgggttcttaaaagtgctggactttgtcatgctcgtgggccaatgacatttcctaggagcggcctctgactcctgtgcagctgcgtctgtgtcagctctggctccctggaaccacgagtgactttgcacaaaggagggctgagagcggacttgatcagtaagtcgtcgtgaatcagtttgcttgagtgggctcggaatgggccttatcacgatggttttgtttcttcgtaactcataatcactggctaccaggataaccctgatgtattgattccgtgaatacatcacattcaatcttaccatgtctccttagcaaacgtgtgtacttattttctgttcagattaaaaaaaaaaaaaaggaattc

SEQ ID NO: 3147 - DNA, 1504 bp, Rattus norvegicus
  Genbank Accession No. NM_012816
gctgcgtggcgtcagggttctggagctggcaggcctggccccagggccgttctgcgggatgatcctggcggacttcggcgccgaggtggtgctcgtggacagactgggctccgtgaaccaccccagtcacctggcccgaggcaagcgctcgctggcgctggacctgaagcggtctccgggagccgcggtgttgcggcgcatgtgcgcacgcgcggacgtgttgctggagcccttccgttgcggtgtcatggagaaactccagcttgggccagagactctacggcaggacaatccaaagctcatctatgccaggctgagtggatttggccagtcgggaattttctccaaagtagctggccatgacatcaactatgtggctttgtcaggtgtcctgtcaaagattggcaggagcggtgagaacccataccctcccctgaacctcctggccgactttggtggcggtggcctcatgtgcacattgggcattttgctggctctcttcgaacgcacgcggtctggcctagggcaggtcattgatgcgaacatggtggaaggaacggcatacttaagtactttcctgtggaaaactcaggccatgggtctgtgggcacagcctcgagggcaaaacctgttagatggcggggcacctttctacacaacctacaagaccgcagatggggagttcatggctgtaggtgcaatagaaccccagttctacacactgctgcttaaaggacttggacttgagtctgaggaactccccagccagatgagcatagaagattggccagaaatgaagaagaaatttgcagatgtgtttgcaaggaagactaaggcagagtggtgccagatctttgacgggacagatgcatgtgtgaccccagtgctgactcttgaggaggccctccaccaccagcacaacagagaacggggctccttcatcactgatgaggagcagcatgcatgcccccgtcctgcaccccagctttccagaacccctgctgttccttctgccaaaagggacccttctgtgggagagcacactgtagaggtgcttaaagactatggattcagtcaggaagagatccatcagctgcactcggatagaatcattgaaagtaataagctaaaagccaacctctgactcaggttcacagctcaagtgaatctgaaggctgtatctgtactggagaaggatgcccaccactgtccgtatggaaatgtgaatgaacagtaatgaagtaatccaaatattccaatcaagacacaacgaaagactgattacagagaaatgactgtgctctcacactgctcatccgagcctctgattgaggagtatttttgtgtgtgtactgatattaacttgtggcagttttctgcctttcagcttacttggtgaagtgcattcactgattaaaacccttttgtaaatgcaactctgataatatattaaatgaactaatataactttaataaataaagcttttttttccttgaaaaaaaa

SEQ ID NO: 3148 - DNA, 1413 bp, Rattus norvegicus
  Genbank Accession No. NM_012818
atcacatgctgtcagggggaatgcgggctacagcttcctcgcaggcaggagtctcaggttctcctcattcctgcacccagtaacagccccagtgtgaccagctctgtggtggggacacctggactccttcttacagttctggtgctaagggaccacttccaaagctggggaaccccagggaggggtcagtggccagatacccatgttgagcatccaccccctgaaacctgaggccctgcatctgcctcttgggacctcagagttcctaggctgccagcggcgccacacactccctgccagtgagttccgctgcctcacgccggaggatgccaccagtgcgtttgagattgagcgcgaagcctttatctcagtctcgggtacctgccccctccacttggatgagatccggcacttcctcaccctgtgtccagagctgtcactgggctggttcgaggaggggtgtcttgtggccttcatcatcggttcactttgggacaaggagagacttactcaggagtcgctgacactacacaggcctggaggccgcacggcccacctgcacgtactggccgtgcaccgaaccttccggcagcagggcaagggctccgtcctgctgtggcgataccttcaccacctggggagtcagccggcggtgcgccgggctgtgctcatgtgcgagaacgccctggtgcccttctatgagaaatttggtttccaggccatgggcccgtgcgccatcaccatgggatctctcaccttcactgagctgcaatgttccttacggtgccacaccttcctgaggaggaacagtggctgctgacccaagctgcgcacttggccatggcgagggtgggagtgacaagcttgggggctcctgtccacttcccaggtcacatccttctctgcccaactagagctggctagcatgaagggagacagcagttcccaagtggagtagagaggtaagggtcaataaagaggacaggagatggcttcccttcagcacaggctgctgtctgtccccagtggaccgcttgccttctgaacagtgcacaaaggcaagaccaggacgtggaaacgggagcagcgggaggtttgtccccacacttcctcctctccctgctctgtttctgggctccagtgcggtgccctggttcttgggagcctcactctaggccaggctgacatcccttcctggctcctaagtctgggaatgaggggcagccaggagccggggacttgtgaatggtggcatcattggggtacagacatgacacagggccacaccaaagtacactcaggcaccaatgtgctggctcacctgcctccctagttccccttctatcctggtccccctaccagccccagtactgacacaataaagcagctatgttcccaaaaaaaaaaaaaaaa

SEQ ID NO: 3149 - DNA, 1451 bp, Rattus norvegicus
  Genbank Accession No. NM_012819
ccggccatggctgcgcgcctgctcctccgctcccttcgtgtcctgagcgcccgctcggcgacactcccgccgccctccgcccgatgttctcattctggagcagaagcacgtctagaaactccttctgctaaaaaattaactgatattggaatcagaagaatcttttcctcagagcatgacattttccgggagagtgtaaggaagttttttcaagaagaagtgattccctaccacgaagaatgggagaaagccggagaagtgagtagagagctctgggaaaaagctggcaagcaaggcctgcttggcatcaacattgcagagaaacatggcggcatcggtggggacttgttgtcaacagcagttacttgggaagagcaagcatactcaaattgcacaggccctggtttcagcctccattcagatattgtcatgccctatattgcaaattacggcacaaaagaacagatcgagcagtttatcccccagatgacggcgggcaagtgtattggtgccatagccatgacagagcctggggctggaagtgacttacaaggagtaagaacaaatgccaaaaggtctgggagtgattggattctcaatggaagcaaggtgttcatcactaatggctggttaagtgatctcgtgatcgtagtggccgtcaccaatcgtgaagctcgatcgcccgctcatggcattagcctctttttggtggagaatggaatgaaaggatttattaagggcaagaagctacataagatgggaatgaaagcccaggacacagcagaactattctttgaagatgttcgattgccagctagtgccctacttggggaagagaataaaggcttctactacctcatgcaagagctcccacaggaaaggcttttaattgctgatttggcaatttctgcctgtgagttcatgtttgaagaaaccaggaactacgtgagacaaagaaaggcttttggaaaaacagtcgcacacatccagactgtgcagcacaaactagcagaattgaagacgaacatatgtgttaccagagcttttgtggacagctgcctacagctgcatgaaaccaaacgtctggactccgcctccgcttccatggcgaaatattgggcatctgaattacaaaacactgtagcttatcagtgtgttcaactccatggaggctggggttacatgtgggaatacccgattgcaaaagcctacgtggatgctcgagttcagccgatctacggtggtaccaacgaaatcatgaaagagctgatcgcaagacagatcgtcagtgacagctagacatctgcctacatcctgaaatcctactacatcacagctaatccggattcaaatatacttgagataaagtggaacctggaagggggggggtagtaaagctggttttatgtatggttgttacagagaaagaaataaaagaattataaagattg

SEQ ID NO: 3150 - DNA, 1454 bp, Rattus norvegicus
  Genbank Accession No. NM_012823
ctcaccttctcagagcttctcctcgggcttcgctgccgccctaaaggttactgtgatctcggcttgagagcaaggtggacagccatggcggcgtctttgtgggttggacctcgagggaccataaacaattatccaggctttaacccatcagtggatgccgaagctatccggaaagcaatcaaaggaattggaactgacgagaaaactctcatcaacattctgacggagcggtcgaacgcacagcggcagctgattgtcaagcatatacaagaggcgtatgaacaggcgctgaaagctgacttgaagggtgatctctctggccactttgagcatgtcatggtggctcttattactgcaccggccgtgtttgatgccaagcaactgaagaaatccatgaggggcatgggcacagatgaagacaccctgattgaaatcttaacaaccaggacaagcaggcagatgaaggagatctcgcaggcctattatacagcatataagaagaatctcagagatgacattagctctgaaacgtctggagacttccggaaagctctgctgactttggcagatggtggaagagacgaaagcctgaaagtggatgaacatctggccaaaaaagatgcccagaccctctacgatgctggtgagaaaaaatggggcacggatgaagacaaattcaccgagatcctgtgtctacggagctttccgcagctgaaactgacatttgatgagtacagaaacattagtcagaaggacattgaggacagcattaaaggagaattatctgggcattttgaagacctgctgctggccgtagttcgctgtacgaggaacaccccagcttttttggcaggaagacttcatcaggctttgaagggagctggaacagatgaattcactctgaacagaataatggtctccagatcagagattgaccttctggacatccgacgtgagttcaagaagcactacggctgctctttatactcagccatccaatcagatacttctggagactacagaactgtgctgttgaagatctgtggaggagatgattgaagaagatggcttccaacagctgcctgccccgatggtggaccgcctcaacagctctgcttactgctttcgtacagcactccagcaatgggcaagcgaatgcaagacagcaacccgtctgcctgatgcgcattggcttccttcaatgcaacagcaaaaatgaacttgattttattttagagcatctcattcataatgtagaggtttataagggaaattcaatctagaattaaagacctactaatgattttttatttggcttaggaagttggaatctgtgttgttcaaagccattaaacataaatcaggatactaaaaatggctgcctttgctaaatgtaatttttgtatttgttttccgtaactactaatactgtatgttgcctggtgccaacaaat

SEQ ID NO: 3151 - DNA, 1250 bp, Rattus norvegicus
  Genbank Accession No. NM_012826
ctcacactacagtagcaatggtgcctgtcctgttgtccctgcctctccttctgggtcctgcagtccttcaggagactgggtcttattctctgatcttcctctacaccgggttgtccaggcccagcaaaggccttccgaggtttcaagccaccgcatttctcaacgatcaggccttcttccactacaacagcaacagtgggaaggcagagcccgtggaaccctggagccatgtggaaggaatggaggactgggagaaggaaagccagcttcagagagccagggaggagatcttcctcgtgaccctgaaagacatcatggactattacgaggacagtacagggtctcacacctttcagggaatgtttggttgtgagatcacaaataacagaagcagtggagcagtctggaggtatgcctacgatggagaagatttcatcgaattcaacaaggaaatcccagcctggatccccttagacccagcagccgcaaacaccaagctgaagtgggaggcagaaaaggtctatgtgcagcgagccaaggcatacctagaggaggagtgtcctacaatgctgaagaagtacctgacctacagtagatctcacctggaccgaacagatcctcccactgtgaaaatcaccagccgtgtggccccaggaagaaacagaatattcagatgtctggcctatgacttctacccacaaagaattagtctgcactggaaccaggccagcaagaagctggcatctgaaccagaaagaggtgtttttcccaatggaaatggcacttacctctcctggatggaggtggaagtccccccacagaacagagacccctttgtctgccacatagaacacaaggggctatcccaatctctctcagtgcagtgggatgagaaaagtaaagtctgaaaacagtgctgtatctcagcctcagaaaggttaccctctctgccggatatgagagagttgaacttcagaagtcactgtcaccagcaagccagcaagtctccaaggaatgggtgtgggcccagaagatttgaataccaagcaccaagttcactctcaaagtcaaatcaatcaccttgccttgtaaaactcctcctcaattaatctgtaagcccttgcaattaccttcacgcccagcacagcacagaaaggcactttaaactctgagatgctacagaagtgtgagttgattttatcatgtatactgccccgacatacttgattcatgggaatgtctccatattc

SEQ ID NO: 3152 - DNA, 4377 bp, Rattus norvegicus
  Genbank Accession No. NM_012836
tgcggagccgctggagcggagcggtgttagcggcgttgctggaagatggcgagcggctgggatgagcggccgccctggcggctggaaagcctgcggctgctaccgccgccaccgctgctgctgctactgctgctattgaggagctcggcccaggcggcgcacatcaagaaggctgaggcgaccacgacgaccgtcggcggctccgaggcggccgagggccagtttgaccactactaccacgaagcggcgctgggcgaggcactggaggcggcagcggccgcggggccgcctggcctggcccgtctcttcagcatcggcaattcggtggagggccgaccgctgtgggtgctgcgcctcacggctggcctggggccgccgcccacccccgccgccgtggggctggacgccgcggggccgctgctgcccggccgaccgcaggtgaagctggtgggtaacatgcacggcgacgagacggtgtcgcgccaggtgttggtctacctggcccgtgagctggcgtcgggctaccgccgcggggacccgcgcctggtccgcctgctcaacaccaccgacgtatatttgctgcccagcctgaatccggatggcttcgaacgcgctcgcgagggtgactgcggcctcggcgacagcggtccgcctgggaccagcggccgagacaacagccgaggccgcgacctcaaccgcagcttccctgaccagttcagcacgggggagccaccttccctggatgaggtgccagaggtgcgcgccctcatcgactggatccgcaggaacaagtttgtgctttctggaaatcttcatggtggctcagtggtagcaagctatccttttgatgattctcccgagcataagaccactggaatctatagcaaaacctccgatgatgaagtctttcgatacttggcgaaagcttatgcttctaaccaccctataatgagaactggtgaaccccattgtccaggagatgaagaggagactttcaaagacgggatcacgaacggtgcgcactggtatgatgtggaaggtggtatgcaagattacaactatgtgtgggccaactgttttgagatcacattagaattatcttgctgcaaatacccacctgcttctcagcttcgacaagaatgggagaacaaccgtgagtctttgatcacattgattgaaaaggtccacattggaattaaaggatttgttaaagactcagtcacaggctctgggttggagaatgcaaccatctcagtggctggtattaatcataatatcacaactgggagattcggtgatttccacagactgctcattcctggaagttacaatcttacagcggtttcacctgggtatatgccgttgactattaataatatagtggtgaaagaaggaccagccacagagatagatttctcccttcaaccaactgtgatgtcagtagtgcctgactcgactgaggctgtgacaactcccggcacagttgccgttcctaatattcctcctggaacaccatcgtcccatcagccaattcagcctaaagactttcaccaccaccattttcctgacatggaaatcttcttgagaagatttgccaatgaatatcctaacatcactcgcctttattctctgggaaagtccgtagagtcgagagaactgtatgtgatggagatatctgacaacccaggcgtccatgaaccaggtgaaccagaatttaaatatattggaaatatgcatggaaatgaagtggttggaagagaactgctattgaatctcatcgaatacctctgcaagaactttggaacagaccctgaagtaacagatttggttcgcagcactagaattcacctcatgccatccatgaatcctgatgggtatgagaagtcccaagaaggagactcgataagtgtagttggcagaaacaacagcaacaactttgacctaaaccgaaatttcccagaccagtttgttccgatcacagatcctacccaacctgaaactatcgctgtgatgagctgggtgaaggcctatccgtttgtgctgtcggccaatctgcatggaggttccttggtggttaactacccttatgatgataatgaacaaggagttgccacatacagcaaatcaccagatgacgccgtgtttcaacaaatagcactttcttattccaaggaaaactcgcagatgttccaaggtagaccttgcaaagacatgtaccttaatgagtattttcctcatggcataacgaatggagcgagttggtataatgtcccaggtggtatgcaggactggaactatttacagacgaattgctttgaagtaaccatcgaactaggttgtgtgaaatatccattcgagaaggaactgccaaagtactgggagcaaaaccggagatctctaatccagtttatgaaacaggttcatcagggtgtcaaaggatttgttcttgatgccacagatggtaggggcatattaaatgccaccctcagtgttgctgaaattaatcacccagtgacgacttacaaagctggagattactggcgtctcttggtcccagggacatataaaatcacagcatctgctcgagggtataaccccgtcaccaagaacgtgaccgtcaggagtgaaggtgctattcaggtcaacttcacacttgttcgatcttcaacagatgcaaacaatgagtcaaagaaaggaaaggggcatagcaccagcactgatgacaccagcgacccaacttctaaggagtttgaagcactgatcaaacacctttcggctgagaatggcttggaaggcttcatgttaagctcgtcctcagacctggctctgtatcgataccattcctacaaagacttatccgagttcctgagaggactcgtaatgaactacccacacattacaaaccttaccactttgggacagagtgttgaatatcgtcacatttggtcccttgaaatctccaataagcccaacatatcagaacctgaagaaccgaagattcgttttgttgctggtatccatggaaacgctccagttggcactgaactgcttttggctctggcagaatttctttgcctgaattacaaaaagaatccagttgttacccaattggttgacaggactagaattgtgattgtcccctctctgaatccagatgggagagagcgagcacaggagaaagactgtacctcgaagactgggcacacaaatgcccgtggcagggacctggacacagacttcacaagtaatgcttcccaacctgagaccaaagccatcattgaaaacttgattcaaaaacaggatttcagcctttccattgctttagatggtggttctgtgctggtcacatatccgtacgacaagccagtccagacagtggaaaacaaagaaacgttaaagcatctggcgtctctttatgcaaataaccacccatcaatgcacatgggtcagcccagttgcccaaataattcagatgagaacataccaggaggagtgatgcggggagcagagtggcacagtcacctgggcagcatgaaggattatagtgtcacctatggccattgcccagaaatcacagtatacacaagctgctgctacttcccaagtgcagctcaactccctgccctatgggcagagaacaagaagtctctcctcagcatgctggtggaggtccacaaaggagtccatgggttagtaaaagacaagactggtaaaccaatctctaaagcagtaattgtactcaatgaaggaataagagtacacacaaaagaggggggttatttccatgtgcttttagctcctggggtccataacatcaatgccatcgctgatggatatcagcaacagcattcacaggtctttgtgcatcatgatgcagccagttctgtggtgatagtctttgatacagataaccggatatttggtttgccaagggaacttgtggtaactgtgtcaggtgccaccatgtcagcgctgatcctcacggcttgcatcatttggtgcatctgctctatcaagtctaacagacacaaagatggcttccaccggctgcggcagcatcatgatgaatatgaagatgaaattcgcatgatgtcaactggctctaagaagtcccttttaagccatgagttccaggatgaaacggacacagaggaagagacattatattctagcaaacattgagaagcacggtttgcatatctccctgcttaagtaccaggcaaatgacagctcctcttgggagacactgcagtaagaagagagattccttcctccttcaaagagctttgggaagttagcctgctaaattcatactctctgaatgtcacaggcagttttgaacttcccttccttaaaagtactcttaaccttttcctt

SEQ ID NO: 3153 - DNA, 590 bp, Rattus norvegicus
  Genbank Accession No. NM_012838
gcaggtttttctagggtccagacacccaggtctcctagttggctctctccgtagcttctctgtgatattctaaccagtgcttgccaaagatgatgtgtggcgcgccatccgccacaatgccggccacgaccgagacgcaggagatcgccgacaaggtgaagtctcaacttgaagagaaagcaaatcagaagtttgatgtctttaaagccatatccttcaggagacaggtagtggccggcaccaacttcttcatcaaggttgatgtcggcgaagaaaaatgtgtgcacttgagggtgtttgaacccctccctcatgagaacaagcctttgaccttgtcttcttaccagaccgacaaagaaaagcacgatgagctaacctacttctgattactgcagcccctttgccaaatacttcacctttggaatccgtgtttgggaccacgaagtaaatacccctctgtgagcagcttcctttgtgatgcccaaacggcgttgtattttgtttctttccaaacaattattttcagaaaactgtataaaaactatctctctaaatatatatttttagagaccgtaaaaaaaaaaaaaaaa

SEQ ID NO: 3154 - DNA, 318 bp, Rattus norvegicus
  Genbank Accession No. NM_012839
atgggtgatgttgaaaaaggcaagaagatttttgttcaaaagtgtgcccagtgccacactgtggaaaaaggaggcaagcataagactggaccaaacctccatggtctgtttgggcggaagacaggccaggctgctggattctcttacacagatgccaacaagaacaaaggtatcacctggggagaggataccctgatggagtatttggaaaatcccaaaaagtacatccctggaacaaaaatgatcttcgctggaattaagaagaagggagaaagggcagacctaatagcttatcttaaaaaggctactaatgaataa

SEQ ID NO: 3155 - DNA, 981 bp, Rattus norvegicus
  Genbank Accession No. NM_012843
aaacctcctgaagagaggaccagaccagcagccagcgccaccactcagggcatctgcctctgtcactggatactccagaattctctactcaggagttacaaaaaagaagccaagatgttggtgctactggccggtctcttcgtggtccacatcgccactgccattatgctgtttgtctccaccattgccaacgtctggatggtggcggacggtatagactcgtccatagggctttggaagaactgcaccagtggcagctgtgacggctctctgagctacggcaatgatgatgctatcaaggcagtgcaagctttcatgatcctctccatcatcttctctataatctccctcgtggtcttcgtgttccagctcttcaccatggagaagggaaaccggttcttcctctcgggatccaccatgctggtgtgctggctgtgcattctgattggagtgtctatctacactcaccactacgcccacagcgaagggaactttttccccagcagccatcaaggctactgtttcatcctgacctggatttgcttctgcttcagcttcatcatcggcatactctatatggtcctgaggaagaaataagctcgtgggcatctggggtgggggtggggaagtagggaggaggaagcaactgaatccgggagggaagcagaagtcactgtgtagggataaccaagggaggggaggggggaagggagggggaaaggaagagtaggagaggcccaaacccaaaccatatctgggggggcgtggttctctactgccaaacgcccatccttggaagaaagttgttggctactatgctgatgcttccttgaggccaccagagagtcctcctctagccaccaaatatggccccatctatcctcaattaccgacacttggggcctcaccagctgccattccactggcgccactcttgagggtgactgctgggtcatacactgaggtcttgcaaacccattc

SEQ ID NO: 3156 - DNA, 1242 bp, Rattus norvegicus
  Genbank Accession No. NM_012844
atgtggctggaacttgtcctggcttcccttctgggctttgtcatctactggtttgtctcccgggacaaggaggaaaccttaccactaggagatggatggtgggggccagggtcaaagccatcagccaaagaagatgagagcatccggcccttcaaggtggaaacatcagatgaggagatcaaggacttacaccagaggatagataggttccgggcatccccacctttggagggcagccgcttccactatggcttcaactccaactacatgaagaaagtggtgtcctactggaggaacgagtttgactggaggaagcaggtggagatcctcaaccagtaccctcacttcaagaccaagatcgaagggcttgacatccacttcatccatgtgaagcctccccagctgccctcagggcgcaccccaaagcccttgctgatggtgcatggctggcctggatccttctatgagttttacaagatcatcccactactgactgaccccaagtcccacggtctgagtgacgagcacgtgtttgaagtcatctgtccctcgattcctggctatggctactcagaggcatccagcaagaaaggtttaaattcggtggccactgcgaggattttctacaagctgatgacacggctgggcttccagaaattctacattcaaggcggggactgggggtccctcatctgcaccaacatggcccagatggttcccaaccacgtgaaaggcctgcacttaaatatggctttcatttcgagaagtttttacaccatgactcctctcctgggccaacgcttcgggagattccttggctacacagagaaggatatcgagctcttgtacccctataaggagaaggttttctacagcatcatgagggagagtggctacttacacatccaagccaccaagccagacactgtgggctgtgctctcaatgactctcccgtgggcctggctgcctacatcttagagaagttctccacctggaccaagtcagagtaccgtgaactggaggatggaggcctggagaggatgaaggtctttgtgcccactggcttttcagccttcccttccgagctactgcatgccccagaaaagtgggtgaaggtcaagtaccccaaactcatctcctattcctacatggaacgtgggggccactttgctgcctttgaagagcccaagcttctggcccaggacatccgcaagttcgtgtccctggctgagctgcagtag

SEQ ID NO: 3157 - DNA, 1216 bp, Rattus norvegicus
  Genbank Accession No. NM_012846
gcccagggtgggaggaagggcggtaatctctaggaagcagaaggcaggtttgcagaggacgctggataggagatgaggtgggggaaaccaaggcctgggcttcccgcagctgcagcaaggttttggtgcttaccacagcagcaggaatgcattgagggatgtgacagtggaacgcaggtggcagtgatactcactgctgctgaaggagcccaaagaaccagcatctgacctgtcttgaacgcaccatcgacagttgctgctgagtcatggccgaaggggagatcacaacctttgcagccctgaccgagaggttcaatctgcctctagggaactacaaaaaacccaaactgctctactgcagcaacgggggccacttcttgaggattcttcccgatggcaccgtggatgggaccagggacaggagcgaccagcacattcagctgcagctcagtgcggaaagcgcgggcgaagtgtatataaagggtacagagactggccagtacttggccatggacaccgaagggcttttatacggctcgcagacaccaaatgaagaatgcctattcctggaaaggctagaagaaaaccattataacacttacacatccaagaagcacgcggagaagaactggtttgtgggcctcaagaagaacgggagttgtaagcgcggtcctcggactcactacggccagaaagccatcttgtttctccccctcccggtatcttctgactaaggagtctgttctgggtgctccctatttttggttgaccctaaaatgttcccttgaccattggctgcgctaaccctcagcccacagagcctgaatttgtaagcagtgcttctaaatagccagttcacttttccgctgagcccttccccaccaccccagcacagtttggaacacggggaccaaattacttctaggggacaactggctggccagtctaggtctgggtttggatatccagatgcttcagggtacctgctacaagttggacctcgtgatacaaagaggggagccatgtgtagcatctggaggggtctaagaagtgggttcttttagtagctgcatgctctttccccttctgagtaatccctggttttgagtacccccaggcacttagcatgactacccttccccctaccagcacctcataaatatcagtaaagaaactgatagtaaaaaaaaaaaaaaaaaaaaaaaaaaaaaaaaaa

SEQ ID NO: 3158 - DNA, 1680 bp, Rattus norvegicus
  Genbank Accession No. NM_012847
gcgggccgcggagggggcggggctccaccaccacctcagctgcggacggaggcgagatggcggccactgagggggtcggggaatctgcgccaggcggtgagccgggacagccagagcagccgccgcccccgcctcctccgccgccagcacagcagccgcaggaagaagagatggcggccgaggccggggaagcagcggcgtcccctatggacgacgggtttctgagcctggactcgcccacctatgtcttgtacagggacagggcagagtgggctgacatagacccagtgccccagaatgatggccccagtccagtggtccagatcatctacagtgaaaagtttagagacgtctatgattacttccgagctgttctgcagcgcgatgaaagaagcgaacgagcctttaagctcactcgagatgctattgagttaaacgcagccaactatacggtgtggcattttcggagagttctcttgaggtcgcttcagaaggatctgcaagaagaaatgaactacatcatcgcaataattgaggaacagcccaaaaactatcaagtttggcaccataggagagtattagtggagtggctgaaagatccttctcaagagctcgagttcatcgccgatatccttaatcaggatgcaaagaattaccatgcctggcagcatcgacagtgggtcattcaggagtttcgactttgggataatgagctgcagtatgtggaccagcttctcaaagaggatgtgagaaataactctgtgtggaaccaaagacacttcgtcatttctaataccactggctacagtgatcgcgctgtgttggagagagaagtccaatatactctggaaatgatcaaattagtgccacacaatgagagtgcgtggaactacttgaaagggattttgcaggaccgtggtctttccagataccctaatctattaaaccagttgcttgatttacaaccaagtcacagctccccctacctaattgcctttcttgtggatatctatgaagacatgctggaaaaccagtgtgacaacaaggaggacattcttaataaagcactagagttatgtgagattctagctaaagaaaaggacactataagaaaggaatattggagatatattggacggtccctccagagtaaacacagcagagaaagtgacataccggcgagtgtatagcagcaagagcggctggaagaagtggacaatgctttctaaggcctcttattcgggagtgtagagcggttagagcggtcatctcatgcctgtgagctaacgttgtccaggtgctgtttctaacaagaactaaggatgactcctgtgtctgacgctgttcagactagctaagagtcgatttcctaaagcaaggtcattggaggggagggtgaagaaaactttcccgtaaaggaactactgcttttgtagtcttcccaacatttaatccaatcctgtagaatcagcatctcctgaaagacatggtgcacggctgtgtgctgggcgtggctaagggcagctgtgtcatgggtttgcagtcatgggaacctcggagcgctgcccgggactgcattgatgattagggctgctggcctcacccacaggatcttgctatcactgtaaccaactaatgccaaaagaaaggttttataataaaatcacattatctacaaac

SEQ ID NO: 3159 - DNA, 1629 bp, Rattus norvegicus
  Genbank Accession No. NM_012850
aaacagcggactacaggcaccactgccatggacagcctgttgtgggctacctgggtcctctgcttgctgaacctgtggggagttgcactgggtcacctccacctagaatgtgacttcatcactcagctgagagacgatgagcttgcatgccttcaggcggcagaggggaccaacaactcgtccatgggatgccctgggacctgggatgggctgctgtgctggcccccaactggctctggccagtgggtctccctcccctgccctgaattcttctctcattttggctcagacccaggggctgtgaaaagggactgcaccatcacgggttggtctgatcccttcccaccatatcccgtggcctgtcctgtgcccttggaactgctaacagaggagaagtcttacttctccacggtgaagatcatctacaccacaggccacagcatctccattgtagccctctgcgtggctattgccatcctggttgctctcaggaggctccactgccccaggaactacatccacacgcagctgtttgctactttcatcctcaaggccagtgctgtgttcctgaaggatgctgctgtcttccagggtgatagcacggaccactgcagcatgtccactattctgtgcaaggtctctgtggccgtctcacattttgccaccatgaccaacttcagctggctgctggcagaagccgtctacctgagctgtctgttggcctccacatctcctaggtccaaaccagctttctggtggctggttctcgctggctggggactccctgtgctatgcactggtacgtgggtgggctgcaaactggcttttgaggacactgcgtgctgggacctagacgacagctccccctactggtggatcatcaaagggcccatagtcctctctgttggggtgaactttgggctgtttctcaatataatttgcatcctgctgaggaagctggggcctgcacaaggcggcttacacacacgggctcagtactggcggctttccaaatcaacacttctccttatcccgctgtttggaattcattacatcatcttcaacttcctgcctgacagtgctggccttggcatccgtctacccctggagctgggactggggtccttccagggttttgttgttgctgtcctctactgcttcctcaatcaagaggtgaggacggagatttcacgcaaatggtatggccatgaccctgaacttctgccagctcggcggacctgcactgagtggaccacacctccccgatcgagagtgaaggtgctcacctctgagtgctaggccagccatcacaaaggccgagccccaaaaccctgcactcaaactgccatgccaccaagggcaacaaggtcctcccttccgttctcattctctgcatctgctttctctaggtccctgtataccaacctccgactttctcagttcctgtatgcccccatctgttctttcttcctatctaggctattgcccaaggcccagggaaaccaataaacttgtacatgagtgatctgcagttgagtcaatgtggctctgaaggggagctcttgtcagcagccattatttgcacttccggtgcattcctcatcccttggctgcagctgcctcattgcc

SEQ ID NO: 3160 - DNA, 1432 bp, Rattus norvegicus
  Genbank Accession No. NM_012851
cctaggacccttcatgctctgagcatcagtaccttttcacatggactccacggtagtgctcattaccggttgctcttctggaattggcctgcacttggctgttcgtctggcttccgaccgttcccagagcttcaaagtttatgccacattgcgggatctgaagtcacagggaccattgttggaggcagccagggctcaaggatgccctcctggctccctggagatactggaattggatgtcagagactcggaatctgtggctgctgcccgggcatgcgtgacggagggtcgagtggatgtactggtctgtaatgctggacgcggcttgttcgggccgctggaagcgcatgagttgaacgctgtgggtgctgtactggatgtgaatgttcttgggaccatccggatgcttcaggcctttctgccagacatgaaaaggcgccactccgggcgtgtgctggtgactgcgagtgtgggaggtttgatggggctgccattccacgaagtgtactgtgccagcaagtttgcgctcgaaggtctgtgcgagagtctggcgatcctgctgccgctctttggagtccacgtgagcctcatcgagtgcggggcagtgcacacagccttccatgaaaagctggagggcggcccgggcggggctctggagcgagcagatgcccagacccgccacctctttgcccactatcagcgtggttatgagcaagccctgagcgaggcgcaggacccagaggaggtgacggagctcttcttgactgcgatgcgagccccgcagcctgcgctgcgctacttctccacaaaccgcttcctgccgctggcccgaatgcgcacagaggaccccagtggcagcagctacgtcgaagccatgcaccgcgaggccttctctgatctgcaggtccaggagggtgccaaggctggggcccaagtttcaggggatccagacacgccccccagagccctcatttgtctccccgagtgtgcaatccctagggtgacagctgaattgggatggtctgcatcagataaaccgggtcagaacaaatcatgttaccagcaaaagatctaagctagaatctctttttattattttagaatgtgttttgttttaagacaaggtttcactatgtagccctgtctgaactgtaactcataaagatccacctgcttctccttctgtgtgcaaccgcacacttctcagaatcatttgaaatagtgcaaacatcttcatgggtcaagataagagggctgtagtcggggttggggatttagctcagtggtagagcgcttgcctaggaagtgcaaggccctgggttcggtccccagctccagggggaaaaaaaacctaaaaaaaaaaagagggctgtagtcaaggttaagggtttttccttccaataaatgtacttattaattattaaaaaaaaaa

SEQ ID NO: 3161 - DNA, 2006 bp, Rattus norvegicus
  Genbank Accession No. NM_012857
gccggcgccgcagctgccgggcctctcgagtcggtggacgcgccctcccgccggcctcgccgcccgcgcaaccgccgtccttcggcctcggctgcgtcgcgccatggcggccccgggcgcccggcggccgctgctcctgttgctgctggcaggccttgcacacagcgccccagcactgttcgaggtgaaagacaacaacggcacagcgtgtataatggccagcttctctgcctcctttctgaccacctatgatgctggacatgtttctaaggtctcgaatatgaccctgccagcctctgcagaagtcctgaagaatagcagctcttgtggtgaaaagaatgcttctgagcccaccctcgcaatcacctttggagaaggatatttactgaaactcaccttcacaaaaaacacaacacgttacagtgtccagcacatgtatttcacatataacctgtcagacacacaattctttcccaatgccagctccaaagggcccgacactgtggattccacaactgacatcaaggcagacatcaacaaaacataccgatgtgtcagcgacatcagggtctacatgaagaatgtgaccattgtgctctgggacgctactatccaggcctacctgccgagtagcaacttcagcaaggaagagacacgctgcccacaggatcaaccttccccaactactgggccacccagcccctcaccaccacttgtgcccacaaaccccagtgtgtccaagtacaatgtgactggtgacaatggaacctgcctgctggcctctatggcactgcaactcaacatcacctacatgaagaaggacaacacgactgtgaccagagcattcaacatcaacccaagtgacaaatatagtgggacttgcggtgcccagttggtgaccctgaaggtggggaacaagagcagagtcctggagctgcagtttgggatgaatgccacttctagcctgtttttcctgcaaggagttcagttgaacatgactcttcctgatgccatagagcccacgttcagcacctccaactattccctgaaagctcttcaggccagtgtcggcaactcatacaagtgcaacagtgaggagcacatctttgtcagcaaggcgctcgccctcaatgtcttcagcgtgcaagtccaggctttcagggtagaaagtgacaggtttgggtctgtggaagagtgtgtacaggacggtaacaacatgctgatccccattgctgtgggcggggccctggcagggctggtcctcatcgtcctcatcgcctacctcatcggcaggaagaggagtcacgcgggctatcagaccatctagcctggtgggcaggtgcgccacagacgcacacgggcctgttctcacatccccaagcttagataggtgtggaagggagggaggcacacttgtggcaaactgttttcaaatctgctttatcaaatgtgaagctcatcttgcaacatttactatgcacaaaggaataactattgaaatgacggtgttaattttgctaactgggttaaatattttgctaactggttaaatgttaatatgttaccaaagtagagctctaaagaggacaagaaggctccacgcatttgacttttaagacttggtgtttggttcttcattcttttactcagatttacgccttacaaagggaatctctggtccagacacttgggcctggcaagggtggctgatggtggttaggctgcacacttgagaagcaaacaggagcagggacgtcctgccacacaggcacgcacagggtcagcctctggacacttggcttgggctgcctggcctggggggctagactctggcatctggctgggcacacccaccagtgtttctgtgctctgccgcctgtgagctaccactttcctaaatagaaaatggcattatggggttggggatttagctcagtggtagagcccttgcctaggaagcgcaaggccctgggttcggtccccagctccggaaaaaaaaaaaagac

SEQ ID NO: 3162 - DNA, 1057 bp, Rattus norvegicus
  Genbank Accession No. NM_012864
cggcaacagacgattgttctcagagccactttgatggcagctatgaggctcaccctgttccgcattgtgtgtctgctgccaggctgcctggccctgccactgtcccaggaagccggagaagtgaccgcacttcagtgggaacaggcgcagaattatcttaggaaattttaccttcacgactctaaaacaaagaaggccaccagtgcagtggacaaactgagggaaatgcagaagttcttcggtttgccggagactggaaagctgtccccccgtgtcatggagataatgcagaagcccaggtgtggagtgccagatgttgcagaattctcactaatgccaaacagtcctaagtggcattccagaactgtcacctacagaatcgtgtcctatactacagacttgcctcggttcttagtagatcaaatcgtgaaaagagctctcagaatgtggagtatgcaaatcccactgaacttcaagagggttagttgggggactgcagacatcataattggcttcgcaaggggagatcacggagacaacttcccatttgatgggccaggaaacactctaggccatgcctttgcaccggggccaggcctcggcggagatgctcactttgacaaggatgagtactggacggatggtgaggactcaggagtgaacttcctgtttgttgccactcatgaacttggccactctctgggtctgggtcactcttctgttcccagttctgtgatgtaccctacctatcaaggagatcattcagaagacttcagtcttacaaaggacgacattgcaggcatccagaagttatatggaaagaggaacaagctgtgatagatgcagacagtttctggaatgagcaaacgcccttcctgagccacacttactcctttcttccttgtactgtggatgggttttgcacatccctctgagggtcattttgatggaatgagtctgacaaatctcaggtaacacgacagacaccagcaataaatgtcatgtgacatcagcaataaatgtcatgtgtgcaaataaaaaaaaaaaaaaaaaaccg

SEQ ID NO: 3163 - DNA, 1203 bp, Rattus norvegicus
  Genbank Accession No. NM_012866
gggggataggagtgacttaaattctccctgtccgaggagatataaataactccatgtaaaattaatgcagttctcggtgtcaaaatgtccacagaaggagggtttggcagtaccagcagcagtgatgcccagcaaagcctccagtccttctggcccagagtcatggaagaaatccgaaacttaacagtgaaagatttccgagtacaagaactaccactggctcgtattaagaagattatgaaactggatgaagatgtgaagatgatcagtgcagaagcccctgtgctgtttgctaaggcagcccagatcttcatcacagagctgactcttcgagcctggatccacacagaggataacaagcgtcgtactcttcagaggaatgatattgctatggcaattacaaaatttgatcagtttgactttctcatcgacattgttccaagagatgaactgaaacctccaaagcgccaggaggaggtacgccagtctgtgactcccgcggagcctgtccagtactacttcacgctggctcagcagcccactgctgtccaggtccagggacagcagcaaggccagcagaccaccagttctacgaccaccatccagcctggccagatcatcattgcgcagcctcaacagggtcagaccacacccgtgaccatgcaggttggagaaggtcagcaggtgcagattgtgcaggcccaacctcagggtcaggcccagcaggcccagagtggtactggacagaccatgcaggtgatgcagcagatcattaccaacacaggagagatccaacagatcccggtgcagctgaatgccggccagttgcagtatatccgcttagcccagcctgtatcaggcacccaagttgtgcagggacagatccagacccttgctaccaatgcccaacagatcacacagacagaggtccaacaaggacagcagcagttcagccagttcacagacggacagcagctgtaccagatccagcaagtcaccatgcctgcaggccaagaccttgcccagcccatgtttattcagtcagccaaccagccctctgatgggcagaccccccaggtgactggagactgaggcctgagctgcaaagccaaggaaccccaacacaatatttgccatagagcccccaggcgatggggacacaccttccctcaccagaggacccgggacttcattgcctcctgc

SEQ ID NO: 3164 - DNA, 324 bp, Rattus norvegicus
  Genbank Accession No. NM_012875
  misc_feature (1)..(324): n = a or c or g or t
tctctcttgattcagatcctcgccatgtcttctcacaagactttcagaatcaagcgattcctggcaaagaaacaaaagcaaaatcgtcctattcctcaatggattcggatgaaaactggtaacaaaatcaggtacaactctaagagaagacactggaggagaacgaagctgggtctataaggagtcacactacggccagactgaggatttctactgaatcaccgtcatcgatcagtccgaccagatggatttcaacatttttaacctagagatttacttgtgtctgaactaatttgtccagtaataaaatttagaacctttcan

SEQ ID NO: 3165 - DNA, 2573 bp, Rattus norvegicus
  Genbank Accession No. NM_012879
actccgcttgctcctcctcctacaatgtataaccaggcagagctgaggacagctactcatccacattcggaacaggacctggattgagacaacaactccgcacacaacatgtcagaagacaagatcaccggaaccttggctttcactgtcttcactgcagtgctgggttccttccagttcggatatgacatcggtgtgatcaatgcacctcaagaggtaataatatcccattatcgacatgttttgggtgttcctctggatgaccgaagagctaccattaactatgacatcaatggcacagacaccccactcatagtcacaccagcacatacgacaccagacgcctgggaagaagagactgaaggatctgctcacatagtcactatgctctggtctctgtctgtgtccagctttgcagtaggcggaatggtcgcctcgttctttggtgggtggcttggggacaaactcggaaggatcaaagccatgttggctgcaaacagcctctcgttgactggagccctcttgatggggtgttccaaatttggaccggcacatgctctcatcattgctggaagaagcgtatcaggactgtactgtgggctaatttcaggactggttccaatgtacattggcgagattgctccaaccacactcaggggtgccctgggcactcttcaccaactggctcttgtcacaggcattcttattagtcagattgctggcctcagcttcattctgggcaatcaggattactggcacatcctacttggcctatctgctgtaccagctctcttgcagtgtctgctactgctcttctgtccagaaagccccagatacctttacctaaatttggaagaggaagtcagggcaaagaaaagcttgaaaagactaaggggcactgaggacatcaccaaagatattaatgagatgaggaaagaaaaggaagaggcgtcgactgagcagaaggtctccgtgatccagctcttcacggatccgaattatcggcagcccattgtggtggcactgatgctacacttggctcagcagttctctggaatcaatgggatattttactattcaaccagcatttttcagacagctggcatcagccagcctgtgtatgcaaccatcggcgttggtgccatcaacatgatcttcacagctgtctctgtgctgcttgtggagaaggcggggcggcggaccctgttcctggccgggatgattggcatgtttttctgtgccgtcttcatgtcgctgggactggtgttgctggataagttcacctggatgagttatgtgagcatgacggccatcttcctcttcgtcagtttctttgagattgggccaggtccaatcccttggttcatggttgctgaatttttcagccaaggaccccgtcccacggctctggcactggctgcctttagcaactgggtctgcaatttcatcatcgccctctgcttccagtacattgcggacttcctcgggccttacgtgttcttcctttttgctggggtggtcctggtcttcaccctgttcacattttttaaagttccagaaaccaaaggaaagtcttttgacgaaattgctgcagaattccggaagaagagtggttcggccccaccacgcaaagccactgtacaaatggaattcctggggtcatcagagactgtgtgaggatgagctgcctaaaatccaggaacagaccagaagggaaccaggtgctccctcttaactcgaatccttcatgagtgtaggactacacccaggaggatcatttattccttttgaagaatttgtacagactccgattagaaacgtcaacatatatcattaccaaagaaagtatttttttaacttagagaatctattttggatggtaaaactcttcagtaaaccagaggctgctctgcttctctacagggaaagcacgttataagcttcctcgcctggttctactgaaattggagagctttcaacatatcactgctcttaaaagcacgtgactaagaaatctgaagctacaactgatatatatatatttaaatataattccattggaattttcttagccacagatctgatgctgaaggacctatggctggcaaggctcacactcaaactgacgtctctgttacccacctcggtttctctcacatgtactagactttgtgttttgttttaaactatttttctgcatttttatagagaactcctgagtatgttaagctatatttgtaatgaaaagcctcttctttacagctaccaaaatcttcatgtagtgagagaaaacgtttcagtttctttgatgtatattgtaaggttaaacgctcgagtttttcctagccattgagtctagattatcagttaatattagcatctaaaccatgttagttactctccatttcagtcctttgtattgtacttttacttgtttttttttttaattgcccatggcacacacttaaaaccatcaggagtcaggcattttgcatattgcctccaaaatctaataaactggaccaatcacagggaaatctggaataaagagctgctctatttgttcatttttt

SEQ ID NO: 3166 - DNA, 1309 bp, Rattus norvegicus
  Genbank Accession No. NM_012883
gaattccgttgctgtcgctagctctctctcttttttttttacagcttaatatttgtggtgcaatttgaagtgaactgaaccgggtgatttcacttctctcacaggagcatctggacagtacaccacttgtgatggagacttctatgcctgaatactatgacgtttttggtgatttccatggatttttaatggataaacggttcaccaaatattgggaagacgttgaaacattcttggcaaggccagatgaccttctcattgttacttatcctaaatctggcagcacatggattagtgaaattgtggatatgatctataaagaaggtgatgtggaaaaatgcaaggaggatgcactttttaacagaatacctgacctggagtgcagaaatgaagatctaataaacggaataaaacaactaaaagaaaaggaatcgcctagaatagtgaaaactcacctgccagctaagctccttccagcatcattttgggaaaagaattgcaagataatctatctttgccgaaatgccaaagatgtcgtcgtttcttattactactttttcctgatcatgaaaagttatccaaatcctaaatctttttctgaatttgtggagaaatttatggaagggcaagttccgtatggttcctggtatgatcatgtaaaatcttggtgggagaagagtaagaattcacgtgttttgtttatgttctatgaggacatgaaagaggatatccgaagagaagttgtgaagctgatagagttcctggagagagacccatcagcagagctagtagacagaatcattcaacatacatcattccaggagatgaagaacaatccatgcaccaattattcaatgctgccagagaccatgatagatctaaaagtatcgcctttcatgagaaagggaattgtaggagactggaagaaccacttccctgaagccctgagggagagatttgaggagcactaccagcagcaaatgaaggactgccctgtgaaatttagagcagagctctgagacaattccttgtgtctgaaattggagtagtctccaatttatccttcagtttttcttgttttgaattcagtagaagtagaagtcttttgaagactgagggtttaaattcattctggtttttttaatctaacttttatatcaatctagtttctgaatgttttgttggcaaaataacatttttcatatatacatatatatacatatatatatatatatatatatatatatatataacacaagcattgtcctctaatagtgttcaaagatttctaataaaaaaaccggaattc

SEQ ID NO: 3167 - DNA, 3508 bp, Rattus norvegicus
  Genbank Accession No. NM_012887
ggcacgaggctcgctgcgggctccaggcttggccgcacttgctcaccagtggtgcgcccggggcttttgtggcttagccggcctgggctttgtgtccgagttctgctccgtgcctgcggcgcttctcccggtcagggattcccgaggcggcgtgcgcagcccccgggaccagcgagcgatcgagcgagcgcgccggcttgagcggtggcgactgcgaggggccgaggaggagagaaggagggggacgagatgccggagttcctagaggacccttcggtcctgaccaaagacaagttgaagagcgagttggtcgccaacaacgtgacgctcccggccggcgagcagcgcaaggacgtgtacgtgcagctctacctgcagcacctcacggcgcgcaaccggccgccgctcgccgcgggagccaacagcaaagggccgcccgacttctcgagcgacgaggagcgcgagcccaccccagtgcttggctccggggcctccgtgggtcgcggccgcggcgccgtcggcaggaaagccacaaagaaaactgataagcccaggccagaagataaagatgatctggatgtgacagagctctctaacgaagaacttctggaacagcttgtgagatatggagtgaatcctggtcccattgtgggaaccaccaggaagctgtatgagaagaagctgttgaagctgagggaacagggagcagaatcgagatcctctactcctctcccaacagtctcttcctctgcagaaaacacgaggcagaatggaagtaatgactctgacagatacagtgacaatgacgaagactctaaaatagagctcaagcttgagaagagagagccgctaaagggcagagcaaagactccagtaacactcaagcaaaggaggattgagcacaatcagagctattctgaagctggagtaactgagactgaatggacaagtggatcttcaaaaggcggacctctgcaggcattaactagggagtccacgagagggtcgagaagaactccaaggagaagggtggaaccctcacagcattttcgtgtagatggtgcagtaatttcagagagtactcccatagctgagactataaaggcttccagcaacgactccttagtggccaataggttgactggaaatttcaagcatgcatcttctattctgccaatcactgaattctcagacataaccagaagaacaccaaagaaaccattgacaagagctgaagtgggagaaaaaacagaggaaagaagagtagaaagggatattctgaaggaaatgttcccgtatgaagcctctactccaaccggaattagtgctagttgccgcagaccaatcaaaggtgctgccggccggccgctcgagctcagtgacttcaggatggaagaatcgttctcatctaagtacgtcccgaagtacgttcccttggcagacgtcaagtcggaaaagacaaagaagggacgctccgttcccatgtggataaaaatgctgctgtttgctctcgtggcgggttttttgtttttggtctatcaagctatggaaaccaaccaaggaaaccccttcactaattttcttcaagatactaaaatatccaactgaagaaatcatttcggcacatccgactcgatctcctgtttttaataactgtagaaaagcatctgtgtccacttgttggccgaagaactaaattgtgatttcacctcagtaaaggtagcgctgcgttggaaagcagacaggaagcttacctggatctcatttcaatgttttggactttggagatcacactgtgccatatgaataatttttttagctccagaacttttttgtaggctttatttttttaatgtggacatcttatttcacttttggggaaaatgcattgttttgtgtatttgaaaaataaggcaaaacatggtgatgtaatgtgaagctacacattaaatacttggaattcttacagaaaagatttatgacttattctctgctgagtaaaaatgttagaaatgtgaatggcgttcagtaagagaagcggtcacgagttgtgcttccttccatatgcagcggtttgtccgtggaaggtccagcaataagctcttctgggactcctgtcgtgcgtgtggtgtcgctggcgcacctgccacactgctcactagaatattttcatatcatgaaagtgctacgtcattaaagccctgagtacacttagttttccactgggatcttggagagcaacatagatacctgcttagggagcctttagctggctgcgcgcgtctaagagaccgagggctagctagaagctcccgttgggatcctgtgcttgtatttacggcaaagcatctatcccgtccatccagctcatcagactgttctgtaggtaaataagcatgggggtgtttgtttagagttagaaactaaacaccagtcccctccacttcagtccgattccattgtcgtcttttaaccaaaaaaaagttttcctggccagggatttttgttttgctttgttttagatggagttggggtgttgagatttttgtttgttttaggcatgtaattcctgatgtaatttgatttaaaagtataactgacttgcttttaaatcacatatatagtagctaatgcttaatttgtaatttcaaataaggtgggcattatggttctgtgtattcctgaagtgattaacgatatccttatggttgtcttttttagctgaaatttacctcatgtatggcttagatgatgttgcagtcgatttaaattttggtaaaaatcaagtacagcataaacatttttaactaaatcatttaagttgcaattttacagtcattgaccacaaagcacactaaaaatgtaaattatttttaataacatccggaatgtaaagacagttttaatttttacaaaggaggaagctgaatatgaatatctagaccagcacacaactttgacttaatgtttactgtgtttagcttatagatatgtcgtaggcatttgaagtaaacttctgccccagagaccagaacatggaccagaacatgtaggcctggtccgtgaggcgtgtggggagctgacttagatctgaagtgctttcctctcaaagacaagccacaaggggcatgttttactcaactttccctctctacagtgacagccatctttctttgttctcagacacagcttctcatattgctttcagtcatctgtttataattaaaaattgtgagaagccccatttgatgtttaaaaacaggggtgggggttaatctggcttcacatttctataaggtcgctctggatagggaagtgtggtccagtacagtgaaagtcggaccaggtaaaacatgccattttctttttaaaagcgtgtacttggtcttttgtctgtgtctgttttattccactagagtaaatgtgtccttgatgtaaatgcaaagcatttattaattcgtagatgtagactttacaatataattcaataataaagtaattaacctct

SEQ ID NO: 3168 - DNA, 2117 bp, Rattus norvegicus
  Genbank Accession No. NM_012891
aattccgcggcggctttggagatgcagtcggcccggatgaccccgagtgtggggcgacaactgctgcggctgggggcccgaagctcgcggtctgctgcgcttcagggacaaccccggcctacctctgcccagcgactttatgccagtgaggccactcaggcagttctggaaaagccagagaccctctcctctgatgcttccaccagagaaaaacctgccagggcggaatctaagtcttttgctgtgggaatgttcaaaggccagcttaccaccgaccaggtgttcccatacccatctgtgctcaatgaaggacagacacaatttctcaaagagctggtgggaccagtggcccggttctttgaagaagtgaatgaccctgccaagaatgactccttggagaaggtggaggaggacactttgcagggactcaaagaactgggggcatttggtctgcaagtacccagcgagctgggtggtttgggcctctctaatacccagtacgctcgcttggcagagattgtgggcatgcatgaccttggtgttagcgttaccctgggagcccatcagagcatcggtttcaaaggcatcttgctctatggcacaaaggcccagaaggaaaaatacctccccagagtggcatccgggcaggctttggcggctttctgcctgactgagccctcgagcgggtccgatgtggcctctatccgaagctcagctgtacctagcccctgtggaaagtattatactctcaacggaagcaagatctggatcagtaatgggggtctggcagacattttcactgtctttgccaaaacgccaattaaagatgcagccacgggggccgtgaaagagaagatcacagctttcgtagtggaacggagctttggaggggttacccatgggctccccgaaaagaagatgggcatcaaggcatctaacacatcagaggtgtactttgatggagtcaaggtgccagcagagaatgtgctaggagaagtgggagatggcttcaaggttgctgtcaacatcctcaacaacggaagatttgggatggctgcaaccctagcaggcaccatgaaagccatcattgccaaggcggttgatcatgctactaaccgtacccagtttggggacaaaattcacaactttggggtgatccaggaaaagctggctcggatggctattctgcagtatgtgactgagtccatggcttacatgctgagtgccaacatggaccagggattcaaagacttccagatagaagctgccatcagcaaaatctttggctcggaggcggcctggaaagtgacagatgagtgcatccagataatggggggcatgggcttcatgaaggaaccaggggtagagcgtgtgctccgagatattcgaatcttccggatctttgaagggacaaatgacattcttcgactgtttgtggctctacaaggctgcatggacaaaggaaaggaactcacgggacttggtaatgccctaaagaatcctcttggaaatgttggcctcctcataggagaagcaagcaaacagctgaggcggcggacagggattggcagtggtctgagtctctcgggaattgtccacccagagttgagtcgcagtggtgaactggcagtgcaggctctggaacaatttgccactgtagtggaggcgaagctgatgaagcacaagaaagggattgtcaatgaacagttcctgctgcagcgactggcagatggagccattgacctctacgccatggtggtggttctctccagagcctcaagatccctgagtgagggctacccgacagcacagcatgagaaaatgctctgtgatagttggtgcattgaggctgcaacacggattcgagaaaacatggccagccttcagtccaaccctcagcagcaggagctctttcgtaacttcagaagtatctccaaggccatggtggagaatggtggcctggtcaccagtaacccccttagagtctgaagactcctaatcaggccctagcacagtcgtgtgccttcttctatgccaaacacaggcccccttcatgggggcactggagtacttactgccttaaggacaataaattttctaccaaaaaaaaaaaaaaa

SEQ ID NO: 3169 - DNA, 1123 bp, Rattus norvegicus
  Genbank Accession No. NM_012895
gggattagagtcaagatggcagctgcggacgagccgaagcccaagaagctcaaggtggaagcgccagaagcgctgagtgaaaatgtgctgtttggaatggggaatcctcttcttgacatctctgctgtggtagacaaagatttccttgataagtattctctgaaaccaaacgaccagatcttggccgaagacaagcacaaggaattgtttgatgaacttgtaaaaaaattcaaagttgaatatcatgccggtgggtccacgcagaattcaatgaaagtggctcagtggatgattcaggagccacacagagcagcaacgttcttcggatgcattgggatagataagttcggggagatcctgaagagcaaagccgcagatgcacacgtggacgcccattactatgagcagaacgagcagcccacaggaacgtgcgctgcatgcatcaccggtggcaaccggtctcttgttgctaaccttgctgccgccaattgttataagaaagaaaagcaccttgatctggagaacaactggatgttggtagagaaagccagagtttactacatagctggcttctttctcaccgtctccccagagtcagtgttgaaagtggctcgctatgctgccgagaacaacaggaccttcactcttaacctgtccgcaccgttacttagccagttcttcaaggaagccttgatggaagtcatgccttatgttgacatcctctttggaaatgagacggaggctgccacttttgctagagagcaaggctttgagactaaagacattaaagaaatagccagaaagacgcaggctcttccaaaggtgaactcgaagaggcagaggaccgtgatcttcacccaagggagagatgacactatagtagctacaggaaatgatgtcactgctttccctgtcttggatcaaaaccaggaagagatcgttgacaccaatggagctggagatgcatttgtaggagggtttctgtctcagctggtctccaacaagcctctgactgaatgcatccgggccgggcactatgcagcgagcgtcatcattaggcgaactggctgtacttttcctgagaagccaaacttccactgacggaagaaaagcaactcaggca

SEQ ID NO: 3170 - DNA, 1800 bp, Rattus norvegicus
  Genbank Accession No. NM_012896
gaagccctgtctctgtctgcccagggaagtaagaacagcagcactcttggatttggctgcatagaactgtgtcctccaggttatcaggagggcagggctaagtggctgaggtctacgatcctgtcaaggaccttttctgagaaaagtctctaaaagagcatcacaccagaaggaataagcaagtcatgaattctccggactgttgctaccttctaacttctgggcagatgtctgtcaagagctaggtccactggcccatacacatcctgctgaagaagcaacagaagtttccagctgaagcttctctgagacagcatgaaagccaacaataccacgacgagtgccttgtggttgcaaatcacctacgtcaccatggaggctgccattggtctctgtgctgtagtgggcaacatgctggtcatctgggtggtcaagctgaaccgcactctgaggaccaccaccttctatttcatcgtctccctagcactggcagacattgctgttggggtgctggtcatacccttggccattgccgtcagcctggaggtccagatgcacttctatgcctgccttttcatgtcctgtgtgcttctggtcttcacccatgcttccatcatgtccttgctggccattgctgtagaccgatacctgcgagtcaagctgacagtcagatatagaacggttaccactcaaagaagaatatggctattcctgggcctctgctggctagtgtcctttctggtgggactgacccccatgtttggctggaatagaaaagtgaccttagagctctctcaaaacagctccaccctctcatgccacttccgtttcgtggtcggcttggattacatggtcttcttcagcttcatcacctggatcctcatccccctggttgtcatgtgcatcatctatctggacatcttctacatcatccgaaacaaactcagtcagaatctgactggcttcagagagacgcgtgcattttacggtcgggagttcaagaccgctaagtccctgtttctggttctcttcttgtttgccttgtgctggctgcctttgtccatcatcaattttgtttcctactttaatgtgaagataccagagattgcaatgtgcctgggcatcctgttgtcccatgcgaactccatgatgaaccctattgtctacgcctgcaaaaataaaaaagttcaaagaaaccactttgtgatcctcagagcttgcaggctctgtcagacctcggattctttggactcaaaccttgaacagactactgagtagttaccatgacagataaagagccagctcatttaccttcacagttcgcatcggtaaacactataaggacttaacagccattcttgcttacttccactgcagtgggatcatcgggctggttgccacagagctcccttccctcctccctccgctcctccctccactcctccctccgctcctcccttccctcctccctctgctcctccctccagtcttccctccactcctccctcccgccttcatgtattttcttgagcttctctcattcaattctgtggaggtctgacatgaaggcaatgcattcctggttaccacagacttcgcccttccttcccagacacaagaagtaatggagtgaatgttgagggagtctcctctcactaaagaagactctagtggggctggatgtacagaacctgcgttgaaggatccctaggatgttgggaacacagggagtgaattgaatttaaagagggctaaattcacctgtgtgggtgcatttgagcaaataaaagatggcgccca

SEQ ID NO: 3171 - DNA, 1490 bp, Rattus norvegicus
  Genbank Accession No. NM_012898
tctagctctccaagctgattatctgggctgcccctgacatttgtccatctcccagggcctctctggagcagccatgaagtccctggtcctgctcctttgttttgctcagctctggagctgccaatcagctccacaaggtgcagggctgggttttcgagaattggcttgtgatgacccggaaacagagcatgtagctttgatagccgtgcactacctcaataaacatcttcttcagggattcaggcagatcttgaatcagattgacaaagtcaaggtgtggtctcggcggcccttcggacaggtgtatgagttggaaattgacacgctggagacaacctgccacgctctggacccaacccccttagcaaattgttctgtgaggcaacaggccgagcatgcggtggagggagactgtgacttccacatcctgaaacaagatggccagttcagggtgctacacgcccagtgtcattccacaccagactctgcagaggacgttcggaagttttgcccacgatgcccaatcctgatccggttcaatgacaccaacgtggtccacactgtcaaaactgccctggctgccttcaatgcacagaataatggaacctattttaaactggtggagatttcccgagctcaaaatgtgcctttcccggtgtctactctcgtggagtttgtgatagctgcgactgactgtactggtcaggaggtcacagatccagccaaatgcaacctgctggcagaaaagcaatatggcttctgcaaggcgactctcatccacagacttggtggggaagaggtttcagtggcctgcaagttattccagacacagccccagccagccaatgccaaccctgcaggtcctgcacccacagtgggccaagctgcgcctgtagccccaccagctggcccacctgaatccgtggtggtaggacccgtggcagttcctctaggacttccagaccaccgaacccaccatgacctacggcatgccttctctcctgtggcttctgtggagtcggcctcaggagaagttcttcactcacctaaggtgggccagcctggtgacgctggtgctgctggcccagtggcccccctgtgcccagggagagtcagatacttcaagatctaggcttgactcagggaagtaaggttttggcaggcaggacatagccaccactgaagtagagggcttgtccactgaccaagcaagtaccacatcatagcttgaattcaggtctcttcattccccagagaaaaggggcagagaggtgatggttaaatttgttgaaagccagcagcagcaacactagcacttgtggggtgacagactactgtcatttgtttctttgccttctcactgacctcatacaaagcagttgcaagcgcgactgtgaaaggtgctctcaccaaacttcaatctacccataaataaaagtacccgaaggagctttcttaaacaagaaggttctgagccgagtgtggttgtg

SEQ ID NO: 3172 - DNA, 1116 bp, Rattus norvegicus
  Genbank Accession No. NM_012899
gcctagactccgtcttagcagactgctgtgttccgccggcccccaccatgcaccaccagtccgttctgcacagtggctactttcacccactgcttcgggcctggcagaccaccccctccaccgtcagtgccaccaacctcatctatcccatctttgtcacggatgttcctgatgatgtccagcccattgccagcctcccgggagtggccaggtatggcgtaaaccagctagaggagatgctgagacctctggtggaagccggccttcgctgtgtcctgatctttggcgtccccagcagagttcccaaggatgaacagggctctgcagctgactcagaggactccccaactattgaggctgtccgtctgctgaggaagaccttccctaccctcctagtggcctgtgatgtctgcctgtgcccctacacctcccatggccactgtggcctcctgagtgaaaatggagccttcctagcagaggaaagccgacaacggttggcagaggtggcactggcctatgccaaggcaggttgtcaggttgtagctccatcagacatgatggatggacgagttgaagccatcaaggctgccctgctaaaacatggacttggcaacagggtctctgtgatgagctatagtgccaaatttgcctcctgtttctatggtcctttccgggatgcagctcagtcaagcccagctttcggagaccgacgctgttatcagctgcctcctggagcccgtggcctggccctccgagcagtggcccgggacattcaagagggagctgacatactcatggtaaagccgggattaccctacctggatatggtgcaggaggtgaaggacaagcaccccgagctccccctcgcagtataccaggtgtccggagagtttgccatgttgtggcacggagccaaggctggggcctttgatctcaggactgctgtactggagtccatgacggccttccgcagagccggtgctgacattatcatcacctactttgcaccccagctgttgaagtggctgaaggaagagtgaaggaaagtgaaggacttggtcttgacagagctccctgggccttacagaagggaaaaagtaaaggcgctgttagaac

SEQ ID NO: 3173 - DNA, 1162 bp, Rattus norvegicus
  Genbank Accession No. NM_012901
gaattccggactgcagagccatgcagggtctcggggccctgttcttgttgctgactgcctgcctcactttgaaggctgacaatgtgccaacactgccagatatccaggttcaggagaacttcaatgaggcccggatctatggaaaatggttcaacctggcggtgggctccacctgcccgtggctgaggcggattaagaacaagatgagcgtgagcacactggtgctgcaggagggggcgacagaagccgagatcagcgtgaccagtactcaatggcggaaaggtgtctgcgaggagatctccggggtgtatcagaagacagacattgacggaaagttcctttaccacaaatccaaatggaatgcaaccttggaatcttatgtggtccacaccaactatgacgaatatgccattttccttaccaagaagttcagccaccgccacggacccaccatcactgccaagctctatggccgggaaccacagctgagggacagccttctgcaggagttcagggaggtggccctgagtgtgggcatccctgagaactccattgtttttatggccgacagaggagaatgtgtccctggggatcgggaggtagagtccacttcatttgcaagagcccggcgggcagtgctgccccaagagaatgaagggtcagggagtgagccactcataactgggaccctcaagaaagaagactcctgccagctgaactactcagaaggtccctgcctggggatgcagcagaagtattactacaatggcgcctccatggcctgcgagaccttccagtatggcggctgcctaggcaatggtaacaacttcgcctccgagaaggaatgcctgcagacgtgccggaccatagcggcctgcaatctccccatagtccaaggcccctgccgagcctttgcagaactctgggcatttgatgcagcgcaagggaagtgcatccaattcatctatgggggctgcaaaggcaacggcaacaagttctactctgagaaggagtgcaaggagtactgtggagtccctggtgatgggtacgaggagctaacacgcagttgaaggagccggtctgcaagccagagggtagccacggtccgtcactgagcagtccagcttagatgatctggacccaataaaacaaggcggaattc

SEQ ID NO: 3174 - DNA, 821 bp, Rattus norvegicus
  Genbank Accession No. NM_012907
aggaaggagtccagagacacagagagcaagatgagttccgagacaggccctgtagctgttgatcccactctgaggagaagaattgagccccacgagtttgaagtcttctttgacccccgggaacttcggaaagagacctgtctgctgtatgagatcaactggggaggaaggcacagcatctggcgacacacgagccaaaacaccaacaaacacgttgaagtcaatttcatagaaaaatttactacagaaagatacttttgtccaaacaccagatgctccattacctggttcctgtcctggagtccctgtggggagtgctccagggccattacagaatttttgagccgatacccccatgtaactctgtttatttatatagcacggctttatcaccacgcagatcctcgaaatcggcaaggactcagggaccttattagcagcggtgttactatccagatcatgacggagcaagagtctggctactgctggaggaattttgtcaactactccccttcgaatgaagctcattggccaaggtacccccatctgtgggtgaggctgtacgtactggaactctactgcatcattttaggacttccaccctgtttaaatattttaagaagaaaacaacctcaactcacgtttttcacgattgctcttcaaagctgccattaccaaaggctaccaccccacatcctgtgggccacagggttgaaatgacttctgggagttggggatggatgaaatgactccttgtatgtcttgacagcagcaattgattacccactaaagagcgactgccacaaggaatctagaagtcg

SEQ ID NO: 3175 - DNA, 1893 bp, Rattus norvegicus
  Genbank Accession No. NM_012912
tgtctcactcagcgagacgcgcggtgcacggtgcttccccggcggacgaccgaccaacccgcgctccggcagagtccttggcgctcgcctgccggcgggacagacagcccgcctctagccgctctctggaccctggccgccccgagcgaagactggagcaaaatgatgcttcaacatccaggccaggtctctgcctcagaagtcagcgcgaccgccatcgtcccctgcctctcacctcctgggtcactggtgtttgaggattttgctaacctgacaccttttgtcaaggaagagctgagattcgccatccagaacaagcacctttgccatcggatgtcctctgcgctggagtcagtcaccatcaacaacagacctctggagatgtcagtcaccaagtctgaggtggcccctgaagaagatgagagaaaaaggaggcggcgggaaagaaacaaaattgctgctgccaagtgtcgaaacaagaaaaaagagaagacagagtgcctgcagaaggagtcagagaaactggagagtgtgaatgccgaactgaaggcccagatcgaggagctgaagaatgagaagcagcatctgatttacatgctcaacctgcaccggcccacgtgtatcgtccgggctcagaacgggcggacgccggaagacgagaggaacctttttatccaacagataaaagaaggaacattgcagagctaagcagaggtggcatgggggcaattggggagtccttactgaatcctccttttccaccccaaaccctgaagccattggaaaactggcttcctgtgcacttctagaatctcagcagccacgagctgttgggtcaggagggcctgcggtgactactgcgttgtcccactctgtccccgagtgaaccgtggagcaggcaggagcatcctttgtctcaccggctccaggatttaggccttaccatcccggccattctcagatgacctagctggccccaggctggggtcccatgcaaagcaggatcgcactaatgggatgcaggcagaagtgtctaccttgacaggtggggtggaccacgtcctccactgcggctgacaacatccctcctagggaagatggagtgagaacattcatcattgaagttgtccaatggccagggtatgctttctagaaactatgctgttctgtcctagactgactgtgcatagggcattcatttctgagcctggtgttgtgctatttagatgtttgtcttgcacaacattggcgtgatttttttccgggagtttcatcagacctgatttccgagagtttgggggtctgccactgtggacaatatcccccaaaagtgtttgggtggccatgtaaactggctgatgaccagctgtgctactctgtgctgaccgaggactgatgcctccttcccctgtacccactgctgaggaagaacccgggcacagcagctgtccttggctacaaactgttacaatgtcacagaacgaaggcacaaagtcccgctttcaaagggcgtaggactccacactcagtgacagggcaggaagagccaaggattctccgttttcccttccttcccaccaaaaaccacagcccgtggagactggtatttgaagccaggagtggggcaaggaaggtgtctgcactgtgggatgttaactgcgcttttgtcttgaagctattttgagatgcggtccagagtatttcagctgggaggtccctcccactggccaccagggctctggctactgttaaaattctgatgtttctgtgaaatcctcagtgttcaatccagactcagtagtatattacagttttctgtaagagagaacgttacttatttatcccagtattcctagcctgtcaacgtaataaaatatcagaatgagacctggt

SEQ ID NO: 3176 - DNA, 1818 bp, Rattus norvegicus
  Genbank Accession No. NM_012913
ctcctaacggagagttgttcccggccgtgcggtcctccgtcgccgtcgctgggctgcgccgccgctgtcgccaggacgcgccgccgagcccctcgtcgcctctagccccgcggcctccgttcacctcaacttccactcgcccatcatgacgaagactgagaagaaatccttccaccagagcctggccgagtggaagctgttcatctacaacccgaccagcggagagtttctggggcgcacctccaagagctggggtctcatcttgctcttctacctagttttttatgggttcttggctgcactcttcacattcaccatgtgggtcatgctccagactctgaatgacgaggttccgaagtaccgagaccagattcctagtccaggacttatggttttccccaaaccaccgactgccttggattatacatacagcatgtctgacccacatacttataaaaagtttgttgaagacctgaagaatttcctaaagccatattctgtggaagaacagaagaatctcacagattgccctggtggagcactttttcatcaggagggtccagactatagtgcgtgtcagttcccagtttccttgcttcaagaatgtagtggtgtgaatgattctaattttggctactccaaaggacaaccttgtgttcttgtgaagatgaacagaataatcgagttagtcccagatggagctccatatattacatgtataacaaaggaagaaaacatagcaaatatagtaacttatcctgatgatggacttatagacttaaagtattttccatattatgggaaaaaacggcacgttggatatcgacagcccctagttgccgtccaggtcatatttggggccgatgctaccaagaaagaagtaacaattgagtgccaaattgatggaaccaggaacctaaaaaacaagaatgaacgtgacaagttcttgggacgagtttcatttaaagtcatagcacatgcctaggagtaggctgtctgcacagagtaaatgttgtgttgtctccattctgtatcagctggacctgccattctaggatatgaggccacctgggaggaggaagtggtatgggacacacttgggtgacatcataacatgcttccagatcatagtgttcagtgtcctctgaagtaactgcctgctgcctctgctgcccttgaacccatgtacggtcgccagacagggaccagtgagctcccaatcccaaacatgcagagtgggggtctcgtcgtcttctgtgtgtaattgccaaatgtctaaagcttcatgtgctgtgctgtgtaaatattttatggatttaacactggtaactgtcatattttgatgccaagaaagttttagggaaaaaatggtaccttgccaacatcaagtgactttagctgaagaaatgtgtgagaagttctgtatgtgatgaaggagaaagggaaataaagtggatctgaaagtactgaccctggttctgcgtacgtgtgagtgagtgcctgtcgtatgctctagtggtttttacatgctgaactagactatagctgactgtactgagaggacagactttctgttgtaatacatatttaaaatactatcggggtgactgagtgtggaatcaagcttccacactcaggtgtcgtagacacatggaagaaacagtgttttaattaggtgaatgagtaccgatgtttttgctttgttttgttttttgaatgaaatgaaattcccaagacataaattgtatagtttttcaaaatgtcttaagtgcttttatttagtagactatggaccctaataaaaaaaatgtgaaatac

SEQ ID NO: 3177 - DNA, 4472 bp, Rattus norvegicus
  Genbank Accession No. NM_012914
actgccgtcggggaaggtcccagcgcggtcatggcctcccagggcggccgccccgcctcaagttcgcagcattctgcacagtagcccggaggagaagcggcctggacgtcgcggccggccggggaagcagcatggaggaggcgcacctgctctcggctgccgacgtgctgcgtcgcttctcggtgacagccgagggcggcttgaccctggagcaggtgaccgacgcccgggagcgatacggccccaacgaactccctactgaggaagggaaatccctgtgggagctggtggtggagcagtttgaggacctcttggtgcgcatcctgctgctggcagccctggtttcctttgtcctggcctggtttgaggagggtgaggagaccacgacggccttcgtggagcccctcgtcatcatgttaatccttgtggccaatgcgatcgtgggagtgtggcaggaacgcaatgctgagagtgccattgaggccttgaaggagtatgagcctgagatgggtaaggtgatccgctctgaccgcaagggtgtgcagaggatccgagccagggacatcgtccctggggacattgtggaagtggcagtgggagacaaggtacctgctgacctccgcctcatcgagatcaagtccaccacacttcgagtggaccagtccatcctgacaggggaatccgtgtctgtgactaagcacacagatgccattccagacccccgagccgtgaaccaggacaagaagaacatgctgttttctggcaccaatattgcatcaggcaaagccctgggtgtggctgtggccacaggcttgcacacagagctgggcaagattcggagccagatggcggctgtggagcctgagcggacgccactgcagcgcaagctggatgaatttgggaggcagctgtcccatgccatctctgtgatctgtgtggctgtgtgggtcatcaacatcggacactttgctgacccggcccatggtggatcctggctccgtggggcagtctactacttcaagattgctgtggccctggctgtggctgctatccccgagggcctcccagcagtcatcactacatgcctagcactgggcacaagacgtatggcacgtaagaacgccattgtgcggagcctgccctctgtggagaccctgggctgcacctcagtcatctgctctgacaagacagggacactcaccaccaatcaaatgtctgtctgcaggatgttcgtggtagctgaagcagaggcaggcgcctgtcgtttacacgaattcaccatttcgggtaccacgtataccccagagggcgaagtgaggcaaggggaacagcttgtgcgctgtgggcagtttgatggacttgtggagctcgcaaccatctgtgcactctgcaatgattctgcactggactacaatgaggccaagggtgtgtatgagaaggtaggagaggccacagagacagccctcacttgcctggtagagaagatgaacgtgtttgacacagacctgaaaggactgtcgcgggtcgagcgcgctggtgcctgcaattccgtcatcaagcaactcatgcagaaggagttcaccctcgaattctcccgggaccggaagtccatgtctgtgtactgcacacccactcgtgctgaccccaaggcccagggcagcaagatgtttgtgaagggagctcctgagagtgtaattgagcgctgcagctcagtccgcgtgggaagccgaacagtacccctaagcgccacctccagagagcatatcctggccaagatccgagactggggctcaggctctcatacattgcgctgcttagcactggccaccagggacacacccccaaggaaggaggacatgcaactggatgactgcagtcagtttgtacagtacgagacaggcctgaccttcgtgggctgcgtgggcatgttagacccaccgagaccagaggtggctgcctgtatcacacgctgttctcgggcgggcattcgagtggtcatgatcacaggggacaacaaagggacagctgtggccatctgccgccgacttggcatctttggggatacggaggatgtgttgggcaaggcttacacgggccgagaattcgatgacctcagcccagagcagcagcgccaggcttgccgtaccgcccgatgctttgcccgtgtggaacccgcacataagtctcgcatcgtggagaacctccagtcctttaatgagatcaccgccatgactggcgatggggtgaatgatgcaccagccctgaagaaggcagagatcggcatcgccatgggctcaggcactgctgtggccaagtcggcagcggagatggttctgtctgatgacaactttgcctccattgtggctgcagtggaggagggcagggccatctacaacaacatgaagcaattcatccgctacctcatctcctccaatgttggcgaggttgtctgcatcttcctcacagcaattctgggcctgcccgaagccctgatccctgtgcagctgctctgggtgaacctggtaacagatggcttacctgccacagcccttggcttcaacccacccgatctggacatcatggaaaagctgcctcggaacccccgggaggctctcatcagcggctggctttttttccgctatttggctattggagtgtacgtaggcctggctacagtggctgccgccacctggtggttcctgtatgacgctgagggaccacaagtcaccttccatcagctgaggaacttcctgaagtgctctgaagacaatccactgtttgccggcatcgactgcgaggtctttgagtcacgcttccccacgaccatggccttatctgtgcttgtgaccattgaaatgtgcaacgcccttaacagcgtctcagagaaccagtcactgctgcgtatgccaccctggctgaacccttggctgctgggggctgtggtcatgtccatggccctgcattttctcatccttttggtgccgcctctgcccctcattttccaggtgaccccactgagtggtcgacagtggggggtggtgcttcagatgtctctgcctgtcatcctgcttgacgaggccctcaagtatctgtccaggcatcacgtggatgaaaaaaaggacctgaagtaaatcctgagagcagaggggggtctccagttcggccctcggactcatcatgtccaagcacttgtcctggtcccacccctgcctcctcactcagccacctgtctcctgctgaacgtaacaggcctgaaacaacaccggccatttctaggccctgttccagggtcctgtctccattcctgtcctccctacagctctggcccagaagttgagcccaggaggggaagctgagaagccagagctgcctgaagggccaccacccatttcccccacagatctgcagccttcccctgctcggaggtgggcatttgcttggtagctagtgcctctgccctgatggagggctcatgggggccgtcttactgactctgacctcttgcttagtttgggtctggagcctggtcagctctgggaaggaggagtccgaggggaccatctgggtccagctgtgaacatgaggggcagccccttccacttggctcagcttccaccaagtccactcctgtgtctgtttatgtatctgctggccccagggagttgaaggatcacagacagataggaacataaggagcagcgggggcaggcctggacaaggactcctttcccaggagtcagcctccactggctggctgggctcagcactagtcccaccttgaggctcacttcctcggctcaggttggctcagggatcctaactttacagtccatgcccctggtgcctgagactccaggcatccctgggtccatgtcagcttctcctgccacgaagcctggggtgataccgtgtcacttgctgcagggctgggtgattctaaacctcctggacccctggcattactctttgccctcttttcctatcatgcatgtctgagtcagagagatgtcactaggaagtgactccacaatcctcccctacctccccactgaaaggaagcatctgatgggggtctatcagatgaatgtgtattggtctttgggatcttttttgcctcttaaccctgctgttgctcctttgacaaaagctagctaagcatcatgggaaacggagaaagcgcctgtcagtgtgacttagctcttccctgactgtgtataatatgattattttatatgtaaatcaaggttcacatcactgtcctgacacctggtagcaaaagtcccctcagcctacccagaagacagatgaactccatgtatacctgcccactctcctgcccatcctccctcccctctggcaggttctggaggggcctcagagagaaaccgagtttggagggatggcttggcaggaacagagccctgtgcccacttgctgatcatttcttgtggagaaataaaggcgtgcgtctg

SEQ ID NO: 3178 - DNA, 833 bp, Rattus norvegicus
  Genbank Accession No. NM_012915
gaattccaaaatatgtaaggctttcaatttattacagatcacccaagaacataatgatatacatgtagtcagaaaacacgatgtagaaatcatagtgagttgtccagacatggtcagtagattattctttctggcatgctccagtgtcaacactcaataaagagcactaaaatccttccatacaattaagtatcagcgatgtaccatattgcagaaaggggtggctgagcaacagtttgttgatactataagacttccatgctcaacagtcgtagcgttgcactcagcacagctctggtttccatatacaaattttccatctcgagtggttactacaacccaggcacaaatctcatcaggataagtctgacatttctgtcttccaacatgacaaaatcctgtagaatcgaagctagtacgctcggtgtctggggtatgagggtcctgcaaacccgaggcttcggctcggactcgtcggagagcatggattcgggcgctggctccatccgagaagctggtggggccttcgggaaacgagagaaggctgaagaggatcggtacttccgagagaagactagagagcagctggctgccttgaagaagcaccatgaagatgagattgaccaccattcgaaggagatagagcgtctgcaaaaacagatcgaacggcataagaagaagattaaatacctaaagaatagtgagcattgagtgcacacagtcagtctctcacagagtggccagtatcattccccacttctatagagattgttttgaatgattgatgtttgacctgtgtgctactaacagataataaattatcaccggaattc

SEQ ID NO: 3179 - DNA, 1249 bp, Rattus norvegicus
  Genbank Accession No. NM_012922
ggaacggtacgcgaagaaaagtgaccatggacaacaacgaaacctccgtggattcaaaatccattaataattttgaaacaaagactatccatggaagcaagtcgatggactctggaatatatctggacagcagttacaaaatggattaccctgaaatgggcttgtgtataataattaataataagaacttccataaaagcactggaatgtcagctcgcaatggtaccgatgtcgatgcagctaacctcagagagacattcatggccctgaaatacgaagtcaggaataaaaatgaccttactcgtgaagaaattatggaattgatggatagtgtttctaaggaagatcacagcaaaaggagcagttttgtgtgtgtgattctaagtcatggagatgaaggagtaatttttggaacgaacggacctgtggacctgaaaaaactaactagtttcttcagaggcgactactgccggagtctgactggaaagccgaaactcttcatcattcaggcctgccgaggtacagagctggactgcggtattgagacagacagtggaactgacgatgatatggcatgccagaagataccagtggaggccgacttcctgtatgcttactctaccgcacccggttactattcctggagaaattcaagggacgggtcatggttcatccagtcactttgcgccatgctgaaactgtacgcgcacaagctggaattcatgcacatcctcactcgtgttaaccggaaggtggccacggaatttgagtccttctccctggacgccactttccatgcaaagaaacagatcccgtgtattgtgtcaatgctcacaaaagaactgtacttttatcactaaaggaatgactgggagtggggtaggggcatgtttctgttttggttttttttttggtttttgttttttgtttttttttttttatttgaatgccaaatgagaaaactgtcagggagactttttttttcccctctcatttaaatcaaatccgatgttccaggtcgtcattgaacaataccactgcctgcaatgcagccacaatacaatacctcagctttgatatcaggtagttgaaatgaaatttaattaggaacaaataaatgtcaataatggtacaaccatcatagaagaaattggaaagtcacactttggtaattagagagatttggtgccactatgaatttgaaattacgaagcagtgatgatcttatacccccccctgtagcggccgc

SEQ ID NO: 3180 - DNA, 3169 bp, Rattus norvegicus
  Genbank Accession No. NM_012923
ccgcacgctgaaccggaggaactgcgcctagtcggggcgctgagggaccctccaccgggacgccggcccctccccgggcctctgctcacttgcccccctgcgagcccgtccccctagtcggcctctcggatcggggacgtggggcgagctgagagcaggcccggggtgggtggtcactgtggagaagacgtggctgtcaagatgatagaagtactgacaactgactctcagaaactgctacaccagctgaacaccctgttggaacaggagtccagatgtcagccaaaggtctgtggcctgaaactgattgagtctgcacatgataatggcctcaggatgactgcaagactccgggactttgaagtcaaagatctactgagtctaactcagttctttggcttcgacacagaaacattttcccttgctgtgaatttactggacagattcttgtctaaaatgaaggtacaggcgaagcatctcggctgtgtcggactgagctgcttttatttggctgtgaaatcgattgaagaggaaaggaacgtcccgctggcaactgatttgatccggataagtcagtataggttcacagtttcagacctgatgagaatggaaaagattgtgttggagaaagtgtgctggaaagtcaaagctactactgccttccaatttctgcagctctattactccctcattcgggagaccttgccatttgaaaggagaaacgatctgaattttgaaagactagaagcccaactgaaggcgtgccactgcaggatcatattttctaaggcaaagccttctgtgctggcgctggcaatcatcgctttggagatccaagcactgaagtatgtggagttaacagaaggagtagaatgtattcagaaacattccaagataagtggccgagatctgaccttctggcaagagcttgtttccaagtgtttaactgaatattcatcaaacaagtgttccaagccgaacggtcagaagttaaaatggatcgtgtctgggcgcactgcacgacaactgaagcacagttattacaggataacccacctcccaacaattcccgaaaccatgggttagttggcaaatctggttgttatcctctgtgtacagaacatttcccagtgagatcgtttttgtgctataacttaaggattgaaatactaccttcaatataaagaatacaggatgaaaacagtaaaggaaacgtgagtttgttggtctagacagagaatactgggaggcattcactgtgtaccgcagtctgaagagaaatgagtatcaaacctctagacacatgctcatactgctgtcaaaggactagcgtagaaaagagagtcctccaaaccggaagtttaaatgtagttactaaaatagcacttcttataacttacatatccccccactgtggcttatttaaagttacagaagtccaagcagaacgacaaaagatgtgacccatatatgaacacattttaatctgttcattgattaggagagtgaatatgaacttgcatgatgcccatgttaggtttctggaaactgccggggtatcttaattctctagtattctccctctgtggcagttgggctaatacaaagtaactatacgcatgagaatataaaatcagtctctgatacatacacatttttaccatcaaaatttcttaatcatagcaaagacttacctttttatgattaggaattttttttttaatgtatggcagcacatgcctttaatcccaacactagggaggcagaggcaggtggatctctttgagttcgaagccaggctggtctttacagtgagttccaggacagctggagagctacagaatggagagacgctgtctcaaaaacactcaaaacaaacaaacaaaccataccagtttgtaggcagacttctgttgggttgggtttgtactgtttgcctatgcagtgggattacagcagcagcaacaaaaactgtccctgaagtctttctctgccactgtgacctgagtttcctatggtacgcgatttactctaggaaacctcagcccctcaccacgttagctgttggcaaatggcctcacagttgcggaaagtcccaattctaggcttgggaaagcaatgcttagatttgaattggcccatgaagcattcaaatcaaggctaaagacataaatgtgaaataaaactgtgaaccttcattttaacattgatctcacttcccagatttaatcaatatatacttaggtggtattaaaaatggtaaactgcctaatttaaatctcaaaatttaaactatgaggtttacatcaaagccaacatttcacaaatgtactttttaaggtattaaaagaggtatttaagcagtaaatggtttcttggcacccataaccaagtaatagttaagttagaggtgggacttttttattgctatgagaattacatttaaacttttgggtgttttataaaaagcagatttcacaagttttgaaaattgtgacctttactgaaatttgttacctttaatatttcttctagaggataggtatttataaaagaaaaattcgtcagaattgctgcctcaatctagtcccatttgagaaaatttgtttctactgtctcaataactggatgaaatatcactctgaaaacttgcctattgcactaaagctagtttaggcttgataaaacactccaggaggtttttaccacagactgtttctattaaaactgctgcttctcatgtacaattttgttttaaaaggaaccgagtacatctgcaaaacctaagtcttaagggacgtcaggaggtaccttcagaattataggatcaccatggtagtggggattctccatgctggccttgaatgtttgatcttcactgctgaaatgtgggtagctcctcagcgccctgtagagcctgagtctacctagaatagctgtaaccattttgacaagtaatggataagaaaattatccattgagaagctaaaaacaaaacaaaacaaaaccaaagaacgggtgtattttattcttaacctttgtaaaccatcactgagaacacttcagttcttcctaacagctgttatgcttcgatttgaaaaaaatactgagtggataaccaactaccatcatgctttgggtacacctttcaataaaattactgaaatgc

SEQ ID NO: 3181 - DNA, 1523 bp, Rattus norvegicus
  Genbank Accession No. NM_012925
ggcacgagggagcccgaaactggcgcaggcaagaagaacctctagcacagatctagctgactgcgaggttgcagatttggtggaccagcacaatgagagctcggaggggattcatcttactcctgcttctggctgtcctctgttccacaggtgttagcctcagatgctacaactgtttagacccggtttcttcatgcaaaacaaacagcacttgctctcctaacctggatgcttgtcttgttgctgtatccggaaagcaagtctatcaacagtgttggagattttcggattgtaatgccaagttcattttgagccgactagaaatcgcaaacgtacaatacagatgctgccaggcggacttgtgtaacaaaagcttcgaagacaagccaaacaatggggcaatctccctattggggaagacagcgttgctggtgacctcggttctggcggccattttgaagccttgtttctaaatcatctctaagctcccgatgcctcctttcttttttccttctttttcttcttcttcagcactctaaagcctttattattttccaacttatattcgtttaggaaacaatatagttcacttgaaatcttggataagagggagggttgtaagcagcacggaagagcaccgaagagcaccgtgcacatagggaaggcccacctgcaggtacagagtgaagtgcgtgggtaaaacactaacaggttatgtaatcttcctttgtcacttcggagggctggctttcagtttcagcttaagtgggtttccggcaaccctcagggatatctctttggttcccggaatgtagctgaggagtgaggtcagaaagtacctttaagtgagtggaccaggaggattctcttcattactctgacacactcaaaacgctttcataacttttacaggtcctgagctggtgtgcaaatgttccatatgtgagctgtcagtcaggggcgctgattgttcatttgctttaaaacaacaaaaacaaaaacaacaacaaaacagttctgggaatgaaacccagtgcattgagcatgtaggcaagtgctttacccataagccccagctccagctccagcagcgaatgaagcagctgcattttcagctagaaaacatagggatttgacctacatttcaacaagacctctgaaccagatgtgatgatgcttgcttagtatgtttagcatctcagtgctctggaggcagagacaggaggagggccataagttgaaggccagcctgaccttcacagtggtctccaagtcacctaaaactatatagtaagaccttgcctcaaatgaaaaacaaaatggcgagtggtggtgcatgcctttaataccagcacttgggagtagaagcaggtgcatctccgtaggtcaaagccagccagttcccggacagccaaggctatacagagaaagcctgtctatacatacatacatacatacatacatacatacatacatacatacatagaaaagaaaaacctcaaaacaacaataacaacaaaaca

SEQ ID NO: 3182 - DNA, 2296 bp, Rattus norvegicus
  Genbank Accession No. NM_012930
cctgcttgctcaggaactccctcagccgccgcgttctctagccgccgttgctgcccgggacgatgatgccgcgcctgctgtttcgtgcctggccccgctgcccctcgcttgtcctgggagcccctagtaggcccttaagtgctgtctcggggccggacgattatctgcagcacagcatcgtgcccaccatgcactaccaggacagcctgcccaggctgcctatccctaaacttgaagacaccatgaagagatacctcaatgcacagaagcctctcttggatgacagccagttcaggagaacagaagcgttgtgtaagaattttgagactggcgttgggaaggagctgcatgcccacctgcttgctcaggataagcagaataagcacaccagctacatctcaggcccctggttcgatatgtatttaactgctcgagactctatcgttttaaactttaatccatttatggcattcaatccggacccaaagtctgagtataatgaccagcttaccagggcaaccaacttgactgtttctgcagtccggtttctgaagacacttcaggctggccttttagaaccagaagtgttccacttgaacccttccaaaagtgacacagacgccttcaaaagactcattcgctttgttcctccctctctgtcctggtatggagcctacctggtcaacgcatatcccctggatatgtcccagtatttccggcttttcaattcaactcgtatacccagacccaatcgtgatgaactctttactgacaccaaggctagacacctcctggtcctaagaaaaggacatttctatgtctttgatgtcctcgatcaagatgggaacattgtgaatcccttagagattcaggcacatctaaagtacattctctcagacagcagccctgtgcccgagtttcctgtggcatatctgaccagtgagaaccgagatgtctgggcagagctcagacagaagttgatttttgatggcaatgaggaaaccctgaagaaagtggactctgctgtcttctgcctctgcctagatgacttcccgatgaaggatcttattcacttgtcacacaccatgctgcacggcgatggcacaaaccgctggtttgataagtcctttaacctcattgtagccgaggacggcactgctgcagtccacttcgagcactcgtggggggatggggtggcagtgcttaggtttttcaatgaagtgttcagagacagcactcagacccctgccatcactccccagagccagcctgccgccaccaactcctctgcgtctgtggagacgctcagcttcaacctcagcggtgctctcaaggctggcatcactgctgccaaggagaagttcgacaccacggtgaaaaccctcagcattgactccattcagttccagagaggtggcaaggagttcctgaagaagaagcagctgagccccgatgcggtggcccagctggccttccagatggccttcctgagacagtatggccagacggtggctacctatgagtcctgcagcactgcagccttcaagcacggccgcacagagactatccgcccagcctccatctttactaagagatgctccgaggcgtttgtcagggacccctccaagcacagtgtgggcgagcttcagcacatgatggctgagtgttccaaataccatggccagctgaccaaagaagcagcgatgggccagggctttgaccgacacttgtatgctctgcgctatctggcaacggccagaggactcaacctacctgagctctatctggatcctgcataccagcagatgaaccacaacatcctgtccaccagcactctgaacagcccagcagtgagccttgggggctttgcccctgtggtccctgatggctttggcattgcatatgctgttcacgatgactggataggctgcaatgtctcctcctactcaggacgcaatgcccgagagtttctccactgtgtccagaagtgcttggaagacattttcgatgctctagaaggcaaagccatcaaaacttagcttcctagtcgctgaaaagcctccattcttcctcatgaacatggatgttcatgtagctggaaggtgccatcttgtgcccaacaaaactaatcccaaggtgcttccacagccagtgctgcaggctgagctggaagagcccaactgaaggtagtgagaggtcgcagctgtaaagccctctttgttcaggagatagggtttggaaaactaactcagctgtatttattgtttaaatagaaataaaacctggtgttgcttag

SEQ ID NO: 3183 - DNA, 3335 bp, Rattus norvegicus
  Genbank Accession No. NM_012931
gtacgcgggtagcacggcctctggccgtggagcaccatgaagtacctggtgagtgtgggcgcggggccggccaggcgggcgggcggtctggaggacgtttcctgggggccccgagtgtcccgccggccgcagagttaccgggcagctcggcacgtaaacgagtccctccctcggtccgcctttcgagtccccgcagctcacggagctagcgtgacgccctccgcagcccttgggtccgggttgcctgagactcagcccgaggcggtatgcagagggactgagaaaccgagatttgctgagggctgcaaaccggcggcgagccgcgacaagaacgtgctggccaaagccctctatgacaacgtagctgagtctccggatgaactctccttccgaaagggtgacatcatgacagtgctcgagcgggacactcagggcctggatggctggtggctctgctcactgcatgggcgccagggcattgtgcctggtaaccgcctcaagattctggttggcatgtatgacaagaagccagcagcacctggaccaggcccacctgccaccccaccccagccccagcccagccttccccagggcgtccatactccagtgcctccagcttcccagtacagtcccatgctccccactgcataccaaccccaacctgacaatgtgtacctggtacccactcccagcaagactcagcaaggtctctaccaagcccctgggcccaacccacagttccagtcacccccagccaaacaaacatccacattctcaaagcaaacacctcatcactcatttcccagccctgccacagacctttaccaggtgcctccagggcctggaagtccagcccaggacatttaccaggtgccaccttccgctggcacagggcatgacatctaccaagtccctccatctttggacacccgcagctgggagggaacgaagccaccggcaaaggtggtggtacctactcgagtgggacagggctatgtgtacgaggcctcccaggcagaacaggatgagtacgacaccccgcgccacctgctagctccaggttcccaggacatctatgatgtgccccctgttcgaggactgcttcccaaccagtatggccaggaggtatatgacaccccgcctatggcagtcaaaggccccaatggccgagacccgttgttggatgtgtatgacgtgccccctagtgtggagaaaggcctgccgccgtccaaccatcattcggtgtatgatgttcctccttctgtgagcaaggatgtgcctgatggcccactgctgcgtgaggaaacatatgatgtaccccctgccttcgccaaacccaagccttttgatccgacccgacatccattaatcctcgctgcacctcctccggactccccaccagctgaggatgtgtatgatgtgccaccccctgctcctgacctctatgatgtgccccctggtttgcggcggcctggccctggaacactgtatgacgtgcctcgagagcgggtgctccctcctgaggtggctgatgggagtgtaattgatgatggtgtgtatgctgtgcccccaccagccgagcgagaggcgccaacagatggcaagcgcctgtcggcctctagcacgggcagcacacgcagcagccaatcggcgtcttccttggaggtagtggtgccaggtcgggagcccctggagctggaagttgctgtggagaccctggctcggctacagcagggtgtgagcaccaccgtagcccaccttctggacctggtgggcagtgccagtggccccgggggctggcgtagtacctctgagccccaggagcctcccgtgcaggacctgaaagctgcagtggccgcagttcatggggcagtacatgagctcctggagtttgcccgcagtgcagtgagcagtgccactcacacttctgaccgcactttgcacgccaagcttagccggcagctacagaagatggaggatgtgtaccagacactggtggtccatggtcaggtccttgacagtggccggggaggtccaggattcactctggacgacctggaccgcctggtggcctgctcacgggctgtgcccgaggatgccaagcagctggcctcctttttgcatggtaatgcctcgctgcttttcagacggaccaaagcccctggccccgggcctgagggcagcagctccctgcacctcaaccccaccgataaagccagcagcatccagtcacgccctctaccctcacctccaaagttcacctcccaggactctccggatggccagtatgagaacagtgaagggggttggatggaggactatgactacgttcatctgcaggggaaggaggaatttgagaagacccagaaggaactgctggaaaagggcaacatcgtgcgacagggaaaaggccaactggagctgcagcagctgaaacagtttgagcgactggagcaggaggtgtctcgtcccatagaccatgacctggccaactggacaccagcccagccccttgtgccggggcggacagggggactggggccttcagaccgacagctgctgctcttctacttggagcagtgtgaggccaacctgaccacactgacagatgcggtggacgccttcttcaccgcagtggccaccaaccagccacccaagatctttgtggcacacagcaagtttgtcattcttagtgcacacaagcttgtgttcattggggacacactgtcacggcaggcaaaggcagctgatgtgcgaagcaaagtgacccactacagcaatctgctgtgtgacctcctgcgtggcatcgtggccaccaccaaggccgctgccctgcagtacccatccccatctgctgcccaggacatggtagacagggtcaaggagctaggccacagcactcagcagttccgccgtgtcctgggccagctggctgccgcctgaaagcagaagactgggctgtgaggctggggagtgggtagcggtggtgtgagctacccaggcgctcgtcttgaagtggagatcctgcaggtttggggacaggtaaccccagctctgctttgggcctggtgccctcaactgtccagggatttgtacatatttatatcaaggcaggatgcagaatgcctcctcggagaggctgaggagccccgtcagagtggaccatgggctgggatcaccagggttggggcacatgggctccagtccacagggctccctgggacaggaagtacagtgtggtgtacacctctgcaccaagaaaacctaaagaactatttttcactattgatttttttccaatcatttgactaatagtctacatttaataaaatttt

SEQ ID NO: 3184 - DNA, 528 bp, Rattus norvegicus
  Genbank Accession No. NM_012935
atggacatagccatccaccacccctggatccggcgtcccttctttcctttccactccccaagccgcctctttgaccagttcttcggagagcacctgttggagtctgacctcttctctacagccacttccctgagccccttctaccttcggccaccctccttcctgcgggcacctagctggattgacactgggctctcagagatgcgtatggagaaggacaggttctctgtgaacctggacgtgaagcacttctctccagaggaactcaaagtcaaggttctgggagacgtgattgaggtgcacggcaagcacgaagagcgccaggacgaacatggcttcatctccagggagttccacaggaagtaccggatcccagccgacgtggatcctctcaccattacttcttccctgtcatcggatggagtcctcactgtgaatggaccaaggaaacaggcctctggccctgagcgcaccattcccatcacccgtgaagagaagcctgctgtcactgcagcccctaagaagtag

SEQ ID NO: 3185 - DNA, 1362 bp, Rattus norvegicus
  Genbank Accession No. NM_012939
gcgatgtggactgcgctgcccctgctgtgcgctggggcctggctgctgagtgctggggccaccgctgagctgaccgtgaatgccatagaaaagtttcactttacgtcatggatgaaacagcatcaaaagacgtacagctcgagggagtacagccacaggctgcaggtgtttgccaacaactggaggaagattcaagcccacaaccagaggaaccacacatttaaaatgggattgaaccagttttcagatatgagctttgccgaaataaaacacaaatacctctggtcagagcctcagaattgctcagccaccaaaagtaactacctccgtggtactggcccctacccatcctccatggactggaggaagaaaggaaatgtcgtttcaccagtgaagaaccagggggcctgtggcagctgctggactttctcaaccactggggccctagagtcagctgtggctattgccagtgggaaaatgatgaccttggctgagcagcagctggtggattgtgcccagaacttcaacaatcatggctgccaaggaggtctccccagccaggccttcgagtacatcctgtacaacaagggcatcatgggagaggacagctacccttacataggcaagaatggtcagtgcaaattcaacccagaaaaggccgtcgcgttcgtcaagaatgttgtcaacatcacactcaatgatgaggctgcaatggtagaggctgtggccctatacaatcctgtgagctttgcctttgaggtgactgaagattttatgatgtataaaagtggtgtctactccagtaactcctgtcataaaactccagataaagtaaaccatgcagtcctggctgttggctatggagaacagaatggattactctactggattgtgaaaaactcttggggctccaactgggggaacaatgggtacttcctcattgagcgtggaaagaacatgtgtggcctggctgcctgtgcctcctaccccatccctcaggtataagccacggctgcacaggccaactgcttggcagacaaagggaggaactggtcctacgatgagaatgccgccctggagaaagttgttcagaaatccacccagaggccctctcactcctgagtctagacgcctaaagacaagtaaggaagaacttgaccagcaacaagcccgcccatgtgacgacatcaccagccatacgctttgtttgaatatggtttttaaatgacccaaaaccatgtggacctagaatcttctcttttcagctctcttcatatagggaaagctccgatggcttaccttttctatgttgtatattcaataaatgcagtgaacgcctgcctgggctgggcctagacccct

SEQ ID NO: 3186 - DNA, 4964 bp, Rattus norvegicus
  Genbank Accession No. NM_012940
gttgcagacacctctgcgacgccagcttgaaagccgccggcgggctgggatttagctccactttatcaactcccaacccctcacccatctcaaccgcaactccaactctgtgagaaagtcctgactttgcggagccccaggtgcactggagctcagcaaacttgagacacttcccccctgtcctccatcctaatctaagtttaggttctgactgagccaagagtgggtgctaaagcagcgggcctcaggtgtctaggactccgggtccttggggactctcaggttgaagtcttgcagagtctgggcagaggctccagagcttctcccagaccccactgctctacaccgctggaaccgcgcttcatcgcagcatggccaccagccttagtgcagacagtccacagcagctgagctcgctgtctacccaacagaccattcttctgctactcgtttcggtcctggccatcgtgcacttaggccagtggctgctgcgccagtggcgacggaaaccgtggtcctcgcccccgggtccctttccttggccattgatcggaaacgcggcgtctgttggccgggcatcgcacttgtacttcgctcgccttgcgaggcgctatggcgacgtttttcagatccgtctgggcagctgtcccgtggtggtgctgaatggcgagagtgccatccatcaggctctggtgcagcagggcggcgtctttgcggaccggcctcccttcgcctctttccgtgtggtgtctggtggccgcagcctggcgttcggccactactcagagcgctggaaggagcggcgacgtgcagcctatggcacgatgcgtgccttctccacccgccacccgcgcagccgcggtctcctcgagggccacgcgctgggagaggctcgagagttggtggcagtgttggtgcggcgctgcgccggtggcgcctgcctcgatccgacgcagccgatcatagtggcggtggctaatgtcatgagcgctgtatgcttcggctgtcggtacaaccacgacgatgccgagttcctggagctgctcagccacaacgaggagttcgggcgcaccgtgggcgcgggcagcctggtggacgtgatgccctggctgcagctttttcccaacccggtgcgcaccatcttccgcgagttcgagcagatcaaccgcaacttcagcaacttcgtcctggacaagttcctgaggcaccgagaaagcctcgtgcccggggctgctcctcgagacatgatggacgccttcatcctctccgccgaaaagaaggcgactggggaccctggtgacagtccctccgggctggatttggaggatgtgcctgccactattacagacatctttggagccagccaggacaccctttccaccgcgctgctgtggctgctcatcctctttaccagatacccggatgtgcaggcccgcgtgcaggccgagttggaccaggttgtggggagggaccgcctgccctgcatgagtgaccaacccaacttaccatacgtcatggcttttctttatgaatccatgcgattcaccagctttttgcctgtcacccttccacatgccaccactgccaacacctttgttttaggctactacatccccaaaaacacggtagtttttgttaaccagtggtctgtgaatcatgacccagcaaagtggtctaacccagaggactttgatccggcccgcttcctggacaaggacggcttcattaacaaggcactagccagcagcgtgatgatattttcagtgggcaaacgacggtgcatcggcgaggagttgtctaagacgcttctgtttctcttcatctccatcctcgctcatcagtgcaatttcaaggctaaccaaaacgagccctcaaacatgagtttcagttacggcctgagcattaagcccaagtcgtttaaaatccatgtgtctctcagagagtccatgaagctccttgatagtgctgtcgagaagctgcaagctgaggaagcttgccagtgagagagggagaggccggaggtaactgaaatgttcaaagaaaaccatctcattaactggagaggaaaacacagattttattttctccagcttcattttggcctcagttctcaagaatgagcggaaaccaagtggcctgaaggtgaggcgggcttaccaattcatggctcctcaccggccagcagctggagatcctgaagtattttgaaattgaagagtaatagggtccaaggaatttgcatactgttcccccctcacccccattaaacacatgcacacaaatcagcatgtgtgtacagctatccaacaaaatatttcagtaactctgcctttttgggtcgatttgaaagggaacttctattgcagaaattggccccataggaaaccacagtaagcagaggcttaggatatatatatatatatatatatattcaagattcaaagaagtgatttaagtgtaaaatataaagagcagaaatttaccaagagacaaatgagcactcccttgtggccctggacgaggttttctttctgcctgtagatgtgcctcccactctagaacggaccataaagccgttttgctccccctcaatttatggctagtttaataaccacagtaggttttagagattagtgaatccaaaggtaaattgtttgaaaggcaaaaggattttgtaagttaaaactgtatgtcattcagctgttcaaacgaagcattccagttatgagggagaaaaaggtttgccagtctaacgtaagctttcaactttgggatcgtaacaaactgatctgagtaataagtcggataaagtaaaaaataaaaaagcctcatgtcaccaaatagcattcaataaattttgcataattattcacaagcatcatatgaatattaactatttgacaggaaagcacttgaataatacatttcttatgtcatcttgcaaaccaaaaagtataatcagttgggtgaaatttgcccaaatccaggaaacgatcctgacaaaatcgatctgattaatatcagggaagcaagtaacaggacgatcctttcctttcttatttacagcccctacacgagacaaatctcaaaactaaaccagcaaaaccatgctctgatctggtaattgtagttacaacgcacttttcttttggaattgacccctttcggttgcgttaagattccaaactcttggctggctctgattttaaattagtttaaaatccaccttgattattttgtttcggttgaagctggagaaagtatggttattatctcacagaaggtgagacacctaacctttatctaaggacaaatgtcaaaggcaacaatcaatcaaacaaacaaacaaagccatgagtgctctgggtgttcttattagacgccctctgacaagaaactcagtaccactggtagttggtagtttctttttatgtgctattactatggttgttgtaggtgttttttaaattgagtattaaggtctgcggttttgtgtttttttttaagtcagaatctgaagattgtcttgggaggttgtttagcgactgcttggggagacagcagagacggctaaaattggctcttatttaggatggcagactgagcagccgccttcctggtagctgagagaggagaaatatatgtatttggattgtgtaaacaatccgaaacctgttaagaagggttggatgagtggaaaagtagggacagggcgcgtggggggtttcccatttctgttttcactgcaatttagacggaacaaaagaagcccacggcactcagagagcttatggttggctctgtttcattaggcttcttggaattttcctatcaaaattgcaaaggaaggagtgtgtgatattcttgtgtgcagaggccagaagctgacagacagagagtgcatgagcaggagagaaatgtttaaatggtccccattcactccaaattagtctcttgacctgtaacatttgaggcatgatgtttagaaaaaaaggagtttcaagggtcaggtcttaccttcaagtgtctcttaagactggctggagaccaagccctcaccctctctctcccccatccacatctattttgtagttggagattgaattataaaaaatataatgtaatccttatttaaatttctcacaacagaaccccttgaatgtgaaacacaggttgtgtcagtattttcgaggccttgatttcaactacaaaaattaactctgtaaacatttttaagtttttcagacattttaaaagcatgcacctcagtaaggtcgggacagtgatttgagcctccatggcctctttactatgagaaatttgtaagagtgaaaagtcttcatgaaccaatctggactcctcattaagccaaccagacccagatgttttgtgaacgtaggggtcatgttcgtctgatgctttcagcaaaggggaaagaagggggctactttgtatatatttagacccagtgaaaggaaggaggatacaagtcaggaaagagtaacaattgtcatattcggaagctaatagattactggcttagttggaaagcctgccttattctgctacagagggatttcttttgctggtcaccatcttcatcagagtatccacctcctgtcagggcaggcaaaaagtatgtttttattaaatgtctcccttgcacagtaaagcttggactatgtcagaacgttgcttttttttttaaaacaaaaaatatgcctcaggtgtgttttatgaattactcaaaagagttcatgccccagaacttagcctgtacctgtgaaatattatcatgccccttatgtattcacaccagggctgtgctagattaaatagagatcatcaccatggtatgctaattactgtttttagcagtgacacagttgtgtgacagaaggtgtatgttaccaggtgattataacccagaaataattccctatttaacctctaaaaaaaaaaaa

SEQ ID NO: 3187 - DNA, 2260 bp, Rattus norvegicus
  Genbank Accession No. NM_012941
cggaggccggggccgcctcccgacgcccacctactagcttctccagctccatctttcccgagaagcggcagggacctcggcctccagcttaccgggcggatcgaagcagcggtcgggatggtactgctgggcttgctgcagtcaggcggctcggtgctcgggcaggcgatggagcaggtgacaggaggcaacctgctttccacgctgctcatcgcctgcgccttcacgcttagccttgtctacctgttccgcctcgcagtgggccacatggtccagctgcccgctggagcgaaaagtccgccatatatttactctccaattccgttccttggccacgcgatagcatttgggaaaagtccaattgagttcctggaaaatgcatatgagaagtacggacctgtgtttagctttaccatggtgggcaagactttcacttaccttttggggagtgacgcagccgccctgctcttcaacagtaagaacgaagacctgaatgcggaagaggtctacggtcggctgacaacgcccgtgtttgggaagggagttgcatacgacgtgccaaatgcagttttcctggaacagaagaaaatactaaaaagcggccttaacatagcccacttcaagcagtatgtttctatcattgaaaaagaagcgaaggagtactttaaaagttggggagaaagcggagaaagaaatgtgtttgaagcgctgtctgagctcataattttaacagctagccattgcttacatggaaaggaaattagaagtcagctcaacgagaaggtggctcagctgtacgcagacctggatggaggctttagccatgccgcctggctgttgccaggctggctgcccctgccgagtttcaggcgcagggacagagcccatcgagagatcaagaatattttctacaaggccatccagaaacgtaggctgtcaaaagaaccagccgaggacattcttcaaactttactggattctacatacaaggatgggcgtcctctgacggacgacgagatcgcagggatgctcatcggactgctgctggccggacagcacacatcctccaccaccagtgcctggatgggcttctttctggccagagataaaccacttcaagacaaatgctacttagaacagaaaacggtgtgcggggaggatctgcctcccttaacttatgagcagttgaaggatctgaatttacttgatagatgcataaaagaaacactaagactgaggcctcctataatgaccatgatgagaatggccaagacccctcagactgtggctgggtacaccattcctccaggacatcaggtgtgtgtttctccaactgtcaatcaaagactgaaagactcctgggtagaacgcttggacttcaatcctgaccgctacctacaggacaacccagcgtcgggagagaagtttgcctatgtgccgtttggagccgggcgccatcgttgtattggagaaaattttgcctatgttcaaattaagacaatttggtccactatgcttcgtttatatgaatttgacctcatcaatggatattttcccagtgtgaattatacaacaatgattcataccccagaaaacccagtaatccgttacaaacgaagatcaaaatgaagaaaggaacaaggagccagtgtggagacgggactgcaagctgcagcttggcagagaatgaagctttgacacagctttcatactgtactgttttttaagtgtgtggttctgaaagccagtttgattttaatgttttattaactcggtgatttttgtcagacctaatggcatttgaaacagttataatagttctgataggatttcagggaagccaagtttatgttagaaatcgtttaggggagcctcggtattcagagatgatacagaatatagcatccaggtaactaacttcagaagcacacgttgccgtagggagattccggcttggaactagtttgggaagttttaagcctggtcagatgctacagaggcaatgggtcattggtgtggttgggccacttctgtgcgtaaagatgtgagagggtgaaggataagttttctgcgaagctctagatggtgtgagtgccctttgtagtgttaactgagagcaccactccagcgagatggcagcaatcttggaccttatcttgataaccttatttcctaaaaataataaatactaaagagtacttatgttattggttccagaaaaatccaaaatcaaatccttgtggaatttttaattttaatt

SEQ ID NO: 3188 - DNA, 1390 bp, Rattus norvegicus
  Genbank Accession No. NM_012943
gacagagcctccacgactcccagcctcctcctccccgccgccgccgccaccgccgccgcctcctcttcctcctcctcctccctcgctcccacagccatgtctgcttagaccagagcagctccacagccaattctggcagcagcggccgcctcaataggacagccaccgcccgggagctatgacaggagtgtttgacagaagagtcccaagcatccgatccggcgacttccaagctccgttcccgacgtccgccgccatgcaccacccgtctcaggaatcgccaactttgccggagtcctcggccaccgattctgactactacagtcccgcgggggccgcccctcatggctactgctctcctacctctgcttcttaccgcaaagcgctcaacccataccagtaccagtatcacagcgtgaacggctccgcagccggctacccggccaaggcttatgcggactacggctacgccagcccctaccaccagtacggaggcgcctacaaccgagtcccgagtgccaccagccagccagagaaagaagtggccgagccagaggtgaggatggtgaatggtaaaccaaagaaagttcgtaaacccaggactatttattccagctttcagctggccgctttacagagaaggtttcagaagactcagtacctcgccctgccagaacgcgcggagttggccgcctctctaggactgacgcaaacacaggtgaaaatctggtttcagaacaaaagatccaagatcaagaagatcatgaaaaacggggagatgcccccggagcacagtcccagctccagcgaccctatggcgtgtaactcgccacagtcaccagcggtgtgggagccccagggctcatcccgctctctcagccaccaccctcatgcccaccctacgacctccaaccagtcccccgcgtccagctacctggagaactcggcttcctggtacccaagtgcagccagctcaatcaattcccacctgccaccgcctggctccctgcagcacccgctggcactggcctccgggacgctttattagatgggctactctctcttgctcagttttgggactacagtgttttcctgttttagaaatcagaaagaaaggaattcatacggggatgtttgaacaatggaaacaaagattcatgtgtaaagctttttttttgcatgtaagttattgcatttcaaaggaccccgcccctttttttacgaaaagaacccttttttgcgcaactgtggacactatcaatggtgccttgaaatctatgacctcaacttttcaaaaagacttttttcaatgttattttaaccgtgtaaataagtgtagatagaggaattaaactgtatattctggataaataaaattatttcgaccatg

SEQ ID NO: 3189 - DNA, 1274 bp, Rattus norvegicus
  Genbank Accession No. NM_012948
agagcggcgcttcctctgctaggctgcgagctgtctgtttcttgggccctgtgtataggtgccggccgcccctggcgttcaacaccgcttccaggtgccggccgtgtctgccatggacgactatgcggttttgtccgatactgagctggccgcagtgctacgccagtacaacatcccgcatgggcctattctgggctccactcgcaagctctacgaaaagaaaatcttcgagtacgagacccagagaaggaggctttcgccccccagctcgtcatcgtcttcattctcctatcggttctcagacttggattcagcctccgtggactcagacatgtatgatctgcccaaaaaggaggacgccttactttaccagagcaaggactataatgatgactactatgaggagagctatttgactaccaggacatacggggagcccgagtctgtgggcatgtccaagagcttccgccggccagggacctcacttgtagatgctgatgataccttccatcaccaggtgcgtgatgacattttctcttcttcagaagaggaaggcaaggatagggaacgccccatctatggccgagacagtgcctaccagagcatcgcagagtaccgccccatttccaatgtctccaggagctccctgggcttatcatattatcctagatcctccacctcttctgtgtcctcctcttcatcttctccctcttcatggcttacccgacgtgccattcgaccagaaaagcaggcccctactgctgctctgggccaggatcgacaggtcccactctggggccagctgttactcttcctggcctttgctacctttctgctctttgtttactattccatacaagctcaagaaggcaaccccttctggatggatccctaagggtattggtttcagagcagctcttaacaggagttttggctgactgccttagcagtgtttgctgggggtggggggtaggggcttttttgtgtattctagttagagggtacagggcccttactacggcagtgcttgtctccacctcatcttgccaaggaagcagcaaatgctggctttccacagcccagtaggccctatgtaccttcctctggagcctcctagccttattgcctctgactcttagggtatggggatctggtggggaggacctcacttcattagaggaaaacttggtggtggcagtggtagttgtcatgcatgcctgtttgttgtcaccttttcagggggtattaacaaggccatcctggctttgctttcg

SEQ ID NO: 3190 - DNA, 1663 bp, Rattus norvegicus
  Genbank Accession No. NM_012953
cctgggggtcgtgaagttccgagcggacgggtccacggaggttcatctggagaggtgggtcccctgcgaggtgaaaggcgccgctgcgacacacccccaccccccgcggtgcagtggttcagcccaataacttttcattcataaaaaagaccagactctgcgaggcgcgagtgagtcagaaccgcagccgccgacgcggaccctaccgaacatccagcccagggcatgtaccgagacttcggggaaccgggaccgagttccggggctggcagcgcgtacggtcgccccgcgcagccccagcaagcgcagacacagacagtccagcagcagaagttccaccttgtgccaagcatcaacgctgtcagtggcagccaggaattgcagtggatggtgcagcctcatttcctgggacccagcggctatccccgacctctgacctatccccagtacagtccccctcagccccgaccaggagtcatacgagccctagggccacctccaggggtgcgacgcaggccctgtgagcagatcagcccggaggaggaagagcgccgcagggtgagacgcgagcggaacaagctagcagctgctaagtgcagaaaccgaagaaaggaattgacagacttcctgcaggcggagaccgacaagttggaggatgagaaatcggggctgcagcgtgagatcgaagagctgcagaagcagaaggaacgccttgagctggtgctggaagcccatcgccccatctgcaaaatcccagaagaagacaagaaggacacaggtggtaccagcagcacgagtggggcgggtagcccaccgggcccctgccgcccagtgccttgtatctccctttctccaggacccgtacttgaaccggaagcactgcatacccccacgctcatgaccacaccctctctgactccttttactccgagtctggttttcacctatcctagcacaccagagccttgttcctcagcccatcgaaagagtagcagcagcagtggtgacccctcctccgaccccctaggttctcccacactcctggctttgtgaggcacccagccacaccccttgcaggtgctacccgttgtcatctcctttccctgttcatccagcaggcctggaccatacccatgccccaaaccagcaggtcttttatctctttcaagtagaacaaacatgttatgctttgatatagagccagcttgggggtccccaaagctgctcactgtttctctagagctggcctatcataatttgcatacagagaaaatatgtccctctgccagagtaagcctggcagctctgactttgtagatccccagtggtcctttgatgccttgcagaccactttcccacaccatgtcactttcttcatgttatccagcctactctaagcctagatagaaggtgccctttaactagcctagaacactaactcacacagcaccaacagccagcagcaccaggacaccctgtaggctcctcctgatcaggaggcaccaacagcttctgtgatgagctgagctgtactccctagctctgagaagcttttagctctggggtatccaagcctccacagcaagggcagctgctatttattttcctaaagagactatttttatacaaaccttccaaaatggaataaaaggcttgaagctct

SEQ ID NO: 3191 - DNA, 1225 bp, Rattus norvegicus
  Genbank Accession No. NM_012963
gtctggctcccgctctcacagccattgcagtacattgagctccatagagacagcgccggggcaagcgagagccggacgggcactgggcgactctgtgcctcgcggaggaaaatcaactaaacatgggcaaaggagatcctaagaagccgagaggcaaaatgtcctcatatgcattctttgtgcaaacctgccgggaggagcacaagaagaagcacccggatgcttctgtcaacttctcagagttctccaagaagtgctcagagaggtggaagaccatgtctgctaaagaaaaggggaaatttgaagatatggcaaaggctgacaaggctcgttatgaaagagaaatgaaaacctacatcccccccaaaggggagaccaaaaagaagttcaaggaccccaatgcccccaagaggcctccttcggccttcttcttgttctgttctgagtaccgcccaaaaatcaaaggcgagcatcctggcttatccattggtgatgttgcgaagaaactaggagagatgtggaacaacactgctgcggatgacaagcagccctatgaaaagaaggccgccaagctgaaggagaagtatgagaaggatattgctgcctacagagctaaaggaaaacctgatgcagcgaaaaagggggtggtcaaggctgagaagagcaagaaaaagaaggaagaggaagacgacgaggaggatgaagaggatgaggaagaggaggaagaagaggaagacgaagatgaagaagaagatgatgatgatgaataagttggttctacgcatgtttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagctagccctgtcctggtggtattttcaatagccactaaccttgcctggtacagtctgggggttgtaaattggcatggaaattaaagcaggttcttgttggtgcacagcacaaattagttatatatggggacagtagttttggttttttggttttctttttttttttgtgtttttgttttttttcctttttgtttttttttccatcttcagttgtctctgatgcagattatacgaaggtaattgttgttctgttaactgaataccactctgtaattgcaaaaaaatg

SEQ ID NO: 3192 - DNA, 680 bp, Rattus norvegicus
  Genbank Accession No. NM_012966
gaggggcttgttctttcacctcagcggccgacctggaaaagcctagaaagtgctccccttttcttccgcctccggctacccgcatcggccgcctgcgcggagtcctggccaccaatcggcgcgcgcgctggagtggccgccttctctcacgctaaggggctgagtgcgcctgcgcgctgcgctgtcttttcacgtgtcctgagccggcccacgggagtctccttgcagcaggagtccgagtgcagagtccggagctgcggcggcgtaagtcatggctggacaagcttttaggaagtttcttccgctatttgacagagtattggttgaaaggagtgccgctgaaactgtgaccaaaggtggcattatgcttccagaaaagtctcaaggaaaagtattgcaagcaacggtcgtggctgtgggatcaggcgggaaaggaaagggtggagagattcagcctgtcagtgtgaaagttggagataaagttcttctcccagaacacggaggcaccaaagtagtactagacgacaaggattacttcttatttagagatggcgacattcttggaaagtatgtcgactgaaatcactgttgaaatggtgtcacatgaagctgcccattccactgatattctgaactatttcatcatgtaaataatttccatgcctcccttttataataaa

SEQ ID NO: 3193 - DNA, 2602 bp, Rattus norvegicus
  Genbank Accession No. NM_012967
ctgctgcctgcactttgccctggtcctccaatggcttcaacccgtgccaggcccatgctgcctctgctcctggtcctggtcgccgttgtgatccccgggcctgtcggtgctcaggtatccatccatcccacagaagccttcctgcctcggggtggatccgtgcaggtgaactgctcttcctcttgcgaagacgagaacctcggcctggggttggagactaactggatgaaagacgaactatcgagtggacacaactggaagctcttcaagctgagcgacattggggaagacagcagaccactgtgctttgagaactgtggcaccacgcagtcctcggcttctgccaccatcactgtgtattcgttcccagagcgagtggagctggatcctctgcccgcctggcagcaggtgggcaagaacctcatcctgcgctgcctggtggaaggcggagcaccgcggacacagctctcagtagtgctgctccgtgggaatgagacactgagccgccaggcagtggatggggaccccaaggagatcacattcacggtgctggccagcagaggcgaccacggagccaatttctcatgcttcacagaactggacctcaggccacaagggctgtcactgttcaagaatgtctccgaggtcaggcagctccggactttcgatcttccgactagggtcctgaagctcgacacccctgacctcctggaggtgggcacccagcagaagttcttgtgttccctggaaggcctgtttcctgcctctgaagctcagatatacctggagatgggaggccagatgctgaccctggagagcacaaacagcagagattttgtgtcagccactgcctcagtggaggtgactgagaagttggacagaaccctgcagctgcgctgtgttttggagctggcggaccagaccctggagatggagaagaccttgagaatctacaacttttcagctcccatcctgaccctgagccagccggaggtctcagaaggggaccaagtaactgtgaagtgtgaagcccacggtggggcacaggtggtgcttctgaacagtacttcccccaggccacccacctcacagggtacttcccccaggccacccacctcacagatccaattcacactgaatgccagcccggaggatcacaaacgacgcttcttttgctctgcggccttggaggtggatgggaagtccctgtttaaaaaccagaccttggaactccatgtgctatatggtcctcacctggacaagaaggactgcttggggaactggacctggcaagaggggtctcagcagactcttacatgccagccccaggggaatccagcccctaatctgacctgcagccggaaagcagatggtgtcccgctgcctatcgggatggtgaagtctgtcaaacgggagatgaatggtacctacaagtgccgtgcctttagctcccgtgggagtatcaccagggacgtgcacctgacagtgctgtaccatgatcagaatacctgggtcataattgttggtgtgttggtactgatcattgcgggcttcgtgatcgtggcgtccatttacacctattaccgccagaggaagatcaggatatacaagttacagaaggctcaggaggaggccctaaaactcaaggtacaagccccgcctccctgagcccactggacaggacacctgcctgggccccgctgctcttgaacagatcaatggacagcatttacccctcacccacctcctctggctgtcacaggacaggacagtggcctggggatgcatacttgtagcctcaggcctaagaggactcggaggggcaagactgtgaactcgtgacctggacacacctacagcctggtgggcctgcagccaagaaaggctgacttccttctctattacccctgctgaggggccccctaccttaggaaggtgtgatatccggtagacacaagcaagagaagaaaaggaacaccatgcttcctctgacatgggaaagctgggacactgtccccaactcttgttgatgtatttattaattcagagttctgacagttatttattgagtaccctgtacagacactagaggagtgagcaggttaacatgtaagttattgcctagaccctggtgaaggggcacaacagagtctggggaaagatcatacgggtttgggcttctccacaggtcagggtgctttcctcaaaagagctgatttctttcacgagtcatataaatactatgtggacgagcagtggccctctgctcgtagacctctctgggacccctgcctcctcccacagcctggagtctcccagcaccagcatgggtgaccacctccccacctacatacattcctacctttgttcccaatgtcaaccaccatgcctaaatatggacgctcacctttagcagctcaacaatggagtctcatgcccgtgaaattatggtcaatccctgcatgcctccacccggctccacctcaaagagaatgcctgggagaaaatgttccaaccacttagaagggtcctgcaagctgttgtgggagggtaggcacccctcccagcgcagaagcctttcctttgaatcaataaagtttta

SEQ ID NO: 3194 - DNA, 1862 bp, Rattus norvegicus
  Genbank Accession No. NM_012968
tcctgggttccgcttggaccagggcgctgaaggaggcagtggccggccaacccgcacccatctggtcgctgtcgccgagcctgcttggctggcccagtaaggatgggacttccttggtgtttgatgagtctgttcttctgtgggatcctgcagagtcacgcttccgaacgctgtgatgactggggactagataccatgcgacaaatccaagtgtttgaagatgagccagctcgcatcaagtgccccctctttgaacacttcttgaagtacaactacagcactgcccattcctctggacttaccctgatctggtactggaccaggcaagaccgggacctggaggagcccattaatttccgccttccagagaatcgcatcagtaaggagaaagatgtgctctggttccggcccaccctcctcaatgacacgggcaattacacctgcatgttgaggaacacgacttactgcagcaaagttgcatttcccctggaagttgttcagaaggacagctgtttcaattcccccatgagactcccagtgcacaggctgtatattgaacagggtattcacaatatcacgtgtccaaatgtagatggatattttccttccagtgtcaaaccatcggtcacttggtataagggttgtactgaaatagtgaattttcataatgttcaacccaagggcatgaacttgagttttttcatccccttggtatcaaataacggaaattacacatgtgtggtgacgtatctggaaaacggacggctctttcacctcaccaggactatgactgtaaaggtggtaggctcaccaaaggatgcagtaccacctcatatctactcgccaaatgaccgcgttgtctatgagaaggaaccaggagaggagttggttattccctgtaaagtctatttcagtttcattatggactctcacaatgagatctggtggaccattgatggaaagaagcctgatgacgtccctgttgacatcactattattgaaagcgtaagttattcttcaacggaagatgagacaaggactcagattttgagcatcaagaaagtcacccctgaggatctgaagcgcaactatgtctgtcacgctcgaaatgccgaaggggaagccgagcaagcagccaaggtgaaacagaaagtcataccgccaaggtacacagtagaactcgcctgtggttttggagccacagtctttctggtggtggttctcatcgtggtttaccacgtttactggctggagatggtcctcttttaccgggctcattttggaacggatgaaacaattcttgacggaaaagaatatgatatttatgtttcctatgcaagaaatgcagaagaagaagagtttgtgctgctgacactacgtggagttttggagaatgagttcggatacaagctgtgcatcttcgacagggacagcttccctgggggaattgtcacagatgagaccctgagcttcattcagaaaagcagacgactcctggttgtcctaagccccaactacgtgctccagggaacacaagccctcctggagctcaaggctggcctagaaaatatggcctcccggggcaacatcaacgtcattttagtgcagtacaaagctgtgaaggacttgaaggtgaaagagctgaagcgggctaagtcggtgctcaccgtcattaaatggaaaggggagaaatccaagtatcctcagggcaggttctggaagcagctgcaggtggccatgccagtgaagaagagtcccaggtggtctagcagtgacaagcagggtctctcctactcatccctgaaaaacgtatgaaaggaaaagtcagggggtgaaaagaacaaggcggttcatgggaggaa

SEQ ID NO: 3195 - DNA, 585 bp, Rattus norvegicus
  Genbank Accession No. NM_012973
cgtccatccaggtccaggcgtgcagagttttgctccacatcagggaaaccgtgaagccccaggatggccctgtccaattccacaactgttctgccttttctggcctcgctgtggcaggaaacagatgagccgggtggcaatatgtcggcggacttggctcgtaggtcccagctccgagatgacagcaagctggaggctctctatatcctcatggtgctgggtttcttcggcttcttcaccctgggcatcatgctgagttacatccgatccaagaagctggaacactcgcacgaccctttcaacgtgtacatcgagtcggacgcctggcaggagaaaggcaaggccctcttccaggcccgcgttctggagagcttcagagcttgctatgtcattgaaaaccaggcggccgtagaacaacctgccacacaccttcctgaactgaagccactgtcatgaaccccatagttaattaatagacaagtgataagtgggtctttctagtcaaatgcctgccagtctttattgtagaggtacccttgagtttttataaggggtgagttaataacaccagttttctgaaattgc

SEQ ID NO: 3196 - DNA, 872 bp, Rattus norvegicus
  Genbank Accession No. NM_012976
ggaagagagcgttggttctcccaagacagaagagatgtcttccttcagcacccagactccatacccgaacctagctgtacctttcttcaccagcatcccaaatgggctttacccatccaagtccatcgtcatatcaggcgtggtcttgtcagatgctaagaggttccagatcaaccttcgctgtgggggtgacattgctttccacctgaacccccgttttgatgagaatgctgtggtccgaaacactcagatcaacaactcctgggggcccgaagagcgaagcctgcctgggagtatgcccttcagtcgtggccagagattctcagtgtggatcttatgtgaaggtcactgcttcaaggtggccgtggacggtcagcatatttgtgaatacagccaccgcctgatgaacttgccggatatcaacactctagaggtggctggtgatatccagctaacacacgtggagacctaggaaggtctctggcctagggatgaaggctgaggaaccctacctgagtcttgtcacctcttccctgtctcagccctgcctccccaaatcctgtcatcaaagagagcctcattggcaggagttccaggaaggtgacattcccaattcacaccctccacaaagggggagtcctgggctgtgggacacatggctgtgagcccacagtgtcagccattgctcccaagctagtcatcttctgagggaagtgacctccctgggtttgcccctttctctgaccctttcccttcacccctccaggagggccaccttgatgtcatcccactggcctccaactgacccagaatgtccacattaacttttccccaatctttcccaatgcccataaaataaagaatatcaacgc

SEQ ID NO: 3197 - DNA, 1545 bp, Rattus norvegicus
  Genbank Accession No. NM_012977
gtgaactcgtgggagtcccgccctgtgcagagttctgtccagcaagtgaggaagagagcgttggttctcccgaaacagaagagatggctttcttcagcacccagcctccatacatgaacccagtcatcccctttactggaataatccaaggagggttgcagaacggacttcagatcaccctccaggggaccgtccacccttttccaaataggattgcggtgaactttcagactggcttcagtggaaatgacattgccttccacttcaatccccggtttgaggaaggaggatatgtggtttgcaacacaaagcagaatggaaagtgggggcctgaggagaggaagatgcagatgcccttccagaaggggatgccctttgagctttgcttcctggtacagaggtcggaattcaaggtgatggtgaacaagaacttctttgtacagtactcacaccgcgtgccctaccacctcgtggacaccatttcggtctcgggatgcttgcacctgtccttcatcaacttccagactcagggctttcagcctgcccaccaggcacccgtggctcaaactatcatccacacagttcacagcatccctggacagatgctctctactcctggaatccctcctatggcataccccaccccagcctatactatacctttcttcaccagcatcccaaatgggttttacccatccaagtccatcaacatatcaggcgtggtcttgccagatgctaagaggttccatatcaaccttcgctgtgggggtgacattgctttccacctgaacccccgtttcaatgagaaggttgtggtccgaaacactcagatcaacaactcctgggggcccgaggagcgaagcctgcctgggagaatgcccttcaatcgtggccagagtttctcagtgtggatcttatgtgaaggtcactgcttcaaggtggccgtggatggtcagcatatttgtgaatattaccaccgcctgaagaacttgccggatatcaacactctagaggtggccggtgatatccagctgacacacgtgcagacctaggaaggtctctggcttagggatgaaggctgaggaaccctacctgagtcttgtcacctcctccctgtctcagccctgcctccccaaatcctgtcatcaaagagagcctcattggcaggagttccaggaaggtggcattcccaattcacaccctccacaaagggggagtcctgggctatgggacacatggctgtgagcccacagtgtcagccattgctcccaagctagtcatcttctgagggaagtgacctccctgggtttgcccctttctctgacctttcccttcacccctccaggagggccaccttgatgtcatcccattggcctccagctgacccagaatgtccacattaccttttccccaatctttcccaatgcccataaaataaagaatatcaacgcttgtctacaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3198 - DNA, 2236 bp, Rattus norvegicus
  Genbank Accession No. NM_012980
gcagccccggggcggatggcacgggccgcctgtctcctccgcgcgatctcgcgcgccctcctgctcccgcttcctctgctgctcctgttgctgcttctcctgccgccgcagctgatggcccgggccaggccaccggagaatcaccgtcaccgccctgtgaagagagtgcctcagctcctgcccgcagctctgcctaatagcttgccgtctgtccccgcctcccattgggtccctggtcctgctagtagctccagacctctacgatgtggtgtgcctgacccgccggatgtactgaatgcccgaaaccggcagaagcgcttcgtactgtcgggagggcgctgggagaagacagacctcacttataggatcctccggttcccatggcaacttgtaagggagcaggtgcggcagacggtggcagaggccctccgggtatggagtgaggtgactccgctcactttcaccgaggtgcacgagggacgcgctgacatcatgattgacttcaccaggtactggcatggggacaacttgccattcgatgggcctgggggcatcctggcccatgccttcttccctaagacccaccgagaaggggatgtacactttgactatgacgagacttggactattggggacaagggcacagacctgctacaagtggcagctcatgaatttggtcatgttctgggcctgcaacacaccacagcagctaaggccctcatgtcccctttctacaccttccgctaccctctgagccttagcccagatgaccggaggggcatccagcacctctatggccggccccagctgacccccacctccccaaccccaaccttgagctcccaggctgggacagataccaatgagattgcactgcaagagccggaagtccctccagaagtctgtgagacctcctttgacgcagtttccaccatccgaggcgagctcttcttcttcaaggcgggctttgtgtggaggctgcgcagtgggcaactgcagcctgggtatcctgctctggcctctcggcactggcagggactacccagtcctgtggatgcagcttttgaggatgcccagggccagatttggttcttccaaggtgctcagtactgggtatatgacggtgagaagccagtcctaggccccgcaccactctccaagctgggcctgcaggggtccccggtccatgctgccttggtctggggtcctgagaagaacaagatctacttcttccgaggtggagactattggcgtttccaccccagaacccaacgagtggacaatccggtgccccgacgtaccactgactggcggggggtaccttctgagattgatgctgctttccaggatgctgagggctatgcctacttccttcgtggacatctctactggaagtttgaccctgtgaaggtgaaagtcctggaaagtttccctcgacccataggtcccgacttctttgactgtgcagagcccgccaacactttccgctgacaacacctcagatgcattcagggcacttatatcattaaagagagccacagccatatttgtggacctgggcttcaggcatgggacagacggggcctaggtctcctcaggggagtgggttggggtgcagccactgtttgcagggaggaccatgctggccatggtcacctgccaacaactgtctcagagaaggcaaaggctttgacattacttaaaaataagggaggtcttgggctgacaatatgtcagctaccagtaatccacagtcaacttgactgccaagcctccatctctgtcccacaaagaacccccacaggaattcaggaaccacagtgtcttcattctgtttctgtaacgaggtccctgttggtagtggtgttggtaatgagatgccaagggtaccatggtaaggagatgcccagggttccatgctgccacagctaaggacctgggccagtatctctcctggttaagttggctctggagagatactggactgattatattcagacgagtttttcctggaacataggccaaaagcgacacagccagccagggaggcagctgcttcctcccagagcctcagaggcctcacatacctcacagccttgccctgggccatttctccctggcgccttccctcttcccagcaccagtgcctcccaaagccatgtaaatgtgtatacagtgtataaagcctttttttaagaaagccgagactgtcattaaacatgagtgttttctaagt

SEQ ID NO: 3199 - DNA, 7336 bp, Rattus norvegicus
  Genbank Accession No. NM_012984
tcggcacgagggcgaggctggtcgctccgggcgggggggccgcgagcagccgggccggccggagaccggcgccagcggtccaagtccagttgcaggaggtgcgcggcccgccgatgaggcatgctgaggccaggaggtgggcaggatgagtgctcacgaggctggcagctcaggccgaaggcggccggccaccttccacctgcacatctaccctcagctgcccagtgctgggagccagacctcatgccgtgtaaccgccaccaaggacagcacaacaagcgatgtcatccgagacgtggtggccagtctacacctggacggctcgaagcactatgtgctggtggaggtgaaggagtcgggtggggaggagtgggtgctggatgccagcgactcgcctgtgcaccgagtgctgctgtggcctcggcgagcgcagaaggagcaccctcgggaggacggctactacttcctgctgcaggagcgcaacgctgacggcagcattcagtacctgcacgtgcagctgctggctcagcccacagccgcatgtcgcctggtggagcgagggctgctgccaaggcctcaagcggacttcgacgacctgtgcaacctgccggagctgaacgaggccaacctgctgcagagcctgaagctgcgcttcgtgcagcagaagatctacacgtacgcgggcagcatcctggtggccatcaaccccttcaagttcctgcccatttacaaccccaagtatgtgaagatgtacgagaaccagcagctgggaaagctggagccgcacgtgttcgctctggccgatgtagcctactacaccatgctgcgcaagcacgtgaaccagtgcatcgtcatctctggtgagagcgggtccggcaagacgcaaagcaccaacttcctcatccactgcctcacagcgctcagccagaagggctacgccagcggcgtcgagaggaccatcctgggtgcagggcctgtgctggaggcttttgggaacgccaagacagcccacaacaacaactccagccgcttcgggaagttcatccaagtcaactacctggagagtggcatcgtgaggggagctgttgtggaaaaataccttcttgaaaagtctcgcctggtttcccaggagaaggatgagcggaactaccatgtgttttattatctgctgctgggcgtcagtgaggaagagcgtcaggaatttcagctgaagcagcctcaagactatttctacctcaaccagcataacttgaatattgaagatggagaagacctcaaacatgactttgaaaggcttcagcaggccatggagatggtgggcttcctacctgccacgaagaagcagatcttctctgtcctctcagccatcctgtatcttggcaatgtcacctataagaagagagccacaggccgggatgaaggcctggaggtcgggcccccggaggtattggacacactatcccagctcctgaaggtaaagcgggagaccctggtggaggtcctaaccaagagaaaaacaatcacggtcaatgacaaactcatcctgccttacagcctcagtgaggctatcactgcacgagactccatggctaagtctctgtacagcgccctgtttgactggattgtgctgaggatcaaccacgccctcctcaacaagaaggacatggaagaggctgtttcttgcttgtccattggcgtcctggacatattcggatttgaggactttgaacggaacagcttcgagcagttttgcatcaactacgccaacgagcagttgcagtactacttcacccagcacatcttcaagctggagcaggaggagtaccagggtgagggtatctcgtggcacaacattgactacaccgacaacgtgggctgtatccacctcatcagcaagaagcccactggcctcttctacctgctggacgaggaaagcaactttccccatgccacaagccacactctgctggccaaattcaagcagcagcatgaggacaacaagtacttcctgggcacaccagtcctggagcccgccttcatcatccagcacttcgcaggcagagtaaagtaccagatcaaggacttccgggagaagaacatggactacatgcggcctgacatcgtggcactgctaaggggcagtgacagctcctatgtgcgccaactcatcggcatggacccggtagctgtgttccgctgggctgtattacgggcagccatcagggccatggctgtgctgcgggaggctgggcgcctgcgtgcagagagagcagagaaagcagaagcaggtgtaagtagtcctgtcactcgaagtcacgtggaagagctgccaagaggagccaacaccccttcagagaaactgtaccgcgatttgcataaccaaatcatcaagagcctcaaaggactgccatggcagggcgaggacccgcggaggcttctccagtccctcagtcggctccagaagccccgcaccttcttcctgaagagtaaaggtatcaaacaaaagcagatcattcccaagaacctgctggactctaagtccctgaggctcatcatcagcatgacgctgcatgaccgaactaccaagtcactgctgcacctgcacaagaagaagaagccgcccagcatcagtgcacagttccagacatctcttaacaagctgttggaggcgctgggcaaggctgagcccttcttcatccgctgcattcgctccaatgccgagaagaaggagctctgctttgatgatgagctggtgcttcagcaactgcgctacacaggcatgctggagaccgtgcgcatccggcgctctggctacagcgccaagtacaccttccaggacttcacggagcagttccaggtgctgctgcccaaggatgtccagccctgtagggaggccattgctgccctgttggagaagctgcaggtggacaggcagaactaccagatcgggaagacgaaggtcttcctgaaggagacagagcggcaggccctgcaggagaggctgcatggtgaggtcttacgcaggatcctgctgctgcagagttggttccggatggtgctggaacgcaggcactttgtgcagatgaagcatgctgccctgaccatccaggcctgctggcggtcttatcgtgtgcgccgtacactggagaggacgcgggcagctgtgtatcttcaggctgcctggagaggctacctgcagagacaggcctaccaccaccagaggcatagcatcatccgcctgcagagcctctgccgtggccacctacagcgcaggagcttcagccagatgatgttagagaagcagaaggcagagcaagccagggagactgcaggagcagagatgtcagagggagagcccagccctgtggccgctggggagcagccgtctgagcaccctgtggaggaccctgagagcctgggtgtggagactgagacctggatgaacagcaagtccccaaatggcttgtcacctaagaaggagatccccagcccggagatggagaccccagcccaaaaaacagtgccagctgaaagtcatgagaaagtccccagtagccgggagaagcgagagtcacggcggcagcgagggttggagcatgttgaacgacagaacaaacacatccaatcctgcagggaggagaatagcaccctccgagaaccttccagaaaggcaagcctggaaacaggggagagcttccctgaggacacaaaggagcccagagaagatggacttgagacatggactgagaccgcagccccctcttgtccaaagcaggtgccgattgtgggagatccgcctaggagtcccagtcccttgcagaggcccgccagcctggacctagacagcagggttagcccagtgctccccagcagctccctggaatccccccaggatgaggacaagggtgagaacagcaccaaggttcaggacaagcccgagagtcccagtggctccacccagatccaacggtaccaacacccggacacagagcggctagccactgctgtggagatatggcgaggcaagaagctcgccagtgccatgctgagccaatccctggacctgagtgagaagccccggactgcaggggcagccctgactcccacagaggagaggcgcatctccttctccaccagtgatgtctccaagctgtccccggtcaagacttcaactgaagtcgatggggatctgagcgccaagaagccagccggccataagaagaagtcagaagacccatctgctggtcccgatgcaggcctgcccacaggctcccagggtgactctaaatctgcctttaagcgactcttcctgcacaaagccaaggataagaagcccagcctggagggtgtggaggagacagagggcagtggagggcaggctgcacaggaggccccggccaggaagactctagatgtaccttctagccagcagcaccgccacaccacaggcgagaagcctctaaaagggaagaagaaccgaaatcgtaaggtcggacagatcacagtgtccgagaagtggcgagagtcggtgttccgtaagatcactaatgccaacgagctcaagtttctggatgagttcctgctcaacaaggtgaatgaccttcgctcacagaagacacccatcgagagcttgttcattgaggccactgagcgtttcaggagcaatatcaagaccatgtattctgtgcctaacgggaagatccatgtaggctacaaggacttgatggagaactaccagatcgttgtcagtaacctggctgccgagcgtggggagaaggacaccaacctggtcctcaatgtcttccagtcactgctggatgaattcactcgcagctacaacaagactgactttgagccggtcaagggcaaagcccagaagaagaagaggaagcaggagcgtgctgtccaggaacacaatggacatgtgtttgccagctaccaagtgaacatcccgcagtcgtgtgagcagtgtctgtcctacatctggctcatggacaaggccctgctatgcagtgtgtgcaagatgacctgccacaagaaatgtgtgcacaagattcagagctattgctcctacactggacggaggaagagtgagctgggtgccgaaccaggccacttcggcgtgtgtgtagacagcctgaccagtgacaaggcctccgtgcccattgtgctggagaagcttctggaacatgtagagatgcatggcctgtataccgagggtctttaccgcaagtcaggcgctgccaaccggacacgggaattacgccaggctctgcagacagaccctgctacagttaagctggaggacttccccatccacgccatcaccggggtcctgaagcaatggctgcgggagctgcctgagccactcatgacttttgcccagtatggagacttcctcagggctgttgagcttccagagaagcaggagcagctggctgccatctatgcagtcctggaccacctgcctgaagccaaccacacctccctggagaggctcatcttccaccttgtcaaagtggccctgcttgaagatgtgaaccgcatgtctccgggagctctagctatcatcttcgcgccctgcctgcttcgctgccctgacaactccgaccccctgaccagcatgaaggacgtactaaagattaccacgtgtgtggagatgctcatcaaggaacagatgaggaaatacaaggtgaagatggaggagatcaaccacctggaggcagctgagagcattgcgttccgcaggctctccctgctgaggcagaatgccccgtggcctctcaaactggggttttcgtctccctatgagggggtccggaccaaaagccccaggaccccagtggtccaagacttggaggagctgggggctctccccgaggaggcggcaggtggtgacgaggaccgggaaaaggagattctcatggagaggattcagtccatcaaagaagagaaggaggacatcacatatcgactgccggagctggacccacggggttctgacgaggagaaccttgactcagagacatcagccagcactgagagcctgctggaggagagggccgtgcggggggccgcagaagagtgacctgccatcgcagggtacactaggacccctggaccaccatgatgccatacttcctggggccaaacgcaggtattcagacccccctacctactgcctgccctccagctccagccaagccaatggctgaggaccatgactggccatctgcgtgttctaaaatccccgaactggcatcccagctgtggagccggccttcactctctgagaaggatctagaatgaaaagttcccagagggatgctgtggccagctctgtgtgttgtggaggctggggactgctggccaggaccatcagagccccaacctgcacagcagtcccccccccccctttgtacttttcagtaactgtttctctttttgtggtttacataacttttaagttcataacagccttaatggaggaccaaactttttgtacgtgtgtctgagctttgatattaactgtccaccgctgtaacctggacatgggcaggactagcctgcaaagtggatatgtgggccacacctggcgactgcactccacagccatggagagcaagcaagcaagcgaacgagcgactcacaagacacctctagcccttgaatacctcccagcagcggtcatctggccagagaaccttccagagattgtgggagctgtccacagggtcacagctgaaggcaggacagaatgggaagtccctgcatcgcagggatgctctacccactgcctgtgggctgcaaggagccagggatcggagctgtagggacaagcagtgcatgtcccgaatttcctctgcagcccccgtgtcagcctgggttcttaagaggctggctctcttctcaggccctacccagtcctggacacaaggaagccccaccggaggtgtgaaataaaagtgcttgacaagtgtggaattccctggagggagttctccaattactgttttaaggccaatactggaaatatctcgaagctgctccttgtcagaaagcatgtttgtacagagggtgtctacaatcgtctcaacttggtactctttcactttactcactaaaggaccaagacatttcacagctaagttctgcacttcgccatttttatcctccagcaacttcagaatcatctttacgactttcctttcgctgtcatcatccagcttgatggagtctttctgcagttctgtcatcagatcatttgtagccataaacctgaagtccttgtcgctggatgtcattttttccagcaagttggagatgtggtacgaat

SEQ ID NO: 3200 - DNA, 5946 bp, Rattus norvegicus
  Genbank Accession No. NM_012987
tgctggagttctccgcttccgctgggtcactgtcgccgctacttcttttcaacccctaaaagctccacgggccactcccttctctagtgctccacgtccgcttgccctcgggggccagaccagcgacatggagggttgcgtcggggaagaatcttttcagatgtgggagctcaatcgacgcctggaggcctacctgacccgggtcaagacgctagaagagcaaaaccagctgctcagcgccgagcttgggggactccgggcgcagtccggagacacctcctggagagcccgagccgatgacgagctggcatccctgcggatcctcgtcgatcagcgctggcgggagaagctcgaggctgaggtgcagcgcgacaaccttgcggaagagctggagagcgtggcgggccggtgccagcaggtgcggcttgctcgggagcggaccgtccaggaggccgcctgcagccggcgcgcactcgaggcggagaagaatgcgcggggctggctgagcacccaggcggccgagctggagcgggagttagaggctctgcgagccgcgcacgaggaggagcgcgcacacctgaacgcccaggccgcctgtgcgcctcgccggccccccgcaccgccccaccggatccccggtccggcccccgaagtcgaggatctggccaggcgactaggcgaagtgtggcgcggggcggtgcgtgactaccaggagcgcgtggctcacatggaaagctcgctgggtcaggcacgcgagcggctgagccaagccgtgcggggcgctcgggagtgtcgcttagaggtgcaacagctgcaggctgatcgcgacagcctccaggagcgcagagaagcgctggaacagagattggaaggccgctggcaggaccggctgcaggccactgataagttccagctggctgtggaagccctggagcaggagaagcaaggtctacagagtcagatcgctcagatcctggaaggtgggcagcaactggcacacctcaagatgtcccttagtctggaggtggctacatacaggactctgctggaggctgagaactctcggttgcagacacctggacgaggttcccaggcttctcttggctttctggaccccaagctgaagccgaatttccttgggataccagaggaccagtacctgggatctgtgctccctgccctcagccccacatccttcccttcccccttgcctaatacccttgagactcctgtgacagccttcctgaagactcaggagttccttcaggccagaacccccaccttggccagcactcccatcccacctatatctgaggctccctgtcctccaaatgcagaggtgagagcccaggaggtccctctttctctgctccagacacaggctccagagcccctttggctgaaggccacagtgcctagttcttctgctatcctcccagaactagaggaacctgggggcaagcagcagggtcacttccctgatgatctgacctccttagccacaaacctcaaccctcaccaccctactttagaggctaaagatggagaatccagtgagtctagagtttctagcatattccaggaagatgaggggcaaatctgggaactggtagagaaagaagcagatatagaggtaaaagtagaaaacagctcagcccagaaaacacaagaaagtggtctggacacagaagaaacccaggattcccagggacctttgcagaaggaaacactgaaggctctaggagaggagccactgatgtctctgaaaatccagaactatgagacagcagggaaagagaattgcaattcttctacagaaggccacctgggaacactagaaggcccagaaaaagaaaagcaaataccactaaagtctttagaagaaaagaatgtagagtcagagaaaactctagaaaatggggttcctgtactatctgagcttttaggaaaagaagacacaagaacagaggatcaagaattaatgtctcctaaaggtacactaaagagattttcatctctaggaaaggaaagtcaagaagtagtgaggccttcaaaagaggggaacctagaatcatggacagcttttaaagaggagagccaacacccactgggatttccaggagctgaggaccagatgcttgagagactggtagagaaagaggatcagagcttcccaaggtctccagaggaagaggaccaggaggcatgtagacctctgcagaaagagaatcaggaaccactagggtatgaagaagcagagggccagatacttgagagactgatagaaaaagagagtcaggagtccctgaggtctccagaagaagaggaccaggaggcaggtagatctctgcagaaagagaatcaggagccactagggtatgaagaagcagaggaccagatgcttgagagactgatagaaaaagagagtcaggagtccctgaagtctccagaagaaaaccagaggattgggaagcctctagaaagagagaatcagaaatctctgaggtatcttgaagaaaaccaggagacttttgtaccactagaaagcaggaaccagaggccactgagatctctagaagtagaagaggaggagcagagaattgtgaaacctctagaaaaagtgagtcaggattccctcggatctctagcagaagagaatgtgcagccactgaggtatctggaagaagatgactgcataaataagagccttctagaagacaagactcacaagtccttggggtctcttgaagatagaaatggggatagcattattataccacaagaaagtgagacccaggtttcattgaggcctccagaagaggaggaccagaggattgtgaaccatctagaaaaagaaagtcaggagttctcgaggtcttcagaagaagaagagcaggtgatggagagatctctagaaggagagaaccatgaatcactgagttctgtagaaaaagaggaccagatggttgagagccaactagagaaagagagtcaggactcagggaagtctcttgaagatgagagccaggagacctttggacctctggaaaaagagaatgcagagtccctgagatctctagcaggacaggaccaagaggaacagaagcttgaacaagagacccaacaaacactgagggctgtagggaatgagcagatggcagtgagcccaccagaaaaggtggatccagagttaccgaagcctcttggaaatgaccaggaaatagctagatctcttggaaaagagaatcaagagtcactagtgtcactgaaagaaaaaggtatagagacagtgaagtctttagaaacagagatcatagaaccactggagactgcagaagaggacctggaaagaaggaagtctatagatactcaggagccattgtggtctactgaagtggctagagagacagtagaacctccagaagatgagcccccaggatcgctagggtctgtggatgagaaccgagagacactgacatcccttgaaaaggagagtcaagaactgagctctctgggcaagtggaacgtagagaccagggtagaggacagtcagcagtgcctgcaagtagaagagggtctgcaggaggaacagcaccaagagtctctgagagaggtgaagcaggagctgcctagctctggaaatcaacagcggtgggaggatgtggtggagggcaaagcagtgggtcaggaagcacctctggcaaccacaggagtgggaactgaggataaggcagagttgcatctgagggggcaaggtggagaggaagaagctgcagcagagggagagctgttgcaggatattgtgggggaggcctggagtctggggagctctgagcccaaggagcagagggtccctgctgaggccctcgacaacctggaaggaggggccttagaggtcccagttgctcagtcaatgccagaggtgacagagcgagatgaggatagagcccaagcaggtgaacaagactccatagaggtgacccttgggttagaggctgccagaactggactggaactcgagcaggaagtggtagggctagaggacccaaggcattttgccagggaggaggccattcccccatccctgggggaggaaagtgtgaaggcaaagatagctcagggcttggaagggcctggaaaggaaccaaaagaggcaggtgctctggactcggggatccttgaattgcccaagactagcagcgaggctctggaatgccagggccatgaagagtctgagtccatggagggctgggaagaagaggaggcctcactggagacttcagatcatgagggcagtgatgcccctcagcccaggcccccagaaacagaagaagatgagggtgcacaggcagcactgacagcccctggtcccaagctcttggaaccctgttcacccatcccaatcctgacagatgcccatgagctgcagccccaggctgaggggatccaggaggctggctggcagccagaagctgggtctgaagcactagaaagggtagaaaatgagccagagtttggtcttggggagatcccggagggcctccaggattgggaagagggcagagaagaaagcgaggcagatgatctaggggaaactctccctgactctactcccctgggcctctacctgaggtcccctgcttctccaaagtgggatctggctggagaacagaggctttcccctcaaggggatgccgggaaggaagactggggtcctgctgtccccgctgcccagggcctcagtggtccaccggaagaggaggaggagcaaggccatggctctgacctatcatctgaggagtttgaggacctagggactgaggcctctcttcttccaggggttcccaaggaggtggcagatcacgtgggccaagtgcccccggtactgcagcctgcatgctgggatcagggtggggaatctgatgggtttgctgatgaggaagaaagtggggaggagggagaggaagaagatgctgatgaggaaggagcagagtcaggagctcagtggtgggggtcaggggcctctggtggaggctgcaaggtccaggatattgcccaaagaggagacccggtacaggagtctgtgggtgtcagtggtctctgggatgatggcttgagaggtgctgcagctaatgttcctgccctagagatggtatctcaggacagtgctgagccttctgggtcagaggagtctgagtctgcttccttggagggggaggaaggtcaagtgactgaccatttagatgctccccaggaggtgaccagcatggtcccgggggtaggagatgcctttgacattggtggccagagccccaacttggactcagaacaagtgaatgggaaaatggagaatggactagaacaggctgaggggcaggtggtcctggatggggacgaggatcaagaactcctattacagggacaggaggtgggtgctctaaaggttcctttggtagcatctcctgtgcatctaggcccaagccagcccctgaagttcactctgagtggggtagatggggattcctggtcctcaggggaagactagaaactgcccctctggctctgaggatgtactggtggggatgtccctccctgctctgggtgaccactcttagctttgataacttgacccatggtatttgtcctggagagttgtggctgggctgagcaagggaggtgagatcctcctgaaggctcaggagttccaggcctatagttctaccccctctttcttctgtggctcacctgctggaagaggcctgggcccagagctttcccacaaggctgttctggccacagcttgctagccttgcctaccacctgcacaaggtctggtctggtgtatgaccaggggagctgagggcagcatttatctgacccttcatctcagcctgctgagagcttgttcctctcttcctccctgaataaagccgtatccctacctac

SEQ ID NO: 3201 - DNA, 3368 bp, Rattus norvegicus
  Genbank Accession No. NM_012988
cgaccgacctgcagttgagccgagttggaaatgtgaacgcaagaagcaggcttgatttttttttcctccccccctctcctagctctctcctcctctctctccctctcgcacccacactcacgcacacctccagcccgcacacagacgtgcacgcaccccccgccgcccggcagttatgtattctccgctctgtctcacccaggatgagtttcatcctttcattgaagcacttctgccccatgtccgcgccttcgcctacacatggttcaacctgcaggcccgaaagcggaaatacttcaaaaagcatgagaagcgcatgtcgaaagaagaggagagggctgtgaaggatgaactgctaagtgagaagcctgaggtcaagcaaaagtgggcttcccgacttctggccaagttacggaaagatatccgacccgagtaccgagaggattttgttcttacagttacagggaaaaaacctccatgctgtgttctttccaacccagaccagaaaggcaagatgcggagaattgactgcctccgccaggcagataaagtatggaggttggacctcgtcatggtgatcttgttcaaaggtattccgctggaaagtactgatggtgaacgccttgtgaagtccccacagtgctcgaatccagggctctgtgtccagccccatcacataggggtttctgtaaaggaactcgatttatatttggcatactttgtacatgcagcagattcaagtcaatctgaaagtcccagccaaccaagtgatgctgacattaaggaccagccagaaaatggacatttgggcttccaggacagcttcgtcacatcaggtgttttcagtgtgactgagctagtaagagtgtcacaaacaccaatagctgcaggaaccggccccaatttttctctctctgatttggaaagttcctcatactacagcatgagtccaggagcaatgaggaggtctctacccagcacatcctctaccagctctaccaagcgcctcaagtctgtggaggacgaaatggacagtcctggtgaagaaccattttacacaggccaagggcgctccccagggagtggcagccagtccagcggatggcatgaagtagagccaggcatgccatctccaaccactctgaagaagtctgagaagtctggtttcagcagcccctccccttcgcagacctcctccctcggaacagcattcacacagcatcaccgacctgtcataacaggaccgagagcaagcccacatgcgacgccatcgactctccactttccaacgtcacctatcatccagcagcctgggccttatttctcacacccagccatccgttaccaccctcaggagacgctgaaggagtttgtccaacttgtctgccccgatgctggtcagcaagctggacaggtggggttcctcaatcccaatggaagcagtcaaggcaaggtgcacaacccattcctccccaccccaatgttgccgccgccaccgccaccaccgatggccaggcctgtgcctctgcccatgccagacaccaagcctccaaccacatcaacagaaggcggtgcagcctcccccacctcaccgacctactcgacacccagcacctcccccgcaaaccgattcgtcagtgttggaccacgggatccaagctttgtaaatatccctcaacagacacagtcctggtacctgggataaaagttgcagcgtcccaccatcctccagacagaccacctgaccccttctcaactctgtaacatggacgcaacctcaacccggcgcagttacaacttcactgtcagtggaaggggagagacaccaactcgaatcaacttgtacatggaaacagcgaacgtcgtggtcaaacagcaaaggcccataacttttcgggattcttttttttttttaatactttagggactgtcgaattctctaaatatggtgctggaaatgcgttgggctgtgtgacatttgaagtgttccagtggtggtgtgagcagtaggtgaagcggctggtaggggatgagccttgctcacgaacttcctgttgtaacacttttgagcctggccttttcacagtatttcaagaatttgcccgcgcaggtgtgtgaccctcccggagcacttggagacacctggagaatgaaatctttcgtagtagctaagatctgtgatctgtaacttacaggacactcaagggcaatgtttttggggttttcttttttttctgtaacatattagaaaaagcaatgcagttaagttatctttcttttagtttggtttggttcagcagtcagcagttaaatacataacacaaccctcaaggacagtgaacccactcatgttgcagagcaatccaaaaagacagcaaagactactactactactctcagttcggttgtttgtttttttttttttttttttgtttttttattaagttttgaaatgctgcacttacatttaaaaaaaacattttcaacaatttcaacaatgacacaaaagttcacatggaaatggggaagatggtctgttttgacagaaactgacaggaatcaaaacaatcgaattttgaattgagtgaagtgcaatttcattggatagctaagtatctttgtaagatagagattgttgaaaattctatttttgtttttcaagtcctcccaccccaggactctaaattattggggttaaaaaaaaacagccttgcaagaaaaaggggagctatttttgctttttatgttttttattgttaaacttgtatccctttaaaaaaaaaaaccgaaggaaaatttaaaaaaaaagcaaaaaaaaaaaatacaaatctaatggtgcttttacctccaatatgttaactacattaaatgctaattaattattttctgttatcaaagcacataactcaaatgaaatcatggtatctgttaattttataagctagaaatcactataatgaattatgccaattctggaaaattttacacatgtatggcaacaccagatctatcggttttcaaacgcctcgtcgtaaccagacattgtccagaagtttcaaagacccttcgcaaaccctgaatcggctacgggaaatatatcagatcgataaggacataactgtgtgagccattcagatcaaagtacttgttaggaaaataaacaaacaaacaaaaacaaaatgttcacacacacacacaccccaaatgtcttgtatcttatgtttaaggaaaaagaaaagacaaaacggcacgagggtctgaccaccatgacaacctacagcaacaaggaccaaagctgagagaggcgtctcattcactcgtgaccttctggtggcaccgagcaggctgctctcttgcacagatggttg

SEQ ID NO: 3202 - DNA, 3027 bp, Rattus norvegicus
  Genbank Accession No. NM_012991
ggcagtagctggatgagggcgttgcttgcctcctcccttttttttctccgattggttctgaggggtatattcgagttgcaaaatggcggccccgagcgctctcttcagcgttcagtagcagcttcaggctgagcggatgtctcttctcctcagtttcggactcagagacacgcggctccctactcctgctgatcacgaagtccttgaaggcgctcaacgcaccggaatctcccagcggccgcgaccgccgcctcggccctgctctccgcggcgccggaactcagcgtgatctgcggcggccgtctaggaggttcacaaaaatggcgaagagagttgcggagaaggaattaacagataggaattgggatgaagaagatgaagttgaagagatgggaacattctcagtggccagtgaggaagtcatgaagaacagagccgtgaagaaggcaaagcgtaggaatattggctttgaatctgatagcggaggagcctttaaaggtttcaaagggttggttgtgccttctggaggaggagggttttctggatttggtggtggctctggagggaagcctctggaaggactgacaaatggaaacagcacagacagtgccacgcccttctccagtgcaaagacagcagcggagcctaaggcagcctttggttcttttgctgtgaatggccctactactttggtggataaaaagatctccagtcctaaatgcaatagcagcaatcagccgccctcctccggcccagcctccagtacctcctgcactgggaatacctatcataagcagttggctggcttgaactgctctgtccgggattggatagtgaagcatgttaacacaaacccactttgtgacctgacgcccatttttaaagactacgagagatacttagcgacgatcgagaagcagctggagaatgggggtagcagcagctcagagagacagacagacagggcgacggctgcaatggagcctccttccctttttggttcaacaaaactacagcaagattcaccattttcatttcatggcaacaaagcggaggacacatctgaaaagttggagtttacagcagaaaagaaatcggacgcagcacaaggagcaacaagtgcctcgtttaattttggcaagaaaattgagagctcagttttgggctctttaagctctggctccctaactgggttttcattctctcctggaaactctagtttatttggtaaagatgctgcccagagtaaagcagcctcttcaccgttttctgctaaagcatccgagagtcaagcaggaggcagcagcagtgagtgcagagatggtgaagaagaggagagtgatgagccacccaaggtggtggtgactgaagtgaaggaagaggatgctttctactccaaaaaatgtaaactattttacaagaaagacaatgaatttaaagagaagggtgtggggaccctgcatttaaaacccacagcaactcagaagacccagctcttggtgcgggcagacaccaacctaggcaacattctgctgaatgttctgatcccacccaatatgccgtgcacccggacagggaagaacaatgtccttatcgtctgtgtccccaaccccccacttgatgagaagcagcccactctcccggtcaccatgctgattcgggtgaagacgagcgaggatgctgatgagttgcacaagattttactgcagaaaaaggacgtctgagcactgaggctgaccagggcacgtcaccatgttgctgcttccctttgcccctaaacttagtcacattctttcctctttgtactgtgacattctgagaacttctaggtaacttgaaacttttgtgaggaagattaaggccaataaatcctttcagtgtgtcgaagctgttctcccttcctaagaactaagcaaaatacattggagtgaaaagtttgggaagattttttaatgtcgattcattgagtaaactaacctaagtgattcttacggactgtaatcagggtaccagttagctctccaaaggctccctcaggcagccacgggtgccactctcttcctgccctgggagactcaatggcagtgtccacagagttccagaagacgcctgctcccctcctgtgggcttgtttggtccgtgactagcactcctgccaaataccacaccggcacactgtaaccgcgcttgttctgtttccttctgagcggaactgtgggtcctggggatctctgtccttagcctgtttttgacaggtgctggcctttgacctggaactgcttgactgaaccaggcactgcctttccatgggaagagagggcaggtagtggcttgtcggggagctggcgaggtatagactgggttttgtcgtttatccatgaggtgctcttacttgcttacctccctagttaacatggatgggggctgtcaggaataatggattttattaaaagcacaaatttggtagcattttttaaatatcatttctataccacaaacaagcctttattttaaaagaaaaaagtgaaattgtgctgaaaagggttgtatgctcgtggccgtttgtgccccggggacctggtggtcacagtctgaatggagccctgtcagagggtgctcgtgagaaggaagagtgtgggagtggagacggctcattcggcctgtgacttcagacagcagcatgttattcagcgtctgaaaagvccaatttcatttttacctttttacggatgaggtattcttgagtctgcccacttggaagagagccatggttctacacgccattcatgccacttgagagcggtgaggttaccgatactagcattctctcaaggccagacatcagttaaatgcaaggtttgttgacgagctggtcacggctccctcctaaccccagtgccggaaagctgaggcaggaagaccgtgtgagttcacaacagcctgagctacgcagtaggaacccctccccctaaaataaaataaaagtttggtgtctaaaaaaaaaaaaaaaaaaaaaaaaaaaaaaaa

SEQ ID NO: 3203 - DNA, 1232 bp, Rattus norvegicus
  Genbank Accession No. NM_012992
gttttccgtccggcttctctcacactcaagtgcgcgcctccacctcatggaagactcgatggacatggacatgagccctcttaggcctcagaactaccttttcggttgtgaactaaaggctgacaaagattatcactttaaagtggataatgatgaaaatgagcaccagttatcattaagaacggtcagtttaggagcaggggcaaaagatgagttgcacatcgtagaggcagaagcaatgaactatgaaggcagcccaattaaagtaacactggcaactttgaaaatgtctgtacaaccaacagtttcccttgggggcttcgaaattacaccacctgtggtcttgaggttgaagtgtggttctgggcctgtgcacataagtggacagcacctagtagctgtagaggaagatgcagagtcagaagatgaagatgaggaagatgtaaaactcttaggcatgtctggaaagagatctgctcccggaggtggtaacaaagtcccacagaaaaaagtaaaacttgatgaagatgatgatgaggatgatgaagatgatgaggatgatgaagatgatgatgatgatgattttgatgaagaggaaactgaagaaaaggttccagtgaagaaatctgtacgagataccccagccaaaaatgcacaaaaatcaaaccaaaatgggaaagatttaaaaccatcaacaccaaggtcaaagggtcaagagtccttcaaaaaacaggaaaaaactcccaaaacacccaaaggacctagctctgtagaagacattaaggcaaaaatgcaagcaagtatagaaaaaggtggttctcttcccaaagtggaagccaagttcattaattatgtgaagaattgtttccggatgactgaccaggaggctattcaagatctctggcagtggaggaagtctctttaagaaaatggtttaaacagtttgaaataattctgtcttcatttctgtaatagttgctatctggctgtcctttttataatgcaaagtgagaactttccctactgtgtttgataaatgttgtccaggttcaattgccaagaatgtgttgtctaaaatgcctgtttagttttcaaggatggaactccgccctttacttggttttaagtatgtatggaatgttatgataggacatagtagtagtggtggtcagatgtggaaatggtagggagacaaatatacatgtgaaataaactcagtattttaataaagt

SEQ ID NO: 3204 - DNA, 3581 bp, Rattus norvegicus
  Genbank Accession No. NM_012993
tgaggagtaggaggaggaggtgggcctggggagcgggatgtccagcgctacgacttgctggtgaatgctgaggagagtcgcggttgctgcagtctttgccaccgggaggaagttgcggtgtgaggccgggcgggacgtcacggctgtgggacgaatcgaagcacggggtctgtgcgaagaatcagcgaaaccgtttcctacgctgaccatgcctggcagaaacaaggcgaagtccacctgcagttgcccggacctgcagcctaatggacaggacttgggcgagagcggccgggttgctcgtctaggagcggatgaatctgaggaggagggacggtctctcagtaatgtcggggaccctgagatcatcaagtctcccagcgatcccaagcagtaccgatacatcaaattacagaatggcttgcaggctcttttgatttcagatctaagtaatgtggagggtaaaacaggaaatgcaacagatgaagaggaagaggaagaagaggaagaggaggagggggaagaggaagaggaagaggaagaagacgatgacgatgatgatgatgaagactctggagctgagatacaggatgatgatgaggaaggctttgacgatgaagaggaatttgatgatgatgaacatgatgatgatgatcttgataatgaggaaaatgaactggaagaactggaagagcgggtggaagccagaaagaaaaccactgagaaacagtctgcagcggctctgtgtgttggagttgggagctttgctgatccagatgacctgcctgggctggcacactttttggagcacatggtattcatgggtagtttgaaatacccagatgagaatggatttgatgccttcctcaagaaacatggaggtagtgataatgcctcaaccgattgtgaacgcacagtctttcagtttgatgtccagagaaagtatttcaaggaagccctggatagatgggcccagttcttcatccatccactgatgatcagagatgcaattgaccgagaggtggaagctgtggacagtgagtatcagcttgcaagaccttctgatgcaaacagaaaagaaatgttgtttggaagtcttgctagacctggacatcctatggggaagtttttttggggaaatgctgagacactcaagcatgaaccaaagaagaataatattgatacacatgccagactgagagagttctggatgcgttactactctgctcattacatgaccttagtagtccagtccaaagaaaccttggacactttggaaaagtgggtgacggagatcttctctcagataccaaacaatgggctacctaaaccaaactttagccatttaacggatccttttgacacaccagcatttaacaaactttatagagttgttccaatcagaaaaatccatgctctgaccatcacgtgggcccttcctccgcagcagcaacactacagggtgaagccacttcattatatctcctggcttgtggggcatgaaggcaaaggcagcatcctttcttaccttagaaaaaagtgctgggctcttgcgttgtttggtggaaatggtgagacaggttttgagcaaaattctacctactcagtgttcagcatttctatcactctgactgatgaggggtatgagcatttttatgaggttgctcacactgtctttcagtatttaaaaatgctgcagaaactaggtccggagaaaagagtttttgaagagattcagaaaattgaggataatgaatttcattaccaagaacagacagatccagttgagtacgtggagaacatgtgtgagaacatgcagctgtacccacgtcaggactttctcactggagatcagcttctgtttgagtacaagccagaagtcattgccgaggcccttaatcagctagttcctcaaaaggcaaatctcgtgcttctgtctggtgctaacgagggaagatgtgacctcaaggagaagtggtttgggactcagtacagcatagaagatattgaaaactcttggactgaactgtggaagagcaattttgacttaaattcagaccttcatctaccagctgaaaacaaatacatagccacggactttacattgaaggcttttgattgccctgaaactgaataccctgctaaaattgtgaataccccacaaggttgcctgtggtataagaaagacaacaaattcaaaatccccaaagcctatatacgatttcatctgatctcacctttgatacagaaatctgcagcaaatgttgtcctcttcgacatcttcgtcaacattcttactcacaaccttgctgagccagcctatgaagccgatgtggcccagctggagtataaactggtagccggagagcacggtttaatcatccgagtgaagggattcaaccacaaactacctctgctcttccagctcatcattgactacctgactgagttcagctccacgcccgctgtcttcaccatgataactgagcagctgaagaagacctacttcaacatcctcatcaagcctgagactctggccaaagatgtgcggcttttaattctggaatattcccgctggtctatgattgacaagtaccgagctttgatggatggcctttcccttgagtctctgctaaactttgtcaaggattttaaatcccaactctttgttgagggcctggtgcaagggaatgtcaccagcacggaatcgatggatttcctaagatacgttgttgacaagctgaacttcgtgcccctggagcgggagatgcccgtgcagttccaggtggtggagctgccgagcggccaccacctgtgcaaagtcagagccctgaataagggggacgccaactctgaagtcactgtgtactaccagtcaggtacaaggagtctgagagaatacacgctcatggagctgcttgtgatgcacatggaggagccctgctttgacttccttcgaaccaagcagacccttgggtaccacgtctacccgacctgtaggaacacatctggcattctaggattttctgtaactgttgggactcaggcaaccaaatacaactctgaaactgttgacaagaagatagaagaatttctttccagctttgaggagaagattgagaacctcacagaggatgcattcaatactcaggtcacagctctgatcaagttgaaagagtgtgaggacacccacctcggggaggaggtggacaggaactggaatgaagtggtgacacagcagtatctctttgaccgccttgcccatgagattgaagcgctgaagtctttctcaaagtcagacctggtcagttggttcaaggctcacagaggacctgggagtaaaatgctcagcgttcatgttgttggatatgggaagtatgaactggaagaggacggcgctcccgtttgtgaggatccgaattctcgtgaagggatgcagctaatctacctgccaccctctcctctcctggcagagtccaccacccccattactgacatcagggccttcacagcgacgctcagcctcttcccctaccataagatagtcaaataaactgcagtctcactggcctgaagcaacttgt

SEQ ID NO: 3205 - DNA, 2460 bp, Rattus norvegicus
  Genbank Accession No. NM_012998
ccccggcgccaacctagctgccccgcccgctgccgacgtccgacatgctgagccgtgctttgctgtgcctggccctggcctgggcggctagggtgggcgccgacgctctggaggaggaggacaacgtcctggtgctgaagaagagcaacttcgcagagccggcggcgcacaactacctgctggtggagttctatgccccatggtgtggccactgcaaagcactggccccagagtatgccaaagctgctgcaaaactgaaggcagaaggctctgagatccgactagcaaaggtggacgccacagaagagtctgacctggcccagcagtatggtgtccgtggctaccccacaatcaagttcttcaagaatggagacacagcctccccaaaggaatatacagctggcagggaagctgacgacattgtgaactggctgaagaaacgcacaggcccagcagccacaaccctgtctgacactgcagctgcagagtccttggtggactcaagcgaagtgacggtcatcggcttcttcaaggacgcagggtcagactccgccaagcagttcttgctggcagcagaggctgttgatgacataccttttggaatcacttccaatagcgatgtgttttccaagtaccagctggacaaggatggggtggtcctctttaagaagtttgatgaaggccgcaacaattttgaaggtgagatcaccaaggagaagctattagacttcatcaagcacaaccagctgcctttggtcatcgagttcactgaacagacagctccaaagattttcggaggtgaaatcaagacacatattctgctgttcctgcccaagagtgtgtctgactacgatggcaaattgagcaactttaagaaagcggccgagggctttaagggcaagatcctgttcatcttcatcgatagtgaccacactgacaaccagcgcatacttgagttctttggcctgaagaaggaggaatgtccagctgtgcggcttattaccctggaggaagagatgaccaagtacaaaccggagtcagacgagctgacagctgagaagatcacacaattttgccaccacttcctggagggcaagatcaagccccacctgatgagccaggaactgcctgaagactgggacaagcagccagtgaaagtgctagttgggaaaaactttgaggaggttgcttttgatgagaaaaagaacgtgtttgttgaattctatgctccctggtgtggtcactgcaagcagctagccccgatttgggataaactgggagagacatacaaagaccatgagaatatcgtcatcgctaagatggactcaacagccaatgaggtggaagctgtgaaggtgcacagctttcccacactcaagttcttcccagcaagtgcagacagaacggtcattgattacaacggtgagcggacactagatggttttaagaaattcttggagagcggtggccaggatggagcgggggacaatgacgacctcgacctagaagaagctttagagccagatatggaagaagacgacgatcagaaagccgtgaaggatgaactgtagtgcagaagccagatctgggcgcctgaacccaaaacctcggtgggccatgtcccagcagcccacatctccggagcctgagcctcaccccaggagggagcgccatcagaacccagggaatctttctgaagccacactcatctgacacacgtacacttaaacctgtctcttctttttttgcttttcaattttggaaagggatctctgtccaggccagcccatcttgaagggctacgttttgttttaattggtggtgtacttttttgtacgtggattttgtcccaagtgcttgctaccatatttggggatttcacactggtaatgtctttcctgttagagaggtttatgctatcacttcagatttcgtctgtgagatgtttcatcttcctgacatgtctccatgtcgaggtacttgttccaccacgcagacctccctgagaccccttcctgccctgcgcaggaggcgatggttctgggtcgtatgctctctctctctccaccttgtactagtgttgccatgacagcatggcttttgtagtttgcatttaacctggggatttctgcatcctgtcagagggtgggtccccacgtgtggaaaagagacagtggtggcttgctgccaggctcaggccaggcctggacagctctcactcttcttaagccagaactaccgaccagccggccggctgtgggcacattactctggctgctggatcctcttccagcatggcatgtggcctgtgtgaggcagaaccgggacccttgattcccagactgggagtcagctaaggacactggggctgaatgaaatgcccattctcaaggtctatttctaaaccataatgttggaattgaacacattggctaaataaagttgaaattttactaccat

SEQ ID NO: 3206 - DNA, 3770 bp, Rattus norvegicus
  Genbank Accession No. NM_013000
gcgggcggctccagcgggcgggcggacggactccagagccgcttcccacgcgtcgggagcggaccgagcggacccggctggccgcgcatcgccctcgcccggggccatgaagtagctgcggccgccagccctgccatcccgcggcccggccactgcccgctgccctggtcctgcgcggacatggccggacgcgcccgcagcggtctgctactgctgctgctggggctgctcgccctgcagagcagctgcctggccttcagaagcccactttctgtctttaagaggtttaaagaaactaccagatcattttccaatgaatgccttggtaccattggaccagtcacccctcttgatgcatcagattttgcgctggatattcgcatgcctggggttacacctaaagagtctgacacatacttctgcatgtccatgcgtctgcctgtggatgaggaagccttcgtgattgacttcaagcctcgtgccagcatggatactgtccaccatatgctgctgtttggatgcaatatgccctcgtccactggaagttactggttttgtgatgaaggaacctgtacagataaagccaatattctatatgcctgggcaaggaatgctccccccacccggctcccgaaaggtgttggattcagagttggaggagaaactggaagcaaatacttcgtccttcaagttcactatggcgatatcagtgcttttcgagataatcacaaagactgctctggcgtgtccgtacatctcacacgtgtgccccagcctttaattgcgggcatgtaccttatgatgtctgttgacactgtcataccaccaggagagaaagtagtgaatgctgacatttcgtgccaatacaaaatgtatccaatgcatgtgtttgcctacagagtccacactcaccatttaggtaaggtggtgagcggatacagagtaagaaacggacagtggacactgattggacgccagaacccccagctgccacaggctttctaccctgtggaacaccccgttgatgttacttttggtgatatactggcagccagatgtgtgttcactggtgaagggaggacagaggccacccatatcggcggcacttctagtgacgaaatgtgtaacctgtacatcatgtattacatggaagccaaatatgcactttccttcatgacctgtacaaagaacgtggctccagatatgttcagaactatcccagcagaggccaatatcccaattcctgtcaaaccggacatggttatgatgcacgggcatcacaaagaagcagaaaacaaagaaaagagtgctttaatgcagcagccaaaacagggagaggaagaagtattagagcagggtgatttctattcactgctttccaagctgctaggagaaagggaagatgttcatgtgcacaagtataatcctacagaaaagacagaatctgggtcagacctggtagctgagattgcaaacgtggtccagaaaaaggaccttggtcggtctgacgccagagaaggtgcagagcatgaggaatggggtaatgctatcctagtcagagacaggatccacagattccaccagctagagtcaactctgaggccagctgagagcagagctttctcgttccagcagcctggcgaaggcccttgggaaccagaaccctcaggagatttccatgtggaagaagaactggactggcctggagtgtacttgttaccaggccaggtttctggggtggccctggattctaagaataacctagtgattttccacagaggtgaccatgtttgggatggaaactcttttgacagcaagtttgtttaccagcaaagaggtcttgggccaattgaagaagacaccatcctggtcattgacccaaataatgctgaaatcctccagtccagtggcaagaacctgttttatttaccacacggcttgagcatagatacagatggaaattattgggtcacagatgtggctctccaccaggtgttcaaattggacccgcatagcaaagaaggccctctcttaattctgggaaggagcatgcaacctgggagtgaccaaaatcatttctgccagcccaccgatgtggctgtggagcccagtactggagctgtcttcgtgtcagacggttactgtaacagtcggattgtgcagttttcaccaagcggaaagttcgtcacccagtggggagaagagtcctctggaagcagtcctaggccaggccagttcagtgttcctcacagtttggcccttgtgcctcatttggaccagttgtgtgtggcagacagggaaaatggccgaatccaatgcttcaaaactgacaccaaagaatttgtgagagagattaagcacgcatcatttggaaggaatgtctttgccatttcatatataccaggtttcctctttgccgtaaacgggaagccttactttggagaccaagagcccgtgcaaggatttgtgatgaacttttccagtggggaaattatagacgtcttcaagccagtacgcaagcacttcgacatgcctcatgatattgtggcttctgaagatgggactgtgtacattggagacgcacacacaaacaccgtgtggaagttcaccctgactgaaaaaatggagcatcggtcagttaaaaaggctggcattgaagtccaggaaatcaaagaagccgaggcagttgttgaacccaaagtggagaacaaacccacctcctcagaattgcagaagatgcaagagaaacagaaactgagcacagagcccggctcgggagtgtccgtggttctcattacaacccttctggttattcctgtgctggtcctgctggccattgtcatgtttattcggtggaaaaaatcaagggcctttggagatcatgaccgcaagctcgagtcaagttctggaagagtcctgggaagattccgaggaaagggaagcggcggcttaaatctgggaaatttctttgcaagtcgaaaaggctacagcagaaaagggtttgaccgagtgagcacagaggggagtgaccaagagaaagatgaggacgacggaactgagtctgaagaggagtactcggccccgctgcccaagcctgcaccttcctcctgagcctccagccttcgcccgggtagctggactgaggtttaccaggatgcccagactccttcccctttagcgcgtgtaaagttctgtgcatttgattgtaaactgtactcgtcagtgtgggactgtacacaccttatttacttcatttggctccgttggcttctgttctctaggtgaggagttccccaccagttcactccagtgccattgtctttatatgaacttagcgtagagaagccgccctcctcttccaaggtagcgctccaacccccgagggaagtttagctcattcacatttggagacgttttagttggtggatgtaaatagccctattctctgcttgaacacagtattctcccagtccacacccatcgccagtgtctttctttggtgcctttcctgttcagcattctcagcctgtggcagtgaagagaaccaacctgccacacgacgaaaagctgctaaatctccttctatttttttaaaatcactaacattatattgcaatgagagaaattttaaaaagtctctatttaaattctttttttaaatttctcctcagttggtgtgtttccgggatgtcttatttttagatggttacactgttagaacactatttttcagaatctgaatgtaatttgtgtaataaagtgttttcaga

SEQ ID NO: 3207 - DNA, 893 bp, Rattus norvegicus
  Genbank Accession No. NM_013003
tccccgctgagttcatcaccagggacaggtgacctgagctgcccctggagcccagctcccatttccttctggttctggccgatctcttcgttatgagctggctgctgggttacgtggaccccacagagcccagctttgtggcggctgtgctcaccattgtgttcaatccactcttctggaatgtggtagcaaggtgggagcagagaactcgcaagctgagcagagccttcgggtccccttacctagcctgctattccctgggcagcatcatcctgcttctgaacatcctccgctcccactgcttcacacaggccatgatgagccagcccaagatggagggcctggatagccacaccatctacttcctgggccttgcactcctgggctggggactcgtgtttgtgctctccagcttctatgcactggggttcactgggacctttctaggtgactactttgggatcctcaaggagtccagagtgaccacatttcccttcagcgtgctggacaaccccatgtactggggaagtacagccaactacctaggctgggcacttatgcacgccagccctacaggcctgctgttgacggtgctggtggcactcgtctacgtggttgctctcctgtttgaagagcccttcactgcggagatctaccggcggaaagccaccaggttgcacaaaaggagctgacagggccatgagggacctttggaaagccggattgcctcccggctgacccaagcaacaacccttctcggggagagcagcgctggccattgtacctgtgccttggaaaccagtcatgggggtgctcaggcattatgtcatgtgactgctgagacccccatccccaccaatccctgacacactaataaaggctttgtgacctcc

SEQ ID NO: 3208 - DNA, 1687 bp, Rattus norvegicus
  Genbank Accession No. NM_013011
cccagagactgccgagccgggtccgtgtgccgccacccactccggacacagaatatccagttatggataaaaatgagctggtgcagaaggccaagctggccgagcaggcagagcgatacgatgacatggcagcctgcatgaagtctgtcactgagcaaggagccgagctgtctaacgaggagaggaaccttctctctgttgcttataaaaacgttgtaggagcccgtaggtcatcttggagggtcgtctcgagtattgagcagaagacggaaggtgctgagaaaaagcagcagatggctcgagaatacagagagaagatcgagatggagctgagggacatctgcaacgacgtactgtctcttttggaaaagttcttgatccccaatgcttcgcagccagaaagcaaagtcttctatttgaaaatgaagggtgactactaccgctacttggctgaggttgctgctggtgatgacaagaaaggaattgtggaccagtcacagcaagcataccaagaagcatttgaaatcagcaaaaaggagatgcagccgacacaccccatcagactgggtctggccctcaacttctctgtgttctactatgagatcctgaactccccagagaaagcctgctctcttgcaaaaacagcttttgatgaagccattgctgaacttgatacattaagtgaagagtcgtacaaagacagcacgctaataatgcagttactgagagacaacttgacattgtggacatcggatacccaaggagacgaagcagaagcgggagaaggaggggaaaattaaccggccttccaacctttgtctgcctcattctaaaatttacacagtagaccatttgtcatccatgctgtcccacagatagtttttttgtttacgatttatgacaggtttatgttacttctatttgaatttctatatttcccatgtggttttatgttttaatattaggggagtagagccagttaactttagggagttactcgttttcatcttgaggtggccaatatgggatgtggaatttttacatgagttacacatgtttggcatagttagtacttttggtccattgtggcttcagaagggccagtgttcaaactgcttccatgtctaagcaaagaaaactgcctacatattggtgtgtgctggcggggaataaacaggataatgggtccagtcatgagtgtagtctgtgtgggtactgtaaggcttggagcacttgtgaggctgggacacgaacaccctgtggatgcacgctaagaccgtgtgtctgcgtgcacacccttgaccacagctccagaagttgtctgtagacaaagttgtgacccaatttactctgataagggcagaaacggttcacattccattatttgtaaagttacctgctgtttgctttcattatttttgctacacattttatttgtatttaaatgttttaggcaatctaagaacaaatgtaaaagtaaagatgcagtacaaacgagttgcttggtgttcccggctccatgcggatcaagcacagcggtaaacaaaatcccatgtatttaactttttttttttaagttttttgttttgttttgtttttgcttttgtgattttttttctctttttgatacttgcctaacatgcatgtgctgtaaaaatagttaacagggaaataacttgagatgacg

SEQ ID NO: 3209 - DNA, 2175 bp, Rattus norvegicus
  Genbank Accession No. NM_013013
attgcagcctgcggagtgaagcgcgccatgtatgctctcgctctcctcgccagccttctggtcaccgctctgaccagccctgtccaggacccgaagatatgctctgggggctcagcagtagtgtgcagagatgtgaagacggcggtggactgtagggctgtgaagcactgccagcagatggtctggagcaagcccacagcaaaatcccttccttgtgacatatgcaaaacggttgtcaccgaagctgggaacttgctgaaagataatgctactgaggaggagatcctccattacctggagaagacctgtgcgtggattcatgactccagcctgtcagcctcttgcaaggaggtggttgactcttacctgcctgtcatcctggacatgattaagggggagatgagcaaccccggggaagtgtgctctgcgctcaacctctgccagtcccttcaggagtacttggccgagcaaaaccagagacagctggagtccaacaagatcccggaggtggacctggcccgcgtggttgcccccttcatgtccaacatccctctcctgctgtaccctcaggatcggcctcgcagccagccgcagcccaaggctaacgaggacgtctgccaggactgtatgaagttggtgactgacatccagactgctgtgaggaccaactccagctttgtccagggcttggtggaccacgtcaaggaggattgtgaccgcctcgggccaggcgtgtctgacatatgcaagaactatgttgaccagtattctgaggtcgccgtccagatgatgatgcacatgcaacccaaggaaatctgtgtgatggttggcttctgtgatgaggtcaagagagtgccaatgaggactctggtccccgccactgaggccatcaagaatatcctccctgccctggagctgacggacccctatgagcaggatgtgatccaggcccaaaatgtgattttctgccaagtttgtcagcttgtgatgcgcaagttgtctgaactgattatcaacaatgccactgaggaacttctaattaaaggtttgagtaaagcctgctccctgctccctgctcctgcttcaaccaagtgccaggaagtgctggtaacatttggcccctccctgttggacgtcctcatgcatgaggtgaacccgaactttctgtgcggtgtgatcagcctctgttctgccaacccgaatttggtggggacccttgaacaacctgcagcagccattgtatctgcactgcccaaagagcctgcaccgccaaaacagcctgaagagcccaagcagtctgcattgcgcgcccatgtgcctcctcagaagaacggggggttctgtgaggtgtgcaagaagctggtcatctatttggaacataacctggagaaaaacagcaccaaggaggagatcctggctgcacttgagaagggctgcagcttcctgccagacccttaccagaagcagtgtgatgaatttgtggctgagtatgagcccttactgctggaaatccttgtggaggtgatggatccttcctttgtgtgctcgaaaattggagtctgcccttctgcctataagctgctgctgggaaccgagaagtgtgtctggggcccaggctactggtgtcagaacagtgagactgctgcccgatgcaatgctgtcgatcattgcaaacgccatgtgtggaactagctttccagcttgcagaagtcgcctacttgtgggtctagggtaatgaacacatagatctatttgacttaataagtaggagcccccttttgtcttcccccatctcctgtcccttactatagcatttctgtcacgtaagaggcgctgacagcacttccgtgtcccatttctgctccaaggatgaggacacttgggcttcagctccccggctgcccttttcacccacctgctggaggggggtggtgagccagagggcaggagcatgtgctcagccctctcggtgtgtagggatcatggccatctcctagcgtcagggaactgcgcaacttcctgtgctaccaaggagtttaatttggatgcttagaagcacagagtgatcaggcctttagagtgtgggatggccattgccacagcacagagacttgagaagcacctgctgcaggtggcttgctgtgacgttgccgtccctggtcagccttcattctg

SEQ ID NO: 3210 - DNA, 3709 bp, Rattus norvegicus
  Genbank Accession No. NM_013016
cgcgctcaccgccgatctcccatccttgctctgcagccgcggcccatggagcccgccggcccggcccctggccgcctagggccgctgctgttctgcctgctgctctccgcgtcctgtttctgtgcaggagccagcgggaaagaactgaaggtgactcaggctgacaaatcagtgtctgttgctgctggagattcggccactctgaactgcactgtgtcctccctgacgcctgtgggacccattaagtggttcaaaggagaagggcaaaatcggagcccgatctacagtttcataggaggagaacactttcctcgaattacaaatgtttcagatgctactaagagaaacaatatggactttagcatctgtatcagtaatgtcacccctgaagatgctggcacctactactgtgtgaagttccagaaaggaatagtagagcctgacacagaaattaaatctggagggggaacaacgctctatgtactcgccaaaccttcttcaccggaagtatcgggcccagactccaggggctctcctggacagacagtgaacttcacctgcaagtcttacggcttctctccccggaatatcaccctgaagtggctcaaagatgggaaagaactctcccatttggagaccaccatctccagtaaaagcaatgtctcctacaacatctccagcacagtcagcgtgaaactaagccccgaggacattcattctcgggtcatctgcgaggtagcccacgtcaccttggaaggacgcccgcttaatgggaccgctaacttttctaacatcatccgagtttcacccaccttgaagatcacccaacagcccctgacgcccgcgagccaggtgaacctcacctgccaggtgcagaagttctaccccaaggctctccagctgaactggctggagaatggaaacttatcacggacggacaagcccgagcatttcacagacaacagggatgggacctataattacacaagcctgttcctggtgaactcatctgctcacagagaggatgtggtattcacgtgccaggtggagcatgacagtcagccagcgatcaccgaaaaccataccgtgcgggcatttgcccactcgagtagtggaggcagcatggaaaccatccctgataataatgcttactacaactggaacgtcttcatcggtgtgggtgtggcgtgtgctttgctagtagtcctgctgatggctgccctctacctcctccgaatcaaacagaagaaagccaagggctcaacttcttccacacggttgcacgagcccgagaagaatgccagggaaataacccagatccaggacacaaatgacatcaacgacatcacatacgcagacctgaatctgcccaaagagaagaagcccgccccccgggtccccgagcccaacaaccacacagaatatgcaagcattgagacaggcaaactgcctaggccagaggataccctcacctatgctgacctggacatggtccacctcaaccgggcacagccaacccccaagcctgagccatccttctcagagtatgccagtgtccaagtccagaggaagtgaatggggctgtggttggctctaggccccatccccacaagttttcttgtcctacatggagtggccatgatgaggacaaccagccagccagccctgtctccagaaggccaggtggcacaggtcctaggaccaggggtaagggtggcttctgtcttccctccgtggctctccaacacctcttggacacccatgtccccttcttctggagctgggtgttgcagaaccagagggggaactggagaaagctgcctagaatccaagaagcgttgtgcctcagcccatcacactgggtctggatcctggtcttggcaacccccaggttgcttccttgatgctccagcgcctggtcttctgtgtggagaagagttcaccatctccatccaacttgagcttcggggccagactccctttagatcagaccgccccatgtgtggaagaactacaccaggagtcaacaagttttcacatgtgtgaagaactacaccaggagtcaacaagtttacgccaacagtgctagcctccccacctcccaggctgacgagccctgaggagaaggaaccctcttccccctagaccagcagagactccctgggcatgttcagtgtggccccacccttccagtcccagctcgcttcctccagctagcactaactcaacagcattgctctgtggacgcctgtaaattattgagaaatgtgaactgtgcagtcttgaagctaaggtgttagaaaatttgatttgtgctgtttagttgttgttgggtttcttttcttttcttttttttcttcctttttctttcttctttttttcttttcccccttaaaacaacagcagcagcatcttggctctttgtcatgtgttgaatggttgggtcttgtgaagtctgaggtctaacagtttattgtcccggaaggattttcttatagcagaaacagattttttttccaattcccagcaccctgaggaccaagaaggatccctctgttgtcattttcagcactcagcgtcactgggatgagccaggctctgtccccacagctggcccttggcctccatggctactgtggtaagtgcagccttgtctaatccagtgctgacgttggccattcctcattgaggagagaaggtcagtgacaaactcacaagcactgcagaggcatacggagagaagggacgctcggccagcacccggtattccagcgctctgaggtaatcagtgcaaggagtctgttattaccatcagacctcagcaggatcatactggaacagaacctgatcatacctgtgacaacacagctgtcagccagggcaaaccaccccactgtcccagagtctgggcagaggctctgacccccacccttcaaactggatgtcggggcctggctgggcccaatggcaagcagatgttgcaaccctagctatctggtcttaacatgcagctcagtaagttgaggcgctaatgtccccccatgccgggggattcctggttccggctcttcaagtaagaagctgattcaacctgcctgtttctgtaggtgtgacagggatgtcaggaaaacagccaggactcatctctatagggctggtgacctgatacttcccataaaggcatccaggagttagctgacccaatagtcagagttgacctcactggcctagcaaaccgtaacttgtctttggcccagccatggtcttgggctgtcttctaattccaaagggttggtaggtaaagatccatcctcttcccctctgccaagagacatcacgtgtgtacacacacacatgcgcgcgcgcgcacacacacacacacacacacacacacacacacacacacacacacgggtgtataggtgagttaaaaggatgtcctcgctgacatcctaattttgtcttaagtttttttggagggagaaaggaaagaggcagggaagatacgtagctctagctttagtcaggcagcctggggggatccccaagcctatgtatggaaccctggtacgaaagcgccctgtgaggagtgggatttcagttttatctgtagaccagatgagaaggagaaaggccccattttgtacatagttgcaacttaaaatttttggcttgcaaaatatttttgtaataaagatttctgggtaac

SEQ ID NO: 3211 - DNA, 279 bp, Rattus norvegicus
  Genbank Accession No. NM_013025
atgaaggtctccaccactgcccttgctgttcttctctgcaccatggcgctctggaacgaagtcttctcagcgccatatggagctgacaccccgactgcctgctgcttctcctatggacggcaaattccacgaaaattcattgctgactattttgagaccagcagcctttggtcccagccgggtgtcattttcctgaccaagagaaaccggcagatctgcgctgaccccaaagagacctgggtccaagaatacatcactgagctggaactgaatgcctga

SEQ ID NO: 3212 - DNA, 2410 bp, Rattus norvegicus
  Genbank Accession No. NM_013026
gcgggctagaggagacagagcctggcgctgaggaaggaatctggcagtcgagagctgactccagccgacggaacctgcagcccttgctccggacagcagcgcgccgggcaggagtccgggatagcgaagcgcagagcaatcagcagagcctgcccggagctccgtgcaaccggcaactccgacccacatagcccgccgagctcccgccgccggtccgggcagcatgagacgtgcggcgctctggctttggctctgcgcgctggcgctgcgcctgcagcctgccctcccgcaaattgtcaccgcaaatgtgcctcctgaagaccaagatggctctggggacgactcagacaacttctctggctcaggcacaggtgctttgccagatatgactttgtcacggcagacaccttccacttggaaggatgtgtggctcctgacagctacacccacagctccagaacccaccagcagggataccgaggccaccctcacctctatcctgccggctggagagaagcctgaggagggagagcccgtggcccacgtggaagcagagcctgacttcactgctcgggacaaggagaaggaggccaccaccaggcctagggagaccacacagctcccagtcacccaacaggcctcaacagcagccagagccaccacggcccaggcatctgtcacgtctcatccccacggggatgtgcaacctggcctccacgagaccttggctcccacagcacccggccaacctgaccatcagcctccaagtgtggaggatggaggcacttctgtcatcaaagaggttgtggaggatgaaactaccaatcagcttcctgcaggagagggctctggagaacaagacttcacctttgaaacatctggggagaacacagctgtggctggcgtcgagcctgaccttcggaatcagtccccagtggatgaaggagccacaggtgcttctcagggccttttggacaggaaggaagtgctgggaggtgtcattgctggaggcctggtgggcctcatctttgctgtgtgcctggtggctttcatgctataccggatgaagaagaaggacgaaggcagttactccttggaggagcccaaacaagccaatggcggtgcctaccagaaacccaccaagcaggaagagttctacgcctgatggggaaatagttctccccccacaacccctgccactcactaggctcccatttgcctcttctgtgaaaaacttcaagccctggcctccctaccgctgtgccgtctcctctgcacccagacccttctgcccgagcggtctcagggtgtgctgggaattccttctcctctgacttctgctagaagcttgggtgcagagggtttcttgcattttgtctttctaccacagccacgcctgttgtccactcttctgacttggcttctccaaatgggaggagactcagctctggacagaaagggaacccaactgctttggacctagatggcctattgtgactggaggatcctgaggacaggagaggggcttcaacagacacgccatagcacttacccatagagaccattagggttggctgtgctgtggtagggaaggagtccagggctccttggaattcacttctcattgtggggaggtctactttagacaacttggttttgcacatgtttcctctaatttttctgttttagagccccagcagaccttacttctggggtaaggcaagtcagttgactggtgtccccacctcgcttccctaatctacattcgggagaccgcatcggggttaaataagacttttcattttcgtttttgtttttaacctagaagaaccaaatccggacaccaaaacgtaggcttagtttgtgtgttgtctctgagtttgtcgctcatgcgtgcaacagggtatggactatctgtttggtgccccatttttggtggcccataagtaggctggctagcccaggatgccatggagtagccacctcttgaccagtcatgcctgtgtgcatagactcagggccatggcctttgtgacattggaagagcctgtgtgagaacttcctcctagattagtctagggatggaggggaggagactgtacagtttgggaggaggggtgacaagggtgtccaagactctcccacctttggtactaactctggtcaccctttctcctggaagttgacaagacacatcttgagtatggctggcactggctcctccatcaagaaccaagttcaccttcagctcctgtggccctgttcccaggctggagtcagaaatgtttcccaaagagtgagagtcttttgcttttggcaaaacgctacttaatccaatgggttctgtacagtagattttgcagatgtaataaactttaatataaaggagtcctatgaaaaaaaaaaaaaa

SEQ ID NO: 3213 - DNA, 664 bp, Rattus norvegicus
  Genbank Accession No. NM_013027
tgctgctagttggtcgggtcctcgctttgtgcggggatgcgacgtgcagcaatggcgctagccgttcgagtcgtgtattgtggagcttgaggctataagcccaagtatctccagctcaaggagaagctagaacatgagttccccggatgcctggacatctgtggcgaggggactccccaggtcaccgggttctttgaagtgacggtagccgggaagttggttcactccaagaagagaggtgatggctacgtggatacagagagcaagttccggaaactggtgactgccatcaaagccgccttggctcagtgccagtgagccctagaggcagggtcctgaaggctcctggccggcctttcttggcagccgcttcatgacaggaaggactgaaatgtctcaaagacctgtggtctttcttcgatgttctgcggccaccaagtcaggccagagatggattctgtgtgtgggtgccttcccagaatctacctgtgcacgcaccccgccctgccctcccgccctcttcctcacctctctctgaattcccccatgtttcctaccttccctcctgctttggtttcccgtctccccctcaagactgcaagaagacgggcagccgtgtcgccaggtgttcctggttgaataaaggttggccaaggcaacctga

SEQ ID NO: 3214 - DNA, 1588 bp, Rattus norvegicus
  Genbank Accession No. NM_013028
ggaattcggcacgagccgggagctggacatgggagccgcggagcggagcagggagcccggcagcccgcggctgacggaggtgtcccctgaactgaaggatcgcaaagaggatgcgaaagggatggaggacgaaggccagaccaaaatcaagcagcggcgaagtcggaccaattttaccctggaacaactcaacgagctggagaggcttttcgatgagacccactatccagacgcttttatgcgcgaggaactgagccagcgactggggctatctgaggcccgagtacaggtttggtttcaaaatcgaagagctaagtgtagaaaacaggaaaatcaacttcataaaggtgtccttataggggctgctagccagtttgaagcttgtagagttgcaccctatgtcaacgtaggtgctttaaggatgccatttcagcaggatagtcattgcaacgtgacgcccttgtcctttcaggttcaggcgcacgtgcagctggacagcgccgtgcgagccgcgcaccaccacctgcatccgcacctggccgcgcacggcccttacatgatgttcccggcaccgcccttcggactgccgctggccacgctggcggcggactcggcctccgccgcctcggtggtggctgccgccgccgccgccaagaccaccagcaagaactccagcatcgcggatctcagactgaaagctaaaaagcacgcggccgccctgggtctgtgacgccggcgccacggccacggtcggtggagccttctatgcggcgcgaccccgcacgctctccgcgaccggctgcttctcccgcacccgcttcggaccgactaagcctgtcccttccccgctgactgccgccttttctttctgcaccctggatccctagggcgggactctgcgctggacccgggatcccacgaggaccaccagcccgggctcctgccacccgcccttgggactaaaattcggctttgtaggagcgggtttggggaagtctggatagagactggacaaaggagtgtggcaacagtgaccacagctgcggcgacggactcgttcataggaataaaatcttgctaacaacaaatgagcaaaaacaaaaaaggatagagaacaaactaaaaaaagaaaatgagaaagggggcttgtttcttattgctatttggctggaattagagagagaacgatgaagcaaaacaattcttaaaattattttgtacataaaaatacggaaaaataacctggatgaatcttgagagaaaggggggagggatttaccaactaaaatgtatgtttttttttaaatggtccaaggaaacaaaacagaaggaagaggtatactatttaagaattaagatgaaaaaaaaaagcgcagctgggaagttcacaggttttgaagctgacctttttctgcgaagttcactttaatacgagacatttgataagagaggcgggcctccttttacgttgaatctgatgctttgagttttaaaacaccatgtttggaagagcaagaagagggaagacagtgtggaaacgaggagggaaaaaaggacgttcatacaaaaaaaaaaaaaaaaactcgag

SEQ ID NO: 3215 - DNA, 2440 bp, Rattus norvegicus
  Genbank Accession No. NM_013030
agcagtcgagctggagctgagccatagtcaaggactcattgtgggtgcccatcatgatgtcctacagcgagagattggggggaccggctgtctccccacttccagtccgtgggagacacatggtgcatggggcagcctttgcttatgtccccagcccacaagtcctgcacaggattcctgggacaaccacctatgccatctccagtctgagcccggtagccctcacagagcacagctgtccctatggggaggtcctggaatgtcatgacccgctccctgccaagctggcccaggaagaggagcaaaagccagagcccaggctgtcccagaagcttgcccaggttggcacaaagctcctgaaggtgccgttgatgctaggcttcctttacctctttgtctgctccctggacgtgctcagctctgccttccaactggccggagggaaagtggctggggacatcttcaaggacaatgccatcctgtccaacccagtggcagggctggtggtgggaatcctggtgacagttctggtgcagagctccagcacctcgacatccatcattgtcagcatggtctcctctggcttgttggaggtgagctccgccattccgataatcatgggctccaacatcgggacctctgtcaccaacaccattgtggccctgatgcaggcgggggacaggactgacttcaggcgggcttttgcaggggcaacagtgcatgactgctttaactggctgtctgttctggtcctgctgcccctggaggctgccacgggctacctgcaccacgtcaccgggcttgtggttgcctccttcaacatccgtggtggccgtgatgcccctgaccttctcaaggttatcacagagcccttcacaaagcttatcatccagctggacaagtctgtgattaccagcattgccgtgggggatgagtccctgaggaatcacagtctcattcggatttggtgtcaaccagagacaaaagaggcttccacttctatgtccagggtagaggccattggcagccttgcaaacaccaccatggagaaatgcaaccatatcttcgtggatactgggctgcccgacctggccgtggggctcattctgctggcgggctccctggtggtcctgtgcacttgtcttatcctcctcgtcaagatgctcaactctctgctgaagggccaagtggccaatgtcatccagaaggtcatcaacacagacttcccagcccccttcacttgggtcacaggctactttgccatggtggtgggcgccagcatgacgtttgttgtccagagcagttccgtgttcacctcagccatcactccgctcattggcctgggtgtgatcagtattgagcgggcctaccctctcaccctgggctccaacattggtaccaccactacagccatcctggcagcactggccagccccagggagaagctctccagctcctttcagattgccctctgccacttcttcttcaacatctcgggcatcctcctgtggtacccgctgccctgcacacgtctgcccatccgcatggccaaggcactgggcaaacgcactgccaagtaccgctggtttgccgtcctctacctcctcgtgtgcttcctgctcctgccctcactggtgtttggcatttctatggcaggctggcaggctatggtcggtgtgggcacaccctttggggccctgctcgccttcgtggtgcttgttaacgtcctgcagagtcgaagtcccgggcacctccccaagtggctgcagacatgggacttcctaccccgctggatgcactctctgcagcccctggatggccttatcacaagagccaccttgtgctatgccaggcccgagccccgttcaccccaacttccccccagagtcttcctggaggagcttcctcctgccacgccctctccccgcctggcactgcccgctcaccacaatgccacccggctctaggctgcaggtccagactattgcctggaggcgagggacgggatttttacagagcccacagtagaaaggcacagcatgtttgtgagtgtgtgtgcatgcatgtagatgcatgtcacttgaggtacatgattttgtgccacccttgggtacctgtccctactcagggccacagcggggtgggctttttttgcaattaagaagcagtgtgcacaaattacatgctaggtcctgagcctttgtggccatcaggacaggagtatgcgagtgcatggtgtgggtacaggggatgcagatgcatgaggagcccccaaaattttctgggaagagtcggctatgccctctcaccttctcactacccttgtcccaacaggagaggcagaagagcagctggccttctgtatacatgagcctttcctctgccaattctgctaactgtgcatagaaaaagttttaaaagttgcatctgtcctgatcat

SEQ ID NO: 3216 - DNA, 2627 bp, Rattus norvegicus
  Genbank Accession No. NM_013033
gcgttcctgccgcgcagcccctccgtcgcggttcccctccctcggggctgatcattaactcaaaagcagtataaggagtgagtggccccggtgagccggtgagccggagggactcgtcgccaccgccatggacagtagcaccttgagccccgctgttactgccaccgatgcacccatccagtcctatgagcgcattcgcaatgcggctgacatatcagtcatcgtcatctacttcgtggtggtgatggctgtcgggctgtgggccatgttttccactaatcgtgggactgttggaggcttcttcctggcaggccgaagtatggtgtggtggccgattggagcctctctctttgccagtaacatcggaagtggtcactttgtggggctggcgggcacaggagcagccgcaggcattgccatgggtggcttcgaatggaacgccttggtgttcgtggtcgtgctggggtggctttttgtccctatttacatcaaggctggggtggtgacgatgccggagtatctgcggaagcgatttggaggcaagcggatccagatctacctttccgttctgtccctgctcctctacatctttaccaagatctcagcagacatcttctctggggctatattcatcaatctggccttgggcctggatatatacctggccattttcatcctgctggccatcaccgccctttacaccatcacagggggactggcagcagtaatttacacagacaccttgcagactgcgatcatgctggtgggatcttttatcctgactgggtttgctttccgagaagtaggagggtatgaggccttcatggataagtacatgaaagctattccaactttggtttctgatggaaacataaccgtcaaagaagaatgttacacacccagggccgactcgttccacatattccgagaccccattacgggggacatgccatggcctgggctcatcttcggcctgtccatcctcgccctgtggtactggtgtacggatcaggtcattgtgcagcgatgcctctcggccaagaacatgtctcacgtgaaggctggctgtaccctgtgtggctatctgaagctactgcctatgttcctcatggtgatgcccggaatgatcagccggattctatacacagacaaaatcgcctgtgtcctcccctcagaatgtaagaaatactgcggcaccccagtgggctgtaccaacatcgcctacccaacactggtggtggaactcatgcctaacggacttcgaggcctgatgctgtccgtcatgatggcttccctcatgagctccttgacctccatcttcaacagcgccagtactctcttcaccatggacatctacaccaagatccggaagggtgcatcggagaaggagctcatgattgcaggaaggttgttcatcctcgtgctgattggcatcagcattgcctgggtgcccattgtgcagtctgcccaaagcgggcagctctttgactacatccagtccatcaccagttacctggggccacccattgcagccgtcttcctgctggctattttctgcaagagagtcaatgaaccgggagccttctggggactgattctcggcttcctgattggaatctcccgtatgatcactgagtttgcctacggaactggaagctgcatggagcccagcaactgccccaagatcatctgcggggtccactatctgtactttgccatcatcctcttcgctatcagcgtcgtcaccgtcttggtcatctccctcctcaccaagcccatcccagacgtacacctgtaccgtctgtgctggagtctacgtaacagcacagaagagcgcatcgacctggatgcaggagaggaggagcccgtcgaggaggaccctaaagataccattgaaatagatgcagaagccccccagaaggagaaggggtgcttcaggaaggcatatgacctgttctgtgggctggaccaggataaaggaccgaagatgactaaggaagaggaggaagctatgaagctgaagatgacggacacttccgagaagcccttgtggaggacagtggtgaacatcaacggcatcatcctcctggcagtggctgtcttctgccacgcctattttgcctgaaccccgccttctgggggtagacttggcgactctggagttgttatttcccactagaccccgccactctgtagtggtaaggggaaactggccagttgtaaattttactcattcggataaaagatgtataagtgtgattatagacttgcttgaggaaaatgattaccctgctgtgaatttatgcctgtgaaaccagtgtgccacactcatccatcacaccagagctttggagtgacgttgactcagatgtagaaaaagtcataccgagacacagaggccctgtgttgtctgtctcaggtacgtccagcgtgtaactattgtttataattcttaaatactattttttaaaattgtggtctggttcctgacatttttctacctgacccctcaccaattcctcctcctcctcctattttttttttctaaaagaaatctcccatcatcgcatccctttagagttttttggttttttgttttgttttgttttttgtttttgtttttaatt

SEQ ID NO: 3217 - DNA, 1155 bp, Rattus norvegicus
  Genbank Accession No. NM_013036
atgaacacgcctgcaactctgcccctggggggcgaggacaccacctggacccctgggatcaacgccagctgggctccggatgaggaggaggatgcagtgcggtccgacggcacagggacagcgggcatggtaactatccagtgcatctatgcgctcgtgtgtctggtgggcctggtaggaaacgccctggtcatattcgtgatcctacgctatgccaaaatgaagacagccaccaacatctacctgctcaacctggccgtcgctgatgagctcttcatgctcagtgtgccatttgtggcctcggcggctgccctgcgccactggccgttcggggcggtgctgtgccgcgcagtgcttagtgtggacggccttaacatgttcacgagtgtcttctgcctcacagtgctcagcgtggatcgctatgtggctgtagtgcaccctctgcgagctgccacctaccggcggcccagcgtggccaagttaatcaacctgggagtgtggctagcatccttgctggtcaccctgcccatcgcagtcttcgctgacactaggccagctcgtgggggtgaggcagtagcttgcaacctgcactggcctcacccggcctggtctgcagtctttgtgatctatacttttttgctgggcttcctactcccggttctggctatcggattatgttacctgcttatcgtgggcaagatgcgtgctgtggccctgcgggctggctggcaacaacggagacgctcagagaagaagatcactaggctcgtgctaatggtggtgactgtctttgtgctatgctggatgccattctatgtagtgcagcttctgaatctgtttgtcaccagcctcgatgccactgtcaaccatgtgtccctcatcctcagctatgccaacagctgtgccaacccgattctctatggtttcctctcagacaacttccgacgctctttccagcgggttctgtgcctgcgctgctgtctcctggaaacaactggaggtgctgaggaagagcccctggactactatgctactgctctcaaaagcagaggtggcccaggatgcatatgccctccattgccctgccagcaggagcccatgcaagcagaacctgcctgcaagcgagtccctttcaccaagaccactactttctga

SEQ ID NO: 3218 - DNA, 2586 bp, Rattus norvegicus
  Genbank Accession No. NM_013037
gggtagtctgaagagaccagaggaaggagcaccaagtagcctcagggccctgggtttattcttcccagcccttcatctgggctacactgatttctcttttggaccctacatcagacagcacacatcaaccgcctagtggactcaccgttaccttcctgtgccattgccatcggagagatctcggccatcaatcactagcacatgattggcaaatggagaatggggctttgggctttggcaattctgacagttcccatgtatttcatagtgacagagggcagaaaaacatcctggggtctagaaaacgaggctttaattgtcagatgcccccaaagaggaggtgcgattaaccctgtggaatggtattattcaaatacaaatgaaagaattcctactcaaaagagaaatcggatcttcgtctcaagagatcgtctgaagtttctaccagccaaagtggaagactctgggatttatacgtgtgttatcagaagccctgaatcgattaagaccggatctttgaatgtcaccatatataaaagaccaccaaactgcaaaatccctgattacatgatgtactcgacagtagatggatcagataaaaattccaagataacatgtccaacaattgccttgtataattggacagcgcctgttcagtggtttaagaactgcaaagctctccaagggccaaggttcagggcacacatgtcctatttgttcattgacaaagtgagtcatgttgatgaaggtgactacacatgtcgattcactcacacggagaacggaaccaattacattgtgactgccaccagatcattcacagttgaagaaaaaggcttctctacatttccagtaattacaaaccctccacacaactacacagtggaagtggaaataggaaaaacagcaaacattgcctgctcagcttgctttggcacagcctctcagttcgttgctgtcctgtggcagattaacaaaacgagaattggatcttttggcaaagcaagaattcaagaagagaaaggcccaaataaaagttccagcaatggcatgatttgcttaacctcactgttaaggataactggtgtgaccgacaaggacttctccctgaaatatgactgtgtggccatgaaccatcacggagtgataaggcaccccgtaagactgagaaggaaacaaccaagtaaggagtgtctctcacaaattgcttgacaaaattggctgaatttgctgcaaaccacaatcctttttctcagaggactgtgtgttatagcttggtcccaggggattcatcatgatcgtgggattagttggccagtttcctcaaatgtgtttttcatgttgagaaagctccttaaatctggtctgtccagaatgtttctgtcttctagaaggactctctgtcattgtatctttcctctctctgtttccccttgtccttgttctcctcacggtcctccccatcccttcaccttccttcacgttctctctactcttcttcccttatctctgggctccttctcacctgttagtggcttcttcagtcaccctttgcacatgctacaagggacattggtgttgatactgggttggaagcagtaataaccctactgtgtttctccctttgtgactcttgtaacagaaaacaacttacacattaggtggatgaccaacttgatcccattttaaaagagtagagaaaacatgatatttttacccttaacactctcttatgatactaaccactgcctcaatggcaatacaactaatgtaaaaacattattttaacttctttcaaatatcaagagggtgtggaagggagagagacactgactctaagctcatagtgatatgtggggcatttattgggattaagatattgattaaatgattagggtgggggtacctattggataccatcaagctgtgtcactgcctgaagtggtagttgggatttttttttggttctgtttgtcttctttggtttgttttaactatagagaccattctgctcttgaactcctagagttccacctggctttgcctctcaggtcctgggattaaagccatatgtcaccttacccagccaggatgtttcttgttttggtttcaattttagagcctctggcttgtaagatttttataaagtagagtttgattcataggtggccagagttgtgactcatagatgggttttagtgaggtcttaggcatccaccccttataatgctgttacccagggtgactgtggaccacagcactgtgttatgagatggtggaggtcatggcacattctataggaaaagagaagccaagcccctagtctcaccaggcacaaccttgagtcctcactgctctcctctgccaacaggaccttttgtccagatttctgagtattctctagttacatttgtatttgaactatatttgtgttatctgtaattctgtatttgttttgtttgtgtgtggttttgtattttccagattatttttaattcacctgttgctattcaaatcaatgtatctgtactgcttcatcaacacagcctgttaaataaaagtcgtgtctgttgttgttgaatgata

SEQ ID NO: 3219 - DNA, 6628 bp, Rattus norvegicus
  Genbank Accession No. NM_013040
agcagctggcctcccaccaccctaaaaataatccactcgccgctgtctgctgacccgggaggaaaacttgtcatcccatggagtgtgtgagctcctcggcttgctccagagagatccccaaccgctttgaggagtcagtgactgagttctgtggacttgtttgaaatttacatcttcagactgtgcgcaggcggttggaaggtagatcaagtgcaccagtagggggactaagttcctgagccaaagtcaaggctaatcaactaagaagaaatgagcctttccttctgtggtaacaacatctcctcctacaacatctaccatggtgttctccaaaacccctgctttgtggacgcactcaacctggtccctcacgtcttcctgctgtttatcacctttccgatcctgttcattggatgggggagccaaagctcaaaagtgcaaattcatcacaacacatggcttcattttcctggacacaacctgagatggattctgacgtttgcactcctgtttgtgcatgtctgcgagatagcagaaggcattgtttcagactcgcaacgggcgtccaggcatctccaccttttcatgccggctgtgatgggatttgtcgccaccaccacatccattgtgtattaccacaacattgaaacatcaaacttccctaaattacttttagctttattcctgtactgggtcatggccttcattacaaagacaataaagttggtcaaatactggcagttggggtggggaatgtcagacctgcgcttctgcatcacgggagtgatggtcatcttgaatggactgctgatggctgtggagatcaatgtcatccgggtccgaagatatgttttcttcatgaatcctcagaaagtgaagcctccagaggacctccaggacctgggcgtgaggttcctccagccgtttgtgaatttgctgtccaaagctacttactggtggatgaacacgcttatcatatcagctcacaggaaacctattgatctgaaggcgatcggaaagttgccgatagcaatgagggcggtgacgaattatgtttgcttgaaggaggcctacgaagagcagaagaaaaaggctgcggatcatccgaatcggactccctccatatggctggccatgtacagggcttttgggagaccgatcctgctgagcagcacgttccgctacttggctgacttgctgggctttgccggccctctttgtatttccggaatcgtccagcgtgtgaatgaaccgaagaataacacgacgagattttcagagacactctcatcaaaggagtttctggaaaatgcccatgtgctggctgtcctgctcttcctggccctcatcctgcaaagaacatttttgcaggcttcgtactatgtgaccatagagaccggcatcaacctgcgtggggctctgctggctatgatctacaacaaaatccttcgactgtctacttctaacctatccatgggcgagatgaccctgggacagatcaacaacttggttgccatagaaaccaatcagctcatgtggttcttgttcctgtgtcccaatctgtgggccatgcccgttcagatcataatgggggtgatcctgctctataatctgcttgggtcaagcgcactggtaggcgcggcggtcatcgtgctcctcgcaccgattcagtacttcatcgccacgaagctggcggaggctcagaagagcactctggattattccaccgagaggctgaagaagacaaacgagatactgaaaggcatcaagctccttaagctgtatgcctgggagcacattttctgcaagagcgtggaagagactagaatgaaggagctctccagcctcaaaaccttcgcgctctacacgtcgctttccatcttcatgaacgcagccattcccatcgcagccgttcttgcaacatttgtgacccatgcctatgccagtggcaacaacctgaaacccgcagaggcctttgcctctctgtctctcttccacatcctcgtcacaccgctcttcctgctgtccacggtggtcagattcgcagtgaaagccatcatcagcgttcagaagctgaatgagtttctcttgagcgatgagattggcgaggacagctggaggactggggaggggacgctgccttttgagtcctgtaagaagcacaccggagtgcaatcaaaaccgataaacaggaagcagcctggaaggtaccacctggacaactacgagcaggcgcggcgtcttcggcctgctgagactgaagatgttgccataaaggtgacgaacggatacttctcatggggcagtggtttagccacattatccaatattgacattcgaattccaacaggtcagctaaccatgattgtgggtcaggtgggttgtggcaaatcgtctctcctccttgccatccttggtgagatgcagaccctggaaggaaaagtttactggaacaatgtaaatgaatctgagccttcttttgaagcaacccgaagcagaagcaggtactctgtggcttatgctgcccagaagccttggctcctcaatgctacggtcgaggaaaacatcacttttggaagttctttcaacagacagaggtacaaggctgtcaccgatgcctgctctctgcagccagacattgatttgttaccctttggagaccaaactgaaattggagagaggggtatcaacctgagtgggggtcagaggcagagaatctgcgtggcccgggcactctaccagaacaccaatattgtcttcttggacgatccattctccgctctggacatccacctgagcgaccacttgatgcaggaagggatcctgaagtttctccaggacgacaagaggacggtcgtccttgtgactcacaaactacagtacctgacgcacgcggactggatcatagccatgaaggatgggagtgtgttaagggaagggactttgaaagacatccagaccaaagacgtggagctctatgaacactggaaaaccctcatgaatcggcaagatcaggaattagaaaaggacatggaagccgaccaaacaacgctggagaggaagactctccgaagagctatgtactcaagggaggccaaagcacagatggaggatgaagatgaagaggaggaggaggaggaagatgaggacgacaacatgtcaactgtaatgaggctcaggacgaagatgccctggaagacctgttggtggtacctcacttcaggagggtttttcctgctcttcctcatgatcttctctaagcttttgaagcactctgtgatcgtggccatcgactactggctagctacgtggacctccgagtacagtataaacgacccagggaaagctgaccagaccttctatgtggctgggttcagcatcctctgtggagcgggcattttcctttgcctcgtcacctccctcactgtagaatggatgggtctcaccgccgccaagaacctccaccacaatctcctcaataagataattctgggcccaataaggttctttgataccacgcccctgggactgatcctcaatcggttttctgctgataccaacatcatcgaccaacatatccctccgaccttggagtcgctgacccgctctaccctgctctgcctgtcggctattgggatgatctcctatgctacacccgtgtttctcatcgctcttgcgcccctgggcgtcgccttttatttcatccagaaatacttccgggttgcctctaaggatctccaggaactcgatgacagcacccagctccccctgctttgtcacttctcagaaacagctgaagggcttaccactatccgggccttcaggcatgaaaccagattcaagcaacgcatgctggagctgacagacacaaacaacattgcctacttatttctctccgcagccaacagatggctggaggtcaggacggactacctgggagcttgcattgttctgacggcctccattgcatccatcagtggctcttccaactctggactagtgggcttgggccttctgtatgccctcacgataaccaattacctgaattgggttgtaaggaacttggccgacctcgaagtccagatgggcgcagtgaagaaagtgaacagtttcttaactatggagtctgagaactatgaaggcaccatggatccttctcaagtcccagagcattggccacaggaaggtgagatcaagattcacgatctatgcgtcagatatgaaaataacctgaagcccgttctgaaacatgtcaaggcttacatcaagcctgggcagaaggtgggcatctgtggtcgcaccggtagtgggaagtcctctctatctctggctttcttcagaatggtcgacatatttgatggaaagatagtcattgatggaatagacatttccaagctgcccttgcacacgctccgctctagactgtccatcattctccaggacccaatcctgttcagcggctctatcagatttaacttggatcctgaatgcaagtgcacagacgacaggctctgggaggctctggaaattgctcagttgaagaatatggtcaaatctctgccaggaggcctagacgccactgtcaccgaaggtggtgagaacttcagcgttggacagagacagctgttctgcctggccagggcctttgttcgaaagagcagcatactcattatggatgaggccacggcctccatcgacatggccacggaaaacattttgcagaaagtagtcatgacagcctttgcggatcgcacggttgtaaccatagctcatcgggttcacaccattctgactgctgacctggtcattgtgatgaagagaggaaacattttggaatacgacaccccggaaagcctcttggcccaggaggatggagtgttcgcctcgttcgttcgtgcggacatgtgacaggattacatcacaacagcacctgtgtctcgatgcctaccgtcgcccaccagagggttcccccaactttgcctcggaagggtggcgccggaaacttcgacagacttctgtatggaaagtagagatttctgtttcctgttttggtctgagggacactccctgtaggttcatcgtgggtgttgtactgtgatcaggccacactggaaaggtagcctatgctaaaacatgccagcgaccttaaggggtaaatctgtcgatgtctgtcaagcactggagctgaaatgaggcgtctgcgctaccacactctcattaggaagactagcactgccctgctgttgatgaagaaaattcattttctaacaaaatactcacgttcatgatccataggagagtcttttctgtgcatttaacattgttgatatttccttttaacttttccccttttaactcatttcctgtcaccacgaagctatcatatttagtacctctataaagccgacccctcacaagagaaagatcatgaaaagagattgaatatttgaaaatattatttgtttccatttgcctccatccaataaggaggaagttcaagttagcttcagtccttcagcaatgggccacctaaactaagctttctagagtttaattctttatcagccaaacaatggctctgaaccctgaaatgctatattatctagggcccaaaagaatatagatgaatggccttatctgtcacacacacacacacacacacacacacacacacacacacacacacacacatatacatacacatcttcatgccatatcttggctgtatgctaatcttggcatgtgcacattcctcgaaggtaccagatatcccctaccctacatctctgtgggaagatagaaatagttctcactctgaatttacacaggtagcaagtgtttattttcacttgggcaaatttcagtggcagacattgatgtcacacatgtggccattggtcctgttctaatttatagagtgtaccagaagtctatatgatattagtgtcacatttcatttaavtgcccattaataaagccaaactgactgaagttcacttccctgttatccagcttccacagtttctgtaacctttaaccatcagatataagcagctgctcaattccatatgagggtctccacagaaaatagatgtccatcgcccaccgttcctgtagtcatatggcgttgtttattctgtgtcaagacttatagttcttgtgcatcgagatatttcaaggtgcctttatggatatagaacgtaatgtaagaaaaacgttcatagagatatacagaaacggcccaggttacttagcctaaatagtcaccttttcttccatatcaaaaacttcattagaaaaaaataatagtattatttgcagaaagctagtaggtcacagctattagcaatgagttcaaccgcaaaagtacttcataagagaatcgactaatctactaaaatattgctggtgctgcagaaggttctgctggggctgatacccatgacgtttgttgtcagtcagtgtctccttctctcctagaaatggcattcatctacagaagtagctccctgctgctgtagcccactacgccatcctgtgcaaaagtgactttcgtttcctcgaaacttttacttacttgatttgcaaaaaacaaacaaaaaacaaacaaacaaacaaaaaaaaaaaa

SEQ ID NO: 3220 - DNA, 2182 bp, Rattus norvegicus
  Genbank Accession No. NM_013048
gcggcgttattcccatgacccgccgggcagcttccgggaaaccaaagtctttgggttccggggggggcgggcatggcagagatgcggccggggccagtggttggaaaacagctcaacgagcagcccgaccactcgcccctggtccagccgggcctggccgaactgaggcgccgggcgcaggaggagggcgtcccagagaccccgcagccgctcacagacgctttcttgttgcgattcctgcgtgcccgggatttcgacctggacctggcctggcgcttaatgaaaaactattacaaatggcgagcagaatgtccagaactaagtgcagatctacaccctagaagtatccttggacttctgaaggctggctaccatggagttctgaggtccagggatccgactggcagtagagttctcatttaccgaatttcctattgggacccaaaagtttttacagcctatgatgtatttcgtgtaagtctgatcacatcagagctcattgtacaggaggtggaaactcaacggaatggagtcaaggctatatttgacctggaaggctggcagatttctcatgcttttcaaattaccccatctgtagccaagaagattgctgctgtagttacagattcctttccattgaaagttcgtgggatccatttgataaatgagccggtcattttccatgctgtcttttccatgattaaaccatttctgactgaaaagattaagggtcggattcatctgcatgggaacaattataaatcaagcctacttcagcacttcccagacattcttcctctggaatatggtggtaacgagtcctccatggaggatatttgtcaggagtggacaaattttataatgaagtctgaagattatctcagcagcatttctgagaccatccaatgagaagttgtttcctgtgaatgacttcatctaaaattcaaggatgggattctatctggttactaaactcaagaccaaaccttctaaacgaattgatccttatctgatctttaaacacgcaacatggatatttggaggatgttttaatttcaacaatgctctgttccttttaaattaattaaatgttaggaaagaaggatatttctggttttcccttgaagagcaaacatagcttcatctaaagtagttgttccagtgtttctttgcatggttcaggaaattttatattaaacaaaactttatgatcccattgtttaatattagattgatggttatctactggaaagaaatactgtacgcatcaactgatggtgaaacaatattaatgctcagctgagattggtagataaccataaatcaggttgcagtctgaatacagattaattagttcatctcaggtaaatccgactttagcatatgcacaatagaagccttcaatgtcagtctacacactataatattgcaatcaatgaaatcactatggttgataaaggtgattcagaacttaagaaaaatttctgggcacagtagatggtttctcatactgtcttgtattttcaaataagtaaagaatataattatggcttctggttatagacagggaagtagatgtatatgttttttacatagacttgaaaatttaagagaactacataaatgaaaggaggtgtttacattttaaaccatcagcagtgatacctagtatttttcagattattcataaataatttgattttattctgatataattgactattacctcagaatattctgtttagtttaaacagtcggcagctgggatgtgcagtctctaccatagtgcagttcatttctaagactttcattcattgagaaaggtgtgatctgatcctgtattcagcccagccttcaatttggcacataggtttatacttgatgtttctaattaattttattttaaactggaactaatacaaggcaaagaacttaatgaatttatgttcaaatagttagacttctacattaatttcataagagtatctttgtacgaggatatttttcattgtacaagggtgtttttctttataagaaaataagtctaatcagataagctgatactcatgattctctgtacatatacttctgacaaaactgaaaggtgcagatagatgttctttagagaactgtttaattttgatttagcaactagacgttaactttactatttaattttact

SEQ ID NO: 3221 - DNA, 1092 bp, Rattus norvegicus
  Genbank Accession No. NM_013050
aggggaagtcccgagacaaaggagcgccgccgcctctgccgccgcgacggtccgggccgcggtcgcccagggactttgaatatgtcggggattgccctcagccgacttgcgcaggagaggaaagcctggaggaaggaccacccttttggctttgtggctgtcccaacaaagaaccctgatggcacgatgaacctgatgaactgggagtgtgctatccctggaaagaaggggactccgtgggaaggaggcttgttcaagctacggatgcttttcaaagatgactatccgtcctcaccaccaaaatgtaaatttgagccaccactgtttcatccaaacgtgtatccttctggcacagtgtgcctgtccatcctggaggaagacaaggactggcggccagctattacgatcaaacagatcttattaggaatacaagaacttctaaatgaaccaaatattcaagacccagctcaagcagaggcctatacaatttactgccaaaacagagtggaatatgagaaaagggttcgagcacaagcgaagaagtttgccccctcataagcagcggcccgggctccatgacgaggaagggattggcttggcaagaacttgtttacaaccttttgcagatctaagtcgctccgtacagttactagtagcctgggagggttgagcgggcgccattttccatttccgccactggcatattcagtcttttgtatttttgattattgagtaaaacttgcttttattttaatattgatgtcagtatttcaactgctgtaaaatgataaacttttgtacttggtaagccctaggagctagtttcttctcgtccgctcggatcgaggcatgttccccactgttcagagctctggcctccagctggctgtatgacagaaccacactgtccctccttccttccctaccctcgtccttctcagaaacctgggctgttgcttatgagcctcagatccaaagttggccagcatctccattctgcaccacttcctttgtgtttatatggcgttttgtctgtgttgctgtttagagtaaataaactgtttatataaaaaaaaaaaaaaaaaaaaaaaa

SEQ ID NO: 3222 - DNA, 1689 bp, Rattus norvegicus
  Genbank Accession No. NM_013052
tgcagccagctagcgagaaggcgcgagcggcggcgcagccagcagcctcccgccagccggcgagccagtgcgcgtgcgcggcggcggcctcggcggcgaccgggaagcggacgggcgggcgaggcgagcgaggcaggcggtgcgggcgtgcgaggcgaggccgatcgcgagcgacatgggggaccgagagcagctgctgcagcgggcgcgactggcggagcaggcggagcgctacgacgacatggcctccgccatgaaggcggtgacagagctgaatgaacctctatctaatgaagatagaaatctcctctctgtggcctacaagaatgtagttggtgccaggcgatcttcttggagggttattagtagcattgagcagaaaaccatggcagatgggaatgagaagaagctggagaaagtcaaagcctatcgggagaagattgagaaggagctggagacagtttgcaatgatgtcttggctctgctcgacaagttccttatcaagaactgcaatgattttcagtacgagagcaaggtgttctacctgaaaatgaagggcgattactaccgctacctggcagaggtggcttctggggagaagaaaaacagtgtggttgaagcttctgaggcagcgtataaggaagccttcgaaatcagcaaagagcacatgcagccaacacaccccatccggcttggcctggccctcaatttttctgtgttctactatgagatccagaatgcaccagagcaggcctgcctcttagccaaacaagccttcgatgatgctatagctgagctggacacattaaacgaggattcctataaggactccactctcatcatgcagttgctgcgagacaacctcaccctctggacgagcgaccagcaggatgaagaagccggagaaggcaactgaagacccatcaggtccctggcccttcctttacccaccacccccattatcactgattcttccttgccacaatcactatatctagtgctaaacctatctgtattggcagcacagctattcagatctgccctcctgtcccttggaagcagtttcagataaaccttcatgggcatttgctggactgatggttgctttgagccacagagcgctccctttttgaattgtgcagagaagtgtgttctgaacgaggcattttattatgtctgttgatctgtagcaaatccatgtgatggtaattgagtgtagaaaggagaattagccaacacaggctatggctgctatttaaaacaagctgatagtgtgttgttaagcagtacatctcgtgcatgcaaaaatgaatttgaccctctcaccccttctttcagctaatggaaactgacacacgacaacttgttccttcaccatcagctttataaactgtttctcgtgagctttcaggcccctgctgtgcctctttaaattatgatgtgcgcacaccttcttttcaatgcaatgcatcagaggtttttgatatgtgtaacttttttttttggttgtgattaagaatcatggatttattttttgtaactctttggctattgttcttgtgtaccctgacagcatcatgtgtgtcaacctgtgtcaatcatgatgggtggttatgaaatgccagattgctaaaataaatgttttggacttaaaaagagtaaataaatgctgctttggggatattaaaa

SEQ ID NO: 3223 - DNA, 2099 bp, Rattus norvegicus
  Genbank Accession No. NM_013053
agatcaaagtggtgggactcgcgtcgcggccgcggagactagaaggaggactccggatccggctcggcgctcgccctcgctcgccatggagaagaccgagctgatccagaaggccaagctggccgagcaggccgagcgctacgacgacatggccacctgcatgaaagccgtgacggagcagggcgccgagctgtccaacgaggagcgcaacctgctatctgtggcctacaagaacgtggtcgggggccgcaggtccgcctggagggtcatctcgagcattgagcagaagaccgatacctcggacaagaagttgcagctgatcaaggactatcgggagaaagtggagtctgagctgaggtccatctgcaccacggtcctggaattgttggataagtatttaatagccaatgcaactaatccagagagtaaggtcttctatctgaaaatgaagggagattatttccggtatcttgctgaagtcgcttgtggtgatgatcgaaaacaaacgatagaaaattcccaaggagcctaccaagaggcatttgatataagcaagaaagagatgcaacctacacatccgatccgcctggggctggctcttaacttttctgtattttactatgagatccttaataatcccgagcttgcctgcacactggctaaaacggcttttgatgaagccatcgccgagcttgatacactgaatgaagactcctacaaagacagcaccctcatcatgcagttgcttagagacaacttaacattatggacatcagacagtgcaggagaagaatgtgatgcagctgagggggctgagaactaaaggcatccaggacaccaacctccttcccctcaagaaaacctttttacatctccattccttattccacttggatttcctctagcaaggaagcccattcatgtgtatggggtcaactgtttatagtcttttcacactgcagctttgggaaaactccatcccttggtttgtgttgtctccaccttcctggtgtgcagttactgctgtagaaaagtatcaatagcttcatttcatataaacacgagtaacttccagacacttgtgtagaggactgacagcacatttggtatttaagtaatctgaaccagttctgcaagtgactgtgttttgtattactgtgaagatatggaaatggtagtgcattacaatttaaagtgattgtaataataacgtcttgatttctacattccttttctgaactttcttgggggtttcctttcagaagcaacttttccatgctcttactacaaattcctttttagtaggaatccagaagtgttagattgaatgggaaagcgcttaatgcatccgggcttgggggtcacagattgaaatgtctcctgtgtcacattctggaggttacatctgtctgtgacaacagggcgtttccttatgcattcttcatttgctgctgtttaagttgacaacttccttcccaataaaaattcacttacacctcctgccttcgtagctctggtattcactttaccttgtgacagaagtagcatgttgctgccagaatacaagcattgctttgggcaaattaaaatgcatgtcctttcttaatacactaggaaggagaaataaagtacacaagtccaagtctaaactttagtacttttccatgcagatttgtgcacatgtgagggggtatccagtttgtccagtgattgttctttagagagttggaccactatattgtgtgtttgctaatcattgactgtagtcccaaaaaagccttgtgaaaatgttatgccctatgtaacagcagagtaacataaaataaaactacattttataaaaccatttattatggctttgtaacagttgcatacccatattttaagaacagacaaatttactactttttgaagtttgttgctatttctctttatgtaacatataatggtgatatccatatttctgcattgtggtacacttgtctagggtgcctggcactgtaaaattggactatatttctccagatagcctcatgggttgtcttcctcagatgtaatgataactggttaggtgtcatgtgtaataaagtgaacatttg

SEQ ID NO: 3224 - DNA, 3754 bp, Rattus norvegicus
  Genbank Accession No. NM_013055
ttggaaggagcgggagttcaagtcgagtgggaacggggcttagagtagtgggtggggggccaaaagctggggctgacacccgtgcacctgagctccactcgagcatcgccggtgacagctctccaggtccagtggagggcaacggggggaggaggggaggaggaggaggaggcgggagcagcatccggagccgagctgcagcagcgccgccttttgtgctgcggccgcggagcccccgagggccttggatcccctggaactggagttataggggttgtgagcatcatgtggatgctgggaatggaaccccagtcatctcgaagaacacccaggctggcctgaaactcactgtgaagccagagatgaccttggacttctgagcctctcacctccattcctgagtgctgggactgctgggcccgctactcagcacacctggctccagaggccatggcctgcctccatgaaacccgaacaccctccccttcctttggaggctttgtgtctactctaagtgaggcctccatgcgaaagctggatccagacacttcagactgcacccctgagaaggacctgacacctacccaatgtgtacttcgagatgttgtgcctctcggtgggcagggtggaggagggcccagcccctccccaggtggagagcctcctccagagccttttgccaatagtgtcctgcagctacatgagcaggatacaggtgggccagggggagccaccgggtcacctgagagtcgagcatctagggttcgagctgatgaggtacgtctgcagtgccagagtggcagtggcttccttgaaggtctttttggctgcctgcgccctgtctggacaatgattggcaaagcctactccacagagcacaagcaacagcaggaagacctttgggaagtcccctttgaggaaatcctggacctgcagtgggtaggctcaggggctcagggtgccgttttcctgggacgctttcatggggaggaggtagctgtgaagaaggttcgagacctcaaggagaccgacatcaagcatcttcgaaaactgaagcaccccaacatcatcactttcaagggtgtttgcacacaggccccgtgctactgcatcctcatggagttctgtgcccaaggacagctgtatgaggtgctcagggcgggccgccccgttaccccctccttgctggttgactggtccatgggcatcgctggaggcatgaattacctacacctgcacaaaatcatccacagagacctgaagtcacccaacatgctaatcacatacgacgatgtggtgaagatctcagactttggcacttccaaggagctgagtgacaagagcaccaagatgtcctttgcagggacagtagcctggatggctcctgaagtgatcagaaatgaacctgtgtctgagaaggttgacatctggtcctttggggtggtgctttgggaattactgactggagagattccctacaaagatgtagactcctcagccatcatctggggtgtgggaagcaacagtcttcacctgcctgtaccctctagctgcccagacggctttaaaattctgcttcgccagtgctggaacagaaaacctcggaaccgcccatcattccgacagatcttgctgcacctggacatcgcctcggctgatgtgctctctacaccccaggagacttactttaaatcccaggcagagtggcgggaagaagtaaaactgcactttgaaaagattaagtcagaagggacctgtctgcaccgcctagaagaggaactggtgatgcggagaagggaggagctcagacatgccctggacatcagggagcactatgagcgcaagttggagagagctaacaacttgtacatggaactgaatgccctcatgttgcaactagaactcaaagagagggaattgctcaggcgagagcaagctttagaaaggaggtgtcctggtctactgaagtcacacacgtcccgaagcctcctacatggaaacacgatggagaagctcatcaagaaaaggaatgtgccacagaaactgtcaccccatagcaaaaggccagatattctcaagacagagtctttgctacctaaactagatgcagccctaagtggggtggggcttcctggttgtcctaaggcccccccttcacctgggaggagtcgtcgtggcaagacccgtcaccgaaaggccagcgccaagggcagctgtggagacctgcctgggcttcgtgcagctttgccaccccatgagcctggaggactaggaagcccaggaggcctaggagtgggccctacagcttgggatgcctccccccctgctctccgtggactccaccatgaccttctacttcggaagatgtcttcatcatccccagacctgttatcagcagcactgggagcccgaggccgaggggcaacagggggagctcgggatcctggctcaccacctccaccccagggtgatactcctccaagtgagggatcagctcctggttccaccagcccagattcacctgggggagctaaaggggaaccacctccaccagtagggcctggagaaggtgtggggctgctgggaactggaagggaagggactacaggccggggaggaagccgggctgggtaccagcacttgacccccgctgcgctgctgtacagggctgctgtgactcgtagtcagaaacgtggtatctcatctgaagaggaagaaggagaggtcgacagtgaagtagagctacccccaagtcaaaggtggcctcagggcccgaacatgcgtcagtcactatctacgttcagctcagagaacccatcagatgtggaggaaggtacagctagtgagccttccccaagtggcacaccggaagttggcagcaccaacactgatgagcgaccagatgaacggtctgatgacatgtgctcacagggttcagaaatcccactggacctacctacttcagaggtggtccctgaacgtgaaaccagctccttgcccatgcaacaccaggatgaccagggccccaatcctgaggactcagactgtgacagcactgaattggacaactccaacagcattgatgccttgccgcccccagcctcccttcctccatgaaagacactcttattccttgtacatagagaaatatttatataaataatatatatgcgccacataatcaacagatagacggggctttcttagccgtaagtcaggcttcagagtgaacgacgcccctgaccaattaagttctagggacactggcagctgtggaaatgactccaagtactaccctagagctgtaaggaaaggacaccggtcccttcttgcttcaccccattccttatgttgaacaagcaagtaggcatagaaaagccaggcttgtctctacactgtctgtccctaaacatggggggcaggaagaggattcacttaaaactgcacttttattttccgtttactgtttacacattttgcacttgggaggagggaaactaaggctgggtcctaggtcctccctctgaggtttctcaggtggcaatgtaactcatttctttgttcctgtttctctgccaaagccctggctttgggcccagaggcaagttagaagattaatagcatgtgatggctcaggctgaagaactgggtgctggttaagtccccgctgttatctggtgcctggtaggggtggggactgtcatattgtaacccctgtgaacaaccctgaaatataaccactccatgcaggccc

SEQ ID NO: 3225 - DNA, 2415 bp, Rattus norvegicus
  Genbank Accession No. NM_013059
cacggcgctccttagggccaccgctcggcgcgccgggacagaccctccccactcctgcctgcaggatcggaacgtcaattaacggctgacactgccccccacctcttcccacccatctgggctccagcgaggaacggatctcggggtacaccatgatcttgccatttttagtactggccatcggaccctgccttaccaactcatttgtgccagagaaagagaaagaccccagttactggcgacagcaagcccaagagaccttgaaaaatgccctgaaactccaaaaactcaacaccaacgtggccaagaacatcatcatgttcctgggagatggtatgggcgtctccacagtgacagctgcccgcatccttaagggccagctacaccacaacacgggcgaggagacacggctggagatggacaagttcccctttgtggctctctccaagacgtacaacaccaacgctcaggtccccgacagcgcgggcactgccactgcctacttgtgtggcgtgaaggccaacgagggcaccgtgggagtgagcgcggccactgagcgcacgcgatgcaacaccactcaggggaacgaggtcacgtccatcctgcgctgggccaaggatgctgggaagtccgtgggcatcgtgaccaccactcgggtgaaccacgccactcccagtgcagcctatgcgcactcggccgatcgggactggtactcggacaatgagatgcgcccagaggctctgagccagggctgcaaggacatcgcctatcagctaatgcacaacatcaaggacatcgatgtgatcatgggtggtggccggaagtacatgtaccccaagaacagaactgatgtggaatatgaactggatgagaaggccaggggcaccagactggatggcctggacctcatcagcatttggaagagcttcaaacctagacacaagcactcccactatgtctggaaccgcactgaactgctggcccttgacccctccagggtggactacctcttaggtctctttgagcccggggacatgcagtatgagttgaatcggaacaacctgactgacccttccctctcggagatggtggaggtggccctccggatcctgacaaagaatcccaaaggcttcttcttgctagtggaaggaggcaggattgaccacgggcaccatgaaggcaaggccaagcaggcgctgcatgaggccgtggagatggatgaggccatcggaaaggcgggcaccatgacttcccagaaagacacgttgactgtggttactgctgatcactcccacgttttcacgtttggtggctacacccccaggggcaactccatttttggtctggctcccatggtgagcgacacggacaagaagcccttcacagccatcctgtatggcaacgggcctggttacaaggtggtggacggtgaacgggagaacgtctccatggtggattatgctcacaacaactaccaggcccagtccgctgtccccctgcggcacgagacccacggtggggaagatgtggcggtctttgccaagggccctatggctcacctgcttcacggcgtccatgagcagaactacatcccccacgtcatggcgtatgcctcctgcattggagccaaccttgaccactgtgcctgggccagctctgcgagcagcccctccccaggggccctgctgcttccactggctctgttccccctacgcaccctgttctgagggcccaggtcccacaagagcccacaatggacagccggctcccctccctttgtggcctgccacctggccgcccacactcaacggggaggcccaggcaacctcgagcaggaacagaagtttgctacctgcctcacttccgcccggaaccctccgtgggtcggattcctggctctgccgttgtttctctattcactgccttttggccagcagggtgggtttctctcttgggccggcaggacacagactgcgcagattcccaaagcaccttatttttctaccaaatatactctccagaccctgcaaccatcatggaacattccagatctgaccttctctcccctaccccttctctctggaacactgggtcccatagtcacagccagtccctcaacccaaccctccttggagggaagaccaggtctgctcagggtgagactcccaggaagccacctccggggttggctgtctacccagggtggccaggctgggaagaacaacccagccggacaggacgcacacactccccacccagctccagagactcgccaacccttcactgaagcgactcccctgtttggaatagcaaaaaaaaaaagaaagaaaaaaaagaaaaaaattttaatttctctttttggtgttggttaaaagggaacacaagacatttaaataaaatgttccaaataaaaaa

SEQ ID NO: 3226 - DNA, 725 bp, Rattus norvegicus
  Genbank Accession No. NM_013060
gtgcggcgcagcacctcagccccctgcggcggctccctcccggcctttcctcctacgagcagcatgaaagccttcagtccggtgaggtccgttaggaaaaacagcctgtcggaccacagcttgggcatctcccggagcaaaaccccggtggacgacccgatgagtctgctctacaacatgaacgactgctactccaagctcaaggaactggtgcccagcatcccccagaacaagaaggtgaccaagatggaaatcctgcagcacgtcatcgattatatcttggacctgcagatcgccctggactcgcaccccactatcgtcagcctgcaccaccagagacctggacagaaccaaacgtccaggacgccgctgaccaccctgaacacggacatcagcatcctgtccttgcaggcgtctgaattcccttctgagcttatgtcgaatgacagcaaagtactctgtggctaaataaatggcatttggggactttttcctttttttttttttttatttttactttctctttttcttttgcacaacaagaagtctacaggatcttttaagactgttgttttgttctgctttgttatcaaccatttcaccaggagaacaagttgaatggacctttttaaaaagaaaacggaaggaaaactaagagtgatcatctccccaggtgtctccggcctggactgtgataaccgttatttatgagagacttcaatgcc

SEQ ID NO: 3227 - DNA, 3128 bp, Rattus norvegicus
  Genbank Accession No. NM_013063
tctgcccatatgtgcagatctagagggaggatggcggaggccacggagaggctttaccgagtggagtacgctaagagcgggcgcgcctcttgcaagaaatgcagcgagagtatccccaaggactcgctccgcatggccatcatggtgcagtcacccatgttcgatggaaaagtcccacactggtatcacttctcctgcttctggaaggtgggccactccatccggcagcctgacacagaggtggacgggttctctgagctgcggtgggatgaccagcagaaggtcaagaagaccgcagaggctggaggcgtggcaggcaaaggccagcatggaggtggcggcaaggcggagaagacgctgggcgactttgcggcagagtatgccaagtccaacaggagcacatgcaagggctgcatggagaagatagagaagggtcagatgcgcctgtccaagaagatgctggatccagagaagccgcaactgggtatgattgaccgctggtaccatccaacttgctttgtcaagaaccgggacgagctgggcttccggcctgagtacagtgccagccagctcaagggctttagcctcctctctgcagaagacaaagaagctctgaagaagcagctcccggcagtcaagagtgaaggaaagagaaaatgtgacgaggtggatggaatagatgaagtagccaaaaagaaatctaaaaaaggaaaggacaaggagagtagtaaactggaaaaggcgctcaaggctcagaacgagctggtctggaatatcaaagatgagctgaagaaagcctgctccaccaacgacctgaaggagttgctcatcttcaaccagcagcaagtaccatctggagagtccgcaatcctggaccgagttgctgatggcatggcgtttggggcccttctgccctgcaaggagtgttcaggacagctggtttttaagagcgacgcttattactgtactggggatgtcactgcctggaccaagtgcatggtcaagacacagaatcccagccgaaaggaatgggtaactccaaaggaattccgagaaatatcctacctcaagaaattaaagatcaaaaagcaggaccggctgttccctccagagagcagcgccccagcaccaccagcacctcccgtctcgatcacctccgcacccacagctgtgaactcctctgcaccagcagacaaacccctgtctaacatgaagatcctgactcttggtaagctctcccagaacaaggacgaagcaaaggccatgattgagaaactcggaggcaagctgacaggatctgccaacaaggcctccttgtgtatcagcactaagaaggaggtggagaagatgagtaagaagatggaggaagtgaaagcagccaatgttcgagtcgtgtgtgaggacttcctccaggatgtgtctgcctcagctaagagcctccaagagctgctctcagcccatagcttgtcctcgtggggggctgaggtgaaggtagagcctggtgaagtggtggtccccaaggggaagtcagctgcaccctccaagaagagcaagggtgctgtcaaggaggaaggtgtcaacaagtctgaaaagaggatgaaactaactctgaagggaggagcagccgttgatcctgactctggtctggaacactctgcacatgtcctggagaaaggcgggaaggtgttcagtgccacgcttggcctggtggacattgtgaaagggactaactcctattacaaactgcaacttctggagtccgacaaggagagcaggtattggatcttccggtcctggggccgagtgggcacagttatcggcagtaacaagcttgagcagatgccgtccaaagaggatgctgttgaacacttcatgaagttatacgaagagaagactggaaatgcctggcactcgaaaaacttcacaaagtatcccaagaagttctaccctctggagattgactatggccaggacgaagaggcagtaaagaagctggcggtgaagcctggcactaagtcgaagctgccgaagccggtgcaggagctcgtcgggatgatcttcgacgtggagagcatgaagaaggccttggtggagtacgagattgaccttcagaagatgcccttggggaaactgagcagaaggcagatccaggccgcctactctatcctcagtgaggtccagcaggcagtgtcccaaggcagcagtgaatctcagatcctggatctctccaatcgcttctacaccctcatcccccatgactttggaatgaagaagcccccacttctgaacaacacagacagtgtgcaggccaaggtggagatgctggacaacctcctggacatcgaggttgcctatagtcttctcaggggtgggtctgatgacagcagtaaggaccccatcgatgtcaactatgagaagctcaaaactgacattaaggtggttgacagagattctgaagaggctgaggtcatcaggaagtatgtgaagaacactcacgcgaccacgcacaatgcctatgacctggaagtgatagacatctttaagatagagcgagagggagagagccaacgctacaagcccttcaggcagcttcacaaccggagactgctgtggcacgggtccaggaccaccaacttcgcaggcatcctgtcacagggtctgcggatagccccacctgaagcacctgtgacaggctacatgtttgggaaaggaatctactttgctgatatggtgtccaaaagtgcgaactactgccacacgtctcagggagacccgattggcttaatactgttgggagaagttgcccttggaaacatgtacgaactcaagcatgcttctcacatcagcaagttacccaagggcaagcacagtgtcaaaggtttgggcaaaaccgcccctgacccttcggccagcatcaccctggatggtgtagaggttccgctgggaacagggattccgtctggtgttaatgacacctgcctgctgtataacgagtacattgtctacgacattgctcaggtgaatctgaagtacctactgaaactgaagttcaatttcaagacctccttgtggtagagtgaaggcgggctttgccagcacccggggcctaggggataatgcccctagtg

SEQ ID NO: 3228 - DNA, 5736 bp, Rattus norvegicus
  Genbank Accession No. NM_013066
aaaagaaagaagccagaacataccaccagccctttgagtatacaacataacaaacgtcattactttacaacttgattaggagacagtacagagatctgaaggatggctgacgagaggaaagacgaaggaaaggcaccacactggacatcagcctcactcacagaggcagctgcacacccccactcgccagagatgaaggaccagggtggctcaggggaagggctgagccgcagcgccaatggatttccatacagagaggaggaggaaggcgcctttggggagcacgggtcacagggcacctattcagataccaaagagaacgggatcaacggagagctgacctcagctgacagagaaacagcagaggaagtgtctgcaaggatagttcaagtagtcacagctgaagctgtagcagtcctgaaaggtgaacaagagaaggaggcccaacacaaggatcagcctgcagctctgcctttagcagctgaagaaacagttaatctgccaccttccccaccaccatcgccagcatcagaacaaacagctgcactggaagaagcctcgaagatggaattccctgagcagcagaaattgccttcctcattcgctgagcctttagacaaggaggaaacggagtttaagatgcaaagtaagcctggtgaagactttgaacatgctgccttagttcctcagccggacacaagtaaaactccccaggataaaaaggatccccaagacatggaaggagaaaagtcgcctgccagtccatttgcgcagactttcggtaccaacctggaagacataaaacagatcacagaaccaagcataacagtacctagcattggcctctccgcagagcccctagctccaaaagatcagaaagactggttcatcgaaatgcccgtggaatcaaagaaggatgaatggggtttagctgccccaatatctcctggccccttgacacccatgagggaaaaagatgtgctggaggatatcccaagatgggaaggaaagcagtttgactctcccatgcctagccccttccacagtggaagtttcactcttcccttagatactgtgaaagatgagagagtcacagaagggtcacaaccctttgcccctgtcttcttccaatcagatgacaaaatgtctctgcaggacaccagtggttcagctacttccaaagagagttctaaagatgaggagccacagaaagataaagcagacaaagtggcagatgttcctgtctcagaagctaccactgtactgggagatgttcacagtccagctgtggaaggctttgtcggggagaacatttcaggagaagaaaagggtaccacagatcaagagaaaaaagagacttcgacacccagtgtacaggaacctacactcactgaaactgaaccacagacaaagcttgaagagacatcaaaggtttccatcgaagaaactgtggcaaaagaagaggaatccttgaaattaaaagatgataaagcaggtgtaattcagacttccaccgagcattctttctccaaagaagaccagaaaggcgaagaacagacaatcgaagcattaaaacaagactcctttcctataagtctagaacaggcagttacagatgcagccatggccaccaagaccttggaaaaggttacgtctgagccagaggcagtaagtgaaaagagagaaatccagggactttttgaagaggatatagctgacaagagtaagctcgaaggcgctgggtctgcaacagtagccgaggttgagatgccattttatgaagataaatcagggatgtccaagtactttgaaacatctgcattgaaagaagatgtgaccagaagcactgggttgggcagtgattactacgagctgagtgactcaagaggaaatgcccaggaatctcttgatactgtatctcccaagaaccaacaagatgaaaaggaacttctggcaaaagcttcccagcctagtcctccagcacacgaagcagggtacagcactcttgcccagagttatacatctgatcatccgtccgagttacctgaagaaccaagttctcctcaagaaagaatgttcactattgaccccaaagtttatggggagaaaagggaccttcatagtaagaacaaagatgatctgacacttagtcgaagcttggggctgggcggaaggtctgcaatagaacagagaagcatgtccattaacttgcctatgtcttgccttgattctattgcccttgggtttaactttggccggggccatgatctttcccctctggcttctgatattctaaccaacactagcggaacgatggatgaaggagatgattacctgccccccaccacacctgcagtggagaagattccttgctttccaatagagagcaaagaggaagaagataagacagagcaagcaaaagtgactggagggcaaactacccaagttgaaacatcctccgagtcacccttcccagccaaagaatattacaaaaatggcactgtcatggcccctgacctgcctgagatgctagatctagcagggaccaggtccagattagcttctgtgagtgcagatgctgaggttgccaggaggaaatcagtcccatcggaggctgtggttgcagagagcagtactggtttgccacctgttgctgatgacagccaacccgtaaaaccagacagtcaacttgaagacatggggtactgtgtgttcaacaagtacacagtccctctcccatcgccagttcaagacagtgagaatttgtcaggagagagtggttcgttttatgaaggaaccgatgacaaagtccgtagagatttggccactgacctttcactaattgaggtaaaacttgcagctgctggaagagtcaaagatgaattcactgctgagaaagaggcatctccaccctcttctgctgacaaatcaggactgagtagggagtttgaccaagacaggaaagctaatgacaagctggatactgtcctagaaaagagcgaagagcatgttgattcaaaagaacatgccaaggagtcagaagaggttggggataaagtagagctcttcggattaggtgtaacctatgagcaaacctctgccaaagaactgataacaactaaagaaacagcacctgagagagcagagaaaggtctcagttcagtgccagaggtagctgaggtagaaacaaccacaaaagctgaccaaggtctagatgttgctgccaagaaagatgatcagagtccattagatataaaagtcagtgactttggacagatggcttctgggatgagtgtagatgctgggaaaaccatagagcttaagttcgaggttgatcagcagctgactctctcatccgaagcacctcaggaaacagattcattcatgggtattgagtccagccacgtgaaggatggtgccaaagtcagtgaaacagaagtcaaagagaaggtggcaaagcctgacttggtgcatcaggaggctgtggacaaagaagagtcctatgagtctagtggtgagcatgaaagcctcaccatggagtccctgaagcctgatgagggcaagaaagaaacatctccagagacatcactgatacaagatgaagttgccctcaaactgtctgtagaaatcccttgcccacctccagtttccgaagctgattcatccattgatgagaaggcggaggtccagatggaatttattcagctgccaaaggaagagagcacagagactccggatatacctgccataccttctgatgtcacccagccacagcctgaagcagttgtgtccgaaccagcagaggttcgaggtgaggaagaagagatcgaagctgagggagaatatgacaaactgctcttccgctcagacaccctccagatcaccgacctgcttgttccaggaagtagggaggagtttgtggagacctgcccaggggagcacaaaggtgtggttgagtccgtggtaaccatcgaggatgatttcatcactgtagtacaaaccacgactgatgagggagagttgggatcccacagtgtgcgctttgcagctccagttcagcctgaggaagaaaggagaccataccctcatgatgaagagcttgaagtactgatggcagcagaagcccaggcagagcccaaggatggctctccagatgctccagctacccctgagaaagaagaggttccattctcagaatataaaacagaaacctacgacgattacaaagatgagaccaccattgatgactccattatggatgccgacagcctgtgggtggacactcaagatgatgatagaagcatcttgacagagcagttagaaactattcctaaagaggagagagctgagaaggaagctcggagaccgtctctcgagaaacatagaaaagaaaaaccttttaaaactgggagaggcagaatttccactcctgaaagaaaagtagctaaaaaggaacctagcacggtctccagggatgaagtgagaaggaaaaaagcagtttataagaaggctgaacttgctaaaaaatcagaagttcaggcccactctccttccaggaaactcattttaaaacctgctatcaaatacactagaccaactcatctctcctgtgttaagcggaaaaccacagcaacaagtggtgaatcagctcaggctcccagtgcgtttaaacaggcgaaggacaaagtcactgatggaataaccaagagcccagaaaaacgttcttccctcccaagaccttcctccatcctccctcctcgcaggggcgtatcaggagacagggaggagaactcgttctctctgaacagctccatctcttcagcacgacggaccaccaggtcagaaccaattcgcagagcaggaaaaagcggcacctcaacacctactacccctggatctactgcaatcacccctggcactcctccaagctactcttcacgtaccccaggcacccctggaaccccgagctatcccaggacaccaggaacccccaaatttggcatcttggtgcccagtgagaagaaagttgccatcattcgcactcctccaaagtccccagctactcccaagcagcttcggctcattaaccaacctctgccagacctgaagaacgtcaagtccaaaatcggatcaaccgacaacatcaaataccagcctaaggggggtcaggtacaaattgttactaagaagatagacttaagccatgtgacttccaaatgtggctctctaaagaacatccgtcacaggccaggtggtggacgcgtgaagattgagagtgtaaagctggatttcaaggagaaggcccaagctaaagttggctcacttgacaatgctcaccatgtacctggaggtggtaacgtgaagattgacagccaaaagctgaacttccgagagcatgcaaaggcccgcgtcgaccacggggctgagatcatcacacagtcgccaagcaggtcaagcgtggcgtctccccggcgactcagcaatgtctcctcttctggaagcatcaacctgctcgaatcccctcagctggccactttggctgaggacgtcactgcggcgctcgctaagcagggcttgtgaatccttctcatctagcactgaagtaccatttaggcatgagctcttggcaggagtgggctctgagcaggtgtcatattcattctttacaaaccatagataaataatctcatcccccaactgtagtaattgttacaattttatataaaaaaaaaaaaa

SEQ ID NO: 3229 - DNA, 2214 bp, Rattus norvegicus
  Genbank Accession No. NM_013067
tcgcggtcatggaggcgccgatcgtcttgctgctgctgctatggctcgccttggccccgacgcctggcagcgcctcttcggaggctccgccgctggtcaacgaggacgtgaagcgcacggtggacctgagcagccacctagccaaggtgacggctgaggtggtcctggcgcacccgggcggcggctctacagcacgagccagctctttcgttctggccctggagcccgaactggagtcgcgacttgcacacctaggcgtgcaggtaaagggagaagatgaggaagacaacaacctagaagtacgagaaaccaaaatgaaggggaaaagtgggaggtttttcaccgtcaagctcccagttgctcttgatcctgggtccaagatctcaatcgttgtggaaactgtctacacccatgtgcttcatccatacccgactcagataactcagtcagagaaacagtttgtggtgtttgagggcaaccattacttctactctccctatccaacaaagacccagaccatgcgagtgagacttgcttcccgaaatgtggagagccataccaagctggggaacccctcaaggtctgaggacatcctggactatgggccttttaaagacatccctgcctacagtcaggatactttcaaagtacattatgagaacaatagccctttcctgaccatcaccagtatgacccgggtcattgaggtttctcactggggcaatattgctgtggaagagaacgtggacttgaagcatacaggtgcggtgctgaagggacctttctcccgctacgattaccagaggcagcctgacagtgggatctcctccattcgttcttttaagaccatccttcctgctgctgcccaggatgtgtattaccgggatgaaatcggtaatgtttccaccagccacctccttattttggatgactccgtggaaatggaaatccggcctcgatttggtctctttggagggtggaagacacactacatcgttggttacaacctcccaagctatgagtacctctataatctgggtgaccagtatgcactgaagatgcggtttgtagaccacgtgtttgatgagcaagtgatagattctctgacagtgaagatcatccttcctgagggagccaagaacatccaggtagacagtccctacgatattagccgggccccagatgagctgcattacacctacctagacacattcggccgcccggtgattgttgcttacaagaagaatctagttgaacagcacattcaggacattgtggtgcactacacattcaacaaggtgctcatgctgcaggagcctctgctggttgtggccgccttctacatcctgttcttcaccgtcatcatctacgtccgtctagacttttccatcaccaaggacccagcagcagaagccaggatgaaagtggcctgtatcacagagcaggtcttaaccctggtcaacaagaggttaggcctctaccgtcactttgatgagactgtcaatagatacaagcagtcccgggacatctctaccctcaatagtggcaagaagagcctagagacagagcacaaagctgtgaccagtgagattgctgtgctgcagtctaggctgaagacggagggctctgacctgtgtgacagggtgagcgaaatgcagaagctggacgcgcaggtcaaggagctggtactgaagtctgcggtggaggcagagaggctggtggctggcaagctcaagaaggacacatacatcgagaatgaaaagctcagctcaggaaaacgccaggagctggtcaccaagatcgaccacatcctagacgctctgtagctcttgtctccagagcaggcctgggtggcctacacttctggatggaataggtagagggaggaagttgtgattagcctaagacctcaagaaaaaagctgaggcccatccatggctgtgtaagaagcttgtcccttatttctgaatggttctcttttttacaaaaacaaaaacctaaacaaaaatcctgcccaaaaaacaaacttggttgtgttttgagcaaaagcattttgagtagttgattgctgttttgttttgatacctgggtattttttctgtctgtaagccctgttttatggccttctgattcctaatgtttggttcttttgtgagcgtatgcatggttttttaaaagtgtgtatgaccaaataaaaataaaggagggactgtg

SEQ ID NO: 3230 - DNA, 1150 bp, Rattus norvegicus
  Genbank Accession No. NM_013069
gcagcagcagcagcaccagcagcacttgggggaaaagctagaggctagagtcatggatgaccagcgcgacctcatctctaaccatgagcagctgcccatcctgggccagcgtgctagagccccagaaagcaattgcaaccgtggagtcctgtacaccagtgtctctgtcctggtggctctgctcttggctgggcaggccaccactgcttacttcctgtaccagcagcagggccgcctggacaagctgaccgtcacctcccagaacctgcaactggagaaccttcgcatgaagcttccgaaatctgccaaacctgtgagcccgatgcgcatggctactcccttgctgatgcgcccactgtccatggataacatgctccaagcgcccgtgaagaatgttaccaagtatggcaacatgacccaggaccacgtgatgcacctgcttacgaagtctggacccgtgaactacccacagctgaaggggagcttcccggagaatctgaagcaccttaagaactctatgaatggtctggactggaaggtctttgagagctggatgaaacagtggctgttgtttgaaatgagcaagaactccctggaggagaagcagcccacccagactccacctaaagagccactggacatggaagacccatcttctggcctgggagtgaccaagcaggatatgggccaaatgttcttgtgaagacagaagccagctctgcacggcggcacgtcccctgctcctcagcccttcttacactccctaacatcacacccattccgtcttcctgcacctgggcttgagactggtatctgcttcaccgtccctgacacaacaaatgaaaccggaacagaatgagaacactggagggagggccttgctgcctacccccatctaaaggacccccatttctgacccattagcagtctttaatgtggggctctgagatctaggcccactgacagggataggggatgccctacccttaatctaggctggatacatttgctgtcttctcaaggaagaggccaagccctcccagcaacccttcctcatgtcctgccgacgcccctgggatccctgctcagccaagcttgtcagcagcctgtaggaccatggttcacgtgacaataaaaggtagaaggtaaa

SEQ ID NO: 3231 - DNA, 1169 bp, Rattus norvegicus
  Genbank Accession No. NM_013075
gtcactcagtgacagatggacaatgcaagattgaactcctttctggaataccccatccttggcagtggcgattctgggacctgctcggcgcgagtttactcctctgaccatggaattacaactttccaatcctgcgcggtcagtgccaacagctgcggcggcgacgaccgcttcctagggggcaggggggtgcagatcacctcgccccatcaccaccaccaccaccatcaccatccccagccggctacttaccagacttctgggaaccttggggtttcttattcccactcgagttgtggtccaagctatggcgcgcagaacttcagtgcgccttatggcccctatggattaaatcaggaagcagacgtaagtggtgggtaccccccgtgcgctcccgctgtttactctggaaacctctcgtctcccatggtccagcatcaccaccaccaccagggttatgctgggggcacagtgggctcgccccagtacattcaccactcatatggacaagagcaccagagtctggccctggccacgtataataactccttatcccctctccacgccagccaccaagaagcctgtcgttcccctgcttcagagacgtcttctccagcgcagacctttgactggatgaaagttaaaagaaaccctcccaaaacagggaaagttggagagtatggctacgtgggtcaacccaacgcagtgcgcaccaacttcaccaccaagcagctcacagagctggagaaggagttccacttcaacaagtacctaacaagagcccgcagtgagatagccgcgtccctgcaactcaatgagacccaggtgaagatctggttccagaatcgccgcatgaagcagaagaagcgcgagaaagaggggctcttgcccatgtcacccgccacccctcctggaagcgatgagaaaactgaagaatcatctgagaaatccagctcctcgcccagcgccccttctcccgcatcatctacctcagatactctgactacctcccactgagctgccccagcccaactctgacccaggcttctccctgggctgagatttcttacccaaagcacattcttagcttatcttcctttctttccagactctctcttcctttctggtcccatctggggagctcctggctaagataagatatttccaga

SEQ ID NO: 3232 - DNA, 1519 bp, Rattus norvegicus
  Genbank Accession No. NM_013078
tgcaactgaaagcattcttagcttgccagtggcccccactgcctgcctgcctgcggaactctctagaccatagattcctcctccactctagcaagagaagatgctgtctaatttgaggatcctgctcaacaaggcagctcttagaaaggctcacacttccatggttcgaaattttcggtatgggaagccagtccagagtcaagtacagctgaaaggccgtgacctcctcaccctgaagaacttcacaggagaggagattcagtacatgctatggctctctgcagatctgaaattcaggatcaaacagaaaggagaatacttgcctttattgcaagggaaatccttagggatgatttttgagaaaagaagtactcgaacaagactgtccacagaaacaggcttcgctcttctgggaggacatccttcttttcttaccacacaagacattcacttgggcgtgaatgaaagtctcacagacacagctcgtgtgttatctagcatgacagatgcagtgttagctcgagtgtataaacaatcagatctggacatcctggctaaggaagcaaccatcccaattgtcaacggactgtcagacctgtatcatcctatccagatcctggctgattaccttacactccaggaacactatggctctctcaaaggtctcaccctcagctggataggagatgggaacaatatcctgcactccatcatgatgagtgctgcaaaattcgggatgcaccttcaagcagctactccaaagggttatgagccagatcctaatatagtcaagctagcagagcagtatgccaaggagaatggtaccaggttgtcaatgacaaatgatccactggaagcagcacgtggaggcaatgtattaattacagatacttggataagcatgggacaagaggatgagaagaaaaagcgtcttcaagctttccaaggttaccaggttacaatgaagactgctaaagtggctgcgtctgactggacgtttttacactgcttgcctagaaagccagaagaagtagatgatgaagtgttttattctccgcggtcattagtgttcccagaggcagaaaatagaaagtggacaatcatggctgtcatggtatccctgctgacagactactcacctgtgctccagaagccaaagttctgatgcctgcaagaggacgaaaaacccaaaagacaaaaaaatctgttctttagcagcagaataagtcagtttatgtagaaaagagaagaattgaaattgtaaacacatccctagtgcgtgatataattatgtaattgctttgctattgtgagaattgcttaaagcttttagtttaagtgctgggcattttattatcctgcttgacttgacttaagcactctcttcaattcacaacttctgaatgatatttgggtttcatattaattatcatacacatttccttccactaagcattaaacactatgcttacaatgcataccatctaagtcattaaatgtaatccatgcttattacctt

SEQ ID NO: 3233 - DNA, 2226 bp, Rattus norvegicus
  Genbank Accession No. NM_013079
aagaagcttggcgactgtaaggcgagaggaagcctccagcgggtcttgtcgctgagctacctcagctccacctcctctggccctggcccctagtgcgcagactgcctgcagccctcctgtagcatgtgtggcatctgggccctcttcggcagcgatgactgcctttccgtgcagtgtctgagtgcgatgaagattgcgcacaggggcccagatgcattccgttttgagaacgtcaatggatacaccaactgctgttttggcttccaccggctggcggtggttgaccccctgtttggaatgcagccaataagagtgaggaaatatccttatctgtggctgtgttacaacggtgaaatctacaaccacaaggcgctacaacaacgtttcgaatttgagtatcagaccaatgtggacggtgagataattctccatctctatgacaaaggcggcatcgagaaaaccatctgtatgttggatggggtgtttgcatttatcttactggacactgccaataagaaagtattcctgggcagagatacctatggtgtcaggcctttgtttaaagccttgacagaagatggatttctggctgtgtgttcagaagccaaaggccttgtctccttgaaacactccaccacccccttcctaaaagtggagccctttcttcctggacactatgaagttttggatttaaaaccaaatggcaaagtcgcgtctgtggaaatggtcaaataccatcactgtacggatgaaccactgcatgccatctatgacagtgtggagaaactcttcccaggctttgagatagagaccgtgaaaaacaatctgcgtatcctttttaacaacgctatcaagaaacgcttgatgactgaccggaggattggctgccttttatcaggaggcctggactccagcttggttgctgcctccctgctgaagcaactcaaggaggcccaagtgccctatgctctccagacatttgctatcggcatggaagacagccctgatctactggctgccagaaaggtggcaaattatattggaagtgagcatcatgaagtcctttttaactctgaagaaggcattcagtccctggacgaagtcatatttcccttggaaacttatgatattacgacagttcgagcatctgtaggtatgtatttaatttccaagtatattcggaagaacacagacagcgtggtgatcttctccggagaggggtcagatgagcttacacagggctatatatatttccacaaggcgccttctcctgagaaggcggaggaggagagtgagaggctcctgaaggaactctacctgtttgatgtcctccgtgccgaccgcactactgctgctcacggtctcgaactgagagtcccgtttctggatcatcggttttcttcctattacctgtctctgccaccagaaatgagaattccaaaagatggcatagaaaaacatctcctgagagagacttttgaggactccaacctgctacccaaagagattctctggcgacccaaggaagccttcagtgatgggatcacctcagtcaagaactcctggttcaagattttacaggacttcgttgaatatcaggttgatgatgcgatgatgtctgaggcctcccagaaatttcccttcaatactccccaaactaaagaaggctattactaccgtcagatctttgaacaccattaccccggccgggctgattggctgacccattattggatgcccaagtggatcaatgccaccgacccttctgcccgcactctgacccattacaagtcaactgccaaagcttagacgctctctacactcttgtgtaaaagtcaatgtttcttcctcctgctctgaaggtagagagacattgaaacaatcagagagaatgaaagtcaaccatcagctgctcaggcttatttaggcatggaaagaaataaaagtatcacatctaaaatgcctcctggttgtaggtaccagtgcggccttgtagctagagactgagtggctcttgctgtattgccactgtcgggatgacagtgagctatgctaaggggcatcttagttctgccttcattcctaacagctggctagtcagattgctatgtgagtcctttgtgggaactggtgacaattctgctttgtaggccaaggattcagtttctttctctttctttctttctttctttctttctttctttctttctttctttcttggaattc

SEQ ID NO: 3234 - DNA, 2153 bp, Rattus norvegicus
  Genbank Accession No. NM_013082
cgtcccctccgttctgcatccccaaacttcagccgcagctctgtttcaacccatcggctgcttgcttcaaatcagacagcaccgcgacccagacacccgagtccgcggagtgaaagcacaacgccgagtaggaccagaccaggaaaatagactcgtgaagcagcaactctggattgggagggcagaagccaacaagtgagaaggcgcggcgtttccggggcgctgtgcgaaagctagagcaggcgccagagaagacagctcgagctcagaacccgagaccaagcctctctcccggaggcagctcagctcctatcttctctaggcccgctgcagcgtgcgctgggcttcgttttatgcgggtacgagccacgtccccggggaatatgcagcgtgcgtggatcctgctcaccttgggcttgatggcctgtgtgtcggcagagacgagagcagagctgacatctgataaggacatgtaccttgacagcagctccattgaggaagcttcaggattatatcctattgatgatgatgactattcttctgcctctggctcaggagcttatgaagacaaagggagtccagatctgacaacatcccaactgattccaaggatctccctcactagtgctgctcccgaagtggaaaccatgacgttgaagacacaaagcatcacacccactcagaccgagtcacccgaagaaactgacaagaaggagtttgaaatctctgaggcagaagaaaagcaggaccctgctgtaaaaagcacagacgtgtacaccgagaaacattcagacaatctgttcaagcggacggaagttctagcagctgtcattgctggcggtgtgattggctttctctttgccattttcctcatcctgttgttggtgtaccgcatgcggaagaaagacgaaggaagctacgaccttggagaacgcaaaccgtccagcgcagcttaccagaaggcacccactaaggagttttatgcataaaactcccacttagtgtctctatttaagagatcactgaacttttcaaaataaagctttagcatagaataatgaatatctttgttatctgttttgttcattacagagccatgctggccctttaatgatgaagatcccattgtatttaaaatttttcatatatttctttagaatgacttaaaagtaaaaatttaacatctgcagtgttctgtgaatagcagtggcaaaatattttgttacaaaaacccttgacattcatggaattgatttgaacatctatgtgcaaatacaaaatgattgtgtttgtcctctggttcaaagatgactgctgttcccctcatcagcagatctccagttgaccttaccgagttgatctttgttaatttatctcttgttcctcttctctgccctcccttcttgtctcctcccttaaaaacaaaaccttatgccttttgtagctgtcatggtgcaatttgtctttgaatgattacaataatggtaatttagtgtatatgtgatttttttcaattatgtaaactttaacctcctctttatgtaatttttttaaatgtcagactacccattttacacttgctttaatttccattccctgtagcttcaggcagatttgcaaaggcaaattataaaattggattattactacgaaactgttagtcctagttatctaagcagtcttctcttggaggatttgacatcactgacaagcctcagcaaacccaaagatgctaacagtatttgagaagttgctacagactcctttggccactgtacttgctagtttacaatttgaaggtacaaggaagagtttaaaggaaaaaaaagatcagtttttgttcttaaaaatgcatttaagttgtaaacatctttttaagcctttgaagtgcctatgattctatgtaacttgttgcagactggtgttaatgagtatatataacagtttttaaaaagttggtattttataagcacagacaattctaatggtaacttttgtagtcttatgaatagacataaattgtaatttgggaacaagcaaactactgaataaatcacatggcctaatattgaaaatgtcactgttataaatttgtacatttcttatcaaatgtacagcttccctttgctatgactgactgtctgttctcagtg

SEQ ID NO: 3235 - DNA, 607 bp, Rattus norvegicus
  Genbank Accession No. NM_013086
ggatccgtatgaccatggaaacagttgaatcacagcaggatcgaagtgtaacacattctgtggcagagcatagctccttgcatatgcagactggccaaatttctgtccctactctagctcaggatgaggagactgaccttgccccaagtcacatggctgctgccacaggtgacatgccaacttaccagatccgagctcctactactgctttgccacaaggtgtggtgatggctgcctcaccagggagtctgtacagtccccagcaactagcagaagaagcaactcgaaagcgggagctgaggctgatgaaaaacagggaagctgcccgggagtgtcgcaggaagaagaaagaatatgtcaaatgtcttgaaaatcgtgtggctgtgcttgaaaatcaaaacaagaccctcattgaggaactcaaggccctcaaagacctttattgccataaagcagagtaactgtgtttgacttggacctggttgactgtgaactctaatcggggcaggcgatgcagcatcctcgtaatggccatatggacttgtagatgggtctcttaacccttgcttaagaatacagtctgctgtagagtgtgaattgggaattc

SEQ ID NO: 3236 - DNA, 1303 bp, Rattus norvegicus
  Genbank Accession No. NM_013087
gtggcggtctgagcgagcgcgcccttgcttcaaagcggtagcgactctagcgcctccggctaggctccaacccttctctaccctacgtctcaatagccacaccgcagtctccggcctcaagcgacccaggctatcttccagtcccgggactccgggtactgcggtccccagaaccgcccgtccagggaccaacccaagttccgcaggccgcggcggccgccaatgggggtggagggctgcaccaaatgcatcaaatacctgctcttcgtcttcaatttcgtcttctggctggctggaggtgtgatcctaggtgtagctctgtggttgcgccatgatccacagaccaccaccttgctctacctggaactgggagacaaaccagcacctagcaccttctatgtgggcatctacattctcattgctgtgggagctgtgatgatgtttgtaggcttcctggggtgctatggggccatccaggagtcccagtgcctgctggggacgttcttcacttgccttgtgatcctgtttgcctgtgaggtagctgcgggcatctggggctttgtaaacaaagaccagatcgccaaggatgtgaagcagttctacgaccaggcccttcagcaggctgtgatggatgatgatgccaacaatgccaaggcagtggtgaagaccttccatgagacgctcaactgttgtggctccaatacgctgaccacactgaccaccgccgtgctgaggaacagcctgtgtccctcaagcagcaactcattcactcagcttctgaaggaagactgccatcagaaaatcgatgagctcttttctgggaagctgtacctcattggaattgcagccattgtggtagctgtcattatgatcttcgagatgattctgagcatggtgctgtgctgtggcatccggaacagctccgtgtactgaggcccttcgcttcgcaccagagggtccctggaatgaccagagggcaccttggggggcatggcctgtgtatatactatttctgtattactctgctacacttagcctttttacttttgagtcttttttgttctgaacttttcctgtcaccttttggagccgacaccacacataggtggcgtatgtggggacgtagaggtggagctggccctagctggcagggccctgtacttctgggacccctggagagttctgcctgctgagccaaacctcctccatagctacttgtccagaggccacatagccaagctagaaggccatgtccacccactctgcccactgtgggtcacatcgctcccatctttttaatccg

SEQ ID NO: 3237 - DNA, 2236 bp, Rattus norvegicus
  Genbank Accession No. NM_013088
cgggctcccgagcggggcctcactcggccccctccatgtgacggcgcctcgtggagcctgagtgagcagcgggtccgtgcggagccggaggcgggaggaacatgacatcccggagatggtttcaccccaatatcactggtgtggaggcagagaatctcctgctgacccgaggagtcgatggcagtttcttagcgaggcccagcaagagtaaccctggagacttcactctgtctgttagaagaaatggagccgttacccacatcaagattcagaacactggggactactatgacctctatggcggggaaaagtttgccaccttgcctgaactggtccagtattacatggagcatcacgggcagctgaaagagaagaatggagatgttattgagctcaagtacccactgaactgtgcagaccctacctctgaaaggtggttccacggtcacttgtctggaaaagaagcagagaagctgctgacagagaaggggaagcatggcagtttcctcgtccgggagagccagagccaccctggggacttcgtcctctccgtccgcactggtgatgacaaaggggagagcaatgacagcaagtccaaagtgacccatgtcatgatccgctgtcaggagctgaaatatgatgttggtggaggagagcgctttgactctttgacagacctggtggagcattacaagaagaaccccatggtggagacactgggcacagtcctgcagctcaaacagcccctcaacacaactcgtattaatgccgctgaaatcgaaagccgggttcgggagttaagcaagctagccgagaccacagataaagtcaaacagggcttttgggaagaatttgagactctacagcaacaggaatgcaaacttctctacagccgaaaagaaggacagagacaagaaaataaaaacaaaaatagatacaaaaacatcctgccctttgatcataccagggttgtcctgcacgatggggatcccaacgagccagtttctgattacatcaatgccaacatcatcatgcctgaatttgaaaccaagtgcaacaattcaaaacccaaaaagagttacattgccactcaaggctgcctgcagaacacggtgaatgacttctggcggatggtgttccaggagaactctcgagtcattgtcatgaccacaaaggaagtggagagagggaagagcaagtgtgtcaagtactggcctgatgagtgtgcactcaaagagtatggcgtcatgcgtgtgaggaacgtcagagaaagtgctgcgcatgactacaccttacgagaactcaaactctctaaggtcggacaaggaaacacagagagaaccgtctggcagtaccactttcggacctggccagaccacggtgtgcctagtgaccctggaggtgtgctggacttcctggaggaggtccaccacaagcaggagagcatcgtggatgcaggccctgtcgtggttcactgcagtgctgggattggccggacaggaacgttcattgtgattgatatccttattgacatcatccgagagaaaggtgtggactgtgacatcgacgttcctaaaaccattcagatggtacggtcccagaggtcagggatggtccagacagaagcacagtaccggttcatctacatggccgtccagcactacatagagacgctgcaacgcaggatcgaggaggagcagaaaagcaaaaggaaaggacatgaatataccaatattaagtattccctggtggaccagacaagtggcgatcagagtcccctgccaccttgcaccccaacgccaccctgtgcggaaatgcgggaggacagcgctcgagtctatgagaacgtgggcctcatgcagcagcagaggagtttcagatgagcttcgggtggcagcgcgcagatgtgaactttcaccccttccctaaaatgtcaagaatagacgagaaagtttccaggacccgtgttcagaagctcgccggggttgactgactgccttttgagaagcgaagtttggaaccatttgaaagagcacgtgcctaattggcacctcctttcctcagctaaggagaaactgctctgcgttgtcgacagtgctattgtcatggaattggttttgaattgtgaagcagctaaattgtgctctgtattttctacattgtgggactcaaattctagtcacgggcaggattttgtttgtttctttttatgaccttaacagacctgttaagaccg

SEQ ID NO: 3238 - DNA, 556 bp, Rattus norvegicus
  Genbank Accession No. NM_013096
acattctccttctgatagactcaggaagcaatcatggtgctctctgcagatgacaaaaccaacatcaagaactgctgggggaagattggtggccatggtggtgaatatggcgaggaggccctacagaggatgttcgctgccttccccaccaccaagacctacttctctcacattgatgtaagccccggctctgcccaggtcaaggctcacggcaagaaggttgctgatgccttggccaaagctgcagaccacgtcgaagacctgcctggtgccctgtccactctgagcgacctgcatgcccacaaactgcgtgtggatcctgtcaacttcaagttcctgagccactgcctgctggtgaccttggcttgccaccaccctggagatttcacacccgccatgcacgcctctctggacaaattccttgcctctgtgagcactgtgctgacctccaagtaccgttaagccgcctcctgccgggcttgccttctgaccaggcccttcttccctcccttgcacctatacctcttggtctttgaataaagcctgagtaggaagc

SEQ ID NO: 3239 - DNA, 554 bp, Rattus norvegicus
  Genbank Accession No. NM_013102
gccgccgccgccgccgccgccgccatgggagtgcaggtggagaccatctcttctggagacgggcgcaccttcccgaagcgcggccagacctgcgtggtacactacacggggatgcttgaagatgggaagaaatttgactcctctcgggacagaaacaagccttttaagtttacactaggcaagcaggaggtgatccgaggctgggaagaaggggtagcccagatgagtgtgggccagagagccaaactgataatctccccagactatgcctatggagccaccgggcacacaggcatcatcccaccacatgctactcttgtttttgatgtggagcttctaaaactggaatgacagaagtggcctcctcccttagctctgcacatggatctgccatggaggaatctggtacctccagatgggtgcacatgaatccatgggagcttttcctgatgtcccaccactctttgtatagacacctactaactgaatgtgttccgtcactcagctttgcttcggacacctccatgtcctcttcccccttctgtatgtgtgtt

SEQ ID NO: 3240 - DNA, 2328 bp, Rattus norvegicus
  Genbank Accession No. NM_013103
cacaaccccttctttttccgttcttggaaaatggtgtccaagctcacgtctctccagcaagaactcctgagtgccctgctgagctccggagtcaccaaggaagtgctgatccaggccttggaggaattactgccgtccccgaatttcggggtgaagctggagacactgcccctgtcccccgggagcggggcggatctcgacaccaagccggttttccatactctcaccaatggccacgccaagggccgcttgtctggggacgagggctcagaggacggcgacgactatgacactcctcccatcctcaaagagctccaggcgctcaacaccgaggaggccgcggagcagcgggccgaggtggaccggatgctcagtgaggacccatggagggccgccaaaatgatcaagggatacatgcaacagcacaacatcccccagagggaggtggttgatgtcacaggcctgaaccaatcccacctttctcaacacctcaacaagggcacccccatgaagacccagaagcgagctgccctgtacacctggtacgtcagaaagcaacgggagatcctccgacagttcaaccagacagtccagagctctggaaacatgacagacaaaagcagtcaggatcagctgctatttctctttccagagttcagtcaacagaaccagggccctgggcagtcggaggacgcctgctctgagcccaccaacaagaagatgcgccgcaaccggttcaaatgggggcccgcatcccagcaaattttgtaccaggcctacgaccggcaaaagaatcccagcaaggaagagagggaggccttagtggaggagtgtaacagggcagaatgtttgcaacgaggggtctccccctccaaagcccatggcctaggctccaacttggtcacggaggtccgtgtctacaactggtttgcaaaccgccggaaggaagaggcattcagacagaagctggccatggatgcctatagctccaaccagacgcacaacctgaaccccctgctcacccatggctcccctcaccaccagccaagctcctctccacccaacaagttgtcaggagtgcgctacagccaaccgggaaacaatgaggtcacttcctcttcgacaatcagtcaccatggtaacagtgccatggtgaccagccagtcagttttacaacaagtctccccggccagcctggacccaggccacagtctcctctcacctgacagtaaaatgatctcggtgtctggaggaggactgcccccggtcagcaccttgacgaatatccacagcctctcccaccacaatccccagcaatctcaaaacctcatcatgactcccctgtccggagtcatggccattgcacagagcctcaacacctcccaagcccagggtgtcccagtcatcaacagtgtggctagcagcctggcagccctacagcccgtccagttctctcaacagctgcacagccctcaccagcagcccctcatgcagcagagcccaggcagtcacatggcccagcagcccttcatggctgcggtgactcagctacagaactcccacatgtatgcacataagcaggagccccctcagtattcccacacctcccggttcccatctgcaatggtggtcacagataccagtagcatcaataccctcaccagcatgtcttccagtaaacagtgtccactgcaagcctggtgatacccacataaccactcactttgtgcacagcaacgaggaccccattttccacaccatcagtttctgggcatctgtcatagagaagtccagcgacctgacaggcacctgggaagccaggagagatccctgcttacctgacatctgccggggacctccgacaagcccaagccactctcaggaggtgcagcccgaagcccagcttctcttctttgcagtattgtcgtaatgcctctcccaagatgccaagtgcccttgtttctcccagaggtggccggtgcaaaatggtgcaacaggaatcgagaagcccatggagtttccactgcaatccgtcattgaacaaactgatgcaaaaacttgaatctgttactgaaataagatgaggaccgaggagggtgtgtgctactgaactgagccagacactgtaaataactgacagacccccctctcccatcccagtgtctcaagatttcttctaaagaagtaaatttgtcaatgggtgtaaactatcaactactgtattaagtgcaatttttccttccacagatatctacccctgcccgatataatactaaagtgtctatcacttttcttgtaaaggtagagttaaattccaaaaaaaaaaaa

SEQ ID NO: 3241 - DNA, 2026 bp, Rattus norvegicus
  Genbank Accession No. NM_013105
aggaagccctgcagagcatcagaggcccagctagagggacaacacagaggagtaatttgctgacagacctgcagggatggacctgctttcagctctcacactggaaacctgggtcctcctggcagtcgtcctggtgctcctctacggatttgggacccgcacacatggacttttcaagaaacaggggattcctgggcccaaacctctgcctttttttggcactgtgctgaattactatatgggtttatggaaattcgatgtggagtgccataaaaagtatggaaaaatatgggggttgtttgatggtcaaatgcctctgtttgccatcacggacacagaaatgatcaagaatgtgctagtgaaggaatgcttttctgtcttcacaaaccggcggtattttggcccagtggggattatgggaaaggccatctctgtatctaaggatgaggagtggaagagatatagagccttgctgtcacccacgttcaccagtggaagactcaaggagatgttccctgtcatcgaacagtatggagacattttggtaaaatacttgaggcaagagaaaggcaaacctgtccctgtgaaagaagtgtttggtgcctacagcatggatgtgatcaccagcacatcatttggagtgaatgttgattccctcaacaacccgaaggatccttttgtggagaaagccaagaagctcttaagaattgatttttttgatccgttgttcttgtcagtagtactctttccattcctcacgccagtatatgagatgttaaacatctgcatgttcccaaaagattcaatagaatttttcaaaaaatttgtgtacagaatgaaggaaacccgcctggattctgtgcagaagcatcgagtggattttcttcagctgatgatgaatgctcataatgattctaaagacaaagaatctcatacagccctatccgatatggagatcacagcccagtcaatcatttttatttttgctggatatgaacccaccagcagcacactttcctttgtcctgcattccctggccactcacccagatacacagaagaaactgcaggaggagatcgacagggctctgcccaataaggcacctcccacctatgatactgtgatggaaatggaatacctggatatggtgttgaatgaaaccctcagattgtatccaattggtaatagacttgagagagtctgtaaaaaagatgttgaaatcaatggtgtgtttatgcccaaagggtcagtggtcatgattccatcttatgctcttcaccgtgatccacagcactggccagagcctgaggaatttcgcccagaaaggttcagcaaggagaacaagggcagcattgatccttatgtatatctgccctttggaaatggacccaggaactgcattggcatgaggtttgctctcatgaatatgaaactcgctctcactaaagttctgcaaaacttctccttccagccttgtaaggaaacacagatacctctgaaattaagcagacaaggacttcttcaaccaacaaaacccattattctaaaggttgtgccacgggatgaaatcataactggatcatgattttccctcaaggagttctgctgaattcttcagaaatgtggtgtctaagaacaccagaccctttaatttatgtcatgaataaaattcagatgaaattagggcttaatcgactttgttttgatttggtacatctttgctctttctcagtgtctacaatgtacccatctaatataaaggaaatgacaagtcagtgacagaacaggaacttaacctttggtgattctcatgggactacctccatccacatctggttgtctctgttaatttcttttgatagtaaccttgtctctgtaatttgatcaagaatttttcatgaaaatgtgaactattgtgacaactttaattgtagatttggtatcagatgttttagatgcattattctacactaaatgttacatggaaaaaatgtgaataaacacttctttaaaaaatccccatttt

SEQ ID NO: 3242 - DNA, 6471 bp, Rattus norvegicus
  Genbank Accession No. NM_013111
gacgacttggccgccaggcaccgatcctccccggtgagaaggtccacgaatcttactgcagacagatttgctcagcgcgatgggctgcaaaaacctgttgagcctgggtcagcagatgctgcgccggaaagtggtggactgcagccgggaggagagccggctgtcccgctgcctcaacacctatgatctggtagctcttggggtgggcagcaccttgggcgctggtgtctacgtcctagccggtgcagtggcccgtgagaatgctggtcctgccatcgtcatctccttcctgatcgctgctcttgcctcagtgctggccggcctgtgctatggcgagtttggtgcccgtgtccccaagacgggctcagcctacctctacagctatgtgacagtgggggagctctgggccttcatcactggctggaacctgattctctcctacatcatcggtacatccagcgtggcaagagcctggagtgcaacttttgacgagctgataggcaaacccatcggagagttctcgcgtcaacacatggccctgaacgcccctggggtgctggcccaaaccccggatatatttgctgtgattataattatcatcctgacaggactgttaactctcggtgtgaaagaatcagccatggtcaacaaaatcttcacctgtatcaatgtcctggtcttgtgcttcatcatggtgtcgggattcgtgaaaggctccattgagaactggcagctcacggagaataaatccagtcctctctgtgggaacaatgacacaaacgtgaaatacggtgagggagggttcatgccctttggattctctggtgtcctgtcaggggcagcgacctgcttttatgccttcgtgggctttgactgcatcgccaccacaggggaagaagtcaagaacccccagaaggccattcctgtgggcattgtggcgtccctcctcatttgcttcatagcttactttggggtgtccgctgctctcaccctcatgatgccctacttctgcctggacactgacagcccactgcctggcgccttcaagtacaggggctgggaagaagctaagtatgcagtggccgtgggctccctctgcgcactctccaccagtctcctaggttccatgttccccatgccccgagttatctatgccatggctgaagatggactactgtttaaatttttggccaaaatcaacgataggaccaaaacaccaataatcgctactgtgacctcaggcgccatcgctgctgtgatggccttcctctttgaactgaaggacctggtggacctcatgtccattggcactctcctggcttactctttggtggctgcctgtgttttggtcttacggtaccagccagaacaacctaatctggtataccagatggccagaaccaccgatgagctagaccaggtagaccagaacgagatggtcagtgccagtgagtcccagacaggctttttaccagcagccgagaagttttctctgaaaaccatactctcacccaagaacatggagccgtccaaattctcagggctaattgtgaacatttcagccggcctcctagccgttcttatcatcaccgtgtgcattgtggccgtgcttggaagagaggccctggctgaagggacgctgtgggcagtctttgtaatgacaggatcagtcctcctctgcatgctggtgacaggcatcatctggaggcagcctgagagcaagaccaagctctcatttaaggtaccctttgtccccgtacttcctgtcttaagcatctttgtgaacatctatctcatgatgcaactggaccagggcacgtgggtccggttcgcagtgtggatgctgataggctttgccatctactttggctatggggtctggcacagtgaggaagcatccctggctgctggccaggcaaagactcctgatagcaacttggaccagtgcaaatgacccacagccccacccaccaaggtgacagcggttgacgggtgcgcagaggcctgggaccctcacactctctcccctcatgcctcgggaccagctcacacccccaatgtcaccaaagctggtttgtagcctcagccatagctgacatggcctggtcagacaaccctgcagccagctccagagatcctggtcacttctggacagttccttggtttttctcatctccctctgaacaaagaaagcagcccttctccctgccagctgggcgctttgctgcttcggccccagcagaagggaggcccccttctcctcttattcgggaagcaggcctccctccctccctgggaccaccctgcgtacactcatacgtacactccagagggttagtgggcgtctatctccctgtcaacccagccaggacagccacctgaccccaagatgcgagactagcccagtgaggaagctgtctcccagcagtgcaacccaacagcccatcaactccagaatacctagaggaccaacaggcccgcatcttactgctttcaggctggggtattaggatggggccctgatctgcatagaggcttctggaccaagcccagcacagtatagccgttcttacgcgcagaaaacgggaggtccctggagtgatcgattgtatcaagactggatgccagctctgctcacgtggacgagggcgacattctctagccttattcttagcaggcctggatcagtttctgctgctcttggcatctgtcctcactgtcctgagtcactggaacacgaggctatatcagtaggattgtcattctctcaggtcttccaaggtgcttcggacaggtggcactcaattcagggtggtgacactcttctaacgtgacgcgaaggactgctgtgggggtcctccagtcgcttgctgtgaatcactccactggattaacttggggttcactgttgttaatgttccaaccttgggagatggtcaaataattacccagtgccatatcagcttgtggttcgtgatgtgcgctctgcacaagaggtggcttggggtcctaccgctatccctcctgtagctgtggtgcctttgcctgccgtgctactggtaagatttctaccctggcctggaccttctgctccccgagtctgccttcatttcccctcccccatgctccttatctctctgggtgaggccctaggcacacctcttcacttactctgtgtagatagaaaggatggtgagtgagtgctggtggattctggaaccagcagggcacccctcctccactcccaacgccatgacatcagggtgggaaggctggtgtcttagactaatattaatgctgtttttaaagcctagctttctttcctgtctggcctttgacccatgtctggtagaaaccggccgggtaaactgatgacactgtcttcccctctgctccggaaggttcttgggaatggccggagttggtggaactggcctggcacggaacctagtggtggagcacttgcctagcatatgcagggccccagtgctacggaaaattagagaaaccgcccggttgctgtgtcagccagtggagggtagcagagcagccaagagccaggcatcgtgccaggccctgacccccatccaggcactttgtctcctaggttgtctgagaaaacttcaaagggagtattataagaccctaaatgttgagtttctaaaggtatttaaagttatgtagattggtgctgtaaaatattttgataaatattaacttatttcattcgggtcttaattacctgttgtcttcttagggcctgttagatatgtctgggttggtttttttcccccccttgttacttacataggcagagaaggagtgcccagtgaggtgttgggagaattaggtttcactctgtagctgccctagtctagcctctgcctcaggctcctgagtgctaaggtcgtaggtgtgagcctcctctcctcctgctaaactgtctcctcgctttctggatgaaactttcctgtctaaggcagctgaacaatgtgtttacagttgacatttcagccagcagcctggatcccaccaaggggaaaggtgtatatatatatatatatatatatgggtttgatccgccgacagcaatggtggcagatctgctctgtgtgtttcactatgtgacacaggagcaaacacaggccttgctgggggtgggggttggaggggtgacatcctatacccacttcctagtcaggaaaagatatgcaggggtgacttgcctagttagttgattggccactgagcttttactaagtgtggacagttaaccagggaagctcttttggggtgcacgggaacaatgaagcttggagggagtccctaatatgctttttattatgcccccagttccttttcctgaaagaaaacacaagccccaaacccagacaacacacatacacacatccctccggacccacagtaggtagggtcgagtctcctagtctcccgtccaaaaaagagtcccattggattcaaagcgtggccagtatttcctacctggttgggacttaaacattttaaagacaacttcccatgccttcccttcaactagagtgctcacattggaaagacccattttctcaggagcctgtgcccttccttcttgtctctgggtcgaagttcatgaagaagccaatacccagggagctgtgcttaggagtggggcccaagatgtctccacctttcagaaggtgccccagtggtggcttggtggcagaagtgactgcaggaccgtggcaggacatcaggctcctccacctgcccctagtggcaagggttggatatccccctccaaaccccctcctgagcacagcagcgtgtgcacaccaaaggaatatatgacacactccaaccctgtccactacctgccactctcatgcacagggctggggataccagtggctatgtttgtacgttggccctaaccccaggcagacattctgaattgggtagtgttcatagtctcctctaacaaggaacttgcccaacgctggaagaagcttagaaacagcagtgtgagggactgggttcctcccataagcgtggacaagtcccacagaccccctcatatctaccggccaagccacgggcaccgctggcctgtgtacctacctacaatgaaaacatggctggctctcgccggggcccatcctttctgacttgaatgtcgtatgtccccacagaaacttatttcattctaataaaagcttaagcttactgttttcttggtacccaaacactaaggaatcttagtagggatctcagtgccaggatacttgagtccaggtatggttgaggtagccaagtgagtggccaacagagaatacatgagccatggaactgctacagaagtcaaagtcagcggtgaatgtatgttatgtgcggttattttatggagttcaaaccgtcctgtctgtttggcctcctcgtgagaagattgtacgtgaggctcctggggggagagtgaacggtccattccttcagctcattttggtgtgtggaatgcttttattgacacagtggtacaggtgaaatgtgcaccagtccaatgtggttaggatgaaaattttaaggcaaaaagaaaaaaaaatcagctggttttcacctcccttactctagcccagtctggccgtatccgctgctccattgaactggaagaatatggtgtggccaagggtcttgggacatggtgaccaaggagccttcctggaccatcctgttacatgtgctgaatggctagcaaaaaaagcccaggagagatgaaaagaccacgtccaaaaaatgttctcagggcgctggcgtgtccagcagggtcaggaagcaagatttaggaagagacatcatgcaaactaatttattgacaagtgttacctttgcgttccttgacaagctttgcgttggactatttcccattggaaagttataatatatcttgtattaaggtattactgcttgttgtgcctgcagcttcgatgggttaaggtcacagagggtcatgatactaatgagggctggtttattagcaaacctgagcagtaaagtgctttctccagcacaatttttttacttctactgaacacggagccattattaaaagagttatgtgtggattttcattatgtaaattgtatatatttttttgcttgttcgaggttctatttttctaatagtcttcttacagtttcttacaatgacattagattaagtccgatactaactgtaaatcaagctggtctctgttggattcccgtggattaattctatttattttaaggccaagtgcaggtgtcgtccatcacccttttaagaaatgtgaaacttgtgtctcccctcgtggctgaatacattgtacactggcaaaccccctcccgtccctgtgtgtcagagctattttgtggtacattgtgtcatgcttctgcagatgctaataaatcctgtctggcttccaaaaaaaaaaaaaaaaaa

SEQ ID NO: 3243 - DNA, 413 bp, Rattus norvegicus
  Genbank Accession No. NM_013112
atgaagctgcttgcaatggttgcactgctggtcaccatctgtagcctagaaggagctttggttcggagacaggcagcggagacggatgtgcagaccctgttcagccagtatcttcagagtttaactgactatggcaaggatttgatggagaaggcccagccctcagagattcagaaccaagccaaggcttactttcagaatgcacaggagagactgacaccctttgtccagagaactgggacgaatctgatggacttcttaagccgtttaatgagccccgaggagaaaccagctcctgccgctaagtgaggtgtgtcaggactcgtcttcctaccccagctgacccactggccatcgctggagtccctctcccgactttctgcttgtcttttccaataaattcggaaggagtt

SEQ ID NO: 3244 - DNA, 2528 bp, Rattus norvegicus
  Genbank Accession No. NM_013113
gagcccgcgctccactcctttcgtccttcccggtgactttccctccttgtccctggtccatctcgccagaggtcatagcaggcagagtggtgcagctacagcttgaagcagcagctgcggggttcgctgagccccccgggaggcgatcggagcgcggggagagcaggagtgcggccacgcgcccacctctaggtgcggggctcggagccgcccagcccgcgcgcgccctcctccctcctccctcctccctccgcccccgccgcacctccccctcctcccgctctgcttaggctgctccgcggcgcgcctcgcactcggagagccgcagcggcagcggcgcgtctcgcctttggagacagagccgggccgcggggacaccgagcagtcgccgcgaggacgccagggcgcgcgcagcactcgctttccctcggcctcggccgccactgctgagcagacaccatggcccgcggaaaagccaaggaggaaggcagctggaagaaattcatctggaactcggagaagaaggagtttttgggcaggaccggtggtagttggtttaagatccttctgttctacgtgatattctatggctgcctggccggcatcttcatcgggaccatccaagtgatgctgcttaccatcagtgagctgaaacccacgtaccaggaccgtgtggccccgccaggattgacacagattcctcagatccaaaagactgaaatttccttccgtcctaatgaccccaagagctacgaggcctatgtgctaaacatcatcaggttcctggaaaagtacaaagattcggcccagaaggacgacatgattttcgaggattgtggcagtatgcccagtgaacccaaggagcggggagagttcaatcatgaacgaggagagcgcaaggtgtgcaggttcaagcttgactggctggggaactgctctggtctcaatgatgaatcctacggctacaaagaggggaagccctgtatcattatcaagctcaaccgaatgctgggcttcaaacctaagcctcccaagaatgaatccttggagacttaccctctgacgatgaagtataatccaaacgtcctacctgtccagtgcactggcaagcgcgatgaggataaggataaagttggaaacatagagtactttgggatgggcggattctatggctttcctctgcagtactatccctactacggcaaactcctgcagcccaagtacctgcagcccctgctggccgtgcagttcaccaacctcaccttggacactgaaatccgcattgagtgtaaggcgtatggtgagaacattgggtacagtgagaaagaccgttttcagggacgctttgatgtaaaaattgaagttaagagctgatcacaagcacaaatctttcccactagccatttaataagttaaagaaaaagatacacaaacctactagtcttgaacaaactgtcatacgtatgggacctacacttaatctctatgctttacactagcttctgcatttaataggttagaatgtaaatttaaagtgtagcaatagcaacaaaatatttattctactgtaaatgacaaaagaaaaaaataaaaattgagccttgggacgtgcccatttttactgtaattagactccgtaactgacttgtagtgagcagtgttctggcccctaagtatcgccgccgtctgttttatttagtgtacagtactataggtgcgcactctggtcattttccaagccatgttttatcatatctgttttctactttccgtgagcgaggtttgctgtccaaggtgtaaatactcatgggaataaaactggcatggtactttcccttcctttctcattttcttggctctgagatttcaaaggtaacggcccatcaacaagcatttttaacacactccatagtctttccctgtggtatcaggtctttactattgtttttctttgtttcctggggctggggggtgggctgtcgtgggggaactgccctttaaattctaagtgacgctgcagaaaaacaacggtgatgggttgtgttgtgctccgtgctgagtgctgtctcgccatctctccccttgtcctccagtgtgctccgaagctgtgtctgatctggatctgcccgtcactttggctagtgatggggctagttaatttgcttagtacatttccttttccttctttcctttctctggaggcatcatgtgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaaatctttattttgaactttataaaaagcaatgcagtaccccatagactggtgttaaatgttgtctacagtgctaatccatgttctagcatatgtagtgattgccaggagtacagtgctcttgttggtcttgtgtcagtcaggttaacacaatggacaataaaagaatgaacacattc

SEQ ID NO: 3245 - DNA, 2156 bp, Rattus norvegicus
  Genbank Accession No. NM_013120
gagggtccacagtgtgggaccatgccaggcaccaaacgatatcagcatgtgatcgagacccctgagcctggtgaatgggagttgtcagggtatgaagcggctgtgccaatcacagagaaatccaacccactgacccgaaacctggacaaagcagatgcagagaaaattgtcaaactgctggggcagtgtgatgctgagatattccaggaggaggggcagattgtgcccacctaccagcgactatacagcgaatcagttctgaccaccatgttgcaagtggctggaaaagtccaggaagttctgaaggagccagatgggggtctggtagtgctgagtggagggggaacctctggtcgtatggcatttctcatgtctgtgtctttcaaccagctgatgaaaggcctgggacaaaagcctctttacacctacctcattgcaggaggtgacaggtctgttgtggcctctcgtgaacagacagaagatagcgccctacacgggatcgaggagctgaagaaggtggctgctgggaagaagagagtggtcgtcataggcatctctgtgggactctctgcgccctttgtggcaggtcagatggactactgcatggataacacagccgtcttcttgccggttctggttggcttcaatccagtgagcatggccagaaatgaccccattgaagactggagatcaacattccggcaagtggcagagcggatgcaaaagatgcaggagaaacaggaagcttttgtgctcaatcctgccatcgggcccgaggggctcagcggctcttcccgaatgaaaggtggaggtgccaccaagattctactggaaaccctgctactagcagcccataagactgtggaccagggtgttgtgtcctctcaaagatgccttctggaaatcctgaggacatttgagcgggctcatcaggtgacctacagtcaaagttccaaaattgccacgctgatgaaacaagtcggcatcagcctggagaagaaaggccgagtgcacttggttggctggcagactctcggcatcattgccattatggacggagtagagtgcatccacacttttggtgctgatttccaagatatccgtggctttcttattggtgaccacagtgacatgtttaaccagaaggatgaactcaccaaccagggtccccagttcaccttctcccaggatgacttcctgacttccatcctgccatccctcacggagactgacaccgtggtcttcatttttaccctggatgataacctcacagaagtacaggccctggcagaaagagtgagagagaagtgccagaacatccaggccctggtgcacagcactgtggggcagtccttgccggcccctctaaagaaactctttccctcactcatcagtatcacgtggccacttcttttcttcgattatgaagggacctatgttcagaagttccagcgtgagttaagcaccaagtgggtgttgaatacagtgagtactggggcccatgtactgctggggaagatcctacagaaccacatgctggacctccgcatcgccaactccaagctcttctggagggcgctggccatgttgcagaggttctctggacagtccaaggctcgctgcattgagagcctccttcaagcaatccactttcctcaaccactgtcggatgatgtccgcgccgctcccatctcctgccacgtccaggttgcccacgagaaggaaaaggtgatccccacagccttgctgagcctcctactccggtgctccatctctgaggctaaggcacgcctgtctgcagcttcttcagtctgtgaggttgttaggagcgccctctctgggccgggtcagaagcgcagcacgcaagcccttgaagaccctcccgcctgtgggaccctgaattgatatttctagaaccatggaggggcagagtctccgtccacttccaaggggacatgtgccagcagtacacgctgtgggaagaactcagtttcgggtgggtggggcctaactgcccagaattggggaagagccctgttctcaaccggattatttccatttttactggtgtcttctgaactcagaaataaaactaaatgtcttgttttggaaaaaaaaaaaaaaaaaaaaaaaaaaaaaaaaaaaaaaaaaaaaaa

SEQ ID NO: 3246 - DNA, 1313 bp, Rattus norvegicus
  Genbank Accession No. NM_013129
ccctcaggccaactccttgtgagacttcacagaaggcaaaggcgttccaggacacactgcagctgcggccaactgcccagggggtggagactgctctcgggctctcagttgcccttcaggttctgcaccctggggacctggcagtggcagaatcatgtgggcatctgaatccactttgacatatggccctctggctcttcaaagcagtgtttgttcatggtccatgctggcgaggtccttaagaacacagaagtccatgtcagcagataaccagcctaccggagccaaaagggtgtggaggaaacctactgctaacagtgaaccactgtcaactgagtattccgagaggcagcatcccctgctgactgagaaattgatccaagcattaacacctgctggaagaagcagagaaggttgtgcatggtctgggaatcccagagttcatctacaaacaaagaggaggcgttctggatggatggcagctggaagccttcgccatagcccgctcttcttcaacacttaagcatttacctgggcattaagtaatgaaaattttgaaaccatatatgaggaatacatccatcttgtactacctgtgtttccttctcaacagtcacttcttaactgaggctggcatccatgtcttcattttgggctgtgtcagtgtaggtctccctaaaacagaggccaactggatagatgtaagatacgatctggagaaaattgaaagtcttattcaatttattcatattgatactactctatacactgacagtgactttcatcccagttgcaaagttactgcaatgaactgctttctcctggaattacaggttattttgcacgagtacagtaacatgactcttaatgaaacagtaagaaacgtgctctaccttgcaaacagcactctgtcttctaacaagaatgtaatagagtctggctgcaaggaatgtgaggagctggaggagagaaacttcacggagtttttgcagagttttatacatattgtccaaatgttcatcaacacgtcctgactgcactcgaaccttgtcagtgtttctgttattaagacacctccgcctgcccagaggcagcacagctccatgcattcgtgatctgctgggaaaccaagctgcctaacaggaaacggttgagccatttggatcccatgaaccctcgggaatgaagagagggaaagggcttttctcggacttatttttgcttgcttatttttaatttattacttcagttgtgcatatttgtaatataatagaagatgtggaataaagttgtatgcatattttatcagttga

SEQ ID NO: 3247 - DNA, 1417 bp, Rattus norvegicus
  Genbank Accession No. NM_013132
gtcctgctctcaaccgcagcctgcgccctaccttctgcagctccagcctactcctgaccgacagcatcatggctctcagaggcaccgtgactgacttctctggattcgacggcagggctgatgccgaagttcttcggaaggccatgaaaggcttgggcaccgacgaggacagcatcctgaacctgttgacagcccggagcaacgctcagcgccagcagattgctgaggagtttaagactctgtttggcagggaccttgtgaatgacatgaagtctgaactgaccggaaagtttgagaagttaattgtggctttgatgaagccctcccggctctacgacgcctacgagctgaaacacgctcttaagggagctgggacagatgagaaagtgttgactgaaatcattgcctcaaggacacctgaagagctcagggccataaaacaagcttatgaagaagaatatggttccaacctggaagatgatgtggtgggggatacctcagggtactaccagaggatgttggtggtcctccttcaggccaatagagaccctgacactgcaattgatgatgctcaagttgaactggatgctcaggcattgttccaggctggagagctgaagtgggggacggatgaagaaaagttcatcaccatccttgggacacgcagtgtgtctcatttaagaagagtgtttgacaagtacatgacaatatcaggatttcagattgaggaaaccattgaccgagagacctcagggaacttggagaacttactcctggctgtcgtgaagtctattcggagcatacctgcctaccttgcagagaccctctactatgctatgaagggtgctgggacggacgatcacaccctcatcagagtcatagtgtcgaggagtgagattgatctgtttaacatcaggaaggagtttaggaagaacttcgccacgtccctgtactctatgatcaagggcgacacatctggagactataagaaggccctgctgctcctctgtggaggcgaggatgactgaggagctgcctggagtgccctgggcccgcctgctgcccaccatcagcttccttcagcaccacgcctacttacgttcaatgcctgcctgcctgccacgctgccttactcacacgagtgtgtgctaatgaccaaagctgtctcgaatgaaagcagtgttctgctgttctgtctgacagaccttcccacgtctctcagtctagtatctctaagttgcgttttctatcctcttctaaagcttcatttatattaagttaataaccatattaccttgaacggaaccttagccatgaaattgtgaactcttggaagtgctgtcaatcaagcttagtgctctagctgacctgaaaaattaagatggtcgtaatatcagaaacgttgccgacaaataaa

SEQ ID NO: 3248 - DNA, 2664 bp, Rattus norvegicus
  Genbank Accession No. NM_013134
atgttgtcaagacttttccgtatgcatggcctctttgtggcctcccatccctgggaggtaattgtgggaacggtgacacttactatctgtatgatgtccatgaacatgttcaccggcaacaacaagatctgtggttggaattatgagtgcccaaaatttgaagaggacgtgctgagcagcgacatcatcatcctcacgataacccggtgcatcgccatcctgtacatctacttccagttccagaacctgcgtcagcttgggtcaaagtacattttgggtattgccggcctcttcacaattttctcaagtttcgtcttcagcactgtcgtcattcatttcctcgacaaagaattgacaggcttaaatgaagctttgccctttttcctgctcttgattgacctttctagagcgagtgcattggccaagtttgccctgagttcaaactcacaggatgaagtaagggagaatatagcgcgtgggatggcgatcctgggccccacgttcacccttgacgctctggtggaatgtcttgtgattggagttggcaccatgtcaggggtgcggcagcttgagatcatgtgctgctttggctgtatgtccgtgcttgccaactactttgtcttcatgacattcttcccagcctgcgtgtccctggtcctagagctttctcgggaaagccgtgagggtcgtccaatttggcagctcagccattttgccagagttttagaagaagaagagaataaaccaaacccagtaacccaaagggtcaagatgatcatgtctttaggcctggttcttgttcacgctcacagtcgctggatagctgatccttctcctcagaacagcacagcagaacagtctaaggtttccttgggtctggctgaagatgtgtccaagagaattgagccgagtgtttctctctggcagttttacctctccaagatgatcagcatggacatcgagcaagtgattaccctgagcttagcgttgcttttggctgtcaagtatattttctttgaacaagcagagacagaatcaacactctcattaaaaaatcctatcacatctcctgtcgtgaccccaaagaaagctcaagacaactgttgtagacgtgagcctctgcttgtgaggaggaaccagaagctttcgtcagtggaggaggatccaggagtgaaccaagacagaaaagttgaggttataaaacctttagtggcagaagccgagacttcgggcagagctacgtttgtgcttggcgcctctgcagccagccctccattggccctgggggcacaggagcctgggatcgaactccccagcgagcctcgacctaatgaagagtgtctacagatactggagagtgcagagaaaggtgcgaagttccttagtgatgcagagatcatccagttggtcaatgctaagcacatcccagcctacaaactggaaaccctcatggagacgcacgagcgtggtgtgtctattcgccggcagctcctctccgccaagcttgcagagccatcttctctgcagtacctgccttacagagactataattactccttggtgatgggagcttgctgtgagaacgtgatcggatatatgcccatccctgttggagtggcaggacctctgtgcctggatggaaaagagtaccaggtgccaatggcaacaacagaaggttgtcttgtggccagcacgaacagaggctgcagagcgatcagtcttggtggaggtgccagcagccgggtccttgcagatgggatgagccgaggcccagtggtgcgtcttcctcgtgcttgtgactcagcagaggtgaagagctggcttgaaacacctgaagggtttgcagtggtaaaggaggccttcgacagcacgagcagatttgcacgtctacagaaacttcacgtgacgctggcaggacgcaacctctacatccgtctccagtccaaaacgggggacgccatggggatgaacatgatttccaagggtacggagaaagcacttctgaagctgcaagagggcgtgccggagctgcagatactggcggtcagtggtaactattgcaccgacaagaaacctgctgccataaactggatcgaagggagaggaaagactgtggtttgtgaagctgtcattccagccaaggtggtgagagaagtattaaagacgactacggaagctatggttgacgtaaacattaacaagaatcttgtgggctctgccatggctggtagcataggaggctacaacctccatgctgccaacatcgtcactgccatctacattgcatgtggccaggatgcagcacagaatgtggggagttcaaactgtattacgttaatggaagcaagtggtcccacaaatgaagacttatacatcagctgtaccatgccgtctatagagatcggaaccgtgggtggtgggaccaaccttctacctcagcaagcctgcctgcagatgctaggtgttcaaggggcgtgcaaagacaatcctggagaaaatgcacggcagcttgcacgaattgtgtgtggcactgtgatggctggtgagttgtccttgatggcagcattggcagcaggacatcttgtcagaagtcacatggttcacaacagatcaaagataaatttacaagatctgcaaggaacatgcaccaagaaggcagcttga

SEQ ID NO: 3249 - DNA, 3117 bp, Rattus norvegicus
  Genbank Accession No. NM_013135
atgatggcggccgaggcgggcagtgaggaaggcggcccggcgaccgcggggaccggcggcgccgcggccacgggctccagcgcctacccagcagcgtgccgggtaaagttacccgcggcccctccgatggcagtcgccccgtgtcctgggctggcggacaccgacctggctgcggccctcggtgggggagccgcgtcggggtccgggttcctggggaccgggccggtgtctggtgtcctggggggcgccgcgctgaccggcggtgctgcagctggcgtggcgggtgctgcagccgctggacctgccggagacatcgctctcaccaaggggactctctctctgcctgctgagactctcgggccgggcggcggattccctcctctgccgcctcctcctctgttgcctcctttgggctccggtctggggacagtggatgaaggtgactccttggatggaccagaatacgaggaggaagaggtggccataccgctgaccgcacctccaactaaccagtggtatcatggaaaacttgatagaactatagcagaagaacgcctcaggcaggcagggaaatctggaagctaccttataagagagagtgatcggaggccagggtcctttgtactttcatttcttagccagacaaatgttgtcaatcattttaggattattgctatgtgtggtgattactacattggtggaaggcgtttttcttcactctcagacctaataggatattacagtcacgtttcttgtttacttaaaggagaaaaattactctacccagttgcaccaccagagccagtagaagatagaagacgtgtacgagccattctgccctacacaaaagtaccagacactgatgaaataagtttcttaaagggagatatgttcattgttcacaatgagttagaagatggatggatgtgggttacaaacctaagaacagatgagcaaggccttattgttgaggacctagtggaagaggtgggccgagaagaagatccacatgaaggcaaaatatggttccatgggaagatttccaaacaagaagcttataatttattaatgacagttggccaagtctgcagctttcttgtgaggccctcagataatactcctggagattattccctgtattttcggaccaatgaaaatatccagcgatttaaaatttgtccaacacctaacaatcagttcatgatgggaggccgctattataacagtattggggacatcatagaccactatcggaaagaacagattgttgaaggctattatcttaaggaacctgtaccaatgcaggatcaaggacaagtactcaatgacactgtggatgggaaggaaatctataatacaattcgtcgtaaaacaaaggatgcattttataaaaatattgttaaaaaaggttatcttctgaagaagggcaaaggaaaacgttggaaaaatttatattttatcttagagggcagtgatgcccaacttatttattttgaaagtgaaaaacgagctacaaaaccaaaagggctaatagatctcagtgtatgttctgtctacgttgtccatgatagtctcttcggcaggccaaactgttttcagatagtcgttcagcactttagtgaagaacattacatcttttactttgcaggagaaactccagaacaagcagaggattggatgaaaggcctgcaagcattttgcagtttacggaaaagtagcccagggacatctaataaacgccttcgtcaggtcagcagccttgtattacatattgaagaagctcataaactaccagtaaaacacttcactaatccatattgtaacatctacttgaatagtgtccaagtagcaaaaactcatgcaagggaggggcaaaacccagtatggtcagaggagtttgtctttgatgatcttcctcctgacatcaatagatttgaaatcacacttagtaataaaacaaagaaaagtaaagatccagatatcttatttatgcgttgccagttgagcaggttacagaaaggacatgccacagatgaatggtttctgctaagttctcatataccactaaaaggtattgaaccaggatctctgcgtgttcgagcacgatactctatggaaaaaatcatgccagaagaagagtacagtgaatttaaagagcttatactgcagaaggaacttcacgtagtctatgctctatcacacgtatgtggacaagaccgaacactactggccagcatcctactgaaaatatttcttcatgaaaagcttgagtcattgttgttatgcacactaaatgacagagagataagtatggaagatgaagccactaccctatttcgagctacaacacttgcgagtaccttgatggagcagtacatgaaagccacggccacgcagtttgttcatcatgctttgaaagactccattttaaagataatggaaagcaagcaatcatgtgagttaagtccatcaaagttagaaaaaaatgaagatgtgaacactaatttagcacacctattgagcatactttcagagcttgtggagaaaatattcatggcttcagaaatacttccaccgacactgagatatatttatgggtgtttacagaaatcagttcagcataagtggcctacaaataacaccatgagaacacgagttgttagtggttttgtttttcttcggcttatctgcccagctatcctgaatccacggatgtttaatatcatctcagattctccatctcctattgctgcaagaacactgacattagtggctaaatctgtgcagaatttagcaaatcttgtggaatttggagctaaggagccttatatggaaggtgtcaatccattcatcaaaagtaataaacatcgcatgatcatgtttttagatgaacttgggaatgtacctgagcttccggacactacagaacattctagaactgacctgtctcgtgacttagcagcattgcatgagatttgtgtagctcattcagatgaactgagaacactcagtaatgagcgtggtgtacagcagcatgtactgaaaaagcttctggcaataacagaactgcttcaacaaaagcaaaaccagtatacaaaaaccaatgatgtcaggtag

SEQ ID NO: 3250 - DNA, 8806 bp, Rattus norvegicus
  Genbank Accession No. NM_013138
ccggatcgtccaagtcgccgggctgcgaggtggcactgcgctcctttccgcccagcgcgcctcagtcctctgcaccgagcctggcagctcgcttctgggcgactttgccgcctcgagccccggaggccaaagccatgaatgaaatgtccagctttcttcacatcggggacattgtgtccctgtacgccgagggctctgtcaacggcttcatcagcactttggggctggtggatgaccgttgtgtggtggagcctgcagctggggacctggacaacccccccaagaagttccgagattgcctcttcaaagtgtgccccatgaaccgctactccgcacagaagcagtactggaaagccaagcagactaagcaggacaaagagaagatcgccgatgtggtgttgctgcagaagctgcagcatgcagcccagatggagcagaagcaaaacgacacagagaacaagaaggtgcacggggacgtggtgaagtacggcagcgtgattcagcttctgcacatgaagagcaacaaatacttaacggtgaacaagcggctgccggccctgctggagaagaacgccatgcgggtgacgctggacgcgacgggcaacgagggctcctggctcttcatccagcccttctggaagcttcggagcaatggggataacgtggttgtgggggacaaggtgatcctgaaccctgtcaacgcagggcagcctctacacgccagcaactatgagcttagtgataacgttggctgcaaggaggtcaactctgtcaactgcaacaccagctggaagatcaacttattcatgcagttccgggaccatctggaggaggtgttgaaggggggagacgtggtgcggctgttccatgcagagcaggagaagttcctgacctgtgacgagtaccggggcaagcttcaggtgttcctgaggaccacgctgcgtcagtccgccacctcggccaccagctccaacgcgctctgggaggtggaggtggtccaccatgacccctgccgcggcggagcgggacactggaatggtctgtacaggttcaagcacctggccacgggcaactatctggcggctgaggaaaaccccagctacaagggtgatgtctcagatcctaaggcagcaggaccaggggcccagagccgcacaggccgcagaaacgccggcgagaagatcaagtaccgtctggtggctgtgccacatggcaacgacatcgcgtctctcttcgagctggaccccaccacgctgcagaaaaccgactccttcgtgccccggaactcctacgtgcggctgcggcacctctgtaccaacacctggatccagagcacgaacgcgcccatcgacgtggaggaggaacggcctatccggctcatgttgggcacgtgccccaccaaggaggacaaggaggcctttgccattgtgtcggttcccgtgtctgagatccgcgacctggactttgccaacgatgcaagctccatgctggccagcgctgtggagaaactcaacgagggcttcatcagccagaacgaccgcaggtttgtcatccagctgttggaggacttggtgttttttgtcagcgatgttcccaacaatgggcagaatgtcctggacatcatggtcaccaaacccaaccgagagcggcagaagctgatgcgggacgagaacatacttaagcagatctttggcatcctgaaggctccattccgtgacaaggggggtgaagggccattggtgcgtctggaggaactgtctgaccagaagaacgccccctaccagtacatgttccgcctgtgttaccgggtgctccggcactcccaggaggactaccgtaagaaccaggagcacatagccaagcagttcgggatgatgcagtcacagattggctatgacatcctggccgaagacaccatcacggccctgctgcacaacaaccggaagctgctggagaagcacatcaccaagaccgaggtggaaaccttcgtgagcctcgtgcgcaagaacagggagcccaggttcctggactacctctccgacctgtgcgtgtccaaccgcattgccatccccgtcacccaggagctgatttgcaagtgtgtgctggaccccaagaacagtgacatccttatccagactgagcttcggcccgtgaaggagatggctcagtctcacgagtacctcagcatcgagtactcggaggaggaggtgtggctcacatggacggacaggaacaacgagcatcacgagaagagtgtgaggcagctggcccaggaggcaagggccggcaacgcacacgacgagaacgtgctcagctactacaggtaccagttgaagctgtttgcccgcatgtgcctagaccgccagtacctggccatcgacgagatctccaagcaactgggtgtggagctgcttttcctatgcatggcggacgagatgctgccctttgacctccgcgcctcattctgccacctgatgctacatgtgcacgtggaccgtgacccccaggagctggtgacccctgtcaagtttgcccgcctctggacagagatccccacggccatcaccatcaaagactatgattccaatctcaacgcctcccgagatgacaagaaaaacaagtttgccagcaccatggagttcgtggaggattaccttaacaacgtggtcggcgaggccgtgccctttgccaacgatgagaagaacatactgacctttgaggtggtcagcctggcacacaacctcatctacttcgggttctacagcttcagcgagctgctgcgactcacacgcacgttgctgggcatcatcgactgcattcaggcaccagccgctgtgctgcaggcctatgaggagcctggcggcaagaacgtgcggaggtccatccagggggtgggacacatgatgtccaccatggtgctaagccgcaagcagtctgtatttggtgcctccagcctgcctactggagtgggtgtccccgagcagctggacagaagcaaatttgaggacaatgaacacaccgtggtgatggagaccaagctgaagatcctggagatcctgcagttcatcctcaacgtgcgcctagactaccgcatctcctacctgctgtcggtcttcaagaaggagtttgtggaggtctttcccatgcaggacagcggggcagacggcacagcccccgccttcgattcctctactgccaacatgaatctggaccgcatcggggagcaggcagaggccatgtttggagtagggaagaccagcagcatgctagaggtggatgacgaagggggtcgcatgttcctgcgagtgctgctgcacctcaccatgcacgactacccacctctggtctccggcgccctgcagctgctcttcaaacatttcagccagcgccaggaggccatgcacaccttcaagcaggtgcagctgctcatctcagcccaggatgtggagaactacaaagtgatcaagtcggaactggatcgactgcggacgatggtggagaagtcggagctgtgggtggacaagaaaggcagcgtcaagggcgaggagggggaggcgggcgccagcaaggataagaaggagcggccctcggatgaggagggatttctgcagccacacggggagaagagcagtgagaactaccagattgtcaaaggcatcctggagaggctgaacaagatgtgtggggtcggggagcagatgcgaaagaagcaacagagactgctgaagaacatggacgcccacaaggtcatgctggacctgctgcagatcccttatgacaagaacgacaacaagatgatggagatcctgcgctacacacaccagttcctacagaagttctgtgccgggaaccctggcaaccaggcccttctgcacaagcacttgcagctcttcctcacgcccgggctcctggaggctgagaccatgcagcacattttcctcaacaactatcagctgtgctctgagatcagcgagccggtgctgcaacacttcgtgcactgctggccgacacacgggcgccacgtgcagtacctggacttcctgcataccgtcatcaaggccgagggcaagtacgtgaagaagtgtcaggacatgatcatgaccgagctgaccaacgcaggcgacgacgtggtggtgttctacaatgacaaggcctctctggcccatctgctggacatgatgaaggcagcccgagatggcgtggaggaccacagccccctcatgtaccacatctccctggtggacttgctggctgcctgtgcagaaggcaaaaatgtctacacagagatcaagtgcacttccctgctgcctctagaggacgtggtgtcggtggtgacccacgaggactgcatcacggaggttaaaatggcgtatgtgaacttcgtgaaccactgctatgtagacacggaggtggagatgaaggagatctataccagcaaccacatctggacgctcttcgagaacttcaccctggacatggctctggtctgtaacaagcgggagaagcgcctgtcagaccccacccttgagaagtacgtgctcaccgtggtgctggacaccatcagcgccttcttcagttccccattttcagagaacagcacatccctacagacgcatcagacaattgtggttcagctgctgcagtccaccacccggctgctcgagtgtccttggctgcagcagcagcacaagggctcggtggaggcctgtgtccgcaccctcgccatggtggccaagagtagagccatcttgctgccgatggatctggatgcccacatgagcgctctgctcagcagtgggggcagctgctcagccgcggcccaacgcagcgctgccaactacaagacggccacgaggaccttccctcgggtcatccccaccgccaaccagtgggactacaagaacatcattgagaagttacaggacatcatcacggccctagaagagcggctgaagcctctggtgcaggccgagctctcggtgctggtggacatgctgcactggcccgagctgctctttctagagggcagtgaggcctaccagcgctgcgagagtggcggcttcctgtccaagctcatccgtcacaccaagggtctcatggagtcggaggagaagctgtgcgtgaaggtgctgcggacgctgcagcagatgctgcagaagaagagcaagtatggggaccggggcaaccagctaaggaagatgctgctgcagaattacctccagaaccggaagtccggtccccggggcgagctcactgaccccacaggctctggcgtggatcaggactggtccgccatcgcagccacccagtgccggctggacaaggagggggccaccaagttggtgtgtgatctcatcaccagcaccaagaacgagaagatcttccaggagagcatcggcctggccatccgcctgctggacgggggcaacactgagatccagaagtctttctacaacctgatgacaagtgacaagaagtcagagcgcttcttcaaagtgctgcatgaccgcatgaagcgtgcccagcaggagaccaagtccacagttgccgtcaacatgagtgacctgggcagccagcctcgtgaggaccgtgagccagcagaccctaccaccaaaggtcgcgtgtcctccttctccatgcccagctcctcccgatattcgctgggccctggcttgcaccgggggcacgacgtgagcgagcgtgcgcagaacaacgagatggggacctcggtgctcatcatgcggcccatcctgcgcttcctgcagctgctgtgtgagaaccataaccgggacctgcagaacttcctgcgctgtcagaacaacaagaccaactacaacctcgtgtgtgagaccctgcagttcctggacatcatgtgtggcagcaccacagggggcctggggctgctggggctctacatcaacgaggacaatgtgggcctggtcatccagaccttggagaccctcacagagtactgccagggcccgtgccatgagaaccagacctgcatcgtgactcacgagtccaacggcattgacatcatcacggcgctgatcctcaatgacatcagcccgctctgcaagtaccgcatggacctggtgctgcagctcaaggacaatgcctccaagctgctcctggctctgatggagagtcgacatgacagcgagaatgcagaacgcatcctcatcagccttcggcctcaggagctggtggacgtgatcaagaaggcctacctgcaggaggaggagcgggaaaattccgaagtgagcccacgtgaagtgggccacaacatctacatcctggcactgcagctttccaggcacaacaagcagctacagcacctgctgaagccggtgaagcgcatccaggaggaggaggccgagggcatctcttccatgctcagcctcaacaacaagcagctctctcagatgctcaagtcctcagcccctgcccaagaggaggaggaagacccgctggcctactatgagaaccacacctcgcagattgagattgtgcggcaagaccgaagcatggagcagatcgtgttcccggtacctgccatctgccagttcctgacagaggagaccaagcaccggctcttcaccaccacggagcaggacgagcagggcagcaaagtgagcgacttcttcgaccagtcctccttcctgcacaacgagatggagtggcagcgccggcttcgcagcatgccgctcatctactggttctcccgccgcatgacgctgtggggtagcatctccttcaacctggcagtgttcatcaacatcatcattgccttcttctacccctacgtggaaggcgcgtccacgggcgtgctgggctccccactcatctcgctcctcttctggatcctcatctgcttctccattgccgcgctgttcaccaagcactacagcgtccgtcccctcattgtggcactggtccttcgctccatctactacctgggcattgggcccacgctcaacatcctgggtgctctcaatctgaccaacaagatcgtgtttgtggtgagctttgtgggcaaccgcggcaccttcatccgtggctataaagcaatggtcatggacatggagttcctgtatcacgtgggctacatcctgacgagtgtcctgggcctctttgctcatgagctcttctacagtatcctgctctttgacctcatctaccgagaggagacgctgtttaatgtcatcaagagcgtgacccgcaatggccgctccatcctgctaactgccctgctggccctcatccttgtctacctcttctccatcgtgggcttcctcttcctcaaggatgacttcatcctggaggtggaccggctgcctgggaaccactccagagccagcaccctggggatgccacacggagctgccacatttatgggcacatgtagtggggacaagatggactgtgtctctgaggtctcggtgcctgagatcctagaagaggacgaggagctggacagcacagagcgggcctgtgatactctgcttatgtgtattgtcaccgtcatgaaccacggactgaggaacggtggcggcgtgggcgacatcctccgcaagccctccaaagacgagtcgctcttcccagccagggtggtgtacgacctcctgttcttcttcattgtcatcattattgtcctgaacctcatctttggggtgatcatcgacaccttcgccgacctgcgcagcgagaagcagaagaaagaggaaatcctcaagaccacgtgcttcatctgtggtctggagagggacaagtttgacaacaagacagtgtcctttgaagagcacatcaaactggagcacaacatgtggaactacctgtacttcattgtgctggtccgtgtcaagaacaagacagactacacgggccccgagagctacgtggctcagatgatcaagaacaagaacctggactggttcccacggatgcgcgccatgtccttggtgagcggcgagggcgagggcgagcagaacgagatccgcatcctgcaggagaagcttggctccaccatgaagctggtctcgcacctcaccgcccagctcaatgagctcaaggaacagatgacggagcagcggaagcggaggcaacgtctgggcttcgtggacgtgcagaactgcatgagccgctgagcagagcggagcctcggaggcccccacgggaggccggcttgcccacagctgccgcccttccttcaggtcaggtagaagccaggtgcctgccccatcttcagctcagctgccaccctccctccccaagccaggctctggccagcgggagtgccagagcagagcacggtcctgcttagtaagtacccttgaagagactcggtttaccttagtgccttaggggatgcaagttctccagactgctgtccttcgaagcagtgactggcatttctcagtggccctggcaggtggttaaaagtgggctggctctcacctccaagcactacattgtggctgtcccctgcctgccaccctggctaggaaggtggtagcctgctgttattagcttcctagggctttgatatttaacttattctgggggccatcccaacctcctgtggcctgctggggacagtgtggccccgtcccaggagcctcatgactcaggtggaccttgctcccaggactttctctaggctttgtaggcaagcctcacaagcccagcaacaggcctgggctgtgtgacagtggcttctctctttttggtgtaatgttttacatgtcctgtgtcctggagactaatgtgttaattgccttaaataaattaatagactccaaaaaaa

SEQ ID NO: 3251 - DNA, 2928 bp, Rattus norvegicus
  Genbank Accession No. NM_013143
gaggttctgccaaacgcagttcacttgcaacaatgctgtggacactacctgtgtgtcttctctcactgagtttttctgcccacattgcagctgtgtccattcagcatctttcgactggacatgaccacgatgatgtagacgttggtgaacaacagaaggacatttcagaaatcaactcagctgcaggcctgaacctttttcaaggggacatccttctgcccagaaccagaaatgccctgagagatccgtcaagcagatggaagccccccattccatacattctggctgacaatctggatctgaacgccaaaggagccatcctcaatgcctttgagatgttccgcctcaagtcttgtgtggacttcaagccctatgagggggagagctcgtacatcatcttccagcagttttctgggtgctggtctatggtcggtgatcaacacgtgggacagaatatttccattggtgagggctgcgactataaggccatcattgaacatgagatcctgcatgctctgggattcttccatgagcagtcaaggactgaccgggatgattatgtgaacatctggtggaatgaaattatgacagattatgaacataatttcaacacgtatgatgacaagaccatcacagacctcaacacaccctatgattatgagtccttgatgcactatgggccattttcatttaacaagaatgaaaccatcccgaccatcactaccaagatccctgagttcaacgccatcattggacagcgcctggatttcagtgccactgatttaacgagactgaatcggatgtacaactgcaccagaacacataccctgctggaccactgtgcgtttgagaagaccaacatctgtggaatgatccaggggaccagagatgatgctgactgggttcatgaggacagcagtcagcctggacaagtggatcacaccttggtgggacggtgcaaagctgctggctacttcatgtacttcaataccagctcgggggtgaccggagaggtagcccttctggagtctcggatcctttaccccaagaggaagcagcagtgtttgcagtttttttataagatgacaggaagcccttcagacagactcctcatctgggtgagaagggacgacaacacgggcaacgtgcgccagctggccaagatccagacttttcaaggagattctgatcacaactggaaaattgctcacgtgacactcaacgaagagaagaaatttcgctatgttttccagggtaccaaaggtgaccctggtaactcagatggcggtatttaccttgatgacatcactctgacagaaaccccctgccctacaggggtttggaccatccggaatatctcccaggtccttgagaacacagtgaaaggggacaggctcgtgagccctaggttctacaattccgagggttatggttttggggtgaccttgtaccccaatggtagaatcaccagtaactctggctacctgggactcgctttccacttgtacagtggggataacgatgtgattctggagtggccagtggagaacgagcaggccataatgaccatcctggaccaggaacctgatgccaggaacaggatgtccttgagtttgatgttcactacctccaagtaccaaacatcttcagctataaatggctctgtcatctgggacaggccaaccaaggttggagtctatgataaggactgtgattgttttagaagcattgactggggttggggtcaggccatttcccaccagatgctgatgagaagaaatttccttaaagatgacaccctcatcatcttcgtggactttaaagaccttacccacttgaggcagactgaagtccccatttccagcagaagcgtgataccccgaggactccttctgcaaggccaggagcctcttgccttgggagactccagaatagccatgatggaggaatccctgccaagaaggctggaccagagacagcccagcagaccaaagcgctcagtggaaaatactggtcccatggaggaccacaactggccacagtacttcagagacccatgtgacccaaacccttgccagaatgaaggcacctgtgtgaacgtaaagggaatggccagctgcaggtgcgtctctgggcatgcctttttctacacaggggagcgctgtcaggctatgcatgtgcacggaagcttgctgggcctgctcattggctgcatcactgctttgatcttcttgaccttcatcacattctccaacacttaccaaaagctgaggcagtgagctgatgtccactagactgcagaagggcctccttcacctagactttccttccagtagtcagtataatttggggatattcttcatcaaacatgtttgaaagagcctccaaaaccaaagccccaaacctcatgtggggctcttgccactccatttctgtacagttctgctatccttctatgagtttctggtgaatccattatgtcctaagataacagtcattgcattttactataaacactttgcttgcttgaccttctccccttaaatcaccaagtctagttgggtaggagcatgttatcctctgctaccacattgaccccagtgctagaagcataccttactggtgtattgtgggtactcagtaagcattaaatgaatgaaccaataagcaagtgaatagctgtggtataataagtctttttttcttcctcatattgtaaaacatatgattaagtctatttgcaggtgtatcagaaccaaatacccagtttacactagatgggaaaactactgtcttattgctcatgtagtttcttgtgaaatgatttcacagattcctctggtcagctgagtttccatggcatgtacttttttcttgttctgattttaaggaaaaggcttaataaaaccattaaatatgaaaaaaaaa

SEQ ID NO: 3252 - DNA, 1500 bp, Rattus norvegicus
  Genbank Accession No. NM_013144
cgccgagcacaaacccagcgagcattgaacactgcacacggccatctgcccagagagctgtgaccaccacttccgctactatctactcagaaagtcgtgactactgagccactgctgcctgcccagattctcatccaccgcctgctgcgtctggttgcgatgccggagttcctaactgttgtttcttggccgttcctgatcctcctgtccttccaggttcgcgtagtcgctggagccccccagccatggcactgtgctccctgcactgctgagaggctggagctctgtccacccgtgcctgcttcgtgccccgagatttctcggcctgcgggctgtggctgctgcccgacatgtgccttgccactgggtgctgcctgtggtgtggccactgcgcgctgcgctcagggactcagctgccgtgcgctgccaggggagcctcgacctctgcatgccctcacccgtggccagggagcctgtgtactagaacctgccgcacccgccacgagcagcttgtccggttctcagcatgaagaggcaaaggctgctgtggcctctgaggatgagcttgccgagagcccagagatgacagaggaacagctgctggatagcttccacctcatggccccatcccgtgaggaccagcccatcctgtggaatgccattagcacctacagcagcatgcgggcccgggagatcactgacctcaagaaatggaaggagccctgccaacgggaactctataaagtgttagagagattagctgccgctcaacagaaagcaggagatgagatctacaaattttatctgccaaactgcaacaagaatggattttatcacagcaaacagtgcgagacatctctggatggagaagctgggctctgctggtgtgtctacccatggagtgggaagaagatccctggatctctggagaccagaggggaccccaactgccaccagtattttaatgtgcaaaactgaaagttgtttcctccctccttcttcacacaaaatatttaagtatatagtgtatttatactccggagcacaccattttatatatgtgtatatgtatatatccaggaactagtttttatactccacatgctgcttgatgtacaagtgggtttgtatttattcactctaagtttatttttttctaccctgtccttgtgctgtattaatttatataactgaagcttttctcatctccatacatgtaaatactaccatctcagctcttccagagttctgctttgaaagggcagcgcggtagtgcctagaacgagcacaagtcagtctgaggtaggggcctttcagtgggttcagggaggaaggttagccctggctcggggagacttcctcatcgaatcccacaggtctgtgtctgatgcctattggctgggaaggttccgatgttggttgtgtaatcaaagctaaacgtggaaagctgcgtcccatgcactgttaaacacacgtctggaataaaacattctacctgga

SEQ ID NO: 3253 - DNA, 2445 bp, Rattus norvegicus
  Genbank Accession No. NM_013151
ggcacgggacacggaagaaacggggagcaaaatgaagggagagctgttgtgcgtcctgctgctttgtggagtggcgttcacgttgcctgaccagggaatacacaggaggttcagaagaggagctcggtcctacagagcgacctgcagagatgaacagactcagacaacttaccaacagcatcagtcatggctacgtcccatgctcagaggcaatcgggtggaatactgccggtgcaacagcggcctggcacagtgccactcggtgcccgtccgaagttgcagtgaaccgagatgcttcaatgggggtacgtgtcagcaggccctgtatttctctgacttcgtctgccagtgccctgacggatttgttgggaaacgctgtgatatagataccagagcaacctgcttcgagggccagggcatcacctacagaggcacatggagcacagcagaaaatggggctgaatgcatcaactggaatagcagtgccctgtcccagaagccctacagtgcaaggaggccaaatgccatcaagctgggccttgggaatcacaattactgcagaaacccagaccgagacgtgaagccctggtgctatgtctttaaggcagggaagtataccacggagttctgcagcacgccggcttgccctaagggaccaactgaggactgctatgttggaaaaggtgtgacttaccgtggcacccacagctttaccacatccaaggcctcctgcctcccatggaattccatgatcctgataggcaagacttacacagcgtggagggccaactcccaggcacttggcctgggcagacacaattattgccggaacccagatggggatgccaaaccttggtgccacgtgatgaaggaccgaaagctgacatgggaatattgcgacatgtccccatgctccacctgcggcctgaggcaatacaaacagcctcagtttcgaattaaaggaggactcttcacagacatcacctcacacccttggcaggccgccatctttgtcaagaacaagaggtctccaggagagagattcctgtgtggaggggtgctgatcagttcctgctgggtgctatctgccgcccactgctttgtagagaggtttccaccccatcatcttaaagtggtcttgggcagaacatacagagtggtccctggaaaggaggagcagacattcgagatcgaaaagtacatagtccataaggaatttgatgacgacacttatgacaatgacatcgcattactgcagctgaggtcagattccagtcagtgtgcccaggagagcagttctgtcggcactgcctgcctccctgaccccgacgtacagctccctgactggacagagtgtgagctttctggctacggcaagcatgaggcatcctctcctttcttctctgaccggctgaaggaggctcacgtcagactgtatccgtccagccgctgtacctcacagcatctgtttaacaaaaccatcacgagcaacatgctgtgtgcaggagacacccgaactgggggcaaccaagacgtccatgacgcgtgccagggtgactcaggaggccctctggtgtgcatgatcgataagcggatgactttactgggcatcatcagctggggcctcggctgtgggcagaaggacgtgccagggatatacacaaaggtcactaattacctgaactggatccaagacaacatgaagcaatgacaaagaaagcccagctccttaaacccagaggacctgccttcctcttcctcttccacagaagatacgcctgaaaggccaagcgttcttcgcaggctcgtcctcctgagctgccgctcagcagagggagtgacagtctttaggcacagacagagtttactttgtgacaggtacttcacaaacttgtacgttttaagggtgaaggtctgactttagaatcagttctgtcagatgagatgacagggaaatgccaaccttcctataactctaagattttaaaaagagaagtagaccaaagtccacccttcctggaccactattttgtacactgaaccacaagatcgtgtctcaacagtgaaatacaacttgatctttcaggagtaaaagtctgcactgaggacaagaatgtgtttttatagttacacaggggcccagcatggcctccaagagaaggaaggggttagctgatcagaccacagccccctaaaacccttgaaatcaaatattccccatcctcccacaatcctcaactcttggggcatatccctttgtacacagtgtagatgtctttttctttataaactttccagatggctgggagaactgtatgattttaatattcgatgaaatgacactagtatatttatatttgaatctatttagtttttactgtgttactagaactctgtattatgctgtactgaaataataaattccaaggtatttttcacactttt

SEQ ID NO: 3254 - DNA, 1200 bp, Rattus norvegicus
  Genbank Accession No. NM_013154
catgagcgccgctcttttcagcctagacagcccagcacgcggcgcaccctggcccacagagcccgcggccttctacgagccaggcagggtgggcaagccaggacgagggccggagcctggggatctgggggagccgggctccacgacccctgccatgtatgacgacgagagcgccatcgacttcagcgcctacattgattccatggctgccgtgcccaccctagagttgtgccacgacgagatcttcgccgacctcttcaacagcaatcacaaagcggccggcgcgggcagcctggagctgctgcagggcggccctacgcgacccccgggtgtggggtcaatcgccaggggcccgctgaagcgcgaacccgactggggcgacggcgacgcgccgggctccctgctgccggcgcaagtggcagtgtgcgcgcagacagtggtgagcttggcggccgcggcacagcccacaccacccacttcgcccgagcctcctcgaggcagccctggaccgagccttgcgcctggccccgtccgagagaagggcgccggcaagaggggtccggaccggggcagccctgagtaccggcagcgacgcgagcgcaacaacatcgctgtgcgcaagagccgggacaaggccaagcgccgcaaccaggagatgcagcagaagctggtggagctgtcggccgagaacgagaagctgcatcagcgtgtggagcagctcacccgggacctggccagcctccggcagttcttcaaagagctgcccagcccgcctttcctgccgcccaccggcaccgactgccggtaacgcgcggtgtgggccttagagactccgaacgaccgatacctcagaccccgacggcggggagcagacgccgcccgaattgctacagtttcttgggcactggactgcgagagaagctatatgaatcccccttaaattatttttttataatggtagcgttttctacgtcttattaccattgcagctaaggtacattgtagaaaagacttttccgacagacttttgtagataagaggaagagactgcgcatgctttttatattcatttttacagtatttgtaagaataaagaagcatttaaattgcaaaaaaaaagaggcaccagctctgactggcctctttctaggctacggtgatcctgagcatcttttgttacctgctggtagaaatgatcct

SEQ ID NO: 3255 - DNA, 2952 bp, Rattus norvegicus
  Genbank Accession No. NM_013155
gagaaggggtgcccgctccttgcgtcgtctccgtgctcccggctcctcactccttccccctcctcctcgcctcctccctccccgcccccacctccttcctcctctccgaagggctggtaacttgttgtgcggagcgaacggcgacaacgacgccgcgacggaggcaccatccgggcgggcagcatgggcacgtccgcgcgttgggcgctgtggctgctgctcgcgctgtgctgggcgccccgggacagcggcgccactgcaagcgggaagaaagccaaatgtgacagctcccaattccagtgcacaaatggtcgctgcattactctgctgtggaaatgtgatggagacgaagactgtactgatggcagtgacgagaagaactgtgtgaagaagacatgtgctgagtcagacttcgtgtgcaaaaacggccagtgtgttcccaacagatggcagtgtgatggggaccctgattgtgaagatggttctgatgaaagcccagaacagtgccatatgagaacatgccgcataaatgaaatcagctgtggcgcccgttctactcagtgtatcccagagtcctggagatgcgatggtgaaaatgattgtgacaatggagaagatgaagaaaactgtggcaacattacatgtagcgcggatgagttcacttgctccagtggccgctgtgtctccaggaactttgtgtgcaatggacaggatgactgtgacgatggcagtgatgagctggactgtgctccaccgacctgcggtgcccacgagttccagtgcaggacctcctcctgcatcccgctcagctgggtgtgtgacgatgacgcagactgttccgaccaatcagacgagtctcttgagcagtgtggccgtcagcctgtgatacacaccaaatgtcccaccagtgagatccagtgtggctctggcgagtgcattcacaaaaaatggcggtgtgacggagacccggactgcaaggacggcagcgacgaggtcaactgtccttctcgaacctgcagacctgaccagtttgaatgtgaggacggtagctgtatccatggcagcagacaatgcaacggcatccgagactgtgttgacggctctgatgaagtcaactgcaaaaacgtcaatcagtgcctgggccctggaaagtttaagtgcagaagtggggaatgcatagacatcaccaaagtatgtgaccaggaacaggactgcagagactggagcgacgagcccctgaaggagtgccatatcaacgaatgcttggtcaataacggtggctgttcccatatctgcaaagacctagtcataggttatgaatgtgactgtgcagctgggtttgaactgatagacaggaaaacctgtggagatattgatgaatgccaaaatccggggatctgcagtcaaatttgtatcaacttaaaaggcggttacaaatgtgaatgtagtcgtggctatcaaatggatcttgccactggcgtgtgcaaggcagtaggcaaagagccaagtctgatcttcactaatcgaagagacatcaggaagattggactagagaggaaggaatacatccaacttgtagaacaactaagaaacacggtggctctcgatgctgacattgcagctcagaagctattttgggctgatctaagccaaaaggccatcttcagtgcctcaattgatgacaaggttggtagacattttaaaatgatcgacaatgtctataatcctgcagccattgctgttgattgggtgtacaagaccatctactggactgatgcggcttctaagactatttcagtagctactctagacggaaccaagaggaagttcctgtttaactctgatttgcgagagcctgcctccatagctgtggatccgttgtctggctttgtttactggtcagactggggtgagccagctaaaatagaaaaagcaggaatgaatggatttgatagacgtccactggtgacagaggacatccaatggcctaatggaattaccctcgaccttgtcaaaagccgcctctactggctggattccaagttgcacatgctctctagtgtggacctgaatggtcaagatcgtaggatagtgctcaagtctctggagttcctagctcatcctcttgcactcaccatatttgaggatcgtgtctactggatagatggagaaaatgaagcagtgtatggtgccaataaattcactgggtcagagctggccactctagtgaacaatctcaatgatgcccaagacatcattatctaccatgaactcgtccagccttcaggtaaaaactggtgtgaggaagatatggagaatggaggatgtgaatatctctgcctgccagcaccacagatcaatgatcactctccaaaatatacctgttcctgtcccaatgggtacaatcttgaagaaaatggacgcgagtgtcaaagtacttcaactcctgtcacttacagtgagacaaaagatgtcaacacaacagacatcctacgaactagtggacttgttcctggagggatcaatgtgaccacagcagtatcagaagtcagtgttcccccaaaagggacttcagctgcctgggccatccttcctctcttgctcttagtgatggcagcagtaggtggctacttgatgtggaggaattggcaacataaaaacatgaaaagcatgaactttgacaatcccgtgtacttgaagaccactgaagaggacctctcaatagacattggtagacatagcgcctctgtaggacacacatacccagcaatctcagttgtaagcacagatgatgatttggcttgagttctggaacaagtcttgctctatgaggtctacacccataacaccctactccggaatggtaacagagccagcagctgaagtttctttttcttcctcccatctggaagaacatcaagatatcttttcgtggatcaagcttgtgtactt

SEQ ID NO: 3256 - DNA, 1386 bp, Rattus norvegicus
  Genbank Accession No. NM_013156
aattccgcggcgacctccggggatccgagtttgcagactacgtgtgtgcgcagctagccacctcaggtgtttgaaccatgacccctttactcctcctggctgtcctctgcttgggaacagccttagccactccaaaatttgatcaaacgtttaatgcacagtggcaccagtggaagtccacacacagaagactgtatggcacgaatgaggaagagtggaggagagcagtgtgggagaagaacatgaggatgatccagctacacaatggggagtacagcaacgggaagcacggctttaccatggagatgaacgccttcggtgacatgaccaatgaggaattcaggcagatagtgaatggctatcgccaccagaagcacaagaagggaaggttatttcaggaacctctgatgctgcagatccccaagactgtggactggagagaaaagggttgtgtgactcctgtgaagaatcagggccagtgtggttcttgctgggcttttagcgcatcgggttgcctagaaggacagatgttccttaagactggcaaactgatctcactgagtgaacagaaccttgtggactgttctcacgatcaaggcaatcagggctgtaatggaggcctgatggattttgctttccagtacattaaggaaaatggaggtctggactcagaggagtcttatccctatgaagcaaaggatggatcttgtaaatacagagctgagtatgctgtggctaacgacacagggtttgtggatatccctcagcaagagaaagccctcatgaagcctgtagcgacggtggggcctatttctgttgccatggatgcaagccatccgtctctccagttctatagttcaggtatctactatgaacccaactgtagcagcaaggacctcgaccatggggttctggtggttggctatggttatgaaggaacagattcaaataaggataaatactggcttgtcaaaaacagctggggtaaagaatggggtatggatggctacatcaaaatagccaaagaccggaacaaccactgcggacttgccaccgcagccagctatcctatcgtgaattgatggacagcgataataaggactgacggacactacatccgaaggagttcatcttaaaactgaccaaacccgtctctgagtgagaccatggtacttgaatcgttcaggatccaagtcacgatttaaattctgttgacatttttacatgggttaaatgttaccactacttaaaactcctgttataaacagctttataatattggacacttaatgcttaattctgattctggaatatttgttttataaaagttgtataaaactttctttaccttttaaaaataaattttagctcagtgcaaaaaaaaaa

SEQ ID NO: 3257 - DNA, 4276 bp, Rattus norvegicus
  Genbank Accession No. NM_013159
gcggctgcgcggggtatgcggaacgggctcgtgtggctgctgcaccccgcgctgcccagcaccttgcactccatcctcggcgctcgcccgcctcccgtgaagcgactgtgtggattcccaaaacaaatttacagcacaatgaataatccggccatccagagaatagaagaccatattgtcaagtctcctgaagacaaacgggaatatcgtggactagaactggccaatggtatcaaagtgcttctcatcagtgatcccaccacggacaagtcatcagcagcactcgacgtgcacatagggtcactgtcagaccctccaaatattcctggcttaagccatttttgtgagcatatgctgtttttgggaacaaagaaatatcctaaggaaaatgaatacagccagtttctcagtgaacatgctgggagttcaaatgcatttaccagcggagaacacaccaattattatttcgatgtttcccatgaacacttggaaggagccctggacaggtttgcccagtttttcctgtgccccttgtttgatgcaagttgtaaggacagagaggtgaacgctgtcgattcagagcatgaaaagaatgtgatgaatgatgcctggagactcttccagctggaaaaggctacagggaatcccaagcaccccttcagcaaattcgggacaggaaacaaatatactctagagactcgacccaaccaagaaggcatcgatgtaagggaagaactcttgaaatttcactctacgtattattcgtccaatctgatggcgatttgtgttttaggtcgagaatctttagatgacctgactaatctggtggtgaagttattttctgaagtagagaataaaaatgtccctttgcctgaatttcctgagcaccctttccaagaagaacatcttaaacaactttataaaatagtacccattaaggatattaggaatctttatgtgacatttcccataccagaccttcaacagtactacaaatccaatcccggtcattatctcggtcatctgatcgggcatgaaggtcctggaagcctgttgtcagagctcaagtcaaagggctgggtaaacaccctggttgggggacagaaggaaggagcccgaggttttatgttttttatcattaatgtggacttaactgaagaagggttattacatgttgaagatataattttgcacatgtttcaatacattcagaagctacgtgctgaaggacctcaagaatgggttttccaagagtgcaaggacttgaacgctgtcgctttcaggtttaaagataaagagaggccacgaggctacacatctaagattgcagggaaattgcactattatcccctaaatggagtgctcacagctgaatatttactggaagaatttagacccgacttgatagacatggttcttgataaactcagaccagaaaatgtccgggtggcaatagtttctaaatcatttgaagggaaaactgaccgcacagagcagtggtatggaacccagtacaagcaagaagctatcccagaggacgtcattcagaaatggcaaaatgctgacctgaatgggaaatttaaacttccaacaaagaatgaattcattcctacaaattttgagattttggcattagaaaaagatgcaacaccataccctgctcttattaaggatacagccatgagtaagctgtggttcaaacaagatgataaatttttcttgccgaaagcttgtctcaactttgaatttttcagcccgtttgcttatgtggaccccttgcactgtaacatggcctatttgtaccttgaactcctcaaagactcactcaacgagtatgcatatgcagcagagctagcaggcctgagctatgatctccaaaacaccatctatgggatgtatctctcagtgaaaggttacaatgacaaacagccaattttgctaaagaagatcaccgagaaaatggctacttttgagattgataaaaaaagatttgaaattatcaaagaggcgtacatgcgatctcttaataatttccgggctgagcagcctcaccagcacgccatgtactacctccgtctgctgatgactgaagtggcctggaccaaagatgagttaaaagaagccctcgatgatgtgaccctcccccgtcttaaggccttcatacctcagctgctgtcccggctgcatattgaagcccttctccatggcaacataacaaagcaggctgccttaggagttatgcagatggtagaagacacccttattgagcatgctcacaccaaacctctccttccaagtcagctagtccggtacagagaagttcagctccccgaccgaggatggtttgtttaccagcggaggaacgaagtccacaataactgtggcattgagatttactaccagacagacatgcagagcacctcggagaacatgttcctggagctcttctgccagattatctctgagccttgcttcaacactctgcgtaccaaggagcagcttggctatattgtcttcagtggacctcgtcgggccaacggcatccagggcttgcgattcatcatccagtcagaaaaaccacctcactacctggaaagcagagtggaagccttcttgatcaccatggaaaaggccatagaggacatgacagaggaggctttccaaaaacacattcaggcgttagcgattcgccgactcgacaaaccaaagaaactctctgcagagtgcgcgaagtactggggggagatcatctcccagcagtacaattatgacagagataacatagaggttgcatatttaaagacactcagcaaggatgatatcatcaaattctacaaggaaatgttggctgtggacgcaccaaggagacataaagtatccgtccacgttcttgccagggaaatggattcttgtcctgtggttggagagttcccctctcagaatgatataaacctttccgaagcgccacccttgccacaacctgaggtgattcataacatgactgaattcaagcgcggcctgccgctgttcccccttgtgaagccacacattaacttcatggcggcaaaactctgaagaagcagctgcgcccctgtgccttccggggccaggaaagcagtctcagctttgagtagtttctggcttgcaattagagagacaaacagaaaagagttatcaggcattattatgtagaatgttaaaaacccaaagtaataaaattataaagtcttatagatgtagaatatttttaaaatctcttaaatattttaatgtttttctttttattcctaaaagaaatttccttatattaactgcttaatctgaagaaagatatctcagtacaatctttcttccttattctgtaaaatagtcacttgtctgaaaaaaaaataagagcttttttttcttaaaggcttcagaacacttagaaaggattacctttttaagacgcgatcaagctcagatctgcttctgtcgatggttcctgtgaaccagcagagcatcgcggtgggcagatagtgcacaaagcggttccgcgttcctttactagtgaacctgctgattaactaaggcatggttttaatgtttttataaaacttgggtatgttttttaaccttcttagtcaaatgctagaaaacccagaatacccaatttacagtgctagaaatgcagattaaccttgaatcaagttcggaatttctcaggattcctgtgggttctctctcatcgaattctgttgacatttctgtttctcgtagttggtctgctgggttccatcagcagacacatactgctgtacagcgtgtgagacatgctgtgctgacatcagctgttgtgactccccgtaactcctagggtgaagttgtgatccgtgtgtgaactaaaacatttgcccctttagggactcaaaaggcagcaaatacaaagccacctccttggaggatacaaaactgtggcgttcttaaacagccagtctccgtaagactctaaactccccactgcttccggtctcatcttgccttaagtgttattttttgaatatatgaatataaacatacagatgatgactggagtggacttttaaaaaatatttttttcacaagatactattttaggtgaaaatgttactgtagatttaacagctgttttaaagtatttgctattattaaaacttcttcaagaacaagcgtggctatgctcccacacacaggcaatagtaacagaaagtgctcctgtttgtccaccagctcaggcaaagtacagaatggcgtttcc

SEQ ID NO: 3258 - DNA, 922 bp, Rattus norvegicus
  Genbank Accession No. NM_013160
atggagcgggtgaagatgatcaacgtgcagcccatgctggaggccgcggagtttttggagcgcagggagcgagagtgtgaacatggctacgcttcatcattcccctccatgccgagcccccggctacagcactcaaagcccccacggaggttgagccgggcacagaaacacagcagtgggagcagcaacaccagcactgccaacagatctacacacaatgagttggaaaagaatcgacgagctcacctgcgcctgtgtttagaacgcttaaaagttctgattccgctgggcccagactgcaccaggcacacaacacttggtttgctcaacaaagccaaagcacacatcaagaaacttgaagaagccgaaaggaagagccagcaccagcttgagaacttggaacgagaacagagatttttaaagcggcgactggaacagctgcagggtcctcaggagatggagcgaatacgaatggacagcattggatcaacgatctcctcagatcgctcggattcagagcgagaggagattgaagtggatgtggaaagcacagagttctcccatggagaagtggacaacatcagtaccaccagcatcagcgacatcgatgaccacagcagcctgcagagtattgggagtgacgagggctactccagtgccagtgtcaaactctccttcacgtcctagaacccagcatgacataacagtgcagggcgaagtgctcactggccagttcaataccgtctctcaaattgggttcatgacgcagtctcctctttaaaactaaaaactatacttgaacaaaaggtcagaagacctgtatttaagcaaatacttaaaaagtggggtagagcctccccggtagaacaaatactcctgtatttggaaagatacagtttctaacagcagcaaaaaaaaaaaa

SEQ ID NO: 3259 - DNA, 1492 bp, Rattus norvegicus
  Genbank Accession No. NM_013161
ggtccatagaacccgacggatccgccacgatgctgatgctgtggacatttgcagtgctgctgggagcagtagctggaaaagaagtttgctttgacaaactcggctgcttcagtgatgatgccccgtggtcaggaaccatagacagacccctgaaagcactgccctggagcccagcacagatcaacacccgctttctcctctacaccaacgagaaccaagacaactaccagaaaattacttcagatgcatcgagtatcagaaactccaatttcaaaacgaacagaaaaacccgcatcattatccacggcttcattgacaagggagaggagaactggctatctgacatgtgcaagaacatgttcaaagtggagagtgtgaactgcatctgtgtggactggaaaggtggctcccgggctacatacacccaggctacccagaacgtccgggtcgtgggtgcagaagtggcattattggttaacgttctgaagtctgacctcggtcatccacctgacaacgtccacctgattggccacagcctgggttcccacgttgctggggaggcaggaaagaggacattcggagctattgggaggatcacagggttggacgcggctgaaccttacttccagggcacacctgaagaagtccgtctggaccccaccgatgcccagtttgtggatgcaattcacacagatgctgcacccatcatccccaacttaggatttggaatgagccagactgtgggtcacctagatttctttcctaatggagggatggaaatgcctggatgtcagaagaatatcctttcccaaatcgttgacatcgacgggatctgggaaggaactcgcgactttgctgcctgtaaccacttgagaagctacaaatattacaccgacagtatcgtcaacccgactggcttctctggcttctcctgtagctcttacaatgttttttctgcaaataagtgcttcccatgtgggagtgaaggatgcccacagatgggtcactatgctgacaaataccctgggaagacaaaagaactctaccagaaattttacctgaacactggtgacaagagcaacttcgcacgttggcggtaccaggtgactgtcaccctctctggacagaaggtcactgggcacattctagtttctttgtttggaaatggaggaaactctaaacagtatgaagttttcaagggctctctgcatccaggtgacactcatgtcaaggaatttgactctgatatggatgttggagatttgcagaaagttaaatttatttggtacaacaatgtgatcaacccaactctacccaaagtgggagcatcaaggatttcagtggaacgaaatgacggcagagtgttcaacttctgtagtcaagatacagtgagggaggatgtcctgcttacactgtctgcatgttagaaggctgctgatgtgtgaccaccaagtcccactgtaataaagtctagtatcaaagccacccggaa

SEQ ID NO: 3260 - DNA, 2152 bp, Rattus norvegicus
  Genbank Accession No. NM_013165
tgcggccgccgcttagcagagctaagtgggacttcactggagccatggagctgctcaagctgaaccgcagcgtgcagggaccaggacccgggtcggggtcttctttgtgccgcccgggtgtctcccttctcaacagcagtagtgccgggaacctcagctgtgacccccctcgtatccgcggaaccgggaccagagaattggagatggcgattagaatcaccctttatgcagtgatctttctgatgagtgttggcggaaacgtgctcatcatcgtggtcctgggactgagccgacgcctaagaacggtcaccaacgccttcctgctctccctggcagtcagcgacctcctgctggccgtggcttgcatgcccttcacactcctgcccaacctcatgggcacattcatcttcggcacagtcatctgcaaggccatttcctacctcatgggggtatcagtgagtgtatccactctaaatctcgtggccatagccctggagcgatacagcgccatctgccgaccactgcaagcacgagtatggcaaacacgctcccacgcagctcgggtgatcttagccacgtggctgctgtctggactgcttatggtaccctaccctgtgtacaccatggtacagccagtgggacctcgagtgctgcagtgcatgcatcgctggcccagtgcacgtgtccaacaaacctggtccgtgctactgctactgcttttgttcttcatcccgggtgtggttattgcggtggcctatggactcatctcccgcgaactctacctaggactccactttgatggtgaaaatgacagcgagacccaaagccgggcccgaaaccaagggggcctgccgggtggggcagcaccagggcctgtccaccagaacgggggctgccggcctgtaaccagcgtagctggggaagacagtgatggctgctgtgtgcaacttccgcgttcccgactggagatgacaacgctaaccacacccactcctgggccagtccctggccctcggcccaaccaggccaagctgctggctaagaagcgggtggtgcgaatgctgctagtgattgttttgcttttcttcctgtgttggctgccagtgtacagcgtcaacacgtggcgcgccttcgatggcccaggcgcacaacgagcactctcaggggcccctatctctttcatccacttgctgagctacgtctctgcttgtgtcaaccccctggtctactgtttcatgcaccgccgcttccgccaggcctgcctggacacatgtgcccgctgttgcccacgccctccacgagctcgcccacagcctcttccagatgaggatcctcctaccccctccatcgcttcgctgtccaggctaagctataccaccatcagcacactggggcctggctgaggggttgggagattggagaaagagacaagatacataattactatcaaatgacccatccaaacacataagaaacaaaattcagaattaatcaggtgaacacccaacaccatggacagacccctacacacagaaaatagtatctttgctgccctacctgaaacagataggagtctcataggaaaggaggctcacttctgataaggggctgagtcccttcctagacatcttgcactgaccccattacatggacagacacaaggtccgtagcagtaaactttacctataaaggggaactctgacaagggctgattggctcctcatatgaacatattactgacactattctgtagtgcccatagcctagtgcagaagtgacttaggacattgtggctgttcccgtttgacttcattattgccttcctcatccagcactgaaattatcaaccacacgcctttcacctttcggagctgccgatcgttcagcactgaaaagtcccccccccccactcctttccattggagactgtggaaagtcctcttccctcctgcctctcctccctcaccagaccacatcataaaaggataagtgacttagtgtcctcctggacttcttgaggtaggtgaacaggtgtggtttatgggaagcttcttcatttattggctcccatgactaatctaccccatatccaaccttgtgcaaaaaggccagggtatgaagatagggatgagcgtaccctctcttggttgtc

SEQ ID NO: 3261 - DNA, 1215 bp, Rattus norvegicus
  Genbank Accession No. NM_013167
cctccggaaccatggttggacttcagccatcagaagtgcctcccacaacagttgtaaagttcctgggggccggcactgcagcctgttttgctgatctcctcaccttccccctggacaccgccaaggtccgcctgcagatccaaggggagaacccaggagtgcagagcgtgcagtaccgcggcgtgctcggtaccatcctgactatggtgcgcacagagggtccccgcagcccctacagcgggctggtcgctggcctgcatcgccagatgagttttgcctccattcgaattggcctctacgactctgtcaagcagttctacacccccaaaggaacggaccactccagcgtcgccatcaggattctggcaggctgcaccacgggagccatggcagtgacctgtgctcaacccacggatgtggtgaaggtccgatttcaagccatgatacgcctgggaactggaggcgagaggaaatacagagggactatggatgcctacagaaccatcgccagggaagaaggagtcaggggactgtggaaagggacttggcccaacatcacaagaaacgccattgtcaattgtgctgagatggtgacctatgacatcatcaaggagaagctgctggactctcacctgttcactgacaacttcccctgtcactttgtctctgcctttggagctggtttctgtgccacggtggtggcctccccagtggatgtggtaaagacccgatacatgaacgctcccccaggcaggtaccgaagccccctacactgtatgctgaggatggtggcccaggagggccccacagccttctacaaaggattcatgccctcctttctgcgtctgggatcctggaacgtgatgatgtttgtaacctacgagcagctgaaacgggccttgatgaaagtccaggtactgcgggaatctccattttgaacaaggcaagcaggccgcttggtactttcctcattaaaaaaggccgcctggaacagaacaaagcttctctgcccaggggtcgcaggcccatgcacgcacacgacggaaccctgcactgttactgacttgagaaactgaactaaaagagggggagagttttggtcttcgatgtttcatcctaaaacacctttgttttgcactgaccagatgggaaataaattatattaatttttaaaacctttccggttggatgcctaacatttaggccagagacaac

SEQ ID NO: 3262 - DNA, 1412 bp, Rattus norvegicus
  Genbank Accession No. NM_013168
tggtctctgcttctctggatcccgaaggagggcagaaggaagaaaacggctcaatgatgagggtgattcgagtgggcacccggaagagtcagctggctcgcatacagaccgacactgtggtagcgatgctgaaaaccttgtaccctggcatacagtttgaaatcattgctatgtccaccacaggggacaagattcttgatactgcactctctaagattggagagaagagcctgtttaccaaggagctagaaaacgccctggaaaaaaatgaagtggacctggttgttcactccctgaaggatgtgcctaccatactacctcctggctttaccattggagccatctgcaaacgggaaaacccttgtgatgctgttgtttttgagggaaagtttattggaaagaccctggaaaccttgccagagaaaagtgccgtggggaccagctccctgaggagagtggcgcagctacagagaaagttccctcacctggaattcaagagtattcggggaaacctcaacacccgcctacggaagctggatgagcagctggagttcagtgccattatcctggctgtggctggcctacagcgcatgggctggcagaaccgggtgggccagatcttgcacccagaggaatgcatgtatgctgtgggtcagggagccctggcggtggaggtccgagccaaggaccaggatatcttggacctagtgggtgtgttgcatgatcctgaaactctgcttcgctgcattgctgaaagggattttctgaggcacctggaaggaggctgtagcgtgccagtagcagtgcatacagtgatgaaggatgggcaactgtacctgactggtggagtctggagtctagatggctcagatagcatgcaagagaccatgcaggccaccatccaggtccctgttcagcaagaagatggtccagaggatgacccacagttggttggaatcactgcccggaacattccaagaggagcccagctagctgctgagaacctgggcatcagcctggcaagcttgttgctcaacaaaggagctaagaacatcctagatgttgcacggcagcttaatgatgtgcgctaactggcgacgtcggcacaggaaccgaaccccagctgtcactccagtgcctatgtctggctgtcaagtgccctgtgctccttaacaaggggaatgattatcccaggagattgaacagagttgttgagacttcggccttggaagatatgcctcaacttggggcctccatgactgcctttccctcagtagtttgtgggcttcatctctttagagaaagtccatgccaatcttttatgtaaccaatgccactaatcagttcagaatgtggttctcctggagttgggggaagatatgaataaacccaaagccctttaaccgtaaaaa

SEQ ID NO: 3263 - DNA, 4409 bp, Rattus norvegicus
  Genbank Accession No. NM_013173
ccacgcgtccgatggggaagaagcagccgagggcagcagcaagtgctgctccaaactgtgagctaaaatcctattctaagagcacagatcctcaggtatctaccatggtgttggatcctgaagaaaagattccagacgatggtgcttctggggaccatggagactcggccagcctcggtgccatcaaccctgcttacagcaactcttccctcccacattccaccggggattctgaggagcccttcaccacctactttgatgagaaaatccccattcctgaggaggagtactcttgttttagtttccgtaaactctgggccttcacaggacctggttttcttatgagcattgcctacctggatccaggaaacattgaatctgatttacagtctggagcagtggctggatttaagttgctctgggtgctcctgctggccactattgtggggctgctgctccagcgtctcgcagctcgactgggagtggtcaccggcttgcaccttgctgaagtgtgtcaccgtcagtatcccaaggtcccacggatcatcctgtggctaatggtggagttggcaatcattggttctgatatgcaggaagtcattggctcagccatcgccatcaatctcctgtctgccggaagggttcccctgtatggtggagtcctcatcaccatcgcagatacttttgtatttctctttttggacaaatatggcttgcggaagctggaagcattttttggctttctcatcactatcatggccctcacatttggatatgagtatgttacagtgaaacccagccaaagccaagtactcaggggcatgttcgtgccatcctgttcaggctgccacacccctcaggtggagcaggcggtgggcatcgtgggagctgtgatcatgccacacaacatgtacctgcactctgccttagtcaagtctagacaagtgaaccgggccaataagcaggaagttcgagaagccaataagtacttcttcatcgagtcctgcattgcactctttgtttccttcatcatcaatgtctttgtcgtctccgtctttgctgaagcattttttgagaaaaccaatgagcaggtggttgaggtctgcagaaatagcagcagcccccatgctgacctctttcctaacgacaactctaccctggctgtggacatctacaaagggggtgttgtgcttggatgttacttcgggcctgcggccctctacatctgggcggtggggatcctggctgctggacagagctccaccatgactggaacctattctggccagtttgtcatggagggattcctgaacctaaaatggtcgcgctttgcccgcgtgatcctgaccaggtctattgccatcatccctaccctgcttgttgctgtcttccaagatgtggagcatctgacagggatgaatgatttcctgaatgttctgcagagcctacagctcccctttgccctcatccctatcctcaccttcacaagcctgcggccagtgatgagtgagttctccaacggaataggctggaggatcgcaggcggcatcttggtccttctcgtctgctccatcaacatgtactttgtcgtggtctacgtccaggagctagggcatgtggcactgtatgtggtggctgcagtggttagcgtggcttatctgggctttgtgttctacttgggttggcagtgtttgattgcgttgggcctgtcgttcctggactgtgggcgctcggtaagcatctctaaagtcctgctgagcgaagataccagcggtggcaatactaagtaaacactgggtcagcctgtctgtctgtctttgcagggagccatcagagccagtgtgtttctatggtttactgtgtgaacatagccacaagtatgtgccgttgcacagactgcatttagggaccaactgttagttgggaaacactggggtgggtgtgtggtgtgtgtgtgtgtgttgtttccttctgtctttgtcaaatagcatgctgctattaaatgcttggtggcctaaaactctgtgtagcctaggctgccttcaaacttacagcaatcctcctggctcagcctcctgggtgctgggattccaggcatgtctaccgctcctggctgtcacgagtgcttacaagatgactggttttgtcaggggaggtcttaccctgtagcattaggcagcaccttgaaaaggtgagccttgagctgttttgaacactaaattcctaaatagctgtccaaggccatggctcggttttagttctgagaaacccaaccagactgttgtcatcatttgaattgcagaattagagaccgctatttttgagttcaggatttctgtttgtttggtgcatttcattttgtttttcaagacaagggtttcttccttgttgtcctggaacttactctgtagaccagcctggctttgaactcacagagatcctcctgcctctgcctctgcttcccgactgctaggattagaggcatacaccaccactgccctgctaagctcagagttttttatttctactttggaattcctcagtggaaagaaaggtagagcaggagagggggtgtggtcaagtgatggctcccctccaggtccttgcaggtttaccttaaggagtggagcttagcagggcttcatctgtagtcctgaggctagtgacttccctgttaatagcaagcatcccgatagtgtttcatctcgagtacacacagtcctggaatctccgccttcctctcctgagagagtgcggatggcaaaagactactgtagcacttgtgaactggctcacagcaaatcccagagctgaccgcactactcccgaaagtacccttcaccaaatcttggctctgacccaccgctgtttcatgcccaagataactcagaaggcaacctcaggagctctggacccaaaccttgcaaagtcagtagttgtcactgtgatgcaaagtcctctccctgcaaggtgggactaggctgcctcctcacagcccttccctcggagagaaagcctcttgagaccaggctgcggagctctggagattcagcacgggactacagaactgctgctctcagttcagccacttctgtcctggcacgtgggagacatgattctgtcacatcaagtcctgtctgtttgctggaaaggaataatacaagtttgtataatcattgccttggtggcaacaggagctacagtgacttcgaaggatgtcgtcctctttgccgctttcccagttcgactgtcccgacaaatgacctgcattgtggtgccactgtggcattagtgctagcatttcacacagtcagaagctcagcctgcatagagtcctgtgaggcatgaagggtaaatgcagtttcactcagcctggttgacctcagccccacagctaacacaacacagtcaggccgcgggtccctcactgcggcattctcaacccctgggttgccacccatttgcagcccctatatccaaaaccatttacattatgatttataacagtagcagcattagttgtgaaatagcaaagattttatggttgggggttaccaccacaaagggtcgcagcagcaggaagtttgagaaccctgcaccacagggtccatctcacacctgcctctgccaccattgttcccaaaactgactggaaactgagcttttgaaactgtctcgatgtggtgcttgagggccagattgacagtagcagaattactggaatggatgctctagtgacatctgcatttgtacaggggcggggttgggcggggcggggcggggttgggcagggtgtgttcagagtcactgtacttacagtccagcccagagctgctggcagtcatgcccaggggtctgccttgtgcgtgctagcaaggctgtgctgcagatctcacttcctgccccagagttctgctgtagtatgttcgtttacagtgatagacggttccattgtgtacgacggtctctgactctatgcctacagtatttacagtgtcaaagattaaaagtgtcgcctgtccatttggccgtcactgggaaacagtgcttccaacagtgctctgtacgtaacctgtaagcatttcaaccccgccacgccagtgtggcctggcgttacgttggcgagccatcttgtacgttctcacttggtcctcgttcttctgcgacctgaaatagttgttccctctgctctgggagctggcggctggggaacagcagcagcttgtcttgtaaggtcctgccaggagggcaacaagtgactataaggaggctgttagtgagcctctgacagcttgtgaacttgctgtaattaaaacaaaaacttccctgttaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3264 - DNA, 2535 bp, Rattus norvegicus
  Genbank Accession No. NM_013176
cgcccggggagccacgggcggccaagcccgagagccgcccgagccgctcggactcaagcgctcgcgcgggcccgaggcagcccagccgccggcggcgcgtggggagggggaagcccgagcccgcgctcccgaccaaagtgaactttaatcgggaaggttggatgcggagcccgggcggcaggacctgctagaagtagctgaagatgaatccccagcagcagcgcatggccgcgatagggaccgacaaggagctgagcgacctgctggacttcagtgcgatgttttctccacctgttaatagtgggaaaacgagaccaacgacactgggaagtagtcagttcagcgggtcaggtatggatgagcgtggaggaacaacgtcttggggaacaagcggtcaaccaagcccctcctatgattcatctagaggttttacagacagccctcattacagtgatcacttgaatgacagtcgattaggaacccatgaaggcttgtccccaacacctttcatgaactcaaatctgatagggaaaacctcagagagaggctcattttccctgtacagcagagactctggattatcaggctgtcagtctagtctcctgagacaagatctaggactcgggagcccagcacagttgtcttcttcaggaaaacctggaacaccatactactcattctctgccacaagttctagaagaagaccgctccatgattctgtagctctagatcctttacaagcaaagaaagtaagaaaggtgcctcctggcctaccttcttctgtgtatgcaccatccccaaattctgacgatttcaaccgtgaatctcctagttacccatctcccaagccaccaaccagtatgttcgctagcactttctttatgcaagatggcactcacagttcttctgacctttggagttcatcgaatgggatgagccagcctggttttggtggaattctggggacctccacttcccacatgtctcagtccagtagttatggcagtcttcattcacatgaccgcttgagttatcctccacactcagtgtcaccaacagacataaacacaagtcttccgccaatgtccagcttccaccgtggtagtaccagcagctcaccatatgttgccgcctcacatactcctcccatcaatggatcagatagcatcctgggaacccgagggaatgctgctggaagctcacagaccggtgatgcacttgggaaggccttggcatctatttattctcctgaccacacaagcagtagttttccatcaaacccatcaacaccagtaggatctccttcacctctcacagcaggtaccagtcagtggcccagagctggagggcaagctccttcatccccaagctatgaaaactcacttcactccctgaaaaatcgagttgagcagcaacttcacgagcatttgcaagatgcaatgtccttcttaaaggatgtctgtgagcagtctcgaatggaagaccgtttagacaggctggatgatgctatccatgtgctacggaaccatgcagttggaccttctaccagtctgcctactagccacagtgatatacacagtttattgggaccatcccataatgcaccaattggaaacctcaattcaaactatggaggatcaagccttgttacaaatagtcgatcagcttcgatggtcggaactcatcgggaagattcggtcagtctcaatggcaatcattcggtcctgtctagtactgttgctgcctcaaacacagaactgaaccataaaacaccagaaagtttcagaggtggtgtacaaaatcagtctggaagtgttgttccaacagaaatcaagactgaaaacaaagaaaaagatgaaaaccttcatgaacctccttcatcagatgacatgaaatcagatgatgagtcctcccagaaagacatcaaagtctcatctagaggcagaacaagcagtaccaatgaagatgaggatctgaatccagaacagaaaatcgaaagggagaaggaaaggcggatggctaacaatgccagagagcgcttgcgtgtgcgggatatcaatgaggcattcaaggagctcggccgaatgtgtcagcttcatttgaagagtgagaaaccacagacaaaacttctcattcttcatcaagccgtggcagtcatccttagtctagaacagcaagtcagagagaggaacctcaaccccaaagcagcctgccttaagagaagagaagaagaaaaggtctctgctgcgtcagcagagccgcccaccacgttgccaggaacccatcctgggcttagtgagacaaccaaccctatgggtcatctgtaaacatcagccagttccagagtcatcagtaggctagatagaaggtgacctctcctcataaagatttggagaactcagattatctgaagacacaaacctggcaggagggagaagaaaaagcaaaacacttgaaacaagaaactcatatgtaatcctatgatcaaagcaactggtcaacacttccatcagaagtgaggataggaagctgcgg

SEQ ID NO: 3265 - DNA, 6957 bp, Rattus norvegicus
  Genbank Accession No. NM_013178
acggcacccggggctcgtccgccaccgctcttctctgcttctggccaacagctgaagtcacgcagttcctggagtctgaacccaggagacagttcgggacactggggcgttggccccaagctcctcgggctggagaagatctggttcactttctgttgatcccgaaggtggcacaatctattgctgagaagagaacactgcggggcctggagtgggggaatgcaccgtgcccagtgtcctgggcatcagcacgcccaggtcttgcaggcacatctcccagccccaacaagaccaggacacccacctccctgacccaactcctgggcaggcagagagtgaggagtacacagtagaccccgggcattggtgaccacccaaaacccaagggctgcgggctgtagcggctctgttacctaccaccctctggcccctgagcccagaatgcaaggatggccagctcatctctgcccaacctggtccccccgggtccccactgcctgcgccccttcaccccagagtccctggcagccatagagcagcgggcggtggaggaggaggcccggctgcagcggaacaagcagatggagattgaggagcctgagcggaagccacgcagtgacctggaagctggcaagaacctcccactcatctatggggaccccccacccgaagtcattggcatccccctggaggacctggatccttactacagtgacaagaagaccttcattgtgctcaacaaaggaaaggccatcttccgattctctgccacgcctgccctctacctgctgagccccttcagcatcgtcaggagggtggctatcaaggtgctcattcacgcgctgttcagcatgtttatcatgatcaccatcctgaccaactgtgtgttcatgaccatgagcaatccgccttcttggtccaaacacgtggagtacaccttcacggggatctatacctttgagtccctcattaagatgctggcccgaggcttttgcattgatgacttcacattcctccgagacccctggaactggctggacttcagtgtcatcacaatggcgtatgtgacagagtttgtggacttgggcaacatctcagccctgaggaccttccgtgtgctgcgggccctgaagaccatcacggttatcccagggctgaagacaattgtgggagccctgatccagtctgtgaaaaagctgtcggatgtgatgatcctcactgtcttctgcctgagtgtctttgccctggtggggctgcagcttttcatgggaaacctgcgtcagaagtgcgtgcgttggcccccgcccatgaatgacaccaacaccacgtggtatggcaatgacacttggtacagcaatgacacttggtacggcaatgacacttggtacatcaatgacacttggaacagccaggagagctgggccggcaactctacctttgactgggaggcctacatcaatgacgaagggaacttctatttcttggagggctccaatgatgctctgctctgtgggaatagcagtgatgctgggcactgccctgagggctacgaatgcataaaggctgggcggaaccccaactatggctacaccagctatgacaccttcagctgggctttcctggctctcttccggctcatgacgcaggactactgggagaaccttttccagctgaccctacgagctgctggcaagacctacatgatcttcttcgtggtcatcatcttcctgggctccttctacctcatcaatctgatcctggccgtggtggccatggcgtacgctgagcagaatgaggctaccctggccgaagaccaggagaaagaggaggagttccaacagatgcttgagaaatacaaaaaacatcaggaggaactggaaaaggctaaggctgcccaggctctggaaagtggagaggaggcagatggggacccaacccacaacaaagactgcaatgggagcctggatgcatccggggagaaggggcccccaaggccaagctgcagcgcagacagtgccatctcagatgctatggaggagctggaagaggcccatcagaagtgcccaccgtggtggtacaagtgtgcacacaaagtcctcatctggaactgctgtgccccgtgggtgaagttcaaacatataatctacctgatcgtcatggacccctttgtggacctgggtatcaccatctgcattgtgctcaacaccctcttcatggccatggagcactaccccatgaccgagcactttgacaacgtgctctccgtgggcaacttggtcttcacaggcatcttcactgcggagatggtgttgaagctgattgccatggacccctacgagtatttccaacagggctggaacatctttgacagtttcatcgtcaccctcagcctggtggagctgggcctggccaacgtacaggggctgtcagtgctccgttccttccgcctgctgcgtgtcttcaagctggccaagtcatggccaacactcaacatgctcatcaaaatcattggcaactcagtgggcgcgctgggcaacctgaccctggtgctggccatcatcgtcttcatcttcgccgtggtgggcatgcagctgttcggcaagagctataaggagtgtgtgtgcaagatcgcctcagactgcaacctgcctcgctggcacatgaacgacttcttccactccttcctcatcgtcttccgcatcctctgcggggaatggatcgagaccatgtgggactgcatggaggtggccggccaggccatgtgcctcaccgtcttcctcatggtcatggtcattggcaacctggtggtcctgaatctgttcctggctctcctgctgagttccttcagtgctgacagcctggcggcctcggatgaggatggcgagatgaacaacctacagattgccatcgggcgtatcaagtggggcatcggttttgccaaaaccttcctcctggggctgttgcgtggcaagatcctgagccccaaggaaataatactcagcctcggtgagcccgggggtgccggggaaaatgccgaggagagtactcccgaggatgagaagaaggagccgccaccggaagataaggagctgaaagacaatcatatcctgaaccacgtgggcctgaccgatggcccccgctccagcatcgagctggaccaccttaacttcatcaacaacccctacctcaccatccaggtgcccattgcctccgaggagtctgacctggagatgcccacagaggaggagacagacgccttctcggagcctgaggatatcaagaagcccctacagcccctctacgacgggaactcctccgtctgcagcacagctgactacaagccccctgaagaggaccccgaggagcaggctgaggagaaccccgagggggagcagcctgaggaatgcttcacggaagcctgtgtgaagcgctgcccctgcctctatgtggacatctcccagggccgtgggaaaatgtggtggacactgcgcagggcctgtttcaagattgttgagcacaactggtttgagaccttcattgtcttcatgatcttgctcagcagtggagccctggccttcgaggacatctacattgaacagcgacgagtcatccgcaccatcctggaatacgccgacaaggtcttcacctacatcttcatcctggagatgttgctaaagtgggtcgcctacggcttcaaggtgtatttcaccaatgcctggtgctggctcgacttcctcatcgtggacgtctccatcatcagcctggtggcaaactggctgggctactctgagctggggcccatcaaatccctgcgcacactccgggccctgcgacctctgagggcactgtctcgatttgagggtatgagggtggtggtgaacgccctcctgggagctatcccctccatcatgaacgtcctcctcgtctgcctcatcttctggctcatcttcagcatcatgggggtcaacttgtttgctggaaagttctactactgcgtcaacaccaccacctctgagagattcgacatctcggtggtcaacaacaagtccgagtctgagagcctcatgtatacaggccaggtccgctggatgaatgtcaaggtcaactacgacaacgtgggtctgggctatctctccctccttcaggtggccacattcaagggttggatggatatcatgtatgcagctgtggactcccgggagaaagaggagcagccacactatgaggtgaacctctacatgtacctctacttcgtcatcttcatcatcttcggctccttcttcaccctcaacctcttcatcggtgtcatcatcgacaacttcaaccaacagaagaagaagtttggagggaaagacatcttcatgacagaggaacagaagaaatactacaatgcgatgaagaagcttggctccaagaagccccagaagccaattccccggcctcagaacaagatccagggcatggtgtacgacttcgtgacgaagcaggtgtttgacatctccatcatgatcctcatctgcctcaacatggttactatgatggtggagacagatgaccagagccagctcaaggtggacatcctgtacaacatcaacatggtcttcattatcatcttcacaggggagtgtgtgctgaagatgtttgccctacgccattactacttcaccattggctggaacatctttgactttgtggttgtcatcttgtccatcgtgggccttgcgctctctgacttgatacagaaatactttgtgtcacccacgctgttccgtgtgatccgcttggctcggatcgggcgtgtcctgcgtctgatccgcggggccaagggcatccggacgctgctgttcgccctgatgatgtccctgcccgccctcttcaacatcggcctccttctctttctggtcatgttcatctactcgatcttcggcatgtctaacttcgcctacgtcaagaaagagtcaggcatcgacgacatgtttaactttgagacctttggcaacagtatcatctgcctcttcgagatcaccacgtcagccggctgggacgggcttctgaaccccatcctcaacagtgggcccccagactgtgacccgacgttggagaacccgggtaccaatgtcaggggggactgcggcaacccttccatcggcatctgtttcttctgcagctacatcatcatctccttcctcatcgtggtcaacatgtacattgctatcatcctggagaatttcaacgtggccaccgaagagagcagcgagcccctcagtgaggatgacttcgagatgttctatgagacctgggagaagttcgacccggacgccactcagttcatcgactacagccgcctctcggactttgtggacaccctgcaggagccactgaaaatcgccaaacccaataagatcaagcttatcacgttagacctgcccatggtgcccggcgacaagatccactgcttggacatcctctttgccctgaccaaagaggtactgggtgactctggggagatggacgccctcaagcagaccatggaggagaagtttatggcagctaacccttccaaggtctcctatgagcccatcaccaccaccctcaagaggaagcaggaggaggtgtgtgctatcaaaatccagagggcctaccgccgccacctgctgcagcgctccgtgaagcaggcctcttacatgtaccgtcacagccaggacggcaatgacgacggggcccccgagaaggagggattgcttgccaacaccatgaacaagatgtatggccatgagaaagagggtgatggtgtgcagagccagggggaggaagagaaggcctctacagaggatgctggacccaccgtggagcccgaacccaccagcagctcagatactgccctgactccttctcctccaccactacccccctcatcatcaccgccacaagggcagacagttcgcccaggggtcaaagagtctcttgtctagatggcagcgtcaaggctgcacgcagagttggaggggaagggctttgagatgggggctatacaggacttgacacctgggctgaggggtatggaaattgtgctcagggttcaggtgggtcggaagcccctgctgcctgatttcatctttacgatgctctgacattctgttggccaggggaggccaggacatctgaatgctgtttccttcttgggggagagccagcataccttggaggggttggccaccttcctgtcactactttaagggcccaggaccccagctctagccaagacaaagacgaatcttaacccccaaacctacacctgacccccagagcttagctatccctctcgcccccataattctagggtgcagcttccccctgacagctcaggaatgccctgtaaaaggggaaatggttctggtacagaaccaattggccgctggatccggatgtatcaggctggaaacatgacttctgaaacctttcacccagtcagatccaggccggtgggcagctcccctggctggcccctgggggaagaactaaggaaggattgccctgagaaattacctttctctagattgcgtggatgggtcaaacaggctgggtcctgccagctgcattcatgcccttgagcctgagcgcccacatctgcctggggtcaggttggaagctctctatcaagaatcgcccgttcccgcctccctgccttctttctttgaataccagggctcctgggagccccatcaaacacgaaagactgccttcctcctgtctaatctctgccccccccttccctgccccttccctgcttcctcaagtgactctgagaatgctagaactcagcacacgggagatgagttgatactggggcatgcagtgagaaggctcaccaggcttggctttggtcttctcattgcctgaaagcaagttttcccctgagacagggtttcttttctccgtgtagccctggctgcctgg

SEQ ID NO: 3266 - DNA, 630 bp, Rattus norvegicus
  Genbank Accession No. NM_013184
atgctccctcgccactcctgctctctcctccttttccttctcctcctccccagcgtccccatggagccccaacccccctcctccaccctgcccccttttctggctcctgagtgggacctcttgtctccccgagtggccctgtcaaggggcacccctgccgggccccctctcctcttcctgctggaggccggggcctatggggagccggcaggggccccagccaaccgcagccggcgcggggtgagtgagacggcaccggcaagccgccggggtgagctggcagtgtgcgatgcagtgagtggctgggtgaccgaccggcggacagctgtggacttgcgtgggcgcgaggtggaggtgctgggcgaggtgcctgcggcaggtggcagtcccctgcgtcagtacttcttcgagacgcgctgcaaggccgaaagcgctggggaaggtggcccaggtgtgggcggagggggctgtcgcggcgtggatcggaggcactggctctcagaatgtaaggctaaacagtcctatgtgcgggcgttgactgcagactctcagggccgcgtgggctggcgctggattcggatcgacaccgcttgcgtctgcacgctcctcagccgaacaggccgtgcctga

SEQ ID NO: 3267 - DNA, 1911 bp, Rattus norvegicus
  Genbank Accession No. NM_013185
gaattccggtcgccggtaaaggcggctctgacccgctcggagcgccaacgcagcctccgtagcccgcaagtcttcgtcgcttgctccgggctctcgagtccgggccaccaggggcgcgcgctggggggtcgttcgagctgcgaggatccgggctgcccgcgaggcgaagggcgggtgcccaggatgggatgtgtgaagtccaggttcctccgagaaggaagcaaggcctcaaaaatagagccaaatgccaaccagaaaggccctgtgtatgtgccggatcccacgtcccctaagaagctgggaccgaacagcatcaacagcctgcccccggggttcgtggagggctctgaggacaccattgtggtcgcactgtacgactatgaggccattcaccgtgaagacctcagcttccagaagggagaccagatggtggttctggaggagtctggggagtggtggaaggcccgttccctggctaccaagaaagaaggctatatcccaagcaattatgtagctcgagttaactctttggagactgaggagtggttcttcaagggtatcagccggaaggatgcagagcgccacctgctggctcccgggaacatgctgggctccttcatgatccgggacagtgagaccaccaaagggagctactcactttctgttcgagactttgacccccagcacggagacacggtgaagcattataaaatccggacactggacagtggagggttctacatctctccgaggagcaccttcagcagcctgcaggaacttgtcgtccactacaagaaggggaaggatgggctctgccagaagctgtcagtgccctgtgtgtctccgaaaccccagaagccatgggagaaagatgcctgggagattcctcgagaatccctgcagatggagaagaaactgggagccgggcagtttggagaagtgtggatggccacctacaacaagcacaccaaagtggcggtgaagacaatgaagccagggagcatgtctgtggaggccttcctggcagaggccaacctgatgaagacgttacagcatgataaactggtgaagctacacgctgtggtctctcaggagcccatctttattgtcaccgagttcatggccaaaggaagcctgctggactttctcaagagtgaagaaggcagcaagcagccactgccaaaactcattgacttctcagcccagatttcagagggcatggctttcattgagcagaggaactacatccaccgagacctccgggctgccaacatcttggtttctgcatcactggtgtgtaagatcgctgactttggactggcacggatcatcgaggacaatgagtacacagctcgggaaggagccaagttccccatcaagtggacagctcctgaagccatcaactttggctccttcaccatcaagtcagatgtctggtcctttggtatcctgctgatggaaatcgtcacctacggccggatcccttacccaggtatgtcaaacccagaggtgattcgagcactagagcatgggtaccgtatgcctcgaccagataactgcccagaggagctctacagtatcatgatccgctgctggaagaaccgtccagaggaacggcccactttcgaatacatccagagcgtgctggatgacttctacacggccactgagagccagtatcagcagcaaccttgatgggccggaagaacatgagcacagccagaagccccatcagggccttgacatgctcgacctgctgggcccactctcagacgccccctcccccacattccagctgtcgagtggagggagaggacttcacaatctctttttgactctagtcatctgcaatctgccattctcagggcctccaagttagtgtttctcatttgcctggaatgaactgaattc

SEQ ID NO: 3268 - DNA, 3350 bp, Rattus norvegicus
  Genbank Accession No. NM_013189
tgcaggcccgcgggagggcggaggaggggagccggggcggcggagcgtgtgtgccacccgcggaccggtcacgtcctcgcgcggccgccggcacccgcttcgtgcagaaccagagcgccacagccctacgctcgcggccccgccccgccgggtgcagctcgaccgacgcacgaagccgcgcccgggaggtgaagggccggatgcgaggcagggagccggagcagcctgaggcaggggggcctcagggagcgctgggccctccagccgtgcttagaaacatcgccacagcaaccagcgagcagacagaagtagcctgggcagacgcaagcggacagcttcctaccgtggcagagtacagggaatgactacggcaaatcaggccacactgccgacaagggaggtggagtgtcactagaggggagggtgtggtctctgccccacgacactgagcgccatgcccacaggagaagaggtgctggggcagggattgcactgtgacacagcctcgccccatagccagttctgagcgtgcccgggtcagctgcctctctcatctgcccggcgtcataccagcccacatttcagcatccctccttgggaccattctgtttggcaagggggagaggcacccatcctgtgtcccgcatccaggggggacgtctgctgctgccggaccatgggatgtcggcaaagctcagaggaaaaagaggcagcgcggcggtcgaggagaattgaccgccacctgcgctcggagagccagcggcagcgccgtgagatcaaacttctcctgctgggcaccagcaactcgggcaagagcaccatcgtcaagcagatgaaaatcatccacagcggtggtttcaacctggaggcctgcaaggagtacaagcccctcatcatctacaacgccatcgactcgctgacccgcatcattcgggccctggctgccctgaagattgatttccacaaccctgaccgtgcctacgacgccgtgcagctctttgccctgactggcccggcagagagcaagggtgagatcacgcccgagctgctgggtgtcatgcgacggctctgggctgaccccggggcccaggcctgcttcggccgctccagcgagtaccacctggaggacaacgccgcttactacctgaatgacctggagcgcatcgcggcgcccgactatatccccacggtggaggacatcctgcgctctcgggacatgaccacgggcattgtggaaaacaagttcaccttcaaggagcttaccttcaagatggtggatgtgggagggcagaggtcagagcgcaaaaaatggatccactgctttgagggcgtgacggccatcatcttctgtgtggagctcagtggctatgacctgaagctttatgaggacaaccagacgagccgaatggcggagagcctgcgtctttttgactccatctgcaacaacaactggttcatcaacacctccctcatcctcttcctgaacaagaaggacctcctgtcggagaagattcggcgtatcccgctcagcgtctgcttccccgagtacaagggtcagaacacgtacgaggaagccgcggtctacatccagcgtcagttcgaggacctaaaccgaaacaaggagaccaaggagatctactcgcactttacctgtgccaccgacaccagtaacatccagtttgtcttcgacgcagtgacagatgtcatcatacagaacaatctcaagtacattggcctttgctgaggagccgggcgcagcctgcttgcctgcggtgaaaacccacggggtgtcacaccccacacctcatgctggagaggcccgacccaggggcaggaaacggggggagtggcttgaagagtgtgtccccacccccagcctctctcgcctccttggccccacgtctctgcaaacataaatatatttggatagattgctaggtaggtagacacacagacacacgcacacgcacacgcacacgcgcacgcacgtctggagacggcaacgctctccggcggtcaaggtttcctgaaattttcagaagctgctgtcacaatttcattctgaggccatcttgcccccccaccccccatccactctgagtcggcccccgctctgcatgggagggagggtccacgtttgactgccgaggaggggccggcggggctggggccagggccggccagctgtgcccattgcctgggagaaggccagctcaccacctgagctctggactggggaccaccactgaccaggagggagggccggggcagggactgtaccttcccgtctcagccactctgtgccacatttgtcctgtacctaggaccagaggaaataagtgactgttctcaccagacctctgactaccagtggcttttacaaaaacctaaaaagtgtgcagcaaaaaacctaacacaggctgaggagtggcactgtttatttcaaactaggccagctgggtttccagctcttcttctactggtctgatgttttataaatggaaacctggtttttcttctctggcacccttctttttttttttttttaatttttattttcggccaaatattatgtctcacggagggggaaaaaatacagacaatttcagatgtgatcggatattcttttttaaatgcgggttttcggaacacatttcatttcgggcgtccccttctgtgtctggtttgctgagtatagaagttgtcacctggacgattctgctcctcggctccaaagaatcctggggcaagtgtcccacaccagcctcatgggacatattatgtatataagcctctgcaatgttctcttgttcttggtgcccttttctgctttaaataaaatgtgatgtatttaaagaaggttctttacctaggagcgaatgaacaatagctaaatgtcctggtatttaaagtgtaaattatctatggctttgccaaaatgaaggaagggggggaggcgggcaagagatggcactcctcggtccccacacactccacgcctgacacgggctgggagctgctcagactcctgtgaaggcacagctagacttgtggcctgaaggaggccctgctgggactgtgcactccggcccttctagccccagggcccacagacgctggtcttgaaagagccttggctgtgtataaatgcaaagcccagctaccgagggaatggcaaccactggatccctggccaaatctctctcgaccctttgtttgctacccgtgtgtccgaggtcaatgtgcagacccgcagccaaggagctgggatgtttaacagagggagaagagctggggaaccgtataaaacatgaagattgtctactttaagaaataaaataccctgaacg

SEQ ID NO: 3269 - DNA, 2770 bp, Rattus norvegicus
  Genbank Accession No. NM_013190
ggcgacagccgcgcggaacgcagagcggcgggagaggagctcgggctcctggtctctgctgccgtcatggctaccgtggacctggagaagttgcggatgtcgggggctggcaaggccatcggagtgctgacaagcggcggtgacgcgcaaggtatgaatgctgctgtcagggctgtgactcgtatgggcatatatgtgggggccaaagtcttcctcatctacgagggctacgagggcctcgtggaaggaggcgagaacatcaagccagccaactggctcagtgtctccaacatcatccagctgggcggcaccatcattggcagtgcccgctgtaaggccttcactacgagggaagggcgcctggcagcggcctacaatctgctccaacacggcatcaccaacctgtgtgtcatcggtggggatggcagcctcacgggggccaacatcttccgcaacgagtggggcagcttgctggaggaactggtgaaggaaggcaagatctcagagtccacagctcagaactacgcacacttgagcatcgccggtctggtgggctccatcgacaacgacttctgcggcaccgacatgaccatcggcacggactcggccctgcaccggatcatggaggtcatcgacgccatcaccaccactgcccagagccaccagaggacctttgtgttggaggtgatgggacggcactgcgggtacctggcgctggtgtctgcgctggcctccggggctgattggctgttcatccctgaagcgcccccggaggatggctgggagaacttcatgtgtgagaggctgggggagactcggagccgggggtctcgactgaacatcatcatcatcgcggagggtgccatcgaccggcatggaaagcctatctcatccagctacgtgaaagacctggtggttcagaggctgggcttcgatacacgagtgaccgtgctgggccacgtacagcgaggagggacaccctcggcctttgaccgagtcctgagtagcaagatgggtatggaggccgtgatggcgctgctggaggccacgccggacacgccggcctgcgtggtcagcctctccgggaatcagtctgtgcggctgcctctcatggagtgtgtgcaagtgacgaaggatgtgcagaaggccatggatgagaagaggtttgacgaggccatccagctccgtggcaggagcttcgagaacaactggaaaatttacaagctcctcgcccaccagaaggtgtctaaggagaagtccaacttctccctggccatcctgaatgtgggagctccagcggccggcatgaacgcagccgtgcgctccgcggtacgcactggcatctccgagggacacacagtgtacgttgtgcatgatggctttgagggcctggccaagggtcaggtgcaagaagtgggctggcatgatgtggcaggttggctaggacgtggtggctcaatgctggggaccaagaggaccctgcccaagccccacctggaggccattgtagaaaatctccgtacctacaacattcatgccctgttggtgatcggtggctttgaggcctacgagggtgtgctgcagctggtggaggctagggggcgctacgaggaactctgtatcgtcatgtgcgtcatcccagccaccatcagcaacaatgtccctggcactgacttcagcctgggctcggacacggccgtcaacgctgcaatggagagttgtgaccgcatcaaacaatcggcctcggggacaaagcggcgtgtgttcattgtagagaccatggggggctactgtggctacctggccactgtgacaggcattgctgtgggcgccgatgccgcctacgtctttgaggaccctttcaacatccacgacttgaaggccaatgtggagcatatgacagagaagatgaagacagacatccagaggggcctggtgctccggaacgagaagtgtcacgaacactacaccacggaattcctatacaacctatactcctcggaaggcagaggtgtgttcgactgcaggaccaacgtgctgggccacctgcagcagggtggcgctccaacccccttcgaccggaactatgggaccaaactgggggtgaaggccatgttgtggatgtcggagaagctgcgtgatgtctaccgcaaagggcgggtgtttgccaatgctccggactcagcctgtgtgatcggcctgaggaagaaggtggtggccttcagttcggtcacagaactcaagaaagagacagattttgagcaccgtatgccgcgggagcagtggtggctgaatctgcggctgatgctgaagatgttggcacactaccgcatcagcatggccgactacgtgtctggggagctggagcacgtcacacgccgcaccttgagcatagacaagggtttctgagcttaccgatcaccctcgttcctgctctcccggactctctctccctcccagtgctagccacagatcccagcactaaggggaactcacatggaactcggagcctgtggttggttgaaggatttgggggtctactgtgctgctctgggactcctcccttagccacccccacccccccaccccctcagaacagagcacctgtggggcccttacattccagttctggctgggcagacccacatcaccactccctcactggtcagctggctgcctcaccacacggccgaaaagagcctcatggtttttttttttagaaataaagtcacctgtttagaaaaaaaaaaaaaaaaaaaaaaaaaaaaaa

SEQ ID NO: 3270 - DNA, 6060 bp, Rattus norvegicus
  Genbank Accession No. NM_013194
tcctggctataagtcaccatggcccagcaggctgcagacaagtacctctatgtggataaaaacttcatcaataacccgctggcccaggccgactgcggtgccaagaagctggtatgggtgccttccaccaagaatggctttgaaccagccagccttaaggaggaggtgggagaagaggccattgtggagctggtggagaatgggaagaaggtgaaggtgaacaaggatgatatccagaagatgaacccacccaagttctccaaggtggaggacatggcagagctcacgtgcctcaacgaagcctcggtgctgcacaacctcaaggagcgatactactcagggctcatctatacctattcaggcctgttctgtgtggtcattaatccttataagaacctgcctatctactcagaggagatcgtggacatgtacaagggcaagaagaggcacgagatgccgccccacatctatgccatcacagacactgcctacaggagcatgatgcaggaccgagaagatcagtccatcctttgcacgggtgagtctggagcaggcaagacagagaacaccaagaaagtcattcagtacctggcacatgtggcctcctcacacaagagcaagaaggaccagggggagctggagcgccaactgctgcaggccaaccctatcctagaggcctttggaaacgccaagacggtgaagaatgacaactcttcacgatttggtaaattcattcgtatcaactttgatgtcaacggctacatcgttggggccaacattgagacttatcttctggagaaatctcgtgctatccgccaagccaaggaggaaagaaccttccacattttttactacctgctgtctggggccggagagcacctgaagactgatctcctgttggagccatacaataaataccgcttcctgtccaacgggcatgtcaccatcccagggcagcaggacaaggacatgttccaggagacaatggaggccatgaggattatgggtatcccagaggatgagcagatgggcttgctgcgggtcatctctggcgtccttcagcttggcaacattgtcttcaagaaggaacggaacactgaccaggcgtccatgccagataacacagctgctcaaaaggtgtcccacctcctggggatcaatgtgaccgacttcaccagaggcatccttaccccgcgcatcaaggtgggcagagactatgtgcagaaggcacagactaaagagcaggctgactttgccatcgaggctttggccaaggctacctacgagcggatgttccgctggctggtgcttcgcattaacaaagctctggacaagaccaagaggcagggcgcctcatttatcgggatcctggacatcgctggcttcgagatctttgatctgaactccttcgagcaactttgcatcaactataccaacgagaagctgcagcagctgttcaaccacaccatgttcatcctggagcaggaggagtaccagcgagagggcatcgagtggaacttcatcgactttggccttgacctgcagccttgcatcgacctcattgagaagccggcgggtcccccaggcatcctggccctgttagatgaggaatgttggttccctaaagccactgacaagagcttcgtggagaaggtggtgcaggagcagggcacccaccccaagttccagaagcccaagcaactgaaggacaaggctgatttctgcatcatccactatgcaggcaaggtggactataaggccgatgagtggctgatgaagaacatggaccctctgaacgacaacattgccaccctgcttcaccagtcctcagacaagtttgtctctgagctgtggaaggatgtggatcgaatcattggcttggaccaggtggctggaatgtctgagacagcgctacccggtgccttcaagactcggaagggcatgttccgtactgtggggcagctgtacaaggagcagctggccaagctcatggccacactgaggaataccaaccccaactttgtctgctgcatcattcccaaccacgagaagaaggccggcaaactggacccacacctggtgctggaccagttacgctgcaatggcgtccttgaaggcatccgaatctgccgccagggctttcccaacagagtggtcttccaggagttccggcagaggtatgagatcctcacacctaactccattccgaagggcttcatggatgggaagcaggcgtgtgtgctcatgatcaaagccttggagcttgacagcaacctgtaccgcatcggccagagcaaagtgttcttccgttccggagtcctagctcacctggaggaagagcgggacctgaagatcactgatgtcatcattggcttccaggcctgctgcagaggctacctggccaggaaggcctttgccaagaggcagcagcagctgactgccatgaaggtcctacagaggaactgtgctgcatacctcagactccggaactggcagtggtggaggctcttcaccaaggtcaagcccctgctgaactcaataaggcatgaggatgagcttttagccaaggaggcggaactgacaaaagttcgagagaagcatctggctgcagagaacaggctgacagagatggagactatgcagtctcagctcatggcagagaagttgcagcttcaggagcagctgcaggcgaaaaccgagttgtgtgctgaggctgaggagctccgggcccgcctgacagcgaagaagcaggagttggaggagatctgccatgacctggaggccagggtagaggaggaggaggagcgctgccagtatctgcaggcagagaagaagaagatgcagcagaacatccaggaactcgaggagcagctggaggaggaggagagtgcccggcagaagctgcagcttgagaaggtgaccactgaggccaagctgaagaaactggaggaggaccagatcatcatggaggatcaaaactgcaaactggccaaggagaagaagctgctggaagacagagtagctgaatttactacagacctcatggaagaggaggagaagtccaagagcctggccaagctcaagaacaagcatgaggcgatgatcaccgacctggaagagcgccttcgtagggaggagaagcaaaggcaggagttggagaagacccgccgcaagctagagggagactccacagacctcagcgaccagattgctgagctccaggcgcagatcgcagagctcaagatgcagctggccaagaaggaggaggaattgcaggctgccttggccagagtggaagaagaagctgctcagaagaacatggccctgaagaagattcgagaactggaaactcagatctctgagctgcaggaagacctggagtcggagcgtgcctgcaggaacaaagctgagaagcagaaacgggatcttggagaagagctagaggctctgaagacagagctggaggacactctggactccaccgctgcccagcaggaactgaggtcaaagcgtgagcaggaagtgagcatcctgaagaagactcttgaggatgaggccaagacccatgaggcccagatccaggagatgaggcagaagcactcgcaggccgtggaggagctggccgagcaattggagcagactaagcgggtaaaagctacccttgagaaggctaagcagaccctggagaatgagcggggagagctggccaatgaggtgaaggccttgctgcagggcaagggcgactcggagcacaagcgcaagaaggtggaggcgcagctgcaagaactgcaggtcaagttcagcgagggagagcgtgtacggaccgagctggctgacaaggtctccaagctgcaggttgaactggacagcgtgaccggtctccttaaccagtcggacagcaagtccagcaagcttacaaaggacttctctgcgctggagtcccagctccaggacacacaggagctgctccaggaggagaaccggcagaagctgagcctcagcaccaagctcaagcagatggaggatgagaaaaactccttcagagagcagctggaggaggaagaggaggaggccaagcgcaacctggagaagcagatcgccaccctccatgcccaggtgactgatatgaagaagaagatggaggacggtgtagggtgcctggagacagcagaggaggcaaagcggaggcttcagaaggacctggaaggcctgagccagcggcttgaggagaaggtggctgcctatgataagctggagaagaccaagacccggcttcagcaggagctggatgacctgctggtggacctggaccaccagcggcagagcgtctccaacctggaaaagaagcagaagaagtttgaccagctcctagctgaggagaagaccatctcagccaagtatgctgaggagcgagaccgagctgaagctgaggcccgtgagaaggagacaaaggcactgtcactggcccgagcacttgaggaggccatggagcagaaggcagagctagaacggctcaacaagcagttccgcacggagatggaggacctcatgagctccaaggatgacgtgggcaagagtgtccatgagctggagaagtccaacagggcattggagcagcaggtcgaggagatgaagacccagctggaggagctggaggatgagcttcaggccactgaggatgccaagctccgtctggaggtgaacctgcaggccatgaaggcccagtttgagcgggatctgcagggccgggatgaacagagcgaggagaagaagaagcagctggtcagacaggtgcgggagatggaggcggagctggaggatgagaggaagcagcggtccattgccatggctgctcgcaagaaactagagatggatctgaaggacctggaggctcacatagacacagccaacaagaaccgggaggaggccatcaaacagctacggaagcttcaggcccagatgaaggactgcatgcgggacgtggacgacacgcgagcctcccgggaggagatcctggcccaggccaaggagaatgagaagaagctcaagagcatggaggccgagatgattcagctgcaggaggaactggcagccgccgagcgtgctaaacgccaggcccagcaggagcgggatgagctggccgatgagatcgccaacagcagtggcaaaggggccctagcattggaggagaagcggcgactagaggccctcattgccctgctggaggaagagctggaggaggagcagggcaacacagaactgatcaacgaccggctgaagaaggccaatctgcagatcgaccaaataaacaccgacctgaacctggagcgcagccacgcccagaagaacgagaatgcgcggcagcagctggaacgccagaacaaggagctcaaggccaagctgcaggagatggagagtgctgtcaagtccaaatacaaggcctccatcgctgccttggaggccaagattgcacagctggaggagcagctggacaacgagaccaaggagcgccaggcagcctccaagcaggtgcgccgggcggagaagaagctgaaggatgtgctgctgcaagtggaagacgagcggaggaacgcggagcagttcaaggaccaggccgacaaggcatccactcgcctgaagcagcttaagcggcagctagaggaggccgaggaggaggcccagcgggccaatgcctcccgccggaagctgcagcgtgagctggaggatgccacagagactgccgatgctatgaaccgagaggtcagctccctgaagaacaaactgaggcgtggggacatgccatttgttgtgacccgccgaattgtccggaaaggcactggcgactgctcagacgaggaggtcgacggtaaagcagacggggctgatgccaaggcgaccgagtagggacttctgctacccaagacggatggacagacggctccacctcccttccccagccctccacacccctgccttgagactgctctgcccatgcccctcttcctcccaggccttcttgagggcattggcttcctctgctgcatccccttccagctccct

SEQ ID NO: 3271 - DNA, 2389 bp, Rattus norvegicus
  Genbank Accession No. NM_013198
gtctcaggcagaggtccagactcagtggaagcagaggagagagcctgaaacctggcgagcaccatgagcaacaaatgcgatgtgatcgtggtggggggcggcatctcaggtatggcagcagccaaacttttgcatgactgtggcctcagtgtggtggttctggaagcacgagactgtgtgggaggcaggacttacacaattaggaataaaaatgttaaatatgtggaccttggaggatcttatgttgggccgacccagaatcgtatcttacgattggccaaagagctaggattggagacctataaagtgaatgaagttgagcggctgatccactttgtaaagggaaaatcatatgccttcaggggcccattcccaccagtgtggaatccaatcacttacctagattataacaacctctggagaacaatggatgagatgggccaagagattcccagtgatgctccatggaaggcaccccttgctgaagagtgggactacatgacaatgaaagagttgctagataagatctgctggaccaactctacaaagcagattgccacactctttgtgaacctatgtgtaactgcggagacccatgaggtttctgcactgtggttcctgtggtatgtgaagcagtgtgggggtacaaccagaatcatatcaacaaccaatggaggacaggagaggaaatttattggtggatctggtcaagtgagtgagcggataaaggatatccttggggacagagtgaagctggagaggccggtgatccacattgaccagacaggagaaaatgttgttgtgaaaaccctaaaccatgaaatatatgaggctaaatatgtgattagtgccatcccacctgttttgggcatgaagattcaccatagtcctcctctgcccattctaagaaaccagctgattactcgtgtgcctttgggttcagttattaagtgcatggtttattataaagaacccttctggaggaaaaaggatttctgtggaaccatggttattgaaggagaggaagctccaattgcgtacacattggatgataccaagccagatgcaggctgtgctgctataatgggatttatccttgctcacaaagctagaaaactggtacgccttactaaagaagaaagactgaggaagctctgtgagctatacgcgaaagttctgaactctcaagaagctctgcagccagtccattatgaagagaagaactggtgtgaggagcagtactccgggggctgctacacagcctacttccctcctggcatcttgacccagtatggaagggttctacgccagccagtgggcaagattttctttgcaggcaccgagacagcttcacattggagtggctacatggagggggctgtagaggctggagagagagctgccagagagattcttcatgccattgggaagattccagaggatgaaatttggcagccagaaccagaatctgtggatgtcccagcaagacccattaccaacaccttcctggagagacacttgccttctgtaccaggtctactaaagctgcttggattgaccaccatcttgtcagcaacagctcttggtttcctggcccacaaaaagggtctgtttgtacgtttctaaagatgggctttaggaccatatccacaggtttctcattcagtgtgtcacaaaagcttttggaaggagttgggataaaaatctgacaaaggtgcagagattatggagtgagaaagcacagtaacttggtctccattttggctatcttttagcatcgctgtggtccactcattttcaactttcctgcactctgaatattgagaacagatacacaggctctctcacaacctacctgccctatgcacatagttgtttttcaaaaccctatgcctttgtgcttgtctttcttctggtgtgttaggtcctcacctatatcaagttcttcatcattgtacctagaatcctgtcttgttagaaccagaaggcattagacactgtagcttattgtctactttagagttaaataaaccaaatgcaacagaagtgaaatctaaccacacaaggcctacacaaagctactggtatttgggtgactggaacacaagctgatgcttttctcacctcccaaggttcattcccctgtgatcctcctccaccttatgtcatagtcattcacggatcattgttcttgtggatttactctgtattaactggtattgtgttactcagtagattcttctaggcttgctattttgtgtagtgttgccagctgattctaatttttcttgagaatgggagtcttgtctttgtcatttcttttttgcatcttccagtatgcttccactcatagatttaagacatgcttaaataattaaaaataaagctg

SEQ ID NO: 3272 - DNA, 3463 bp, Rattus norvegicus
  Genbank Accession No. NM_013199
cggtgaggggagccgggcgggtggcagagcagagcaggaggaagcaacggccacagacgcatcgggaccgcgagtcgtagtcgggggatccgcggggcggaggcgggcaccatgggcaaccgcgggatggaagagctcatcccgctggttaacaagctgcaggacgccttcagctccatcggtcagagctgccacctggacctgccgcagatcgccgtggtgggcggccagagcgccggcaagagttcggtgctcgagaacttcgtgggccgggacttccttccacgaggatcaggaattgtcacccggaggcctctcattctgcagctcatcttttccaaaacagaatatgcggagtttttgcactgcaagtccaaaaagtttacagactttgatgaagtccggcaggagatcgaagcagagactgaccgggtcacaggcaccaacaaaggcatctccccggtgcccatcaaccttcgggtctattcaccacacgtgttgaacttgaccctcatcgacctcccaggcatcactaaggtgccagttggggaccagccaccagacatcgagtaccagatcaaggacatgatcctgcagtttatcagccgggagagcagcctcattcttgccgtcacacctgccaacatggacttggccaactcggatgccctcaagctggccaaggaggtggacccccaaggcttgcggaccattggtgtcatcaccaagctagacctgatggatgaaggcacagatgccagggatgtcctggagaacaagctcctgcccttgagaagaggctacatcggcgtggttaaccgcagccagaaagacatcgagggcagaaaggacatccgggcagctctggcagctgagaggaaattcttcctctcccacccagcctaccggcacatggctgaccgcatgggtaccccacacttgcagaaaacactgaaccagcaactgaccaaccacatccgggagtcactgccaaccctgcgcagcaagctgcagagccaactgctgtccctggagaaggaagtggaagagtacaagaatttccggcctgacgaccccacacgcaagaccaaagccctgctgcagatggtccagcagtttggagtggactttgagaagcgaatcgaaggctctggagatcaagtcgacaccctggagctgtctgggggcgcccgcatcaatcgcatcttccacgagcgctttccctttgagctggtgaagatggagtttgacgagaaagacctccgaagagagatcagctacgccattaagaacatccacggagtcagaactgggctcttcacgccggatttggcgttcgaggccattgtgaaaaagcaggtggtcaagctgaaagagccctgtctgaaatgcgtggacctggttatccaggagctaatcagtacagttaggcaatgcaccagcaagctcagttcctacccccgccttcgagaggagaccgaacgcattgtcaccacctacatcagggagcgagaagggagaaccaaggaccagatccttcttctgattgacattgagcagtcctacatcaacacaaaccatgaagacttcattggatttgccaatgcccagcagaggagcacgcagctgaacaagaagagggccatacctaaccagggggagatcttggtgatccgcaggggctggttgaccatcaacaacatcagcttgatgaaaggcggttccaaggagtactggttcgtgctgactgctgagtcgttgtcttggtacaaggatgaagaggaaaaagaaaagaagtacatgctgccactagacaacctcaaaatacgggatgtggagaagggcttcatgtccaacaagcatgtgtttgccatcttcaacacagagcagaggaacgtctacaaggacctgcgacagatcgaactggcttgtgactcccaggaagatgtggacagctggaaggcttcgttcctgcgagctggggtctacccagagaaggaccaggcagagaacgaggatggagcacaagagaacaccttctccatggacccgcagctggagcggcaggtggagaccatccgcaacttggtggactcctatgtggccatcatcaacaagtccatccgggacctcatgccaaagaccatcatgcacctcatgatcaacaacacaaaggccttcatccaccatgagctgctagcctacctgtactcatcagcagaccagagcagcctcatggaggagtcagctgagcaggctcagcggcgggacgatatgctgcgcatgtaccatgcactcaaggaagcgctcaacatcattggggacatcagcaccagcaccgtgtccacgcctgtgcccccacctgtcgatgatacttggctccagaacaccagcagccacagccccactccacagcgcagacctgtgtccagtgtgcacccgccgggccgcccacccgcagtgcggggccccacaccggggcctcccctcattcctatgcctgtgggggccacatcctccttctcggcaccccccatcccatcccggcctggaccacagaatgtgtttgccaacaatgaccccttctctgcgccacctcagataccgtctcggccagcacggattccccctgggatccctccaggagtgcccagcagaagagcgcccgctgcgcccagccggcccaccattatccgcccagccgagccgtccctgctcgactaggctgcaggggacagtgttctgggggggtcctcgtgtacctacagtggtctgggccctgctactgccccccatgctgggaccaggctccccgtgggcaagcctgccctctcctccctagccctagtgcacatgataaggagggagagggtgggaaggaggcccaaacaaacagaacttgggggctttgcactttggggcgagggggagctctggttagcagaacagaaactgcacccttgggaccatctggaaagaaaggtctaggctagtggtggggaactctacatgggctcctccatactgtaagcctttgctctttctgaggtacagaactgtccacctttccctaaggactcctcaggagttagccaggcccaggaggtccagtgctggccacccacctggctcaagttgtatatatatatatagcttctttggccacattaaccacacagcctgagcccagcccagtctccacacccagaggtgcctttgtgccttccaggcctggagtgcctcagctctggcctgcctctctcctcagcccctgttgtggtttgggctgtaagaactctggagacatcaggacctcttggcttccaaccagatgtctcctacagggtgggccctggtgcctctgtacagattctgctcccaacgcttggattgaccactgttaagtgcctgcctctgtatatcctattaataaactaaaataaagggaagccctctcgtggct

SEQ ID NO: 3273 - DNA, 2826 bp, Rattus norvegicus
  Genbank Accession No. NM_013200
gacagaagcaaacctgagctgtgctgactaaaccccaggatggcggaagcacaccaggcagtagctttccagttcactgtgaccccagacggggtcgacttccggcttagtcgggaggctctgagacacatctacctgtctggaatcaactcctggaagaaacgccttattcgaatcaagaatggtatccttaggggtgtgtaccctggcagccctaccagctggctggttgttgtcatggcaacagttggttccaactactgcaaagtggacatctccatggggctggtccattgcatccagagatgcctcccgacaaggtatggctcctacgggaccccacagaccgagacacttctcagtatggtcatcttctccaccggagtctgggcgacaggcatttttttattccgacaaaccctgaagctgctgctttcctatcatgggtggatgttcgagatgcacagcaagaccagccatgccaccaagatctgggctatctgtgttcgtctcctgtccagccggcggcccatgctctatagcttccaaacatcactgcccaagcttcctgtccccagtgtgccagccacaattcaccggtacttggattctgtgcggcccttgctggatgacgaagcctatttccgcatggagtcgttggccaaagaattccaggacaagattgcccccagactgcagaaatacctggtgctgaagtcatggtgggcaaccaactatgtaagtgactggtgggaagagtacgtctacctccgaggcaggagccccatcatggtggacagcaactattacgccatggattttgtgcttattaagaacacgagccaacaagcagcacgtttgggaaacaccgttcacgccatgatcatgtatcgccgcaaactggaccgagaagagatcaagccggtgatggcactgggtatggtacccatgtgctcctaccagatggagaggatgttcaacactacacgcatcccaggcaaagagacagacttgctacagcacctctcagagagcaggcacgtggctgtctaccacaaaggtcgcttcttcaaggtttggctctatgagggctcgtgcctgctcaagccccgagacctcgagatgcagttccagagaatcctcgatgacacctccccgcctcagcctggagaggaaaagctggcagccctcaccgcaggaggaagggtagagtgggcagaagcacgtcagaagttctttagctctggcaagaacaagatgtccctggataccatcgaacgtgctgctttctttgtggccctggacgaagactctcactgttacaaccctgatgacgaggccagtctcagcctctacggcaaatccctgctgcacggcaactgctataacaggtggttcgacaaatctttcactctcatctcctgcaagaatggccagctgggcctcaacacagaacactcatgggcagatgctcccatcatcggtcacctctgggagttcgtcctggccactgatacctttcacctgggctacacggagacaggacactgtgtgggtgaacccaacaccaagttgccgccgcctcagcggatgcagtgggacattcccgagcagtgccagacagccatcgagaattcgtaccaagtagccaaggccctggctgatgatgtggagttatactgcttccagttcttacccttcggcaaaggcctgatcaagaagtgtcggaccagccctgatgcctttgtgcagattgccctgcagctggctcatttccgggacaaaggcaagttctgcctgacctatgaggcctccatgacaagaatgttccgagaggggcggacagagactgtgcgttcctgtactagcgagtccacggcctttgtgcgggccatgatgacggggtcccataaggaacaagacctccaagacctcttccggaaagcctccgaaaaacaccaaaacatgtaccgcctagccatgacaggggctgggatcgacaggcacctcttctgcctctacatcgtctccaagtacttaggggttaggtctcctttcctggacgaggtgctttcggaaccctggagcctctccaccagccagatcccccagttccagatctgcatgtttgacccaaagcagtaccccaatcatctgggtgctggaggtggctttggtcctgtggccgaccacggatacggggtttcctacatgatcgcaggcgaaaacacaatgttcttccatgtttccagcaagttatcgagttcagaaacgaacgccctgcgcttcgggaaccacatccgtcaagcactgttggatatcgccgaccttttcaaaatttccaagactgacagctgagaccaggagacacaccagctgccctttggtccccacctggtggaggaagaggtctgtggccagttcacaggcataaggggtggcatgcacacgtgcccagttctgagaccagctccagcgcaggggctccccaggcagacactgctcctccaggcccggtcgaggtgggattggagtggtgagggaactttgatctttttttttcccccggtcttggtagatgctaataaaaataaggctgtataattctctctcagcccttaggtgcctatgtttggttagagaactagaaggcctttcccctgcccctgctcaggttagggtggtggcgactgaagggccgggtgaatgttcataatggctttttacctgctttgaaatgtgtgcttttcctgaataatgcggacttcgagagtgctgtccaacctctcatgtgcacttggaataaattcttactttagaaccttt

SEQ ID NO: 3274 - DNA, 1523 bp, Rattus norvegicus
  Genbank Accession No. NM_013214
acttctacatcaagatccgtcctggggagtatgagcagttcgagagcaccatcggcttcaagctccctaaccttcaccttcattgcgccacggcggctttcggacgagcctctgactcgcgcacgcgttagactccttggtccgtgttacaagacgggtcgggtgggtagccgacatcgccgccgaccccgtgccgtcgcagccaagatgtccggtcccaccaccgacacgccggccgccatccagatctgccggatcatgcgtccggatgatgccaacgtggccggcaatgttcacggagggaccattctaaagatgatcgaggaggctggggtcatcatcagcacccggcactgtaacagccagaatggggagcgctgtgtggctgccctggcccgggtggagcgcactgacttcctgtcgcccatgtgcatcggtgaggtggctcacgtcagcgcagagatcacctatacttccaagcactctgtggaggtccaggtccacgtgttgtcggagaacatcctcacaggtaccaaaaagctgaccaataaggccaccttgtggtatgtgcccctgtcattgaagaatgtggacaaggtccttgaggtgcctcctattgtgtatttacggcaggaacaggaggaggagggtcggaaacgctatgaagcccagaagctagaacgcatggagaccaagtggaggaacggagacattgtccagcccatcctgaacccagagccgaacacagtgagctacagccagtccagcctgatccacctggtggggccctcagactgcactcttcatggcttcgtgcacggaggtgtcaccatgaagctcatggatgaggtggccgggattgtggctgcgcgccactgcaagaccaatatagtgactgcctctgtggatgctattaatttccatgacaagatccggaaaggctgtgtcatcaccatctctggacgcatgaccttcacaagcaataagtctatggaaattgaggtcctggtggacgctgaccctgtggtggacaactcacagaagcgctaccgggctgccagtgccttcttcacctacgtgtccctgaatcaggagggcaagccgctgcctgtgcctcagcttgtgccggagacggaggacgagaagaagcgttttgaagaaggcaaaggccgctatctgcagatgaaggcgaagcgacagggccatacagagcctcagccctagatgtcttcctccctcccatcctgtcccgtcctgggtcagcacagttgtggcagtagtcctgtgtgcagtcacttagaagtcgcccccttggccaaaccccgatttcctttgagagctggtgttgtgaagtaccgtgtgacagtgttacctgtggcctgttcccaaaacctgtgcaccaaagctttatttatatccctccagtccctgtcccatgttgtcccaaaggccatcgtggacaccagagcacactgactggcctggagaagccagcaccactaataaagctgctgtctggctgg

SEQ ID NO: 3275 - DNA, 1088 bp, Rattus norvegicus
  Genbank Accession No. NM_013216
gcgcccgccgccgcgctctgtatgccgcgttcccccggcgcacccgccgccgatagtctgagccggaggagtcgccgccgctgcggttgatgtggttgggccggggctgaccaggctaccaagatgcctcagtccaagtcccggaagatcgccatcctgggctatcggtctgtgggaaagtcctcattgacaattcagtttgttgaaggtcaatttgttgattcctacgatccaaccatagaaaacacattcaccaagctgatcacagtaaatgggcaagagtatcatcttcagcttgtagacacagcagggcaggatgaatattccatttttcctcagacatactccatagatattaatggttatattcttgtgtattctgttacatcaatcaaaagctttgaagtaattaaagttatccacggcaagctgttggacatggtggggaaagtgcagataccgattatgttagtcggaaataagaaggacctgcatatggaaagggtgatcagttatgaagaaggaaaggctttggcagaatcttggaatgcagcttttttggaatcttctgcaaaagaaaatcagactgctgtggatgtttttagaaggataattttggaagcagaaaagattgacggagcggcttcacaagggaagtcttcgtgctcggtgatgtgacgcgcctgctgcagagcctgagtgtattccacctgaggaagcaagctgcctgtcatccttgaagataaaactaggcttctgttttcttctgttaacctgaacgatgtcatttgggtcagaggtcctcccctctcagattatgttaacgtctgactctgtccaaatgagttcacttccattttcaaattttaaacaatcatattttcaatttatatattgtatttcttaatattatgaccaagaattttatcggcattaatttttcagtgtagtttgttgtttaaaataatgtaatcatcaaaatgatacacgttacactactattagctaggcttcagtctatcagtgtttatctccttgtgttaaatgtatacttgtaaataaagtagctgcaaaccttaaaaaaaaaa

SEQ ID NO: 3276 - DNA, 1061 bp, Rattus norvegicus
  Genbank Accession No. NM_013218
ggccaggccaggccgcagttcagcgtctgcgcacgttcggccaccgttgccaccatgggggcatcggggcggctgctgcgcgccgtgatcatgggggccccgggctccggtaagggcactgggtcgtcacgcatcaccaaacacttcgagctgaagcacctctccagcggggacctgctccgccagaacatgctgcagggcacagaaatcgctgtgttggccaagagcttcattgaccaaggaaagctcatcccggatgatgacatgactcggctggccctccatgagctgaaaaaccttacccagtgtagctggctgttggacggatttccaaggacacttccacaggcagaagccctggatagagtttatcagatagacacagtgataaatctcaacgtgccctttgaggtcattaaactacgccttactgctcgctggattcatcctgccagtggccgagtttacaacattgaattcaaccctcccaagactgtgggcatcgatgacctaacgggagaacctctgattcagcgtgaggacgacaaaccagagacggtgatcaagagattgaaagcgtatgaagcccagacagagccggtcctgcagtattaccagaaaaaaggggtgttggaaacattctccggaacagaaaccaacaagatcaggccccacgtatactccttcctgcaaatgaaagttccagaaaccatccaaaaagcctctgttactccctgaggaaggcacttggcgggatgaagcagggcctcctccactcctcccctcgcctctgtatttcgaagctgttttcctaagacttctctgaaaattatgatttaagtcctaatggccttgcctaatgagtcagaaactaaggctgaccgtgtgtttatgtasgttgtccttccatggatgtgcaattgaaaacgtcagacatgttgaaacaaacaaactcagagcacaattaagagagcaactggtggggttggggatttagctcagtggtagagcgcttgcctaggaagtacaaggccctgggttcggtccccagctccgaaaaa

SEQ ID NO: 3277 - DNA, 1749 bp, Rattus norvegicus
  Genbank Accession No. NM_013220
cccgggcaggtccaggggttcagccacaagagggaaaaacatagactaacggctgccaacatgatggtttttcgagtagaggagctggtaacgggcaaaaagaacagcaatgggtcctcaggggagttccttcctggcgagttcagaaatggagagtatgaagctgctgttgccttggagaaacaagaggacttgaagacacttccagccaacagtgtgaacctgggggaagaacaacggaaaagtgagaaagttcgagaggcagagctcaaaaagaaaaaactagaacaaagatcaaagcttgaaaacttagaagaccttgaaataattgttcaactgaagaaaagaaaaaaatacaagaaaactaaagttccagttgtgaaggaaccggagcctgaaattattactgaacctgtggatgtgccaaggtttctgaaagctgcactggagaacaaactgccagttgtagagaaattcctgtcagacaagaacagccccgacgtctgcgatgagtataaacggaccgctctccatagagcatgcttagaaggacacttggcgatcgtggagaagttaatggaggctggagcccagattgaattccgagatatgctggaatccacagccatccactgggcatgtcgtggaggaaacctggatgtcctgaaactgttgctaaacaaaggtgccaaaatcagtgcccgagacaagctgctcagcacagcgctgcacgtggcggtgaggaccggtcactacgagtgtgctgagcacctcatcgcctgcgaggcggatctcaatgccaaggacagagaaggagacacccctctgcatgatgcggtgaggttgaatcgctacaagatgatccggctcttgatgaccttcggtgcggacctcaatgtcaagaactgtgctgggaagatccctatggatctggtgttgcactggcagaatggaaccaaagcgatattcgacagcctcaaggagaatgcctacaaaaactcgcgcatagctacgttctgaggaaagagactcgacaggagctgttctcagccgttttcaaaacatttcccagcagcggagcaaccagctataacacccagcttttgtttgccagccaaatagggagataagctttaaagacgcttcatggaaggaccctgggttagagatgctaacatgtcctctagcgatgctcaccatttttatctgctcctatttatttatttatttatttcatagcactggtagtcaggttttcatgagcatcattttgggggagcaagacttaatctgtgtgtaacattcggagtcttcccgtggctctaaaaccgcgtgggtgaatggtgtctaatctcccttttgtgtcctcacttgcattaaagctactcaaggtatttttgaaagccaagggttggtcggtcgctgcagcccttctctggattctcactgctgatatccgaatgaagcagcagaaggtgtacaggaatgcagaaggggatgggagcagttctgcaggacctaagccgtggctcgccaggcacccacaggtgtggtttgccggatcacacagtgccgaggtgaaggccacgtcaggagcgtgtgtggagggggatggagggagtaggcaatggggcctcactaacctgaggtcgatgagaggaaaaagtccaaaaggacatgccctgtaaatgtgtaaatggtattgtgttgtatgcatattttatattcctaataaatgcaaactaattc

SEQ ID NO: 3278 - DNA, 2642 bp, Rattus norvegicus
  Genbank Accession No. NM_013221
agtgtgctctaaaggcgacgggtttgtcggagcaccataatatggtgtgggaagtgaagacgaaccagaggcctcatgcagtacagagactcctgctggtgatggacgagagagctacaggagtgagtgactcattggagttgctgcagtgtaatgagaatgtgccgtcctctccaggatacaactcctgtgatgagcacatggagcttgatgaccttcctgaacttcaggctgttcaaagtgaccctacccaatctgccatataccagctcagttcagatgtatctcatcaagaatatccaagaccatcttggagccagaatacctcagacataccggaaaatactcaccgtgaagatgaggtggactggctaacagagttagcaaatattgccactagtccacaaagtccactaatgcagtgctcattttataacagatcatctcctgtacacatcatagctactagcaacagtttacattcctatgcacgcccaccaccagtgtcctctgcaaagagcggaccagccttccctcatgaccactggaaggaagaaacaccagtaagacatgaaagggcaaacagtgagtcagagtcaggaattttctgcatgtcctccctgtcagatgatgatgatctgggctggtgcaattcctggccatcaaccgtttggcattgctttctcaaaggcacacgactgtgcttccataaggaaagcaaaaaggagtggcaagatgttgaagactttgctagagccgccacctgtgatgaggaggagatccaaatgggcactcacaagggctatgggtctgatggtctaaagttgttatcccatgaagagagtgtgtcattcggtgagtctgtactgaagttgacatttgatcctggtacagtagaagatggcttgcttactgtggagtgcaagctggaccaccctttctatgttaaaaataaaggctggtcatcattttatccaagcttgactgtggtacagcacggcattccatgctgtgagattcatattggtgacgtatgtctacctcctggacaccctgatgccattaatttcgatgattcaggtgtttttgatacatttaaaagctatgacttcacacctatggactcttccgcagtctacgttttgagtagtatggctcgccagcgccgcgcatctttgtcttgtggaggacctggtactggtcaagagtttgcaggatctgaattcagtaaaagctgtggttcaccaggatcatcacagctctcctctagttctttatacactaaagctgtcaaaagccacagctcagggactgtgagtgccacttctcctaataagtgcaaaagaccaatgaatgccttcatgctttttgccaaaaaatacagagttgaatatactcagatgtatccagggaaagataacagagccataagtgtgatccttggtgacaggtggaaaaaaatgaagaacgaggaaaggaggatgtatacattagaagcaaaggctttggctgaagaacaaaagcgtttaaatcccgactgctggaaaaggaaaagaaccaattcaggctctcaacagcactaaacctgatgcttctgtctgtaagtctgtaccttgcatcagtactgactctgtacctgcataaggactgactctggacggaaaagcttggaagaccttggtctcaccatttgtcctacatttgtgtgaccataaaatgctgggagcattgagttttgtaatgatttaatgggtgaggaggatctgctttctccattagagcattaagtaagctaaaactatcaacattgtaaaccaaattgccttattttccttccaaacttcatatatgtctatcaggtaatataggcttgaaaattgatatcctgtggtgctaaagtacagtagaaagagagatgtgtatacatgtcttattttaaattgtacgaaggggaatttaaaaatatgtaactgctgtttatacatcagctccttactgcttattaatctgtattgtacccacgatatcaggaatgaagtagaagctggcctttccatgaatagccaccacatggcccagtgtctctgccaaacacagttgcttctagtctggccagtgccaagagacaacataacatggcaggtggatggtgtcattgtctcagctgagagccacctgcttcagataccatgggcgtgtgctgagtggatgcaccagggggcagcacagctccatgattcccagtgggggccaagccaggctaaggtgcagtcagttagcattgggacagtcattgtaatggtgctgttatcagttgaaaccatgctccctgtctcctcagccacatcccctccgtctctgctgtcatcttctctgtggtggggcagactttgcacttactgcagtgcaacacttgcactttacccctccggcttctacagtagagcaagtccttcggcagccctgctgctttcgctctgcgctacaatcatggcttctcatgttacttaccaagtggtatttttggttaggaatcacagctgtaaagttgatttcagttcattacacttcttaaacatattgcccctcaattttgcacactatattcttgtatattatttcaaataaaatgaaaaaagtct

SEQ ID NO: 3279 - DNA, 2145 bp, Rattus norvegicus
  Genbank Accession No. NM_013223
ctcgcggcaacgatgctggggggcggctccgtggatggcgagcgcgacacggacgacgacgcggcgggggcggtggccgcgcctcctgccatcgacttccccgcagaggtgtcggaccccaagtatgatgagtccgatgtcccagcagagctccaagtgttcaaagagcccttgcagcagcccacgttccctttcttagtggcaaaccagctgctgctggtctccttgctggaacacttgagccatgtgcacgagccgaacccacttcactcaaaacaggtctttaaattactgtgccagacttttatcaagatggggctgctctcttcctttacctgcagcgatgagttcagctccctgagactccaccacaacagagccatcactcatttaatgaggtctgccaaggagagagtccgtcaggatccttgtcaagataattcttacatgcagaaaatcagatccagggagatagctctcgaagcacagacttcacgctacttaaatgaatttgaagagctcgccatcttaggaaaaggcggatatggaagagtttacaaggtccggaacaaattagatggtcagcattatgcaattaagaaaatcctgattaagagtgcaactaaaacggattgtatgaaggtgctacgggaagtgaaggttctggcaggcctccagcaccccaatatcgttggctaccacactgcatggatagagcacgttcacgtgcttcagccacaagacagagttcccattcaactgccctctcttgaagtgttgtcagagcatgaaggggacagaaatcaaggtggtgttaaagataatgaaagcagttcgtccattatctttgctgaactcaccccagaaaaagaaaaccctttagcggaatctgatgttaagaatgagaataacaacttggtgagctacagggccaacttagtgatcaggagcagcagtgaaagcgaatcgtccattgagctccaagaagatggcttgaacgagtcgcctctcagaccagttgtcaagcaccagctgccgctggggcatagctcagacgtggaagggaattttacctccacggatgagtcttctgaagacaatttgaacctgctggggcagacagaggcgcggtaccacctgatgctgcacatccagatgcagctgtgtgagctctccctgtgggactggatagctgagaggaacaagcggagccggaagtgcgtggatgaagcagcttgtccctatgttatggccagtgttgcaacaaagatttttcaagaactggtggaaggtgtcttttacatacataacatgggcatcgtccacagagatctgaagcctagaaatatttttcttcatggtcctgatcaacaagtgaaaataggagactttggtctggcctgtgcagacatcattcagaagagcgcagattggaccaacagaaacgggaaaggaacgccgacacacacgtcccgagtggggacttgtctctacgcgtcacctgagcagttggaaggatccgagtatgatgccaagtctgatatgtacagcttgggtgtgatcctgctcgagctcttccagccattcgggacagaaatggagcgagcaacagtcctaacaggtgtgaggactggtcggataccagagtccctcagtaaaaggtgtccagtgcaagccaagtatatccagctcctgactgggaggaacgcggcccagagaccatctgctcttcagctactgcagagcgaactgttccaaacaacgggaaatgttaatctcacattgcagatgaagataatggagcaagaaaaggaaattgaagaattaaagaagcaactaagcctcctttcgcaggacaaagggctgaagagatgagagggaaatgggggcctacctgtgtagcctgaattatgctctcaaccatgtgaaagtggacttgcattcttaaaagtcaccagggatgtaaattttcaacccttagctgaggacgggtgtgactcccaattgtactgagcaaagctgtgtaaagaggtgaaaggacggtggctggggatttagctcagtggtagagtcgcttacctaggaagtcgcaaggtccctgggttcggtccccagctccggaaaaaaagaactaaaaaaaaaaaa

SEQ ID NO: 3280 - DNA, 435 bp, Rattus norvegicus
  Genbank Accession No. NM_013224
ctctttcgagtcttggctccaatatgaccaaaaaaaggagaaacaacggtcgtgccaaaaagggccgcggccatgtgcaaccaattcgctgcacgaactgcgcccggtgcgtgcccaaggataaggccattaagaagtttgtcattcggaacattgtagaagccgctgcagtcagggacatatctgaagcaagcgtcttcgacgcttacgtgcttcccaagctctatgtcaagctgcactactgcgtgagctgtgccattcatagcaaggttgtcaggaatcgatctcgtgaggcccggaaggaccgaacacccccaccacgattcagacctgctggcgctgcaccacgacctccaccaaagcccatgtaaagaggtgatttcatgaagacagaaagaaaaataccatggaaaaataaaactgaagttatacttt

SEQ ID NO: 3281 - DNA, 465 bp, Rattus norvegicus
  Genbank Accession No. NM_013226
ggcatcatggctgcccttcggcctctggtgaagcccaagatcgtcaaaaagaggaccaagaagttcatcaggcaccagtcggaccgatatgtgaaaattaagcgaaactggcggaaacccagaggcatcgacaacagggtgcggagaagattcaagggccagatcctgatgcccaacattggttacgggagtaacaagaaaaccaagcacatgctgcctagcggcttccggaagtttctggtccacaatgtcaaggagctggaagtgctgctgatgtgcaacaaatcttactgtgctgagattgctcacaatgtgtcctctaagaaccgaaaagccatcgtagaaagagcagcacagctggccatcagagtcaccaatcccaacgccaggctacgcagcgaagagaatgaatagatggcttgtgtgcctgttttgtgttcaaataaaaccacaaaaactgccaaa

SEQ ID NO: 3282 - DNA, 1866 bp, Rattus norvegicus
  Genbank Accession No. NM_016986
agagccaacagagcaggaaggcatcatggcagcagcgctccgcagaggctacaaggtcctgagaagtgtctctcattttgagtgtcgagcacaacacacaaaaccatctctcaagcaggagccgggactagggtttagcttcgagttgacggagcagcagaaagagtttcaaacaattgctcggaagtttgccagagaggaaataatcccggtcgccccagactacgataaaagcggggaatacccgttccctctcatcaagagagcctgggaacttgggttgatcaacacacacattccggagagttgtggtggtcttggcctgggaacttttgatgcgtgtttaattacggaagagttggcatatgggtgtacaggggtgcagactgctattgaagcaaattctttggggcaaatgcctgtgattattgctggaaatgatcaacagaagaagaagtatttggggaggatgacggagcagccgatgatgtgtgcctactgcgtgacagaaccctcagcaggctctgatgtggcgggcattaagaccaaagcagagaagaagggtgatgaatatgtcatcaatggccagaagatgtggataaccaacgggggaaaggccaactggtattttgtattgacgcgatctaacccagatcctaaagtacctgctagtaaagccttcaccggattcatcgtggaggccgacaccccgggaatacacatcggaaaaaaggaactaaacatgggtcagcggtgctctgacaccagaggaatcaccttcgaagatgtcagagtgcctaaggaaaatgtgttaattggtgaaggagcaggtttcaagattgcaatgggggcttttgatagaaccaggccgacggtcgcagctggtgctgtcgggctagcccagagagccctggacgaagctactaagtatgccctggacaggaaaacatttggaaagctgctagtggagcaccaaggagtttcatttctgctcgcagaaatggcgatgaaagttgaactggccagactcagttaccagcgagcagcctgggaggttgactccggccgccggaacacgtactttgcctctattgcgaaggcctttgctggagatattgccaaccagctcgctaccgatgctgtgcagattttcggaggctatggattcaacactgagtacccagtagaaaagctgatgcgggacgccaagatctatcagatttacgaaggtactgcacaaattcagaggctgatcatagctcgtgagcacattgaaaagtataaaaattaacagaaattactatcgaacgatgcttcaccctcatgtaactacgctcagagcactgttgctgcttcagggggaaagggctttacttgtcttcccacagaaatgagataaaagacgcgtgtcacagatctgtgcaatggggtcccacggcggagggtgcctctgttgagttccacagtgaccctttctagataggtttggttttggacagtgagtggtcagtccttggccccgaattgtgttaatttgctccttgatcacttgagatggagaaataccctggagttctaatgctcattcaagtgacaagaaaggtagcctgtcacgaaagaactcaggattctacacagacactgaggaatgtggcggattggacccatcacactgtgaagagagagcatttctgtgctgagctgtttcataattttgattatatttcccttgtattgcagaagagtaaaaaagtttatatgcattttctcccattataaaactaaaaactttctggaaaatcttaattctgaactggcattttatttgtcttgattacaatgattcaataaagctagccttaactt

SEQ ID NO: 3283 - DNA, 4269 bp, Rattus norvegicus
  Genbank Accession No. NM_016987
taagctggtgcttacggacagagagccacactcgggctttctcgaagaggtaaaccaggtccctctgcagccatgtcagccaaggcaatttcagagcagaccggcaaagaactcctttacaagtacatctgtaccacctcagccatccagaaccggttcaagtatgcccgggttactcccgacacagactgggcccatctcctgcaggaccacccctggctgcttagccagagcttggtagtcaagccggaccagctgatcaaacgtcgaggaaagcttggtctagtcggggtcaacctctctctggatggagtcaaatcctggctgaaacctcgactgggacatgaggccaccgtcggcaaggccaaaggcttcctcaagaactttctgattgagcccttcgtcccccacagtcaggcggaggagttctacgtgtgcatctatgctacccgggaaggagactacgtcctgttccaccatgaagggggtgtggatgtgggcgatgtggacaccaaagcccagaagctgcttgtgggtgtggacgagaaactgaacgctgaagacattaagagacacctgttggtccacgcccccgaagacaagaaagaaatcctggccagcttcatctccggcctattcaatttctacgaagatctttacttcacctaccttgagatcaacccccttgtggtgaccaaagatggtgtctacatccttgacctggcggccaaggtggacgccactgctgactacatctgcaaagtcaagtggggtgatatagagttccctcccccctttgggcgtgaggcatacccagaggaagcctacattgcagacctggatgccaaaagtggggcgagcttgaagctgaccttgctgaaccccaaggggcggatctggaccatggttgccgggggtggcgcctctgtcgtgtacagtgataccatctgtgatcttggaggtgtcaacgaactggcgaattacggggagtactctggtgcccccagtgaacaacagacctatgactacgccaagaccatcctctcacttatgactcgagagaagcacccggatggcaagatcctcatcattggaggcagcattgcaaacttcaccaacgtggccgccaccttcaagggcattgtgagagcaattcgagattaccagggttccctgaaggagcacgaggtcaccatctttgttcgaagaggtggcccgaactatcaagagggattacgagtgatgggagaagttgggaagaccactggaatccccatccatgtctttggcacagaaactcacatgacggccattgtgggcatggcctgggcaccggccattcccaaccagccacccacagcggctcacactgccaacttcctccttaatgccagtgggagcacatcgacaccagcacccagcaggacagcgtctttttccgagtccagagctgacgaggtggcccctgcaaagaaagccaagccagccatgccccaagattcagtcccaagtccaagatccctgcaaggaaagagtgccaccctcttcagccgacataccaaggctatcgtatggggcatgcagacccgggctgtgcaaggcatgctggactttgactacgtgtgctcccgagatgagccttcagtggctgctatggtctacccgttcacgggggatcataagcagaagttttactggggacacaaggaaatcctgatccctgtcttcaagaacatggctgacgccatgaaaaagcatccggaggtagacgtgctgatcaactttgcatctctgcgatcggcttatgacagcaccatggagaccatgaactatgcacagatccggaccatagccatcatagcagaaggcatccctgaggctctcacacggaagctcatcaagaaggcagaccagaagggcgtgaccatcattgggccagccacggttgggggcatcaagcctggatgctttaagattgggaatactggtgggatgctggacaacatcctggcctccaaactgtatcgcccaggcagtgtggcctacgtctcgcgttcaggaggcatgtctaacgaactcaataatatcatctctcggaccacagatggtgtctacgagggtgttgccatcggcggggacaggtaccctgggtccacattcatggatcacgtgctgcgttaccaagacactccaggagtcaagatgattgtagttcttggggagatagggggtacagaagaatataagatctgccggggcatcaaggagggccgcctcaccaagccagtggtctgctggtgcatcgggacctgtgccaccatgttctcttctgaggtccagtttggccacgctggggcttgtgccaaccaggcttctgaaacggcagtagccaagaaccaggccttgaaggaagcgggagtgtttgtgccccgaagctttgatgagctcggagaaatcattcagtccgtgtatgaagatcttgtggccaaaggcgccattgtacctgctcaggaagtgccacctccaacagtacccatggactactcttgggccagggagctgggtttaatccgaaaacctgcctcattcatgaccagcatctgtgacgagcgggggcaggaactcatttatgcgggcatgcccatcaccgaggtcttcaaggaagagatgggcattggtggtgtcctgggcctcctctggttccagagaaggttgcccaagtattcctgccagttcattgagatgtgtctcatggtcaccgctgatcacgggccagctgtctccggggcccataacactatcatctgtgctcgggctgggaaggacctggtctccagcctcacctcagggctgctcaccattggggaccggtttgggggtgccttggacgcagcagcgaagatgttcagtaaagcctttgacagcggcattattcccatggagtttgtgaacaagatgaagaaggaggggaaactgatcatgggcatcggccatcgagtcaaatcgataaacaacccagacatgcgagtgcagatcctcaaagactttgtcaaacagcacttccccgccaccccgctgctcgactatgcactggaagtggagaaaatcaccacctcaaagaagccaaatcttatcctgaacgtggatggtttcatcggcgttgcgtttgtggacatgcttaggaactgtggctccttcacccgggaggaagctgacgagtatgttgacattggagccctcaatggcgtctttgtgctgggaaggagtatgggcttcatcgggcactatcttgaccagaagaggctgaagcaagggctgtatcgtcacccctgggacgacatttcctatgttctcccggaacacatgagcatgtaaccgagccagcagccctaccgtagaaaaaggaagacaaaaactccctcctcgacaatatagcggacagacagctggaaacagagcccgttatgggctgggcctggaatggaaatagccattgatgtgcaggcatggaaagccaacaccacaggcccattcagtccacacagagaagcttagtatttttttttatatatatatctatatatatataagcatagaaatttaaaaccaagccaatacttgtgacgtttgcgctgctacctgctgtatctattacatggaagactgtaagcaagcgctgtcagaataatgttcttctagggccttatgatgttgctttctttttttaattagttgaaaatttatttttcctctagaactagtggatccgacttttaagacttcaggatactatctgtttgtaggaccactgtctggtatcccacctcccactcatcttcacaccacatgaagaacactgtattaatctgattttttaggatctttttttttttttttgtgttatgtgttaagggtttatttagtatcccactgaaacgttctgtgtttcggaccaatgtctacttatgtcaaggggaggagggttggggccattgtacccttagccatcgtcacacatgtggagtagtaacttaaatgtaaagttgtaacatacaagtgtttaaaatggaaaccgcaaagcaaaaagctgtgaaacgtctcgtgtcttgtgttctctgtgttcatgcagctgacttgtctgttactgaagtgtgggtccaaagactcacatctgttccgcatctgtaacccacagagattctggcagctgccacctcagtctcttctctgtattatcatgtttggtttaaataaactagatagtaaaaa

SEQ ID NO: 3284 - DNA, 2009 bp, Rattus norvegicus
  Genbank Accession No. NM_016988
ccggtgatggccggcagacagtctggttggagccaggcggctcttctccagttccttcttggcatgtgcctaatggtgatgccacccatacaagcccggagtctgcgctttgttaccttgctgtatcgacacggagatcggtcaccagtgaaggcatatcctaaggacccctatcaggaagagaaatggccccagggatttggtcagctaaccaaggaagggatgctacagcattgggagctgggccaggccctgcggcaacgctaccatggctttctgaacgcctcttaccacaggcaagaggtttacgtgcgaagcacagactttgaccgtactctcatgagtgcagaggccaacctggccggactcttccctcccactgaagttcagcacttcaacccgaacatttcatggcagcctatccctgtccacaccgtgcccattactgaagacaggttgctgaagtttcctttgggtccatgtccccgttatgagcagttgcagaacgagactcggcagacaccagagtatcagaacatgagtattcagaatgcacaatttctggacatggtggccaatgagacagggcttatgaacttgaccctagagaccatctggaatgtgtatgacacactcttttgtgagcaaacacatgggctgctcctgccaccctgggcctctccccaaaccgtgcaggctctgagccagctaaaggacttcagcttcctcttcctcttcgggatccacgatcaagtacagaaggcccggcttcaggggggagttctgctggctcaaatattgaagaatctgaccctaatggcaactacctctcaattccctaagcttctggtttattctgcgcatgacactaccctggttgctctgcaaatggcactgaatgtctacaatggtaaacaagccccctatgcttcctgccacatatttgaactgtaccaggaagataatgggaatttctcagtcgagatgtactttcggaatgacagtaagaaggcaccctggccactgaccctgcctggctgtcctcaccgttgcccactgcaggacttccttcgcctcacagaacctgtcatacccaaggactggcagaaggagtgccagctagcaagcgatactgcagacacagaggtgattgtggcactggctgtctgtggctccatcctcttccttctaatagtgttgctcctcactgtcctcttccggatgcaggcccagcctcctggctaccaccatgttgcagacagggaagaccatgcttgacaaccactcagtccccttccctctgcctcctaggggatgtgggctgagtccttgctcctgactattgccgatcccagagggacaggtttagccttcctgattacctacgcccaaatgaatgagtgaggctgggctggtcgcacgtcacctgtgacttaccatcctcatgcctgatgtttaccatgtactgtgttggacactggctttctctaaatgggatttgcctcttctatactccctaaggacttgagatacagacaagcattcaggttttactcaagaccttgggattaaaaaaacaaaacaacaacagaaaaaaaaccccaaaccctgaagaagctggtacttgatctgtctagctcttcccccaagccttgctctttgtcttctagcccatatctttggcaaatggcttggagacattgtcccttggtacttttgcagttcatataaatggctcattttatatggatcacccaacagcaaagtttccctctgactgaggcctgccgtcagtgtcaacctcaggcaggttgaaggacactggtgctgcacctggatgacagtgggaggacacaggagtgaaacacatggaatcatgacgtgactctccctcagctgggctggactcttcagggacttgaagtaaatgcagctggtgaactgtacaccttgactgtggcccgaaacagagctgaagtaactccgaggaaatgaaggttttgactgag

SEQ ID NO: 3285 - DNA, 602 bp, Rattus norvegicus
  Genbank Accession No. NM_016992
gctgcacgcagtgcccacctatgctcgccatgatgctcaacactacgctctctgcttgcttcctgagcctgctggccctcacctctgcctgctacttccagaactgcccaagaggaggcaagagggccacatccgacatggagctgagacagtgtctcccctgcggccctggcggcaaagggcgctgcttcgggccgagcatctgctgcgcggacgagctgggctgcttcctgggcaccgccgaggcgctgcgctgccaggaggagaactacctgccctcgccctgccagtctggccagaagccttgcggaagcggaggccgctgcgctgccgcgggcatctgctgcagcgatgagagctgcgtggccgagcccgagtgtcgagagggttttttccgcctcacccgcgctcgggagcagagcaacgccacgcagctggacgggccagcccgggagctgctgcttaggctggtacagctggctgggacacaagagtccgtggattctgccaagccccgggtctactgagccatcgccccccacgcctcccccctacagcatggaaaataaacttttaaaaaatgcaaaaaaaaaaaaaaaaaa

SEQ ID NO: 3286 - DNA, 1179 bp, Rattus norvegicus
  Genbank Accession No. NM_016993
cctcatgaaataaaaagctgaaaggaatttgaataaaaatttcctgcatctcatgccaagggggaaacaccagaatcaagtgttcgtcataactaaagacaccccttcatccaagaatgcaaagcacatccaataaaagcgctggatataacttcttttttctctctttcggccgtggggcgggagccgggacgcgaagtgctattggtacctgcagcttctttccccggaaggatggcgcaagccgggagaacagggtatgataaccgggagatcgtgatgaagtacatccattataagctgtcacagaggggctacgagtgggatactggagatgaagactccgcgcccctgagggctgcccccacccctggcatcttctccttccagcctgagagcaaccgaacgcccgctgtgcaccgagacacggctgccaggacgtcgcctctacggccccttgtcgccaacgctgggcctgcgctcagccctgtgccacctgtggtccacctgaccctccgccgggctggggatgacttctctcgtcgctaccgtcgcgactttgcagagatgtccagtcagctgcacctgacgcccttcaccgcgaggggacgctttgccacggtggtggaggaactcttcagggatggggtgaactgggggaggattgtggccttctttgagttcggtggggtcatgtgtgtggggagcgtcaacagggagatgtcacccctggtggacaacatcgctctgtggatgactgagtacctgaaccggcatctgcacacctggatccaggataacggaggctgggatgcctttgtggaactatatggccccagcatgcgacctctgtttgatttctcctggctgtctctgaagacgctgctcagcctggccctggtgggggcctgcatcactctgggtgcatacctgggccacaagtgaggtcagcagacctgccccaaacaaatatgaaaaggttcactaaagcagtagaaattaatatgcattatcaaggatggaccatgaaacaaagttgtgatttttttttaaagcagaacacacacacacacacacacacacacacacacacacacacacacacacacacattcaggcaaatggtcaaatcagctatttactgccaaagggaaatattatttattttttacattattt

SEQ ID NO: 3287 - DNA, 5066 bp, Rattus norvegicus
  Genbank Accession No. NM_016994
ctaccccttacccctcactccttccacctttgtcctttaccatgggacccacgtcagggtcccagctactagtgctactgctgctgttggccagctccctgctagctctggggagccccatgtactccatcattactcccaatgtcctgcggctggagagtgaagagactttcatactagaggcccatgatgctcagggtgacgtcccagtcactgtcactgtgcaagacttcctaaagaagcaagtgctgaccagtgagaagacagtgttgacaggagccactggacatctgaacagggtcttcatcaagattccagccagtaaggaattcaatgcagataaggggcacaagtacgtgacagtggtggcaaacttcggggcaacagtggtggagaaagcggtgctagtaagctttcagagtggttacctcttcatccagacagacaagaccatctacaccccaggctccactgttttctatcggatcttcactgtggacaacaacctattgcctgtgggcaagacagtcgtcatcgtcattgagaccccggacggcgttcccatcaagagagacattctatcttcccacaaccaatatggcatcttgcctttgtcttggaacattccagaactggtcaacatggggcagtggaagatccgagccttctatgaacatgcaccaaagcagaccttctctgcagagtttgaggtgaaggaatacgtgctgcccagtttcgaagtcctggtggagcctacagagaaattttattacatccatggaccaaagggcctggaagtttccatcacagccagattcctgtatgggaagaacgtggacgggacagctttcgtgatctttggggtccaggatgaggataagaagatttctctggccctgtccctcacccgcgtgctgatcgaggatggttcaggggaggcagtgctcagccgaaaagtgctgatggacggggtacggccctccagcccagaagccctagtggggaagtccctgtacgtctctgtcactgttatcctgcactcaggtagcgacatggtagaggcagagcgcagtgggatcccaattgtcacttccccgtaccagatccacttcaccaagacacccaaattcttcaagccagccatgcctttcgacctcatggtgtttgtgaccaaccctgatggctctccagcccgaagagtgccagtagtcactcagggatccgacgcgcaggctctcacccaggatgacggtgtggccaagctgagcgtcaacacacccaacaaccgccaacccctgactatcacggtaagcaccaagaaggagggtatcccggacgcgcggcaggccaccaggacgatgcaggcccagccctacagcactatgcacaattccaacaactacctgcacttgtcagtgtctcgggtggagctcaagcctggggacaacctcaatgtcaacttccacctgcgcacggacgctggccaagaggccaagatccgatactacacctatctggttatgaacaaggggaagttactgaaggcaggccgtcaggttcgggagcctggccaggacctggtggtcttgtcactgcccatcactccagaatttataccttccttccgcctggtggcttactacaccctgattggagctaatggccaaagggaggtggtggccgactcagtgtgggtggatgtgaaggactcctgtgtaggcacgctggtggtgaaaggtgacccaagagataaccgacagcccgcgcctgggcatcaaacgacactaaggatcgaggggaaccagggggcccgagtggggctagtggctgtggacaagggggtgtttgtgctgaacaagaagaacaaactcacacagagcaagatctgggatgtagtagagaaggcagacattggctgcaccccaggcagtgggaagaactatgcgggtgtcttcatggatgctggcctgaccttcaagacaaaccaaggcctgcagactgatcagagagaagatcctgagtgcgccaagccagctgcccgccgccgtcgctcagtgcagttgatggaaaggaggatggacaaagctggtcagtacaccgacaagggtctgcggaagtgttgtgaggatggcatgcgtgatatccctatgccgtacagctgccagcgccgggctcgcctcatcacccagggcgagagctgcctgaaggccttcatggactgctgcaactatatcaccaagcttcgtgagcagcacagaagagaccatgtgctgggcctggccaggagtgatgtggatgaagacataatcccagaagaagatattatctctagaagccacttcccagagagctggttgtggaccatagaagagttgaaagaaccagagaaaaatggaatctctacgaaggtcatgaacatctttctcaaagattccatcaccacctgggagattctggcagtgagcttgtccgacaagaaagggatttgtgtggcagacccctatgagatcacagtgatgcaggacttcttcattgacctgcgactgccctactctgtggtgcgcaatgaacaggtggagatcagagctgtgctcttcaattaccgtgaacaggagaaacttaaggtaagggtggaactgttgcataacccagccttctgcagcatggccactgccaagaagcggtactaccagaccatcgaaatccctcccaagtcctctgtggctgtgccttatgtcattgtccccttgaagatcggcctccaggaggtggaggtcaaggccgccgtcttcaaccacttcatcagtgatggtgtcaagaagatactgaaggtcgtgccagaaggaatgagagtcaacaaaactgtggctgtccgtacactggatccagaacacctcaatcaagggggagtgcagagggaggatgtgaatgcagcagacctcagtgaccaagtgccagacacagattctgagaccagaattctcctgcaagggaccccggtggctcagatggccgaggacgctgtggacggggagcggctgaaacacctgatcgtgaccccctctggctgtggggagcagaacatgattggcatgacacccacggtcattgcagtacactatctggatcagaccgaacagtgggagaaattcggcctagagaagaggcaagaagctctggagctcatcaagaaagggtacacccagcagctggctttcaaacagcccatctctgcctatgctgccttcaacaaccggcctcccagcacctggctgacagctatgtggtcaaggtctttctctctggctgccaacctcatcgccatcgactctcaggtcctgtgtggggctgtcaaatggctgattctggagaaacagaagccagatggtgtctttcaggaggacggaccagtgattcaccaagaaatgattggtggcttccggaacaccaaggaggcagatgtgtcgcttacagcctttgtcctcatcgcactgcaggaagccagagatatctgtgaggggcaggtcaacagccttcccgggagcatcaacaaggcaggggagtatcttgaagccagttacctgaacctgcagagaccatacacagtagccattgctgggtatgccctggccctgatgaacaaactggaggaaccttacctcaccaagtttctgaacacagccaaagatcggaaccgctgggaggagcctggccagcagctctacaatgtggaggccacctcctacgccctcctggccctgctgctgctgaaagactttgactctgtgcctcctgtggtgcgctggctcaacgacgaaagatactacggaggtggctatggctccacgcaggctaccttcatggtattccaagccttggctcaataccgggcagatgtccctgaccacaaggacttgaacatggatgtgtccctccacctccccagccgcagctccccaactgtgtttcgcctgctatgggaaagtggcagtctcctgagatcagaagagaccaagcagaatgagggcttttctctgacagccaaaggaaaaggccaaggcacactgtcggtggtgacagtgtatcacgccaaagtcaaaggcaaaaccacctgcaagaagtttgacctcagggtcaccataaaaccagcccctgagacagccaagaagccccaggatgccaagagttcgatgatccttgacatctgcaccaggtacttgggagacgtggatgctactatgtccatcctggacatctccatgatgactggctttattccagacacaaacgacctggaactgctgagctctggagtagacagatacatttccaagtatgagatggacaaagccttctccaacaagaacaccctcatcatctacctagaaaagatctcacactccgaagaagactgcctgtccttcaaagtccaccagttctttaacgtgggacttatccagccggggtcggtcaaggtctactcctactacaatctagaggagtcatgcacccggttctatcatccggagaaggacgatggaatgctgagcaagctgtgccacaatgaaatgtgccgctgtgccgaggagaactgcttcatgcatcagtcacaggatcaggtcagcctgaatgaacgactagacaaggcttgtgagcctggagtggactacgtgtacaagaccaagctaacgacgatagagctgtcggatgattttgatgagtacatcatgaccatcgagcaggtcatcaagtcaggctcagatgaggtgcaggcaggtcaggaacgaaggttcatcagccacgtcaagtgcagaaacgccctaaagctgcagaaagggaagcagtacctcatgtggggcctctcctccgacctctggggagaaaagcccaataccagctacatcattgggaaggacacgtgggtggagcactggcccgaggcagaggaacgtcaggatcagaagaaccagaaacagtgcgaagacctcggggcattcacagaaacaatggtggttttcggctgccccaactgaccaccacctccaataaagcttcagttgtatttt

SEQ ID NO: 3288 - DNA, 1091 bp, Rattus norvegicus
  Genbank Accession No. NM_016995
attcgcatttctagaaactgggaaatttcttaagattttaattctggcagctctttaattgtctctttgtggttgcaaatccactggatacactgtcttatttctgctattcttctctattacagggtagactttctttttcccatctgttacaggggaaatataattccttagaaggaagttgttttgatctgacgtctttagaggatgcttttgactgatatcagagtttaagtccatcgtgggtcaagtaactggtcaccaaatgctttgtttggttgtgtgctgtctgatatggttgatttctgccttagatgggagctgttcagaaccccctccggtgaacaatagtgtgtttgttggaaaggaaactgaagaacagattctgggaatttacctttgtatcaaaggctaccacttggtgggaaagaagtctttggtctttgatccctcgaaggaatggaattcgaccctccctgagtgcctcctgggccactgtcctgaccctgtactggaaaatggcaagatcaattcttctgggcctgtgaatataagtggcaaaatcatgtttgagtgtaatgatggttacatcctcaagggaagcaattggagccagtgcctagaggaccacacctgggcacctcccttgcccatctgccgaagtagagactgtgaacctcctgagactcctgtccatggctattttgaaggagaaactttcacttcaggatctgtcgttacttattactgtgaagatgggtaccacctagtgggcacacagaaggtgcagtgcagtgatggagagtggagcccgtcctatcctacctgtgagtccatccaggaaccccccaaatcagctgaacagagtgcacttgagaaagctattcttgcctttcaggagagtaaggacctttgcaatgctacagagaactttgtgagacagctaagggaaggtggaataacaatggaagaacttaaatgttctctggagatgaagaaaactaagctgaagtcggatattttactgaactaccatagctaagcagaatggttacagacagacacctatgaataaattgcttctaaaggtg

SEQ ID NO: 3289 - DNA, 1396 bp, Rattus norvegicus
  Genbank Accession No. NM_017000
tgggccaatacaatcagggctcttctcaccgccatggctccagaagttgggggcggatcgtagtgtcaagcgctgattggctgagcagagaggacatcattcaactatgccatgaaggaggctgctgtggaggctctgaagaagaaaggatgggaggtggtcgaatctgacctctatgctatgaactttaaccccctcatttccagaaacgacatcacaggggagccgaaggactcggagaactttcagtaccctgttgagtcatctctggcgtataaggaaggccgcctgagcccggatattgtagctgaacagaaaaagctggaagctgcagacctagtgatatttcagttcccattgtattggtttggggtgcccgccattctgaaaggctggtttgagagagtgcttgtagcaggattcgcctacacgtatgccaccatgtatgaccaaggtcctttccagaataagaagaccttgctttccatcaccaccgggggcagcggctccatgtactctctgcagggtgtccacggggacatgaacgtcattctctggccaattcagagtggcattctgcgcttctgtggcttccaggtcttagaacctcaactggtgtacagcattggccacaccccacccgatgcccgcgtgcaggtcctggaagggtggaagaagcgtctggagaccgtctgggaggagtcaccactctactttgctccaagcagcttgtttgacctaaacttccaggcaggattcttactgaaaaaagaggttcaagaggagcagaaaaagaacaagtttggcctttctgtgggccatcatttgggcaagtccattccagccgacaaccagatcaaagctagaaaataaggttttccataccatgtagttagacccaggtttctttttccccagtttgcctggcttgctttcagttttcgcctttgttccacaaggataggaaaaggaggaggctcgcctcatgcgtttttggatagttctgccacggctgtgacagcaaaatgaacgaggtcagattaggggcctcaggtggcctgggatatgaatcagggagaggtgtagccgcgagcggggaaaatactcttctaggtcttttgtacactataagcttttttcttcgggctagccttggctaaatggcatccaatcctccacccacttgttgctattagttacctctctgtggtttagggcaggagggaattgctcaaacaatggctgagggactaacttgtttagcagttagctaaagcctgtttatgatccatcctggtttcaattactgtgcagtgactgacaagcctcgggggattgctctccagctcttctctgccttgtacatagcacacccaggtcctgggaaatgaataca

SEQ ID NO: 3290 - DNA, 1589 bp, Rattus norvegicus
  Genbank Accession No. NM_017005
ctttccatccacgtacagcagcaccatgaaccgcgcattctgtctcctcgctcgctcgcgtcgcttcccgcgggtcccctccgccggtgctgtattgtcaggggaagcggccaccctcccacggtgtgctccgaacgtcgtgcgaatggcaagccaaaattccttccgtatagaatacgacacctttggtgaactgaaggtcccaaccgataagtattatggtgctcagactgtaagatctacgatgaactttaagattggaggtgcgacggagagaatgccaatcccagtcattaaagcatttggcatcttgaagcgagctgctgctgaagtgaaccaggagtatggtctcgatcccaagattgctagtgcaataatgaaggccgcagatgaggtagctgaaggtaaattaaacgatcactttcctctggtggtatggcagactgggtcaggaacccagacgaacatgaatgtaaatgaagtcattagcaacagggcaatcgaaatgctaggaggtgaacttggcagcaagaagcccgtgcaccccaatgatcacgttaacaaaagccagagctcgaatgacaccttccccacagcaatgcacattgctgctgcactggaagttcaccaggtcctgttgccaggattacagaagctgcacgatgccctcagtgcaaaatccaaagagttcgcgcaggtcataaaaattgggcggactcatacgcaggacgctgtccctcttactcttggacaggagttcagtggttatgttcagcaagtccagtatgcgatggagaggataaaagctgccatgcccagaatctacgagctcgctgctggcggcactgccgtcggcacgggactaaacaccaggatcggcttcgcagaaaaggtggctgcaaaagtcgcagcactcacaggtttgccttttgtcactgccccgaataagtttgaagctctggccgctcatgatgctctggtggagcttagtggagccatgaacactacggcctgcagtctgatgaagattgccaatgacattcgcttcctcggttctggtcctcggtccggtttgggggagctgatcttgcctgaaaatgagccagggagcagcataatgccaggaaaggtgaaccctactcagtgtgaggcgatgaccatggttgcagcccaagtcatggggaatcatgtcgctgttactgttggaggcagcaatggacatttcgaactgaatgtttttaaaccgatgatgattaagaatgtgttgcactcagccaggctactgggagatgcttcagtgtccttcacagagaactgtgtggtagggatccaggccaacacagagaggatcaacaagctaatgaacgagtctttaatgttggttacagctcttaatccgcatatagggtatgacaaagcagcgaagattgccaagactgcacacaagaacggatcaaccttaaagaaaacggctattgaacttggctatctcacagcagagcagtttgatgagtgggtgaaacccaaggacatgctgggtccaaagtgacttaaataaatttatattaaaataaacatgtatgaaattt

SEQ ID NO: 3291 - DNA, 1233 bp, Rattus norvegicus
  Genbank Accession No. NM_017008
ggtcagtgccggcctcgtctcatagacaagatggtgaaggtcggtgtcaacggatttggccgtattggccgcctggtcaccagggctgccttctcttgtgacaaagtggacattgttgccatcaacgaccccttcattgacctcaactacatggtctacatgttccagtatgattctacccacggcaagttcaatggcacagtcaaggctgagaatgggaagctggtcatcaatgggaaacccatcaccatcttccaggagcgcgatcccgctaacatcaaatggggtgatgctggtgctgagtatgtcgtggagtctactggcgtcttcaccaccatggagaaggctggggctcacctgaagggtggtgccaaaagggtcatcatctccgccccttccgctgatgcccccatgtttgtgatgggtgtgaaccacgagaaatatgacaactccctcaagattgtcagcaatgcatcctgcaccaccaactgcttagcccccctggccaaggtcatccatgacaactttggcatcgtggaagggctcatgaccacagtccatgccatcactgccactcagaagactgtggatggcccctctggaaagctgtggcgtgatggccgtggggcagcccagaacatcatccctgcatccactggtgctgccaaggctgtgggcaaggtcatcccagagctgaacgggaagctcactggcatggccttccgtgttcctacccccaatgtatccgttgtggatctgacatgccgcctggagaaacctgccaagtatgatgacatcaagaaggtggtgaagcaggcggccgagggcccactaaagggcatcctgggctacactgaggaccaggttgtctcctgtgacttcaacagcaactcccattcctccacctttgatgctggggctggcattgctctcaatgacaactttgtgaagctcatttcctggtatgacaatgaatatggctacagcaacagggtggtggacctcatggcctacatggcctccaaggagtaagaaacccctggaccacccagcccagcaaggatactgagagcaagagagaggccctcagttgcctgagagtccccatcccaactcagcccccaacactgagcactctccctcacaattccatcccagaccccataacaacaggaggggcctggggagccctcccttctctcgaataccatcaataaagttcgctgcaccctc

SEQ ID NO: 3292 - DNA, 831 bp, Rattus norvegicus
  Genbank Accession No. NM_017013
agttgggagctgagtggagaagaagccacgattctcgctagacagtgaagcacagttgctgctatgtctgggaagccagtgcttcactacttcaatgcccggggcagaatggagtgcatccggtggctcctcgctgcagcaggagtggagtttgatgagaagtttatacaaagtccagaagacttggaaaagctaaagaaagacgggaatttgatgtttgaccaagtgcccatggtggagattgacgggatgaagctggcacagaccagagccattctcaactacatcgccaccaaatatgacctctatgggaaggacatgaaggagagagccctgattgacatgtacaccgaaggcattttagatctgactgaaatgattatgcaattggtaatatgtcccccagaccaaaaagaagccaagaccgccttggcaaaagacaggaccaaaaaccggtacttgcctgcctttgaaaaggtgttgaagagccatggccaagactaccttgtaggtaacaagctgacccgggtagacatccacctgctggaacttctcctctatgttgaagagtttgatgccagccttctgacctctttccctctgctgaaggccttcaagagcagaatcagcagcctccccaatgtgaagaagttcctgcagcctggcagtcagagaaagcttcccatggatgcaaaacaaatcgaagaagcaaggaagattttcaagttttagcggagctgcactgtccaatttctttatgttttgcaaaaaatgagaagcaattgttgatcctaggtatttttgaaataataaacacgaaaaaatactcta

SEQ ID NO: 3293 - DNA, 1055 bp, Rattus norvegicus
  Genbank Accession No. NM_017014
gctgaagcaaattgagaagaccacagcgccagaaccatgcctatgatactgggatactggaacgtccgcgggctgacacacccgatccgcctgctcctggaatacacagactcaagctatgaggagaagagatacgccatgggcgacgctcccgactatgacagaagccagtggctgaatgagaagttcaaactgggcctggacttccccaatctgccctacttaattgatggatcgcgcaagattacccagagcaatgccataatgcgctaccttgcccgcaagcaccacctgtgtggagagacagaggaggagcggattcgtgcagacattgtggagaaccaggtcatggacaaccgcatgcagctcatcatgctttgttacaaccccgactttgagaagcagaagccagagttcttgaagaccatccctgagaagatgaagctctactctgagttcctgggcaagcgaccatggtttgcaggggacaaggtcacctatgtggatttccttgcttatgacattcttgaccagtaccacatttttgagcccaagtgcctggacgccttcccaaacctgaaggacttcctggcccgctttgagggcctgaagaagatctctgcctacatgaagagcagccgctacctctcaacacctatattttcgaagttggcccaatggagtaacaagtaggcccttgctacactggcactcacagggaggacctgtccacattggatcctgcaggcaccctggccttctgcactgtggttctctctccttcctgctcccttctccagctttgtcagccccatctcctcaacctcaccccagtcatgcccacatagtcttcattctccccactttctttcatagtggtccccttctttattgacaccttaacacaacctcacagtccttttctgtgatttgaggtctgccctgaactcagtctccctagacttaccccaaatgtaacactgtctcagtgccagcctgttcctggtgggggagctgccccaggcctgtctcatctttaataaagcctgaaacac

SEQ ID NO: 3294 - DNA, 2472 bp, Rattus norvegicus
  Genbank Accession No. NM_017015
ccccgcatgtccccaagacggagtgtgtgttggttcgtactgggccagctgctgtgcagctgcgccgtggcgctgcagggcgggatgctgttcccgaaggagaccccttcgcgggaactcaaggtgctggacggcctgtggagcttccgtgccgattactcgaacaatcggttgcagggcttcgagaagcagtggtaccggcagccgctacgggagtcgggcccaaccttggacatgccggtcccttccagcttcaatgacatcacccaagaagcagagcttcggaacttcattggctgggtgtggtatgaacgggaagcagtgcttccacagcgatggacccaggacaccgacaggagagtggtgttgagaatcaacagcgcccattactatgcagttgtgtgggtgaatgggattcatgtggtggaacatgagggaggtcacctcccctttgaggctgacatcaccaagctggtccagagtgggcccctgaccaccttccgggtcaccatcgccatcaacaacacactgaccccttatacccttccaccggggaccattgtctacaagactgatccttccatgtatcccaagggttacttcgtccaggacataagcttcgacttcttcaactatgcggggctgcaccggtctgtggtcctgtacaccacccctaccacctatatcgatgatatcactgtgaccactgacgtggaccgggacgttgggctggtgaactactggatttctgtccagggcagtgaccatttccagctagaagtgcgtcttctggatgaggatggcaaaattgtggcccgtggaacagggaatgagggtcaacttaaggtgccgcgtgcccacctctggtggccttacctgatgcatgagcatccagcctacctgtactccttggaggtgacgatgacaacacctgagtctgtgtctgacttctataccctccctgtcgggattcgaacagtggctgtcacaaagagcaagttcctcataaatgggaagcctttctacttccaaggcgtcaacaagcatgaggattcagatatccgagggagaggcttcgactggcctctgctgataaaggatttcaacctcctccgttggctcggggcaaattcctttcgtaccagccactatccctactcggaggaggtacttcagctctgtgaccgatatggaattgtggtcatcgatgagtgtcccggtgtgggcatcgtgctgccccagagttttggcaacgtgtctcttcggcaccacctagaggtgatggacgagctggtgcgcagggacaaaaatcaccctgcggtcgtgatgtggtctgtggccaatgagcctgtctcttctctgaaacctgccggatattacttcaagacgctgatcgcccacaccaaagccctggaccccacccgtcctgtgacctttgtgagcaataccagatatgacgcagacatgggggccccgtacgtggacgtgatttgtgtgaacagttacttatcctggtatcatgactacgggcatctggaggtgattcagctgcagctgactagccagtttgagaactggtataagatgtaccagaagccaattatccagagcgagtatggagcagacgccgtctcggggcttcatgaggatccacctcgcatgttcagtgaggagtaccagacagctctcctggagaattatcatttgatcctggatgagaaacgaaaagaatatgtcatcggagagctcatctggaattttgctgacttcatgacgaaccagtcaccactgagagtaacaggaaacaagaaggggatcttcactcgacagagaaaccccaagatggcagccttcattttgcgagagagatactggaggattgccaacgaaaccagaggttacggttcagtgccgaggacccagtgtatgggaagcagaccgttcacattctaaagctacgactacctcaccgcagacagggcctgatgaagtgaaaggtattctctcagcagaagagtttttcctctggagtttgtgaaccaacacaaggaggactttagaagtgacatggaagttttccttgtgtggggataatgacttgcagtgccttaggctcagtaatgtgtcctgctgagaagtgtcccaggtcatttctgtcaggttttttttggccttggctttgtgtactcttgaaaacctactgtgtgaatactcacactaagagctcctggttaccggctaagggacggctcacaatttaagaatactgactgttctaccaggggttccagattcgattcctagcacccacgtggtcgttaactatgagctgttgccccatttctcaggtgatgtacgaacatacatgtggggggaggggaatagtcatacgtgtaaaatgaaaataaatctaaataaaactgttttctttcattataaaaaaaaaaaaaaaaaaccaactaatagaaacgt

SEQ ID NO: 3295 - DNA, 2485 bp, Rattus norvegicus
  Genbank Accession No. NM_017017
gtttagtcctagatctttccagttaatcacacaacaaacttagctcatcgcaataaaagcagctcagaaccgaccggcttgcaacaggattctttcagcccggcatctcctgcagagggatcagcctgctcgaactgcaagcatgatgtgggggaccaaacttctgccggtcctgttgctgcagcatgtcctgctgcacctcctcctgcttcctgtcaccatcccctatgcagaaggacagaagaagagaagaaatactcttcatgaattcaaaaagtcagcaaaaactactcttaccaaggaagacccattagtgaagattaaaaccaaaaaagtgaactctgcagatgagtgtgccaacaggtgcatcagaaacaagggctttccattcacttgcaaggcctttgtttttgataagtcgagaaaacgatgctactggtatcctttcaatagtatgtcaagtggagtgaaaaaagggtttggccatgaatttgacctctatgaaaacaaagactatattagaaattgcatcattggtaaaggaggcagctataaggggacagtatccatcactaagagtggcatcaagtgccagccttggaattccatgatcccccatgaacacagctttttgccttcgagctatcgcggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaacggtgaaagctacagaggtcccatggatcacacagaatcaggcaagacatgtcagcgctgggatcagcagacaccacaccggcacaaattcttgccggaaagatatcccgacaagggctttgatgataattattgccgcaatcccgatggcaagccgaggccatggtgctacactcttgaccctgacaccccttgggagtattgtgcaattaaaatgtgcgctcacagtgctgtgaatgagactgatgttcccatggaaacaactgaatgtataaaaggccaaggagaaggttacaggggaaccaccaataccatttggaatggaattccgtgtcagcgttgggattcgcagtacccccacaagcatgacatcactcccgagaacttcaaatgcaaggaccttagagaaaattattgccgcaatccggatggggctgaatcaccatggtgttttaccactgatccaaacatccgagttggttactgctctcaaattcccaaatgtgacgtgtcaagtggacaagattgttatcgtggcaatgggaaaaactacatgggcaacttatccaaaacaaggtctggactcacatgttccatgtgggacaagaatatggaggatttacaccgtcatatcttctgggagccagacgctagcaagttgactaagaattactgccggaaccccgatgacgacgcccatggaccttggtgctacacagggaatcctctcgttccttgggattattgccctatttcccgttgtgaaggagatactacacctacaattgtcaatttggaccatcctgtaatatcctgtgccaaaacaaaacaactgcgagttgtaaatggcattccaacacaaacaacagtagggtggatggttagtttgaaatacaggaataaacacatctgtgggggatcattgataaaggaaagttgggttcttactgcaaggcaatgttttccagctagaaacaaagacttgaaagactatgaagcttggcttggaatccatgatgtccatgagagaggcgaggagaaacgcaaacagatcttaaacatttcccagctagtctatggacctgaaggctcagatttggttttactgaagcttgctcgccctgcaatcctggataactttgtcagtacaattgatttacctagttatggctgtacaatccctgaaaagactacttgcagtatttacggctggggctacactggattgatcaacgcagatggtttattacgagtagctcatctgtatattatggggaatgagaaatgcagtcagcaccatcaaggcaaggtgactttgaatgagtctgaattatgtgctggggctgaaaagattggatcaggaccttgtgagggagattatggtggcccactcatttgtgaacaacacaaaatgagaatggttcttggtgtcattgttcctggtcgtggatgtgccatcccaaatcgtcctggtatttttgttcgagtagcatattatgcaaaatggatacacaaagtaattttgacatacaagttgtaatagccatagaagaggccagtgtatttgaagcatccatggatacaggaagatttccaagacttcaggattaaaatgtcacctaaaacaatcctaaaacaactacttgagtgttgtgagtgttcagatactcattaatatatgtggcgttttctgttg

SEQ ID NO: 3296 - DNA, 4614 bp, Rattus norvegicus
  Genbank Accession No. NM_017020
aattccgtgggcggcgggcggcggagaagctccgagcggggccgggcggcggcagattggagtcgcgacacagccgccgtccgcttcgggctccacgtagaaggaaccatgctggccgtcggctgcaccctgctggtcgccctgctggccgcgcccgcagtcgcgctggtccttgggagctgccgcgcgctggaggtggcaaatggtacggtgacgagcctgccaggggccactgttaccctgatctgccctgggaaggaagcagcaggcaatgctaccattcactgggtgtactcaggctcacagagcagagaatggactaccacgggaaacacactggttctgagggccgtgcaggtcaatgacactgggcactatttgtgcttcctggatgatcatctggttgggactgtgcccttgctggtggatgttcccccagaggagcccaagctctcctgcttccggaagaacccccttgtaaatgccttttgtgagtggcatccaagcagcactccctctccaaccacgaaggctgtgatgtttgcaaagaaaatcaacaccaccaatgggaagagtgacttccaggtgccttgccagtattctcagcagctgaaaagcttctcctgcgaggtggagatcctggagggtgacaaagtgtaccacatagtgtcactgtgcgttgcaaacagtgtcggaagcaggtccagccacaatgtagtatttcagagtttaaaaatggtgcagccggatccacctgccaaccttgtggtatcagccatacctggaagcctcgttggctcaaagtcagttggcaagaccctgagtcctgggacccaagttactacttgttgcaattcgagcttcgataccgacctgtatggtcaaagaacgttcacggtgtggccgctccaggtggcccagcatcaatgtgtcatccatgatgccttgcgaggagtaaagcatgtggtgcaggtccgagggaaggaggagtttgacattggccagtggagcaaatggtccccggaggtcacaggcactccttggctagcagagcccaggaccactccggcagggatcccggggaaccccacacaggtctctgttgaagactatgacaaccacgaggatcagtacggaagttctacagaagcaacgagtgtcctcgccccagtgcaaggatcctcgcctatacccctgcccacattcctggtagctggaggaagcctggcgtttggattgcttctctgtgtcttcatcatcttgagactcaagaagaaatggaagtcacaggctgagaaggaaagcaagacgacttctcccccaccgtatcccttgggaccgctgaagccgaccttcctcctggttcctctcctcaccccatcagggtcccataacagctctgggactgacaacaccggaagccacagctgcctgggtgtcagggacccacagtgccctaatgacaacagcaacagagactacttattccccagataattgtctggagggtacctggcagctggcacgcaagtttctcactgccggccccgtccaccagggctgggggcggggtgggcggggctgcagcttcacgatcccacaggagccttgcaaaggttctgagtgggagaagactggtgtgctgcacgggcttcgaaagaaggggctgtgaggagcacgagccatcatgaagagagcctgtgatgactctgaatagagacgcccgcccatcagctacacacctgatggtggctctcaagctatcctctcaggaagcctctgggaggggcgacaaaggctgccccagttgcctagctctggctcactggcccaagctgccttttagcttgaactcctaaaatccaagcaccttggccattctcttcctaggccaccgaggccgcggggaagcttggttctactttccttctcaacacctggagaagcagctgcccggtggtggtgactaacgtatcagggcctgatggcttatgaggaatgacaattaattcctcataagcagtttttaaatgtgaatagtaatcctaggcactgctgacttgaggttttattttcttcgatctcaggacttcaggagagaagcagagcagaagtagagagaggatgggtgtccattgtccgtgtggtacttgagggggatacagcctggaaaacacgtttcctgtccccctactctcccagaagaggtagggggtggcgcctcttccagggcagagagtataactactttacctggccttgcccatactggtttcaactggacttgagctactaggaaaaatgacattcatgcaaaaagaaaactttaactagcaagaatgcacttccactttggtttctagaggactgttgctcctcttgagacgctggaagaggccgctcactgtaccctggtgtatgagccctcaccccccaccccagggtaagtgcagtaactttagtctaaacaccgagtcaggtaaaaatcgaggaaaaaacaaccctgtttcctgtaacagaaaagcctttggtttcgttttgtattttgattttttttttgtcttaaaaagtgtaaaaatagtctgtccatactctgcttcagggaatgacctgtgaatactccccaggcgtgggcaggaagggtgtctgcttcctgctacacctcactgccacctcggccttccttgctttacattcaactgagttgcctcagctgctttcccctggggcgctgaaaaagccagtgatgttggtggtcaccgagaagaccacagagccacagagtaatgctgtgattgaagcgagttacgcaaccacagcaccccacatttgctgtattatagaactatgctaggagcttgccttttcacaaaataccaccaccacgagacgtggcagagctcggaagctgtcaccttgtgccatctgcttgccagctccaaggggccactgacttaagcagttattttctttgtgggctttgttcatttcagggcctgttgctgtcttagaaaaagctctgtcggttgacaaaaacatcagacaggtagtcatgtttatttattttttttccttctttgctaagtctttgggactcaagggtagtaaaaaatgctgtgaaaagggaaacattagaaacagcgatcttcggggaataggtgactgtgcccacgcactgttcttcagtccctcacgtggctctgcccgagtgctgttccaagccaggcagagcaggctggcggaagattgaaatccagatagctcgttatctctgagagctaaatagctttgatctccaagctgttattgctttcactattgtaacaggatagcctccccccccatgtcaaaaggatgcttttcccttttgactttttataagctaagtcagtgaagtctgtttcatctgagctccagcttcgttcagttcgcacaggtgtatgccctcagctgcttcgggcctcagatctgtgctagttgaatggttgtcccatccttgggtcatccttaccagagtttctgcagcccacaggtctgccttgtcaacagtaccacttaacaccagcattcagtgcccaggcagccagatgtggagggtttacccagagatgatttaaacatgaccttaaacgtgtatggtagaacgaggggaacccataccagctcaggttctaaagagatctttgattcttctggcattagtgaaatagctttaaactatttcaaggaagaagccttggccacacccacgacatttggtgacaatcctttctctccatgagccttgtctttacaccttctcacctggctgaaagctcacactgaatctttcctatgtccctggtgtcttgggagaaaggaaactggtatgggcttcactgctggaattggcttggagccagcgtgtggcgcagccctggcagggtgggccaggcttagttatggtgtgctggtttaaggaatgcctggcttgcctggttgcttgggttctgagctgcagagtttcctagcagttctttatggctgacctagttggggaagattcccacactcaactgcaggtggaggtggtgagaaagctgttttcatttggagaggcaggatcagcccaagaagctttcagtgggagagcctacagtgaggctgtacctcactgtgggaggaggcaggccagctggctcaggtcctgggactggcactggggagggtctgccaaaggtccctccagcctgtagtcctagcatagtcgggtgccagttccaggaagtttctatggcaaccttagtgctcattaaggaacattgtcagttttgtgaacatatgctcagatggagatcttgttttcagagaaaggactggtacagtgtgtaacaagctggagcagacagagagactttttggcaagagatcacatccgttaagcagaatacctcagtgctacatgtttttgtctttgagacaatgtttttaaggtttttatgctctgttacctgtaagctgatacctaaaactttctgcaaagtcagggtttttcaatgccttttttttttttttgccattgtttgctttaaagtgaagattgtaactgtttgaaataaataatttctaaaactg

SEQ ID NO: 3297 - DNA, 3692 bp, Rattus norvegicus
  Genbank Accession No. NM_017021
gtgagactctccatggccctgggaagatgctttccagaaggttgtaccgtggagggagcagcagtgaaacaggtctcctggttcctgatctacagctgtgtctgctcctgtgtctgctggggagtctccgtcccagcgcaggaaggagggcggaaggctgggacattcacttgcttcagcaacagtgttttcaggattgactgtcactggtcagctccagagcctggctccagggcctggctcctctttaccagtaaccaggggactgacatcaagcacaagtgcaccttctgggacagtaggtgtaccctggtgctgcccaaggaggaggcgttcttgccctttgacaacttcaccatcacactccaccgctgtgtcatgggacaggagcaggtcagcctggtggactcacagtatctgccgaggagacacatcaagctggatccgccctctgatctgcagagcaatgtcagctctgggcgttgcgtcctgacctggggtatcagttttggtctggagcccttgatcacatccctcagctatgagctggccttcaagaggcaggaagaggcctgggagcaggcccggctcaaggaccgtatcgttggagtgacctggctcgtacttgaagccatcgaactgaatcccgataccatctacgaggccagactgcgtgtccagatggcgttagagagttatgatgacaagacggagggggaatattataagagccattggagcgagtggagccagtccgtgtcctttccttctccccgcaggaagactcaggggctcctgatcccacgctggcaggggtcagccagcatccttgttgctgtgcccatctttcttctgctgactggccttatccactttctcttcaggctgtctcccaaggtgaagagaatcttttaccagaatgttccctctcccgaggcattcttccatcctctctacagtgtgtaccatggggacttccagacctggataggggcccgcagagccggaccacaagcaagacaggatggtgccagcgctccgtcgggagactcagagtccagcatctgggaggccatcgccacactcacctatagcccagcatgctctgtgcagtttcctagcctgaagtgggaggccacagcccctggcttcccaggacccccaggctcagagcttgtgctgccggcagggtgtctggagttggaaggacagccatctgcctacctgccccaggaggactgggccccactgggctctgccaggccgccccctctagactcagacagtggcagcagtgactactgcatgctggactgccgtgaggagtatgacctctcagtcttcccagaacacaccctgagtcccgagttcacactggctcagcctgtggcccttgctgtgtctagcagggcctgatagctaccaagggatgtgggcattctcatccctccttattctcagatggcaccagatgcagagccagcgtatctctgctagatgcaccatgtctgtttcggggaggtgaacaaaaggccctggagctggccctgggcggtgtatagaactccggagaagaggcagctgtgcaccgatcagaggctacgtggatggaagcaacagactgagtctcaccccgctgctctgcctctctggtggagatgtctccgagttcagcatcttaacacccgccttctcttctttcctctctctggctttttcccaggccggaaaagagggtgtgacaggcagcctggtctatcctcgtgcccctaaaggctagcctgagcccagggacactgatgagacgacatcggtgaaaaagtgttctttctcagtgccttccccattaagaccggaagggacgctttcgactttgcagaccgtggatggcggggggtggagggaatggcggagctttgagcaggtggggaatgtccatctctgagcttttggggttccaagaccagctggaaggagtctcaccgaatgattcacagatgccttaccagtctgtggcattttctttcctggtgttgtgataaaacaccgtaatcaaaaatgacttacagaaggaagagtcggttttggtttagggttccagaagtgtggaagcatggcagcaggaaccggaagccgagagctcaagtctcaacctaaagctgaagcagaatggactgcaagcgctgtccccgcccactccagcaaggctccacctcctaaaggttccgcagccttgctgaacagtgcggcggaatagagagcaagtgttccagtatctgagcctgtggggaacgtttctcattcaaaccacctcactgcctgccccctaaccttccactgttcttaggaaaaaagctgacacccagggccatgagacacggttgggagtggctatttttcagcagctgtggcctatgaagaacaccgatacccctaactgcctcgtggggtagccgggagagagcgatggtgggctagaatgtggctgttattttccttggcttgcgtaacagaagaccagaaaccgggtagccaacaccgtggatttgttttctctctgctctgcggtacacgggtctggaatggagacaccaggaaggccaaggccgtgctcctggaagaagggtttgtttcaagccctcgttcacatttactttcctctgagcctcctcttccagactgagaccggatgccacccaatggcggggacagggcgtttgtgcagatttgcagctgtaaagcactggcccaacagaagtcctcttgctactcggagggtttttaaaggacaagcgtggaaactgtgttaagtgtgaggatgatttctgatcccgtaacactgtgcaagagagggccgcactactacatggaggtcatggaagagcggggaggacggcagcattgtgggctcagagctggtgttctgggactgctcacaatggtgacagtgatcaggatatttagaataagtcggcatttctcaggtagaagaaatttctagtttgtcagtaagccctcaactattttaaaatttatctttcatttaaataattacccttttcgtgaagataggcacgatataaacctgcataaatactaccctggcttctactattctcttcctgattccgaggcttcctgttatgctgtataaatcagccgatgtaaaccagcaccaaggtttgtgtgttttgtaggtcatggaatcatctgcgaaaacaaggaaagagtaaaattttacaaaaggcaatttaagatttgggaaacccgggctttttagtatactcctgtaacaccattcccatgaccatcagggcccttacaaaaagaagtaagatgtaattggtgagataattgtcagcaaatatttcaaaacattgtaattaaccctgggcagtggttactggacagtcctcgtgtcttttgtctgggtgttaatatcagttacttagaagcttgaagaggatggaaaagctcagtgtctgtagcaattcattcaaaagacaagagaactgtcccttattctctgtatctgtgcttttcatctctgtggcaattatcttagggtctgaaatgtgaataaaggccttccatattccttttatcttcaaataatcatattctcttataaatagataagtatatcaggctgttctttcatgtatgtattttaataaagatttttttccatt

SEQ ID NO: 3298 - DNA, 2069 bp, Rattus norvegicus
  Genbank Accession No. NM_017023
caatcacacaactccactcgagttagccattgaaagccaatgcaagtaaatgtcattccaaagcttaagattcattaaggtgggcctaaaagaagacagctgctgtgcagacaacgtcgaacaagcaccacttgcttgctttgcccagcatgggcgcttcggaacggagtgtgttcagagtgctgatcagggcactgacagaaaggatgttcaaacacctccgaagatggtttatcactcacatatttgggcgttcccggcaacgggcaaggctggtctctaaagaaggaagatgtaacatcgagtttggcaatgtggatgcacagtcaaggtttatattctttgtggacatctggacaactgtgctggacctgaaatggaggtacaaaatgaccgtgttcatcacagccttcttggggagttggttcctctttggtctcctgtggtatgtcgtagcgtatgttcataaggacctcccagagttctacccgcctgacaaccgcactccttgtgtggagaacattaatggcatgacttcagcctttctgttttctctagagactcaagtgaccataggttacggattcaggtttgtgacagaacagtgcgccactgccattttcctgcttatcttccagtctattcttggagtgatcatcaattccttcatgtgtggtgccattttagccaagatctctagacccaaaaaacgtgctaaaaccattacgttcagcaagaatgcggtgatcagcaagcgtggcgggaagctctgcctcctcatccgagtggccaatcttaggaagagccttctgattggcagccacatatatggcaagcttctaaagacaaccatcactcctgaaggcgagaccatcattttggatcagaccaacatcaactttgtcgtcgacgctggcaatgaaaatttgttcttcatatccccactgacgatctaccacattattgaccacaacagccctttcttccacatggcagcagaaactctttcccaacaggactttgagctggtggtctttttagatggcacagtggaatccaccagtgcaacctgccaggtccgcacgtcatacgtcccagaggaggtgctttggggctaccgtttcgttcctattgtgtccaagaccaaggaagggaaataccgagttgattttcataacttcggtaagacagtggaagtggagacccctcactgtgccatgtgcctctataatgagaaagatgccagggccaggatgaagagaggctatgacaaccctaactttgtcttgtcagaagttgatgaaacggacgacacccagatgtagcagtggcttttccacctacaaaaagcctcccaaggacctaagggttgactgtgttcagaagcatctgacgggggtctgaaagcaggatgagaacatgcgaaatctgctagcacagtcacccctgaaccccagggctatggttctacaagacacatagctctataaggctgcatacggtgcatgcatgtgaatgaaactgtggaagccaaaggggcccacttggatcctcactatgactgtgtaagctcatatcgtgttgatggaaacaaagtcattcaaggacaaaacttaggagctttagaaagcttcaggaactagccacatttcctgtttgattctatggatgagaaagatgccatttttatcttaaagtagacttctatcaatggaaaatctgccctctgcgctgggaagtgagccagccaatcagtgacaataagagactgtcatacaaagaatcagtaaagactctaaccttctcaagctctggtgtttgaagcctttgtctgagtctgggtccatgcttcagaaggggtaaggtgacatccactgactgtacctctctgaacccaaggtacagaagaacaggaagccccaatcaacttcataatcaacccagatgctgcagcccatacagaatttggcctgaatgatttcctgtggagcattaaatggaggccaagtccactctttagatattaaatgaatattcttttgcaaaggaaaaaaaaaaaaaaaaaaaaa

SEQ ID NO: 3299 - DNA, 1362 bp, Rattus norvegicus
  Genbank Accession No. NM_017024
ggcacgaggcactgggctgtaatggggctgcctggctccccttggcagtgggtgctgttgctgttggggctactgctccctcctgccacctccttctggctcctcaatgtgctcttccccccgcacaccacgcccaaggctgaactcagtaaccacacacggcctgtcatcctcgtgcctggctgcatggggaaccggctagaagccaagctggataaaccaaatgtggtaaactggctgtgctaccgaaagacagaggacttttttaccatctggctggatttcaacatgtttctacccctcggggtggactgctggattgataacaccagggttgtctacaaccgaagctctgggcacatgtccaatgcccctggtgtacagatccgtgtccctggctttggcaagacctactctgttgaatacttggatgacaacaagctagcaggctacctgaacacactggtgcagaatctggttaacaatgggtatgtgcgggatgagacagtgcgggccgcaccctatgactggcgtctggcaccccgccagcaggatgaatactaccagaagctggcaggactggtagaggagatgtatgctgcttacgggaagcctgttttccttattggacacagccttggctgcctacatgtgctccatttcttactgcgtcagccacagtcctggaaggaccacttcattgatggcttcatctctctcggggccccatggggcggttccatcaagcccatgcggatcctggcctcaggtgacaaccagggcatcccgatcatgtccaacataaagctgagagaagaacagcgcataaccacaacttccccctggatgtttccagctcaccacgtgtggcctgaagaccacgtgttcatttccacaccaaacttcaactacacaggccaagacttcgagcgtttttttgcagatcttcattttgaagaaggctggcacatgtttctacagtctcgtgacctactagcaggcctcccagcgcctggtgtagaagtatattgtctatacggtgtaggcatgcccacagcccacacctacatctatgaccacaactttccctacaaagacccggtggctgcactctatgaagatggggacgacactgtagccacacgtagcactgagctctgtggccaggtgcagggccgccagtcacagggtgtacacttgctccgcatgaatgggacagatcatctcaacatggtcttcagcaataagacactggagcatattaatgctatcctactgggtgcctacccgcatggcactcctaagtccccaaccgccagcctaggtcccccaccaacggaataaagacttactgttatgaaa

SEQ ID NO: 3300 - DNA, 1842 bp, Rattus norvegicus
  Genbank Accession No. NM_017033
cgccagagccgcagcttctctcgccccgcagcccgtcgccaccatggtgaagatcgtgacagtgaagacgcaggcatatccggatcagaagccgggcaccagcgggttgcggaagcgagtgaaggtgttccagggcaacgctaactatgcggagaatttcatccaaagcatcgtctccaccgtggagccggcgttgaggcaggaggctaccctggttgtgggcggggacggtcgcttctacatgaccgaggccatccagctcatcgtacgcatcgccgcagccaacgggattggccgcctggttattggacagaatggaatcctctccactcctgctgtatcctgcattatccgaaaaatcaaagccattggtgggatcattctgacagctagccacaatccaggagggcccaatggagattttggaattaaattcaatatttctaatgggggtcctgctccagaagcaatcactgataaaattttccaaatcagcaagacaatcgaagaatatgccatttgccctgacttgaaggtagacctcggtgttctggggaagcagcagtttgacttggaaaacaagttcaagcccttcacagtggagatcgtggactcagtcgaggcctatgccacaatgctgagaaacatctttgatttcaacgcactgaaggagctactctctggcccaaacagactgaagatccgcatcgacgccatgcacggagttgtgggaccgtacgtcaagaagatcctctgtgaagaacttggtgcccccgcaaactcagctgtgaactgtgttcccctggaggattttggaggccaccaccctgaccccaacctcacctacgctgctgacctggtggaaaccatgaagtcaggagagcatgatttcggggctgcctttgatggtgatggggataggaacatgattctgggcaagcacgggttctttgtgaacccttctgactctgtggctgtcattgcagccaacatcttcagcattccgtatttccagcagactggggtccgcggcttcgcacgcagcatgcccaccagtggtgctctggaccgggtagcaaacgccacaaagatcgcttcgtatgagaccccaactggctggaagttttttgggaatttgatggatgcaagcaagctttccctctgtggagaggagagctttgggactggttcagaccacatccgagagaaagatggactgtgggctgtcctggcctggctctccattctggccacccgcaaacagagggtggaggacattctcaaagaccactggcagaagtttggtcggaacttcttcaccaggtatgactacgaggaggtggaagccgagggggcaaacaaaatgatgaaggacctggaggccctgatgctggaccgctcctttgtggggaagcagttctcagcaaacgataaagtctacacggtggagaaagctgataacttcgaatatagtgacccagtagatggaagcatttcaaaaaatcagggcttgcggcttatttttgcagatggttctcgtatcatcttcagactgagcggcaccgggagtgctggggctaccatccggctctatattgatagctacgagaaggacgctgccaagatcaaccaggacccccaggtcatgctggcacccctgatctccattgctctgaaagtgtcccagctccaggagaggacaggccgcactgccccaactgtcatcacctagagagatggctggatgtggcacatcctccccaggaactgtccacactgcctgattgaagagcacagacagaacagtgtattcgacctggcctttagactcatcttatttta

SEQ ID NO: 3301 - DNA, 1816 bp, Rattus norvegicus
  Genbank Accession No. NM_017037
gagttacagggagctccaccagagaacatctcagggagcctggctggaagcagcagagctccgagtctggtctgctgtgagcatccgctgtcctgcggggagggctcccatccctggctctcgattgcaaagaaatccaagcggaggaagggcgtacaccattggtctggcacgctccaccgagcccgagcccaactcccagccaccatgcttctactcttgttggggatcctgttccttcacatcgcggtgctagtgttgctcttcgtctccaccatcgtcagccaatggctcgagggcaatggacacaggactgatctctggcagaactgtaccacatccgccttgggagccgtccagcactgctactcctcatctgtgagcgaatggcttcagtctgtccaggccaccatgatcctgtctgtcatcttcagcgtcctgtccctgttcctgttcttctgccagctcttcactctcaccaaaggcggccgcttttacatcactggagtcttccaaatccttgctggtctgtgtgtgatgagtgcagcggccatctacacagtgagacacagtgagtggcatgtcaacaacgactactcctatggctttgcttacatcctggcctgggtggctttcccgctggccctccttagtggcatcatctacgtgatcctgcggaaacgcgaatgaggcgcccgacgcaccatccgtctaggctctgagcgtgcatagggtacacagggagggaggaaggaaaccagaaaaccaaaccaaccaacccaaaagagctagcccccaaacccaaacgcaagccaaaccaaacagaacacagttgagtggggattgctgtcgattgaagatgtatataatatctatggtttataaaacctatttataacactttttacatacatgtacataggattgtttgctttttatgttgaccgtcagcctcgtgttgaatcttaaacgactctacatcctaacactataaccaagctcagtattttcgttttgtttcgtttttttcatctttttgttttgctcagacataaaaaaaaaaaaatccacgtggccccctttcatctgaaagcagatccctccctcccattcaacctcataggataaccaaagtgcggggacaaaccccagatggccagaggttcacactatgggtgacccagtgaatttagcaggaataatccgctgcccgaatcaatgtgtgaagccctaagcactcacagacgaaacgccctgaccagagccctctgcgaaaccaatagctggtggctgcggaacacttgaccctgaaggcggagtactggggccacatgtttaaatgagacgtcagagacaagcaatctgtgaaatggtgctatagatttaccattccttgttattactaatcatttaaaccactcactggaaactcaattaacagttttatgacctacagcagaacagagacccgatacaaacggttcgtaactgctttcgtacatagctaggctgttgttattactacaataaataaatctcaaagccttcgtcactcccacagttttctcacggtcggagcatcaggacgagcgtctagacccttgggactagcaaattccctggctttctgggtctagagtgttctgtgcctccaaggactgtctagcgatgacttgtattggccaccaactgtagatgtatatacggtgtccttctgatgctaagactccagacctttcttggttttgcttgctttttctgattttataccaactgtgtggactaagatgcattaaaataaacatcagagtaactc

SEQ ID NO: 3302 - DNA, 1804 bp, Rattus norvegicus
  Genbank Accession No. NM_017039
ctggggccgcaggaagcaccccggggagcggcggcggcgtgtgcgtgtggcccgggtgcgggcggcggcgcgggagcagcgcagagcggcagccggttcgggcgggcggcatcatggacgagaagttgttcaccaaggagctggaccagtggatcgagcagctgaacgagtgcaagcagctctccgagtcccaggtcaagagcctctgcgagaaggctaaagaaatcctgacaaaagaatctaatgttcaggaggttcgatgtccagtcactgtgtgtggagatgtgcatgggcaatttcatgacctcatggaactctttagaattggtggtaaatcaccagatacaaattacttgtttatgggagactatgtggacagaggatattactcagttgaaacagttacactgcttgtagctcttaaggttcgttaccgagagcgtatcaccatactccgagggaatcacgagagcagacagatcacacaagtttatggtttctacgatgagtgtttaaggaaatacggaaatgcaaatgtttggaaatacttcacagacctttttgactaccttcctctcactgccttggtggatgggcagatcttctgtctacatggtggtctttcaccatccatagacacactggatcacatccgagcacttgatcgcctacaagaagttcctcatgagggtccaatgtgtgacttgctgtggtcagatccagatgaccgtggtggctgggggatatctcctcggggagctggttatacctttggccaagatatttctgagacatttaatcatgccaatggcctcacgttggtgtccagagctcaccagctggtgatggagggatataactggtgccatgaccggaatgtagtaacaattttcagtgctccaaactattgctatcgttgtggtaaccaagctgcaatcatggaacttgatgacactcttaagtattctttcttgcagttcgatccagcacctcgtagaggcgagccacatgtcactcgtcgtaccccagactacttcctgtaatgaaagtttaaccttgtacagtattgccatgaacaccgtctgttgacctaatggaatcgggaagagcagcagtaactccaaagtgtcagaaatagttaacattcaaacttgtttccacacggaccaaaagatgtgccatataaaatacaaagcctcttgtcatcaacagccgtgaccactttagaatgaaccagttcattgcatgctgacgcgacattgttggtcaagaatccagtttctggcatagcgctatttgtagttacttttgctttcttgagagactgcagatctaggatgtaacattaacacctgtgagtccagttgacttccacttagctgtagcttactcagcatgactgtagatgaggatagcaaacaatcattggagcttaatgaacatttttaaatgagtaccaaggcctcccctcttgttgtgttctttcagggatactattaatttaattgtatgatttctctgcactcagtttctcccttctcaaatctcggccccgcgttgttctttgttactgtcagaaaacctggtgagttgttttgaacagaactgtctccctcctgtaagatgatgtactgcacaagtcaccgcagtgttttcataataaacttgagaactgagaaagtcaggtttgaattgtatcagtgggcacgactggtgctgtttattaaacaagataaatctattgatcaatttcagaatttgtagaattccaggtaaagaaaaataaagatcaaggccactatat

SEQ ID NO: 3303 - DNA, 4057 bp, Rattus norvegicus
  Genbank Accession No. NM_017048
aaaagagttgggagaagttgggagcggcgggggcgcgccccggggtgggcaccgggaaatcgtcgggagcgcgcgagggttccggaggatcaggggagacccggagacccccgggacacgaaatctagagctagcgggttatgcctccaccttgttgccctgaaagccgaagcgacagtgagaagggctaagatttggccatgagcagcgcccccaggcgccccgcctcgggcgcagattctttgcacacgccagagccagagagcctgagccccggaacacctgggttccctgagcaagaggaggaagatgaacttcgtaccttaggtgtggagcggttcgaggagatcctccaggaagctggatccagaggaggagaagagccaggccgcagctatggggaggaagactttgaataccaccgccagtcctcccaccatatccatcatccactctccacccacctgcctcctgacgcccgccgtcgcaagactccccagggcccaggacggaaacctcggaggcgccctggagcctctcccactggagagacccccactattgaggaaggggaggaagatgaggatgaagtcggtgaagctgaagggttcagagctcccccgcaacaaccatctcctgcctcttcaccctctgcagttcagttttttctccaagaggatgaaggtacagataggaaggcagagagaaccagcccatctccccctacacagacgccccaccaggaagcagctccccgggccagcaaaggggcacagacaggaactctggtggaggagatggtggccgtggccagcggcacggctggaggtgacgacggaggtgctgcagggcgccccctgaccaaagcccagcctggacatcgaagttacaaccttcaggagagaaggcgaattggcagtatgacaggggtggagcaggccctgctgcccagggtccctactgatgagagtgaggctcagacgctggccacagctgacctcgacctcatgaaaagtcaccggtttgaggacgttccgggggtacggcgacatttggtgaggaagaatgccaaagggtctacacaggctgcccgggaaggccgagagcctggccccacacctcgggcacgaccacgggccccccataagcctcatgaggtgttcgtagagctgaatgaattgcagttggacaaaaaccaggagcctcagtggcgggagacagcccggtggataaaatttgaggaggacgtggaagaggagactgagcgctggggcaagcctcacgtggcatcactgtccttccgcagcctcctggagctccgcaggacactggcccatggagctgtgctcttggacctcgatcagcagaccctgcctggggtggcccatcaggtggtcgagcagatggttatctctgaccagatcaaagcagaggacagagccaatgtgctacgagcccttctgctgaaacacagccacccaagtgatgagaaagaattctccttcccccggaacatctcagcgggctctctgggctctctcctggggcatcaccacgcccaggggactgagagtgatcctcacgtcactgagcctctcatcggtggtgttcctgagacccggctggaggtggatagagagcgtgagctgccgcccccagccccacctgcaggtattacccgctccaagtccaagcatgagctgaagctgctggagaagatccctgagaatgcagaggccacagtggtcctcgtgggctgtgtggagttcctctcccgccccaccatggcctttgtgcgcctgcgggaggctgtggaactggatgcagtactggaggtgcctgtgcctgtgcgcttcctcttcctgctgctggggcccagcagcgccaacatggactaccatgagattggccgatccatctccaccctcatgtctgacaagcaattccacgaggcagcctacctggcagatgaacgggatgacttgctgactgctatcaatgccttcctggactgcagtgttgtgctaccgccttctgaagtgcagggcgaggagctgctgcgttctgttgcccatttccagcgccagatgctaaagaagcgagaggagcagggccgcctgctgccccctggtgctgggctagagcccaagtctgcccaagataaggcactcctgcagatggtagaggtggcaggtgcagctgaagatgatccccttcggaggacaggccggccctttggggggctgatccgtgacgtgcggcggcgctacccgcactacctgagtgacttccgagatgcactagacccccagtgcctggctgctgtcattttcatctactttgccgccctgtcgcctgccatcacttttggggggctactgggggagaagacacaggacctgataggagtgtcagagctgatcatgtccacagcgctccagggagtgatcttctgcctgctgggcgcccagccactgctggtgatcggcttctcggggcctctgctggtcttcgaggaggccttcttctcgttctgcaagagcaaccagttggagtacttggtgggccgagtttggattggcttctggctggtgctcctggccctgctcatggtggctctggaggggagcttcctggtccgctttgtctcccgattcacccaggagatctttgccttcctcatatcactcatcttcatctatgagaccttctataagctgatcaagatctttcaggagcaccccctccatggctgctcagtctccaacgactcagaggcagacagcagcagtaacaatatgacttgggcagcaaccacactggcaccagacaacagcagtgcgtctgggcaggagaggccccggggccagcctaacactgccttgctatcactggtgctgatggccggcactttcttcatcgccttcttcctgcgcaaattcaagaacagccggttcttccctggccggatccggcgggtaattggggactttggggtgcccatcgcgatcctcatcatggtgcttgtggattacagtattgaggatacctacacccagaagctaagtgtgcccagtgggttctcagtgacagccccagacaagcggggctgggtcatcaacccccttggagagaagactcctttccctgtgtggatgatggtggccagcctgttgcctgccgttctggtgttcatcctcatcttcatggagacacagatcaccacgttgatcatctccaagaaagagcggatgcttcagaagggctctggcttccaccttgatctgttgctcattgtagccatgggtggcatctgtgccctctttggcctgccttggttggctgctgccactgtccgctctgtcactcatgccaatgcactcactgtcatgagcaaggctgtggcacctggtgacaaacccaagattcaggaagtcaaggagcagcgggtgaccgggctgctggtggccctgcttgtgggactctccatggtcattggggacctactgcggcagatccccctggctgtgctctttggcattttcttatacatgggagttacttcccttaatgggatccaattctacgagcggttgcacctgctactcatgccgcccaaacaccacccagatgttacctatgtcaagaaggttcggaccatgcggatgcacctgttcactgccttgcagctgctctgtctggccctgctttgggcggtcatgtccacagctgcttccctggccttccccttcatcctcatcctcacagtgcctttgcgcatggtggtacttacccggatcttcactgagcgagaaatgaaatgtctggatgctaatgaggcagagccagtgtttgatgagtgtgaaggtgtggacgagtacaacgagatgcccatgcctgtgtagctgctgtccagaggcatagcagagggactaaggggcaggggctggggggctggggagctggggctcccctcctcctgtccctcctcatttttatttaagtgaataatttaaagcccccttgtccccaccctgcagtaaagtgcttcaacccc

SEQ ID NO: 3304 - DNA, 650 bp, Rattus norvegicus
  Genbank Accession No. NM_017050
gttttgcaccttcgtttcctgcggcggcttctgtcgtctccttgctttttgctctcccaggttccgaggccgccgcgcgtctcccggggaagcatggcgatgaaggccgtgtgcgtgctgaagggcgacggtccggtgcagggcgtcattcacttcgagcagaaggcaagcggtgaaccagttgtggtgtcaggacagattacaggattaactgaaggcgagcatgggttccatgtccatcaatatggggacaatacacaaggctgtaccactgcaggacctcattttaatcctcactctaagaaacatggcggtccagcggatgaagagaggcatgttggagacctgggcaatgtggctgctggaaaggacggtgtggccaatgtgtccattgaagatcgtgtgatctcactctcaggagagcattccatcattggccgtactatggtggtccacgagaaacaagatgacttgggcaaaggtggaaatgaagaaagtacaaagactggaaatgctggaagccgcttggcttgtggtgtgattgggattgcccaataaacattccctatgtggtctgagtctcagactcatctgctgtcctgctaaactgtagaaaaaaaccaaaccattaaactgtaatcttaacagtt

SEQ ID NO: 3305 - DNA, 1358 bp, Rattus norvegicus
  Genbank Accession No. NM_017052
cgacctcaaagcaagagagcgacatggcagctcctgctaagggcgagaacctgtccctggtggtgcacggacctggagacattcgcctggagaactacccaatccctgagctgggcccaaatgatgtgttactaaagatgcattcggtggggatctgtggctcggatgttcactactgggagcatggccgaattggggacttcgttgtgaaaaagccaatggtgcttgggcatgaagctgctggaacagtcacaaaagtgggaccgatggtgaaacatctaaaaccaggagatcgggtggccatcgagcctggcgttccccgagaaatagatgaattctgcaagatcggccgatacaatctgacgccatccatcttcttctgtgccacgcccccagatgatgggaacctctgccgcttctacaagcacagcgctgacttctgctacaagcttcctgatagtgtcacctttgaagaaggggccctgattgagcctctctctgtggggatctatgcctgccgtcgaggttcggtttccctggggaacaaggtccttgtgtgtggagctgggccaattgggatagtcactttgcttgtggccaaagcaatgggagcttctcaagtagtggtgattgacctctctgcttctcggttagccaaggccaaggaagttggagcagactttaccatccaggttgccaaagagacccctcacgacattgccaagaaggtggaaagtgtgctggggagcaagccagaggtcaccatcgaatgcacgggagcggagtcctctgtccaagacggcatctatgccactcactctggcgggaccttggtggttgtgggaatgggccccgagatgatcaatttacccctagtgcacgcagctgtgcgggaggtggacatcaaaggcgtgtttcgatactgcaacacgtggccgatggcagtttccatgcttgcatcgaagactttgaatgtaaagcccttagtgacccataggttccccctggagaaggctgtagaagcctttgaaacagccaaaaagggactggggctgaaagttatgatcaagtgtgaccccaatgaccagaacccctaaatgtgattgctctatgcccttagcccactctctcagcatctaagggctaaatggaccagaaggggaagccattaatgcagaaccttctttttgaatggtaggaataataaactcataagccgagagccttagaggagctggcgtgccttaaagacagaagtaggggcaccttgggggacctcgtagccagaatgagatgcgtatactgagtaaagtctagaaccaagagtctggcagagaggtcccgaaatgccctttctc

SEQ ID NO: 3306 - DNA, 579 bp, Rattus norvegicus
  Genbank Accession No. NM_017059
atggacgggtccggggagcagctcggaggcggcgggcccaccagctctgaacagttcatgaagacaggggcctttttgttacagggtttcatccaggatcgagcagagaggatggctggggagacacctgagctgaccttggagcagccgccccaggatgcatccaccaagaagctgagcgagtgtctccggcgaattggagatgaactggacaataatatggagctgcagaggatgattgctgacgtggacacggactccccccgagaggtcttcttccgggtggcagctgacatgtttgctgatggcaacttcaactggggccgcgtggttgccctcttctactttgctagcaaactggtgctcaaggccctgtgcactaaagtgcccgagctgatcagaaccatcatgggctggacactggacttcctccgtgagcggctgcttgtctggatccaagaccagggtggctgggaaggcctcctctcctacttcgggacccccacatggcagacagtgaccatctttgtggctggagtcctcaccgcctcgctcaccatctggaagaagatgggctga

SEQ ID NO: 3307 - DNA, 966 bp, Rattus norvegicus
  Genbank Accession No. NM_017060
  misc_feature (1)..(966): n = a or c or g or t
ggcgtgaggaggttggagagttttttctgggacctaaacaaaggcacccncggccctnctaanctgaagttgagcctcacatatcctggaaaggaaaatgcccataccagaacccaagcctggagatctgattgagattttccgccctatgtacagtcactgggccatctatgttggtgatggatatgtgatccacctggctcccccaagtgaaatcccaggagctggggcagccagcatcatgtctgctttgacggacaaggccatagtgaagaaagagctgctgcgtgatgtggctgggaaggacaagtaccaggtcaacaacaagcacgacaaggagtacactccgctgcctctgaacaagatcatccagcgagctgaggagctggtggggcaggaggtgctgtacaggctgaccagtgagaactgtgagcacttcgtgaacgaactgcgttatggagtccctcggagtgaccaggtcagagataccgtcaaggtggcgaccgtcactggagtgggcttggcggccttgggcctcattggagtcatgctctcaagaaacaagaaacagaagcagtgagctgaatgactatccagctttagggctcttcttttgctagagggntggagtttgatttatagattctactgctttataattaggtatattttcacaatatacaataaaccacaagaagggaattttcatggagtacactgtagctatcttcagacacaccagaagagggcaccagatcccattacagatggttgtgagccatcatgtggttgctgggatttgaactcaggacctccggaagagcaatcagtgctcttaaccgctgagccacctctccagccctgaagggctctttcaaaggtttattctttctcctttcacaagtcggcatcgaaacttccaagtgtcctcaaagtccagggctccttggactccataacgtttct

SEQ ID NO: 3308 - DNA, 4557 bp, Rattus norvegicus
  Genbank Accession No. NM_017061
cttctacttcagacactgtgcgctctcccggaccgtcgtgcgccgctccccgtcgccttccaggactgggaaaggggagaggaggacggtgccacgtccgacggcctcctgggctgggggcagggtctgccgctcgcccttggcaccagtccctgcgacccatccccgagcctcgccctcctcctccctgctcgaagaggtctccctccttcgcgggatctgagtccctgtcttcatttttctcctagccacgtccctccccgagaagggacgagccgggagcatcatgcgtttcgcctggaccgtgctctttctgggacagctgcagttctgtccccttctccgctgcgccccgcaggccccgcgcgagcctcccgccgcccccggtgcctggcgccagacaatccaatgggagaacaacgggcaggtgttcagtctgttgagcctgggggcgcagtaccagcctcagcgacgccgcgactccagcgccactgccccgagagccgacggcaacgctgcagcacagccacgcacgcccattctgctgctgcgtgacaaccgcactgcctctgcccgtgcgaggactccaagcccatctggggtcgccgcgggtcgtccccggcccgcagcccgccactggttccaagttggtttctcgccgtcgggggccggcgatggagcctcaaggcgcgcagcgaaccggactgcgtcgccacagcctccgcagctcagtaatctgaggccacccagccacgtagatcgcatggtgggcgacgacccctacaatccctacaagtactccgacgacaacccctattataactactatgacacttatgagagaccccggtccgggagcaggcaccgacctggatatggcaccggttacttccagtacggtctcccggacctggtacccgatccctactacatccaggcatccacgtacgtacaaaagatgtctatgtacaacctgagatgcgctgcggaagaaaactgcctggccagttcagcatatagggcggatgtcagagactatgaccacagggtactgctacgatttcctcagagagtgaaaaaccaagggacgtctgacttcttaccaagccgcccccgctactcctgggagtggcacagctgccaccaacattaccacagcatggatgaattcagccactacgacctgctggatgccagcacacagaggagagtggccgagggccacaaagcaagcttctgtctggaggacacttcctgtgattatgggtaccacagacgatttgcctgtactgcacacacacaggggttgagtcccggatgttatgatacttatgcagcagacatagactgccagtggattgatattacagatgtacaacccggaaattacattctaaaggtcagtgtaaaccccagctacctggtgcctgaatcagactacagtaacaatgtcgtacgctgtgaaattcgctacacaggacatcacgcctatgcctcaggctgcaccatttcaccgtattagaaagaagctcaccttcccaaaggatgaagcagtacctggtgtttggacctatgaaaaccgtagattagcttaagtaggaagacttagatattttaaaaggcaaacggaaaaacaacaaagaaggttttgtttggactctttcacaacaaatcacataactggattttgagtgtttaaatcagcattagattggcacattttaaatacttattcatgttgctttatgaagtaatggtgtttcaattctgtgggtgcatagtgggctctttcaaagaattctgaatttcttaccttcttttgaaattatagtgcaaaaagaagaggatattttaatgaatgagccacaatttgaactgattactttctaaattgccagacccatgagacaatgatgatgggtttgtatttgcctcaacatagattcgctttttaaaaagggtgttcctattgtataggcaaaaatggatacacttggtgctgaggaagggtcaaatactaactattgttgtcacgaaatataggtctacagcagagagatggtgagtatatattcagatagttacatccctatataaactatgtttacattttagatgcttttctttctgttaattgcttaatctcactctgacttgaggtacaacttctgttttggaatgaattagataattccagattctggtttgataattgttgacattcccccatgctactttttctgagggcagaaacgtctaatgtgacgactcttcacattaccattacgaggatacacagcacagcgaaatcattccgatgacaggtgtgatagatggagagctaacatgcaactgccgagtgtttcactgttagccagaactaagtcactgcccacacagcaattacaccatgaatctctaacatcacaaccttctttcaaatactgtaaaaaaaaaaatactggaaaacctttttagatttgtttcaatctaccacgcttctgaaatgttcagctattaaggggaatgtcaatatatatatacagcccaaattagcgaagcccaaattagggaagcacatagcatggcatacttgagaggttggcaaacaagagggaagcaggtactttctgcaaaaacagggactgtgcgccacaatgagaccgctgtgaccttacttcaaactgtgaaactgtgtgcagcagtaggatttggagtcttaaattcagaaggagcagaaagaaagagagttagacgtttgaattcctggtgcttatgctgacgttttctctcatttgccagcattaaaatctcaagtaaggtgtctcctgtgccaggacgtgtcaggtagacctttctcagtgagctggaatcctgccttctgtgtcatagagttgtaagagcagcagtttctacccatcatgctgtgtactcactgctgcagagcaagtgggaggggccagagatgggccgtccccaggggcggatagcgcggtacacttaattctcttctgcctgaaagcacacttccccgtaagcgaatacagacagaactttgattgagctggtatctgaccgataggattgcttctttgatgtacctctttgacctagctagcatttcagctttgatactgcagaacgatcttttcaaattataatcattctgatagagatatcttaatagacgtgcttttaaaaacaaaacggaaactactgtcagtatgaatactgagccagactggcattcatagatttaacaacttgtatttctaagattcttaactctataaaagtaatatggcttttagatatataggataataatttcagtgagaccgttatctctttactcaacattatgttagggacagtataagccaagcacttacctgttacacattggagactaaaacgactgcccccaaccttagtaagtatgaaaactagactcacattatttcatttttaactgctaaaagtatgtctatagaatttaaaatttaagcactactatttgtcctggccacatttttcaaaaattaagttaaaagttattaattatatacaggtgtgtatttctaataattaaaatacctttcaaatccatggaatgtctgccttttaaatgtaatttgggcttttttgtttgattctttttcacttaactagctgtttatttgtaaacatttctttccacgatttaaaaacacttccaatcggctttacttcctgatttagcacttcctattttgacccttgggcatctgttcttcgtttaattggtgtagaataatgataaaaatcccaagctagtctaaccaaactgcattcttaagagtactaagtgggaatgatgcaaagttcatcaagaattgaaaagaagccggtctttgcactaaggaagacagcataattaagtcttctcgttgccatctgagtaatatcatgatatggggaccgcagaatccatctccggtgggatgatggtatagctttcctagttccagaaaaaatctccttcacattttatataataatttaatcacaatgtccatcgaattcttccttaggcattctttgtaacagtagtgtgctgctctttaaaatattaacctctgacacatgtgtgaacctcattccctgtggtcactaaaatttcttccccactgagcatcaatctttagcagattttaggaaaatactgaattcttagtcaggaaatattttaggaataatcttgctaacagtatattaagtaataaaattacccactctatgtgtgtttcattttttttaatttacatagacaatggtttttataaagcaatgatttcaatttttcccagctacccaaagtcctggttaatttgtgaacacaaattttgttagccttcaagtttaaacggtgctgaattgtcttaacttgaatgtaaaaatggattaaggcttatctcatgggacacaaacatgtcccatatgactgcttgctgcgtactaggggacatgccatttggtgttaaattgtctataataaagttcggtttctcccaaaaa

SEQ ID NO: 3309 - DNA, 1548 bp, Rattus norvegicus
  Genbank Accession No. NM_017068
gtcggtggtcgcccgtgctttcgctttctcagggctgtgagggtgttcgttggaattgtcggtccagtcgtcacttgtcctgagggatcacgatgcgccttcctctctccggttacggctcgaagctcgtcctgctctttctgttcctgggagcagttcggtccgatgcattgaaacttaatttgacagattcaaagggtacttgcctttatgcagaatgggagatgaatttcacaataacatatgaagctctaaaagtcaatgaaactgtaaccattacagtgcctgacaaggtgacatacaatggaagcagttgtggcgatgataagaatggtgccaaaataatgatacaatatggatccactctctcttgggctgtgaatttcaccaaggaagcatctcagtattttattaacaacatcacgctttcttacaacactaatgataccaaaacatttcctggtgctgtacctaaaggaatccttactgttatcattcctgtgggatcccagcttccattgggtgtcatctttaagtgcagtagtgttttaactttcaacctgagtcctgttgttcagcactattggggcattcacctgcaagcttttgtccaaaatggtacagtgagtaaacatgaacaagtgtgtaaggaggacaaaactgctaccactgtagcacccatcattcacaccaccgtgccatcgcctactacgacactcactccaacttcaatacccgttccaactccaacggttggaaactacaccatttctaatggcaatgctacctgtctgctggctaccatggggctgcagctgaacatcaccgaggagaaggtgcctttcatttttaacatcaaccctgccacaaccaacttcaccggcagctgtcagccccaaacagctcaacttaggctgaacaacagccaaattaagtatctcgactttatctttgctgtgaaaaatgaaaaacggttctatctgaaggaagtgaatgtcaacatgtatttggctaatggctcagctttccatgtttcaaataacaaccttagcttctgggatgctcctctgggaagttcttatatgtgcaacaaagagcaggtggtttccgtgtctcgaacatttcagataaatacctttaacctgaaggtgcaaccttttaatgtgacgaaaggagagtattctacagctcaagactgcagtgcagatgaagacaacttccttgtgcccatagcggtgggagcagccctgggaggagtacttattctagtgttgctggcttattttattggtctcaagcgccatcatactggatatgagcaattttagcacctacaatctgattgaatatattacaaaatacatacaaataacaaagttgtcttacctgtcagtttatgaaacactttgctacttaagacagactccttggaacttttatttggaaatcagtccccacaatttgagataaggctttttttgaaaaaaaacaaaaaacaacaaaaaaacaaaaaacaaaaaaatcattctctgatctgcttaaaatgca

SEQ ID NO: 3310 - DNA, 4503 bp, Rattus norvegicus
  Genbank Accession No. NM_017072
atgacgaggattttgacagcatgcaaagtggtgaagacactgaagagtggctttggtttggccaatgtgacttcgaagcgacagtgggacttctctagacctggcatcaggctcctttctgtgaaggcacagacagcacacattgttctggaagatggaactaagatgaagggctactcctttggccatccctcctcggttgctggcgaagtggtttttaatactggcttaggagggtactcggaagcacttactgatcctgcctacaaggggcagatcctcaccatggccaaccctatcattgggaatggtggggcccctgatacaacggcacgtgatgaactgggactgaataagtacatggagtctgatggaatcaaggtggcgggtctgctggtgctgaattacagtcatgactacaaccactggctggccaccaagagtctgggtcagtggctgcaggaggagaaggtccctgcaatttatggagtggatacaagaatgctgactaaaataattcgggataagggtaccatgcttgggaagattgagtttgagggccagtctgtggactttgtggatcctaataagcagaatttgattgccgaggtttcaaccaaggatgtcaaggtgtttggcaaaggaaaccccacgaaagtggtagccgtggactgtgggataaaaaacaatgtcatccgcctgctagttaagcgaggagcggaagtgcatttggtcccctggaatcatgacttcacccagatggactatgacggacttctgatcgctggaggacctgggaacccagctctggcacagccactaattcagaacgtgaagaagattttggagagtgaccgcaaagagccgttgtttggaatcagtacaggaaacataataacaggattggctgctggcgccaaatcctacaagatgtccatggccaacagaggacagaaccaacctgttttgaatatcacaaacagacaggctttcataactgctcagaatcatggctatgctctggacaacaccctccctgctggctggaaaccactgtttgtcaatgtcaatgaccaaacaaatgaggggattatgcatgagagcaaacccttcttcgctgtgcagttccacccagaggtcagcccggggccaacagacactgagtacctatttgattccttcttctcgctgataaagaagggcaaaggcaccaccattacctcagttctgcccaagccagcattggtggcatctcgagtcgaggtttccaaggtccttatcctaggatcaggaggcctgtccattggtcaggcaggtgaatttgattactccggatctcaggctgtaaaagccatgaaggaagaaaacgtcaaaacagtcctgatgaacccgaacattgcatccgtgcagaccaacgaggtgggattgaagcaggcagatgcagtctactttctccctatcaccccccagtttgtcacagaagttatcaaggctgaacggcccgatgggttaattctgggcatgggtggccagacagctctgaactgtggagtggaactattcaagaggggtgtgctcaaggaatatggtgtgaaggtcttgggaacatcggtcgagtccattatggccacagaagacaggcagcttttctcagacaagctgaatgagatcaacgagaagattgctcctagctttgcagtggaatcaatggaggatgccttgaaggcagcagacaccattggctaccctgtgatgattcggtctgcgtatgctctgggtgggttaggctccggcatctgtcccaacaaggagaccttaatggatcttggcacaaaggcatttgctatgaccaaccagatcctggtggagcggtcagtgacaggttggaaagaaatagaatatgaagttgtccgagatgcggatgataactgtgtcacagtctgtaacatggagaatgttgacgccatgggtgttcacacaggtgattcagttgttgtggccccggcccagaccctctccaatgcagagttccagatgttgagacgcacttcaatcaatgttgttcgccacttgggcattgtgggtgaatgcaacattcagtttgctcttcaccccacttccatggaatactgtatcattgaagtgaatgccaggctctccaggagttctgccctggcctccaaggccactggctacccactggcgttcatcgcagcaaagatcgctctaggaatcccacttccagaaatcaagaatgttgtgtctgggaagacctcagcctgcttcgaacctagcctggattacatggtgaccaagattcctcgctgggaccttgaccgttttcatggaacatccagccgaattggtagctcaatgaaaagtgtaggcgaggtcatggccattggtcgcacctttgaggaaagtttccagaaggctctgaggatgtgccatccatctgtggatgggttcactccccgtctcccaatgaataaggaatggccagcaaacctggatctgaggaaggagctgtctgaaccctccagcacccgcatctatgccattgctaaggccttggaaaacaacatgtcccttgacgaaatcgtgaagctcacatccattgacaagtggtttttgtataagatgcgtgacattttaaacatggataagacactgaaagggcttaacagtgagtctgttacagaagaaactctgagacaggccaaagagattgggttctcagacaagcagatttcaaaatgtttaggactgaccgaggctcagacaagagagctgagattgaagaaaaacatccacccttgggttaaacagattgatacattggctgcagaatacccatcagtgacaaattacctgtatgttacctacaatggccaggagcacgacatcaaatttgatgaacatggaataatggtgctgggctgtggcccataccacattggcagcagtgtggaatttgattggtgtgctgtctccagtatccgcacactgcgccaacttggcaagaagacggtggtggtgaattgtaacccggagactgtgagcactgactttgatgagtgtgacaaactctactttgaagagctgtctttggagagaatcctagatatctaccaccaggaggcatgtaatggctgcatcatatcagtcgggggccagattccaaacaacttggcggttccgctatacaagaacggtgtcaagatcatgggtaccagtcctctgcagatcgatagggctgaggatcgctccatcttctcggctgtcttagatgagctgaaggtggcccaggctccttggaaagctgttaacactttgaacgaggcgctggaatttgcaaactctgtgggctatccctgcttactgagaccttcctatgttttgagtgggtctgccatgaacgtggtattctctgaggatgagatgaaaaggttccttgaggaggccactcgagtctctcaggaacacccagtggtgctgaccaagtttattgagggggctcgggaagtggagatggacgctgttggcaaagaaggacgggtcatctcccatgccatctctgaacatgttgaagatgcaggtgtccactcaggggatgccacactgatgctacctacgcagaccatcagccaaggagccattgaaaaggtgaaggatgccacacgaaagattgcaaaggcttttgccatctctgggccattcaatgttcagtttcttgtcaaaggaaatgatgtcttggtgattgagtgcaatctgagagcctctcgatccttcccctttgtctccaagactcttggggtggacttcattgatgtggccaccaaggtgatgatcggagagagtgttgatgagaagcatctacccacactggaacaacccatcatcccctctgactatgttgccattaaggctcccatgttttcctggccccgactgagggatgctgatcctattctgagatgtgagatggcttctactggagaggtggcgtgttttggtgagggcattcatacagccttcctaaaggcaatgctgtccacagggtttaagatacctcagaagggcattctgattggcatccagcaatcattccgtccaagattccttggtgttgctgagcagttacacaatgaaggtttcaagctttttgccacagaagccacatcagactggctcaacgccaacaatgttcctgccaccccagtggcttggccatctcaggaaggacagaatcccagcctctcttccatcagaaagttgataagagacggaagcattgacctagtgattaacctccccaataacaacaccaaatttgtccatgataattatgtgattcggaggacagctgtggacagtggaattgctctgctcaccaatttccaggtgaccaaactttttgctgaggctgtgcagaaagctcgtactgtggactccaagagtctgttccactacaggcagtacagcgctggaaaggcagcatag

SEQ ID NO: 3311 - DNA, 2793 bp, Rattus norvegicus
  Genbank Accession No. NM_017073
acagccgagaatgggagtagggcggagtgtttgagcagcacacccatttcctctccgctcttcgtctcgttctcgtggcctgtccacccatccatcatctgccggccaccgctctgaacaccttccaccatggccacctcagcaagttcccacttgaacaaaggcatcaagcagatgtacatgaacctgccccagggcgagaagatccaactcatgtatatctgggttgatggtaccggggaagggctacgctgcaagacccgtactctggactgtgaccccaagtgtgtagaagagttacccgagtggaactttgatggttctagtacgtttcagtctgaaggctccaacagcgacatgtacctccatcctgtggccatgtttcgagaccccttccgcagagaccccaacaagctggtgttctgcgaagtattcaagtataaccggaagcccgcagagaccaacctgaggcacagctgtaagcgtataatggacatggtgagcagccagcgcccctggtttggaatggaacaggagtatactctcatgggaacagacggccaccctttcggctggccttctaatggcttccctggaccccaaggaccctattactgcggtgtgggagctgacaaggcttatggccgagatatcgtggaggctcactaccgggcctgcttgtatgctggaatcaagatcacagggacaaatgccgaggttatgcctgcccagtgggaattccagataggaccctgcgaagggatccgcatgggagatcatctctgggtagcccgttttatcttgcatcgggtatgcgaagactttggggtgatagcaacctttgaccccaagcccattccagggaactggaatggggcaggctgccacaccaactttagcaccaaggccatgcgggaggagaatggtctgaggtgcattgaggaggccattgataaactgagcaagaggcaccagtaccacatccgtgcctacgaccccaaggggggcctggacaacgcccgccgtctgactggattccacgaaacctccaacatcaacgacttttccgctggcgttgccaaccgcagcgccagtatccgcattccccggattgtcggccaggagaagaagggttactttgaagaccgtcggccttctgccaattgcgacccctatgcggtgacggaagccatcgtccgcacgtgtctcctcaacgaaactggcgacgagcccttccaatacaagaactaagcggactcgacttccagtgatcttgagcccttcctagttcaccccactcccaactgttccctctcccactggtccccactgtaactcaaaaggatggaataccaaggtctttttattccttgcgcccagttaatttttgcctttattggtcagaatagaggggtcaggttcttaatctctacacacccaaccccttctttcctagctagctttccagtgggggaacgggagggggtggggaagggtaacccaccgcttcatctcagcgggaatgcatgtcctgtaggcatagctgtcacaaatcgggtgtacttgtggtgagggaggactggttttttttttccttcaggataattgaaagggcaggcccaacagcttagattaacattttctctgtcagtagagagctgttatttcttccggtgaaaccagctttctattgaagtctggtgaggagttggaggttggtctcttggcttccttagcttagggaaggggagttcaccctcccttcatgaaacacagttcacctgacaaatggccctactgtaaaggaagaaaaaagtttcttggtcctccatttataactcaaagcagagtagtatttttatatttaaatgttaaaaacaaaaaagttatatatatgggtgtgtggatatatatgtcttttctaattgagaaaaccatcctattccctgggtgccaagtttgagtgaggagctcggtgtagaagtgaggcactcttgaggtaggggtggggatgcagtactgggaaagttggttatcttgggggttcagcttcattactacttagggtttccctgcccactctgcaggagcagatgttggacaggtagccagtgggatgccactgcttgccgccactgtccctgggcttagtttaaggggacgtgtatacctaatccacacacgagttagaagtatgagttggctggtcaacttgaacattgttacaggcgggtgggtgttagtggggggttattttttggtgggactagcatgtcactaaagcgggccttttgatatattaaattttttaaagcaaaacaagtttagattttaatcaagttcgtagggtttctaactttacagaattgcctgtttgtttcaatgactccttccacttggctcttaggggaactgaggacaggcctggagttaatacacttgtcattctgtgtcctagtgtcctcttcctccggcagactgtccccttccttctgaaaaagccgatagagtcttgttttatttttcttttataataaacacaccccacctccatcccagcttgttgccttgcagttttctggatgtttgtgtcggcagcaggcagctgtggtttttttctcttgccacgatgactctaattaccatgtatagtatgttcagttagataactcactgtaaacagactgtaactgagagcagagcttgtaaatcaacctaacgtttataagatttcctctgacttgtttctttgtggttccaaaaaaaaaaaaaaaaaaaaaaacctcaaaaact

SEQ ID NO: 3312 - DNA, 1715 bp, Rattus norvegicus
  Genbank Accession No. NM_017075
gacaagcttttccggtctccatggctgccctggcggttctacacggcgtcgtccgcaggcctctgctccgcgggctgctgcaggaagtaagatgcctgggacgaagttatgcatccaaacccactttgaatgatgtggttatagtgagtgctacacgaactcccattggatccttcctgggcagccttgcctctcagccagccaccaagcttggtactattgcaattcagggagccattgaaaaggcagggattccaaaagaagaagtgaaggaggtctacatgggcaacgtcatccaagggggagaaggacaggccccgaccaggcaagctacactgggtgcaggtctacccattgccactccgtgcaccacagtaaacaaggtgtgtgcctcaggaatgaaagccatcatgatggcctctcaaagtcttatgtgtggacaccaggatgtgatggtggcaggcggaatggagaccatgtcaaatgtcccgtacgtaatgagcagaggagcaacaccatacggtggggtaaaacttgaagacctgattgtgaaagacgggctaaccgatgtctacaataaaattcatatgggcaattgtgctgagaacaccgcgaagaagctgagtatctcgcgggaggagcaggataagtacgccatcggctcttacacccgaagtaaagaggcgtgggatgcagggaagtttgcaaatgagattacgcccatcaccatctcagtgaaaggtaaaccagacgtggtggtgaaggaagatgaagagtacaagcgagttgacttcagtaaagtgccaaagctcaagacagtgttccagaaagaaaacggcacagtaacagctgctaacgccagcacactgaacgacggagcagctgctgtggttctcatgactgcagaggcagcccagcggctcaaggttaagccactggcacgaatcgcagcatttgctgatgctgctgtagaccccattgatttcccactcgcacctgcatatgctgtacctaaggttcttaaatatgcaggactgaaaaaagaagacattgccatgtgggaagtaaatgaagcattcagtgtggttgtactagccaacattaaaatgctggagattgaccctcaaaaagtaaatgtccatggaggagctgtttctctgggccatccaatcgggatgtctggagctcggattgttgttcacttggctcatgccttgaagcaaggagaattcggtctggctagtatttgcaatggaggaggaggggcttccgccgtgctgattgagaagctgtagacatcttgttttaggagacagttccacgtgacccgctgaagtgaactaccccttgggccagattatattcaggataagctatttcattttttattattttctactaaaaatttttaaaaatcacatccaaaaacccattgaaattgcaaataaaaatttctcctcctttaatattttgtaaacagtcggatactctactattgaaatatactgtaggtactagaggcatggctcagccgttaagagcacttgttgctacctgtgtggtgcatggctttaatcccagcacttggagacagaggcaagtgcatctttctgagttaaagttagcctggtccacagagctagtgccctgacagccaagactacacagagtagtagaaactctgggggaaaaaaaaaaaacaaataaaaaaaaaa

SEQ ID NO: 3313 - DNA, 2171 bp, Rattus norvegicus
  Genbank Accession No. NM_017076
ccttgccgctcgctgctagcttggatccgcgtggactacagggactgaatcggacccggaaccacatggccccactcgccggtgcctctcgctcccgggtgtggtcagcggggctactgaggctgctgctgctgtcctgctttacgctccagaaagcgggtggggagatagctgtgcaggtgctctccaattcgaccggcttcttgggagggtctacagtcttgcactgtagtctggcttccaaagacaatgtgacaatcactcagctaacatggatgaagagggatccagatggatcccacccttccgtgcctgtcttccaccccaagaaggggcccagcatctctgatccagagagggtgaagttcttggttgccaaggtgtacgaggatctgaggaacgcatctctggccatctcgaacttgcgtgtagaagacgaaggcatctatgagtgtcagattgccacgttccccacaggcagtaagagcgccaatgtctggctgaaggtgttcgcccgacctaaaaacacagcagaggccctggagccctctcccaccttgatgccgcaggacgtggccaaatgcatctctgctgatggtcaccctcctggacgaatcacgtggtcctcgaatgtgaatggaagctaccgtgaaatgaaggaaacagggtcccagccgggcaccaccacagttatcagctacctctccatggtgccttctagccaggcagatggcacgaacatcacctgcacagtggaacatgaaagcttccaggagccggaccagcagccattgatcctttccctaccttatccacccgaagtgtccatctctggctatgaaggcaactggtacattggcctcactaacgtgaacctgacctgtgaagctcgcagcaaaccaccgcccaccaactatagctggagcacggccacgggtccccttcccaactccactcatttccaggaaaacggcagtcacctgctaatctccaccgtggatgacctcaataacacgatctttgtgtgcaaagccatcaatgccctagggtctgggcagggccaagtgaccatcctagttaaagaggcatctgagattctgccgccaaagacaagcttaggcactggctacatcattgccatcgtcttttgtgtcctgatcatcggagtagtagcaggcattgtattctggaaatacaggcgtggttgtggtcggcagtccaggaccttagacagggagaacgtccgctattcagcagcgaatggcgtctctgtcccaaacgtggagacgaacaacttgaggtgatggtgctggggtagacagaactaaggaacttgaagacataacaactggaaccctacttccacaaaagaaaaagcctccagagagacttgactgtccagtgtggcgaacatagcaaggttgggggtctccttggccgctgccgaattccgcattgtcgaaaggactcatggaacccggtgtgctgactcacacttgacatctcagcaagcgagggccacataaagcaaggttgagtctagcacggctgtagagagaagccctgtctatacacaggcaagctaaggggctttgagacagtcagaaactgaagtctttctttgggtaaggtaaatcctctacctcgtgtatgtgacaaacttgaaagacttctacctctgagactcaagtgcggactctctttatagctgactcagctggggctaacccctctctcctctctggacaaggtctcagagtgtagccaaagctagaccgaaactcacagaggtccgtctgtctctacctcccaagtgctgcagttaaaggtttgtgtgtgccacactcctttgctaggtctttttaataaagtaaatatttaataaagtaatatatttataaaaaaactagttataatatatattttttgagacagtgtttcctgtagcccaggctgacctcaaacttactatgtagccaagaatgatagtaaactaatttattttaatttgtcttcaagcttaaacatagcccaacccctgctcctttccctctcttctctcaatccattttcgtcttctttttcttcccagacactattctgatgtatgtcttcattgcaaacattttattgaccttcgtaaaaatgtgtgaaccacagataaaaaaaag

SEQ ID NO: 3314 - DNA, 1497 bp, Rattus norvegicus
  Genbank Accession No. NM_017077
cgcccgtagagagaccgaagcgctcggttcccccggggggaccgcagcctgggcgtgtgggggcacaggcccgggggatgctgggctcagtgaagatggaggcccatgacctggccgagtggagctactacccggaggcgggcgaggtgtattctccagtgaatcctgtgcccaccatggcccctctcaactcctacatgtccttgaaccctcttagctctccctaccctcccggagggcttcaggcctcccctctgcctacaggacccctggcacccccagcccccaccgctcccctggggcccaccttcccaggcctgggcgcaggcagcggcaccggaggcagtgcttccgggtatggcgccccagggcccgggcttgtacacggaaaggaaatggccaaggggtaccggcggccactgactcatgccaaaccaccttattcctacatctctctcatcaccatggctatccagcaggcaccaggcaagatgctgaccctgagtgaaatctaccaatggatcatggacctcttcccgtactaccgggagaaccagcaacgttggcagaactccatccggcactcgctgtccttcaatgactgcttcgtcaaggtggcacgctccccagacaaaccgggcaaaggctcctactgggccttgcatcccagctctgggaacatgtttgagaacggctgctatctccgccgtcagaagcgcttcaagctggaggagaaggcaaagaaaggaaacagtgccacatccgccaccaggaatggaacagtggggtcagccacctctgccaccactacagctgccactgcagtcacttccccggctcagccccagcctacgccgccgtctgagcccgaggcccagagtggggaagatgtggggggtctggactgcgcctcgcctccttcatccgcaccctatttcactggcctggagctcccaggggaactgaagttggatgcgccctacaacttcaaccaccctttctctatcaacaacctgatgtcagaacagacatcaacaccttccaaactagatgtggggtttgggggctacggtgctgagagtggggaacctggggtctactaccagagcctctattcccgctctctgctcaatgcatcctagcggcgcaactgggagaaatgcggtgatgggggtttgctgtgacagatgaccggttcttcggccctgatctttctggttacactctgcttatccagttaattaacatcgtatttggtctattactgtgatatgacccattggctactgtggtaactgcatggactcttcggtgggcctagggttggggtattgtgaaggcagatgcatttgggagtgttacgaaggtggccatgtcggacataccgtgaaggcaattagactggtgtactataaaagctgcatgttaagtgagtgatccactgggtgcctgatggccgcgatgtcggaggacatattgtttggccctttggatgct

SEQ ID NO: 3315 - DNA, 1835 bp, Rattus norvegicus
  Genbank Accession No. NM_017079
ggtaggctcagtgcctaaaagccacagagccccatcaggcggggagcagggtaaagtgcagaagtcggagcccagggctgtgtagaccgccggcactatgctgtacctaccgtgcctgttgctgtgggcattcccacagttctggggacaatccgaagtccagcagaattacaccttcggctgcctgcagatctcttccttcgccaaccgaagctggtcccgcacagacagtgtggtctggctgggggatctgcagacacaccgttggagtaatgactcagacaccatcagcttcacaaagccgtggtcccagggcaaattcagtaaccagcagtgggagaagttgcagcatatgtttcaagtgtatcgaaccagctttaccagggacatcaaggaaatagtcaaaatgatgtcacctaaagaagactatcctatcgaggtccaactgtctgctggctgtgaaatgtaccctgggaatgcttcagaaagctttttacacgtagcatttcaaggagaatatgtcgtgagattccatggaacatcctggcagaaggtcccagaggccccatcttggttagatttgcccatcaaaatgctcaacgctgatgaaggaacgagagaaacagtgcagatactcctgaacgacacctgcccccagtttgtccgtggcctcctagaagcagggaagccagacctagaaaagcaagagaagccagtggcctggttatcccgtggccccaaccctgcccatggccatctgcagctggtatgtcatgtctctggcttccacccaaagcctgtgtgggtgatgtggatgcggggtgaccaggagcaagggggtactcacagaggtgacatcctgccaaatgcggatgagacatggtatcttcaagcaaccctggatgtggaggctggagacgaggctggcctggcctgcagggtgaagcacagcagtctagaggggcaggacatcatcctctactggggtggcagacaagtatccccggtgttgatcttcttgatagtaggcgtactggttctagtggtgtgtgctgtggcctactatatcatcaggaaaaggagacgctcctatcaagacatcatgtgagatttttacccctgcctctcctgaagttcagaccttccaggttctaggacttcagtccttgtctgctcagaaactgaggataaaaaagaggaatcctgaagaaatgaagagcaaccagtacacccttttaatattaattataagaaatcaattatttaaatgatttttataagcttgggtagttcagaacaaacacaactgcacatgtgtgtacctgccagaaacaagctgtgagcagtgtctcgtgggatttgtactgaactagacagcacgcttcctgcccaaacagacactttgggggttgttggcaagtgtaaagtccaacaccaacacgactgtactctgtatttttcaagataacgagaaaaatggatttgtgtgtgtgtgtgtgacatatagctttggggtttgttggcaagtataaagtccaacaccaacacgactgtactctgtatttttcaagataactagaaaaatagattttgtgtgtgtgtgtgtgtgatacaagtattttaaaaagtaaactcaaatatttacaaatgattactaccttaaatacaaagctgctgactgatgattaccccaaaggcttcttccagtgtgtggtctttttacaatgtttgttctaattgtcataatggccactttagggcacagtctccattgaaaatgtgcattaatgactgaaaggtggtttctctttaaaataaaattaggatgtacgatg

SEQ ID NO: 3316 - DNA, 1265 bp, Rattus norvegicus
  Genbank Accession No. NM_017080
cggcctgggaggttgtagaaagagctgcaggttttctttgtgtgtcctacagagctccctgagccaggtccctgttggacggcagttatgaaaaaatacctcctccccgtcctggtgctctgcctgggttactactattctacaaatgaagagttcagaccagaaatgctccaggggaagaaagtgattgtcactggggccagcaaagggatcggaagagaaatggcatatcatctgtcaaaaatgggagcccatgtggtattgactgcaaggtcggaggaagggctccagaaggtggtgtctcgctgccttgaactcggagcagcctctgctcactacattgccggcactatggaagacatggcttttgcagagcgatttgttgttgaggcaggaaagctcttgggtggactggacatgctcattctcaatcacatcacacagaccactatgtctctcttccacgatgatatccactctgtgcgaagaagcatggaggtcaacttcctcagctatgtggtcctgagcacagcagccttgcccatgctgaaacagagcaatggcagcattgccatcatctcctccatggctgggaaaatgacccaacctctgattgcttcctactctgcaagcaagtttgctctggatgggttcttttccaccattagaaaagaacacttgatgaccaaggtcaacgtgtccatcactctctgtgtcctcggcttcatagacacagaaacagctttgaaagaaacctctgggataatcttgagtcaagctgctcccaagcaggaatgcgccctggagatcaaaggcacagttctgcgcaaagatgaggtatactatgacaaatcatcttggactccacttctgcttgggaatccaggaaggaggatcatggaatttctttcattacggtcatataacagggacctatttgtaagcaactaggaactcctgaggcctggtgaagggtcttggaacagtcctgcctgatatttctgtgagccctacccacaaatttctctgagcccctttccagagatacacaaattttggggtacacctcaccatgagaaattcttgcaacacttgcacagtaaaaatgtaattgtaataaatgtcacaaaccactttgtagcctgcagttgtgaacttgattgtaactatggatttaagcacacagttgtatcaattttacctcatacagaatgaaacaatgatgcctaatgtaacattaaataaaataaaggtaatatcaaccg

SEQ ID NO: 3317 - DNA, 988 bp, Rattus norvegicus
  Genbank Accession No. NM_017084
caggatggtggacagcgtgtaccgtacccgctccctgggggtggcggccgaagggatccccgaccagtatgcggatggggaggccgcacgtgtgtggcagctgtacatcggggacacccgcagccgtactgcagagtacaaggcgtggttgcttgggctgctgcgccagcacgggtgccaccgggtgctggacgtggcctgtggcacaggagtggactcgattatgctggtggaagagggctttagcgtcacgagtgtggatgccagcgacaagatgctgaaatacgcactgaaggagcgctggaaccggaggaaggagccagcctttgacaagtgggtcattgaagaagccaactggttgactctggacaaagatgtgccagcaggagatggctttgacgctgtcatctgccttgggaacagttttgctcacctgccggacagcaaaggtgaccagagtgagcaccggctggcgctaaagaacatcgcaagcatggtgcggcccgggggcctgctggtcatcgaccaccgcaactacgactacatcctcagcacgggctgtgcacccccagggaagaacatctactataagagtgacctgaccaaggacattacgacgtcagtgctgacagtaaacaacaaagcccacatggtaaccctggactacacagtgcaggtgccaggtgctggcagagatggcgctcctggcttcagtaagtttcggctctcttactacccacactgtttggcgtctttcacggagttggtccaagaagcctttgggggcaggtgccagcacagcgtcctgggtgacttcaagccttacaggcccggccaggcctacgttccctgctacttcatccacgtgctcaagaagacaggctgagcctggctccggctcccaccctaagaccatcgcctaccacagatattgcagagatgtggggggcaggcaaacagggagtcgacaatacagccttcccttgcc

SEQ ID NO: 3318 - DNA, 1390 bp, Rattus norvegicus
  Genbank Accession No. NM_017088
tctagaaataattttgtttaactttaagaaggagatataccatggacgaggaatatgatgtgattgtgctggggacaggtcttaccgaatgcatcctgtctggcatcatgtctgtgaatggaaagaaggtgttgcacatggaccgaaacccctactatgggggtgagagctcttctatcacaccccttgaggagctatataagcgctttcagttgctggaagggccccctgaatcaatgggccggggccgagactggaatgttgacttgatccccaaattcctgatggccaatggtcagctggtaaagatgctactgtatacagaagtgactcgttatctggacttcaaggtggtagagggcagctttgtatacaaagggggcaagatctacaaagtgccatctactgagactgaggccttggcttctaatctgatgggcatgtttgaaaaacgacgcttccgaaaatttttggtgtttgtggcaaactttgatgagaatgaccccaaaacctttgagggtgttgacccgcagaccaccagcatgcgtgatgtctaccggaagtttgacctgggccaagatgtcattgatttcactggccatgccctggcgctctaccgcactgatgattacctggatcagccatgtcttgagactattaaccgcatcaagttgtacagtgagtccctggcccggtatggcaagagcccatatttgtacccactctatagcctgggtgagctgcctcagggctttgccagattgagtgccatctatgggggaacatacatgctgaacaaaccagtggatgacatcatcatggaaaatggcaaggtggtgggcgtaaaatctgagggagaggtggcccgctgcaagcagctgatctgtgatcccagctacatcccagaccgtgtgcgaaaggctggccaggttattcgcatcatctgcatcctcagccaccccatcaagaataccaatgatgccaattcctgccaaattatcatccctcagaatcaggtcaacaggaagccagacatctatgtgtgcatgatctcctatgcacacaacgtggccgcacaaggcaaatacatcgccattgccagcaccaccgtagagactgcagaaccagaaaaggaggttgagcctgcattggagctgttggaacctattgaccaaaagtttgtggctatcagtgatttatatgagcccattgatgacggttcagagagtcaggtgttctgttcctgctcctatgatgctaccacacactttgagacaacctgcaatgacatcaaagatatctacaaacgcatggctggttctgcctttgattttgagaacatgaagcgcaaacagaatgatgtgttcggggaagctgaccagtaggatcc

SEQ ID NO: 3319 - DNA, 2659 bp, Rattus norvegicus
  Genbank Accession No. NM_017091
attctattctggctgggaaggctggggctcctctcagccaggagactgaagtgcttcagtgagcgctggctcatcgccgcccagcctctcccagggagcctcctagctctagtaaagcaacccagagccaggagccagtgtgcagggtggaaaggtctagcctagctggtgtgtttctgatcttgcttcttttctctcagcccttcctacttgtgcgagccatgaagcaaagaggttggactctgcagtgtactgctttcaccctcttttgcgtttggtgtgcactgaacagtgtaaaagcgaagaggcagtttgtcaatgaatgggcggcggagatacatggagggccagaagctgcttctgccattgccgaagagctgggctatgacctcttgggtcagattggatcacttgaaaatcactatttattcaaacacaaaaatcatcctcgaagatcccgaagaagtgctcttcatatcactaagaggttatctgatgatgatcgtgtgatatgggcggaacaacaatatgaaaaagagagaagaaaacgttcagttccaagagactcagcattgaatctcttcaatgatccaatgtggaatcagcagtggtacttgcaagacaccagaatgactgcatctctgcccaagctggacttgcatgtaatacctgtttggcaaaagggtattactggcaaaggagttgttattactgtactggacgatggcttggagtggaatcacacagatatttatgccaattatgacccagaggctagctatgattttaatgataatgatcatgatccatttccccgatatgatcccacaaatgaaaacaaacatggaacaagatgtgcaggagaaattgccatgcaagcaaataatcacaaatgtggagttggagttgcatataattccaaagttggaggcataagaatgctggatggcattgtaactgatgccattgaggctagttcaattggattcaaccctggccatgtggatatttacagtgcaagctggggccctaatgatgatggaaaaactgtggaggggcctggcagactagcccagaaggcatttgaatacggtgtcaaacaggggagacaaggaaaaggctccatttttgtctgggcttcagggaatgggggtcgtcaaggagataactgtgactgtgatggctacacagacagcatttacaccatctctatcagcagtgcctcccagcagggcctgtcaccctggtatgcagagaagtgttcctccacactggccacctcctacagcagtggtgattacacagaccaacgaataactagtgcggacctgcacaatgactgcacagagacccacacaggcacctcagcttctgcacctctggctgctggcatctttgctctagccttggaagcaaacccaaatctcacctggcgagatatgcagcatctggttgtctggacctctgagtatgacccattggccaataacccaggttggaaaaagaatggagcgggcttgatggtgaacagccgatttggatttggcttgctaaatgccaaagctctggtggatttggctgatcctagaacttggagaaacgtgcctgagaagaaagaatgtatcataaaagacaacaactttgagcctagagccctgaaagctaatggagaagtgattgttgaaatccctacaagagcttgtgaaggacaagaaaatgctatcaattccctggaacatgtgcaatttgaagcaacaatcgaatattctcgtagaggagaccttcatgtcacacttacctctgctgctggaaccagcaccgtactgttggctgaaagggaaagggatacatcccccaatggctttaagaattgggacttcatgtctgttcatacatggggagagaatcctgtaggcacctggacattgaaagttacagacatgtctggaagaatgcaaaatgaaggaaggattgtgaactggaagttgattttgcatggcacatcttctcagccagaacacatgaagcagcctcgtgtatacacgtcctacaatactgtccagaatgacaggagaggagtggaaaagatggtgaatgttgtggaggagaagcccacacaaaacagcctgaatggcaatctcctggtacccaaaaactccagcagcagcagtgtggaagacagaagagatgagcaggtacaaggagctccttcaaaggccatgctacggctcctacaaagtgctttcagcaagaacacaccttcaaagcaatcatcaaagattccaagtgctaagctcagtgtcccttatgagggtctctatgaagccctggaaaagctcaacaagccctcccagcttgaagactctgaagacagtctgtatagcgactatgttgatgttttctataacacaaaaccttataagcatagagatgacaggctgctgcaagcactcatggacattctgaatgagaagaattaaaataagtgtatatggcctgagttagaaatccttatgtaccctccttttccttagatgttcctgggtctggagttgttgtatccctgcttcctgtgattataatgtccttcattgtaattttactttttcttctcaaactgtacttttggagtgagttccaaaatgaaagccaacttcat

SEQ ID NO: 3320 - DNA, 693 bp, Rattus norvegicus
  Genbank Accession No. NM_017096
atggagaagctactatggtgtcttctgatcacgataagcttctctcaggcttttggtcatgaagacatgtctaaacaggccttcgtatttcccggagtgtcagctactgcctatgtgtccctggaagcagagtcaaagaagccactggaagccttcactgtgtgtctctatgcccacgctgatgtgagccgaagcttcagcatcttctcttacgctaccaagacgagctttaacgagattcttctgttttggactaggggtcaagggtttagtattgcagtaggtgggcctgaaatactgttcagtgcttcagaaattcctgaggtaccaacacacatctgtgccacctgggagtctgctacaggaattgtagagctttggcttgacgggaaacccagggtgcggaaaagtctgcagaagggctacattgtggggacaaatgcaagcatcatcttggggcaggagcaggactcgtatggcggtggctttgacgcgaatcagtctttggtgggagacattggagatgtgaacatgtgggactttgtgctatctccagaacagatcaatgcagtctatgttggtagggtattcagccccaatgttttgaactggcgggcactgaagtatgaaacacacggtgatgtgtttatcaagccgcagctgtggcccttgactgactgttgtgagtcctga

SEQ ID NO: 3321 - DNA, 743 bp, Rattus norvegicus
  Genbank Accession No. NM_017101
ctttgcagacgccgctgtctcttttcgccgcttgctgcagacatggtcaaccccaccgtgttcttcgacatcacggctgatggcgagcccttgggtcgcgtctgcttcgagctgtttgcagacaaagttccaaagacagcagaaaactttcgtgctctgagcactggggagaaaggatttggctataagggttcctcctttcacagaattattccaggattcatgtgccagggtggtgacttcacacgccataatggcactggtggcaagtccatctacggagagaaatttgaggatgagaacttcatcctgaagcatacaggtcctggcatcttgtccatggcaaatgctggaccaaacacaaatggttcccagttttttatctgcactgccaagactgagtggctggatggcaagcatgtggtctttgggaaggtgaaagaaggcatgagcattgtggaagccatggagcgttttgggtccaggaatggcaagaccagcaagaagatcaccatctccgactgtggacaactctaatttctttgacttgcgggcattttacccatcaaaccattccttctgtagctcaggagagcacccccaccccatctgctcgcaataccctgtaatctctgctctcactgaagttctttgggttccatattttcctcattccccttcaagtctagcaggattgcaaagttaagtttatgattatgaataaaaactaaatgagaagtgtt

SEQ ID NO: 3322 - DNA, 1305 bp, Rattus norvegicus
  Genbank Accession No. NM_017104
ggcacgagcaactttctgctcaaggacgcatgaagctgatggccctacagctgctgctgtggcacagtgcactatggtcaggacaagaggccattcccctgctcaccgtcagctctctgccaccatccctgcctttgccccgaagctttctgcttaagtccttggagcaagtgaggaagattcaggccaggaacactgaactgctggagcagctgtgtgccacctacaagctgtgtcatccggaggagctggtgctgtttggccactctctgggtatccccaaggcttccctgagcagctgctccagccaggccttgcagcagacaaagtgcctgagccaactgcacagcgggctcttcctctaccaaggtctcctgcaggccctagcaggcatttcctctgagctggcccccaccttggatatgcttcacctggatgtcgacaactttgccaccaccatctggcagcagatggaaagcctcggggtggcccctactgtgcagcccacccagagcaccatgccaatcttcacttctgccttccagcgtcgggcaggaggagtcctggtcacttcatacctgcagagcttcctggagacagctcaccacgctctgcaccacttgcctaggcctgcgcagaagcactttccagaaagtttatttatctctatttaatatttatgtgtatttaagcccactatttaaagacaaacaagagaaaatggagctctaagcttctagatccttctctccacttctgagttttgttctcctgcttggagcagagagagaaggctcttgtgtcctcctgtggagcagggaaggagataggtaaataccgagtattgattcctgccgctgctccaggcaccccattctgtggtggtacccaagaaatcacattgagccctgctgtgctgaggcacctgtctcaggggcccaggcagcatctggtctcccttctgggggacaagacatccctgtttaatatttaaacagcagtgttcccaaactgggttcttacatcccttgctctggtcaaccaggttgtaggttttcctgaccccgtaggaatgaagtccctaaagaaacagtggcgccaggtttggccctggaattgaccgattcttttttagcgcttgctggcctagaactgggagtgtgggagggaaaaggcacaaggaatcctgtggggagtgcgtggcatagaggaaggctgacctgtctaccctccctctcgaccccacttgtcactgtaaccaagcttgcggataataaagtgtgtgtgtgcccagtaaaaaaaaaa

SEQ ID NO: 3323 - DNA, 1739 bp, Rattus norvegicus
  Genbank Accession No. NM_017112
gcaggccccacgctgctggctgctgctgccacccttgcctcccgggctgcccgctgctgtggggacaccatgccccttcccaggcccggagactaaccccaaacctgcaccatctccggcgaaccccagggttccgccccagcccaacaggtcaacctgggaatcattaacaagagtccctgacatggcgaaggagggtggccggactgcaccatgctgttccagacccaaggtggcagctctcactgtggggaccctgctgttcctgacaggcattggggctgcgtcctgggccattgtgaccatcctactacggagtgaccaggagccactgtaccaagtgcagctcagtcccggggactctcgacttttggtgttggacaagacagagggaacgtggaggctgctgtgctcctcacgctccaacgccagggtagcagggctcggctgtgaggagatgggctttctcagggctctggcgcactcagagctggatgtgcgaaccgcgggcgccaacggcacatcgggcttcttctgcgtggacgagggcggtctgcctctggctcagcggttgctggatgtcatctctgtatgcgactgtcctagaggccgattcctgactgccacctgccaagactgtggccgcaggaagctgccggtggatcgcattgtggggggccaggacagcagcctgggaagatggccatggcaggtcagcctgcgttatgatgggacccacctctgtgggggatccctgctgtccggggactgggtactgaccgctgcacactgctttccagagaggaaccgggtcctgtctcggtggcgagtatttgctggtgctgtagcccggacctcacctcatgccgtgcagctgggggttcaggctgtgatctatcatgggggctaccttccctttcgagaccctactatcgacgaaaacagcaatgacattgccctggtccacctctctagctccctgcctctcacagaatacatccagccggtttgtctccctgctgcgggacaggccctggtggacggcaaggtctgtacagtgaccggctggggtaacacacagttctatggccagcaagctgtggtgctccaagaggcccgggtccccatcataagcaacgaagtttgcaacagccccgacttctacgggaatcagatcaaacccaagatgttctgtgctggctatcctgagggtggtattgatgcatgccagggtgacagcggaggccactttgtatgtgaggacagaatctctggaacatcaagatggcggctctgcggcattgtaagctggggtacgggctgtgctttggcccggaagccgggagtgtacaccaaagtcattgacttccgggagtggatcttccaggccataaagactcactccgaagctaccggcatggtaactcagccctgaccccgcctcatcgcctgctccgcgctgctccagcatccagagtcagagttggtctggtggctccagccgcacgtggcaggctccacactgggcctcacatggaacggttttctgctcggatccagtccatagatccaaggatgctgggtccaaggacctctcttccacagtggccggcccactcaatcccagggccattggcctcaccctcccaccccatgtaaatattactctgtcctctgggggctgctttcgaggcgccccttgtgcggatgctctttaaataataaaggtggttttgatt

SEQ ID NO: 3324 - DNA, 2113 bp, Rattus norvegicus
  Genbank Accession No. NM_017113
gcgcaggcaagaccatgtggatcctggtgagctggctggccttagtggcaaggctggtggctggaacacagtgcccagatggtcaattctgccctgttgcctgctgccttgaccagggaggagccaactacagctgctgtaaccctcttctggacacatggcctataataacgagccgtcgtctagatggctcctgccagatccgtgaccactgtcctgatggctactcttgtcttctcactgtgtctgggacttccagctgctgcccgttctctgagggtgtatcttgtgatgatggccagcactgctgcccccggggcttccactgtagtgcggatgggaaatcctgctctcagatatcagatagcctcttgggtgctgtccagtgtcctggtagccagttcgaatgtcctgactccgccacctgctgtattatgattgatggttcctgggggtgctgccccatgccccaggcctcttgctgtgaagacagagtgcattgctgtccccacggggcctcctgtgacctggttcacacgcgatgcatttcacccacgggcacccaccccttactaaagaaattccccgcacaaaggaccaacagggcagtggcttccttttccgtggtgtgccctgatgctaagacccagtgccctgatgactctacctgctgtgagctacccactgggaagtatggctgttgtccaatgcccaacgccatctgctgttccgaccacctgcactgctgcccccaggacactgtatgtgacctgatccagagcaagtgcatatccaaggactacaccacagatctcatgaccaagctgcctggatacccagtgaatgaggtgaagtgcgacttggaggtgagctgtcctgatggctacacctgctgccgcctcaacactggggcctggggctgctgtccattcaccaaggctgtgtgttgtgaagaccacattcactgctgcccagccgggtttcagtgtcacacagagacaggaacctgtgaactgggagtccttcaggtaccctggatgaaaaaggtcacggcctccctcagcctgccagacccacagatcttgaagaatgatgtcccctgtgatgacttcagtagctgtccttctaacaatacctgctgcagactcagttctggggactggggctgctgtcccatgccagaggctgtctgctgcttagaccaccagcattgctgccctcagggtttcaaatgtatggatgaggggtactgtcagaagggagacagaatggtggctggcctggagaagatgcctgtccgccagacaactctgctccaacatggagatattggttgtgaccagcataccagctgcccagtagggcaaacatgctgcccaagcctgaagggaagttgggcctgctgccagttgccccatgctgtgtgctgtgaggaccggcagcactgttgcccggctgggtacacctgcaacgtgaaggcgagaacctgtgagaaggatgcaggctctgtccagccttccatggacctgacctttggctctaaggttgggaatgtggaatgtggtgccggacatttctgccatgataaccagtcctgttgtaaagacagccaaggaggctgggcctgctgtccctatgtaaagggtgtctgctgtagagatggacgtcactgttgtcccattggcttccactgttcagccaagggaaccaagtgtttgcggaagaagacccctcgctgggacatacttttgagggatccagccccaagaccgctactgtgaggaagggctaacgactaaagaactccacagtcctgggaaccctgttctgagggtatccaccactcaggcctccctggcacctcttcctttagtctccccggcctactcattctgagtcaccccatcaccatggaaggtggggcctcaaactaagaccttctcttatggaaagaaggctgtggcaaaagccccgtatcaaactgccatttcttatgatttctgtggaccttgtggccaggtgctcttctcgatccacaggtgttgtgtgagcttgcttttgtgtgtgtgtgtgtgcgcgcgtgcgagcgtgttgctccaataaagtttgtacc

SEQ ID NO: 3325 - DNA, 3252 bp, Rattus norvegicus
  Genbank Accession No. NM_017116
agctcccgcagtccgctgcagcgccccgggcttggccgcgccccaaccgagtgctgcgccccgcctctccgcgacccctctctctgtgctgtgcgccatcccgatcgctaccatggcgggcatcgcgatgaaactggccaaagaccgcgaggcggccgaggggctggggtctcacgagagagccatcaagtacctcaaccaggactacgagacactgcggaacgagtgcctggaggccggggcgctcttccaggatccttccttccccgccctgccgtcgtccctgggcttcaaggagttggggccctactccagcaaaactcggggcatcgaatggaagcggcccacggagatctgcgcagacccccagttcattattggaggtgctacccgcacagacatctgccaaggagcccttggggactgctggcttctggctgccatcgcctccctcaccttgaatgaagagatcctggctcgagttgtgcctctagaccagagcttccaggaaaactatgcaggcatcttccatttccagttctggcaatatggcgaatgggtggaggtggtggtggacgacagactgcccactaaggacggggagctgctctttgttcattcagctgaggggagcgagttctggagtgcccttctggagaaggcctatgccaagatcaatgggtgctatgaagcactctcagggggtgccaccactgagggctttgaagacttcacaggaggcattgccgagtggtatgagctgaggaagcctcctcccaatttgttcaagatcatccagaaggctttggagaaaggttctctgcttggctgctctatcgatatcaccagcgctgcggattctgaggccgttacgtaccagaagttggtgaaaggacatgcgtactccgtcactggagccgaggaggttgaaagctcaggaagcctgcagaaattgatacgtatcaggaacccctggggacaagtggagtggaccgggaagtggaatgacaactgccccagctggaacacggttgacccagaagtaagggcaaatctaacagaacggcaggaggacggagaattctggatgtccttcagtgacttcctgaggcactactctcgtctagaaatctgcaacctgaccccggacaccctcacctgtgactcctacaagaagtggaaactcaccaagatggatgggaactggaggcgaggctccactgcagggggctgcaggaattacccaaataccttctggatgaaccctcagtacctaatcaagctggaggaagaagatgaagatgatgaggatggggagaggggctgtaccttcctggtgggcctcatccagaagcatcggcggcggcagaggaagatgggtgaggacatgcacaccattggcttcggcatctatgaggtcccagaggagctaacagggcagaccaacatccacctcagcaaaaactttttcctgacaacccgagccagggagcggtcagataccttcatcaacctccgggaggtcctcaaccgcttcaagctgcccccgggagaatatgtccttgttccttccaccttcgagccccacaagaatggcgatttctgcatccgagtcttctcagagaagaaggctgactaccaaactgtcgatgatgaaatcgaggccaacattgaagagattgaagccaatgaggaggacattggagatggattcagaaggctgtttgctcagctggctggagaggatgcggagatctctgcctttgagctgcagaccatcttgagaagagttctagccaagcgcgaagacatcaagtcagatggcttcagcatcgagacctgtaagatcatggtggacatgctggatgaagatgggagcggcaagctggggctgaaggagttctacatcctctggacgaagattcagaaataccaaaaaatttaccgagagatcgacgtggacaggtcgggaaccatgaattcctatgagatgcggaaggctttggaagaagcaggtttcaagctgccctgtcaacttcatcaagtcatcgttgcccggtttgcagatgacgaactcatcatcgactttgacaactttgtgcggtgtttggttcggctggaaatactattcaagatattcaagcagctggaccctgagaacactggaacgatacagctcgaccttatctcgtggctgagtttttcagtactctgaagttacatgcctgaagatttctggtggaagaaaacagccaatgcctacacttaaatactttgtatctggaccttgaacgtacgggaacatttacttcatcgggtgattgtaactgaagctctaaccgtcagaggtggatgaactttcacatatcagagtaatggatctgcataccattaaccaaatgcaaatgaattgcataaccctcggtaaggtcagagagagctttatgcctgtacatagtatatcctttctacttctacacatcgtctcttcatagcaatattaaaccaggaaggactgttgagaggtttaagtaattgggcaaacagcaattgatctcagaggccacaatgccttgatgggaatatttaaagaaatttaaaaatttaagatgcagtggtggcatcttccacagcaggccagagagaaacagagagagagagagagagacttggaaatacaataataaagtaatctgtgtggagcgtctaaagaatccagtctgatggaggcatctaaagaatccagtctgatggaggcatctaaagaatccaggagccaggagtatctgacacaaggccaacctgggctacctagcaagacctgatctcaaaaaataaatgtcaattaaaaaaaaagaaggcatgtttccatcatttggttctaacaaaagatggtttttatacacctttgtgaacagcaagccctcttagactcaagtccttgaccatatttggccttagacattgaagtagtgagtagtgagatcatttgactgaccaactgagccaggtctgccatctgaaagaaaatcgtgatacaaccccagggatggtgcctacggctcgggagaacagggctcagaagatccttcttaaaacaaccaagctggcttcgtggtccgaggaaaatgctagcaaccatacagacatactgccttatccacttccaaacgtactgttaataaagagttgcaatgcatgcacgccgtgccttgtttttcctcgtagagcgtggcccccgtggagggtttc

SEQ ID NO: 3326 - DNA, 860 bp, Rattus norvegicus
  Genbank Accession No. NM_017125
ggctgctgagccgcggtaggagagcatcaagaagcgtcggggagcgcaggcccagcagccatggcggtggaaggaggaatgaagtgtgtcaagtttttgctctacgttctcctactggccttttgcgcctgcgcagtgggattgattgccattggcgtagcagttcaggttgtcttgaagcaggccattacccacgagactactgctggctcgctgttgcctgtggtcatcattgcagtgggtgccttcctcttcctggtggcctttgtgggctgctgtggggcctgcaaagagaactactgtctcatgattacatttgccatcttcctgtctcttatcatgctcgtggaggtggcggtggccattgctggctatgtgtttagagaccaggtgaagtcagagtttagtaagagcttccagaagcagatgcagaattaccttacagacaacaaaacggccaccattttggacaaattgcagaaggaaaataaatgctgtggagcctctaactacacagactgggagcgcatccccggtatggccaaggacagggtccccgattcttgctgcatcaacatcactgtgggctgtggaaacgatttcaaggaatccaccatccatacccagggctgcgtggaaactatagcggcatggctgaggaagaacgtactgctggtggctggagcagccctgggcattgcttttgtggaggtcctgggcattatcttctcctgctgtctggtgaagagtatccggagtggctacgaagtaatgtagggtgggggcgtgtctgagctcgtctgtcttttcatggagtggactctccaggttttcaattaaacggattattttttcagacc

SEQ ID NO: 3327 - DNA, 838 bp, Rattus norvegicus
  Genbank Accession No. NM_017126
gggacccaggggacccttggcactgcgcaggaccccgcgggacccggaaccttccgacagggttatggcggccgctccgggcgcccgactcctgcgcgctgcctgcgcctccgtcgcttttcgtggtctggactgccgtcggctgctggtctgcgggacccgtgcgggacctgccgtccctcagtggaccccgagcccccacacgcttgcagaggccggacctggccggccactgagcgtgtctgcgcgcgcgcggagtagctcagaagataaggtaacagtccacttcaagaaccgagatggtgaaacgctaacgaccaaggggaaagttggtgactctctgctagatgttgtgattgagaataacctagatatcgatggatttggtgcgtgtgaggggactttggcttgctctacctgtcatcttatctttgaggaccatatatatgagaagttagatgccattactgatgaagagaacgacatgcttgacctggcttttggactaacaaacaggtcacggctgggctgtcaagtttgtctgaccaaggctatggacaatatgactgtccgtgtgcctgaagcagtggcagatgtccgacagtctgttgacatgagcaagaattcctaagctacaataaaaagaatattttcattaaatttttacctatttttataattatttcttagcataattgattatatggccaaaatatgtagctgtgctgtcttagttcagttttgtagtactgaaaatttgcagtttttattttgattaaattattaaaatatcagtctattagaagacagctgatacaataaactccttatgtatttt

SEQ ID NO: 3328 - DNA, 2540 bp, Rattus norvegicus
  Genbank Accession No. NM_017127
ccgcggcccactacagcagtcgcccgccgtcagcctcccgcgctcgtctctcgtcactgctgctcggcgtccattgctgcctctccccgcagtcgccgacgtcgcttccccgcgcgctcccacaaccgccgccccgccggtcagtgaagccggtgagccattccccgcgccggcccccagaggcgggcatccagccggaccccgagtgtggccctctcctgctgtggccgtccgcgccttctcgaccgcttatccagcatgaaaaccaagttctgcaccgggggcgaggccgagccgtccccgcttgggctgctgctgagctgcggtggcagcgctgccccgacgcccggcgtagggcagcagcgcgatgccgcaggcgagctggagtccaagcagcttggtggccggtcccaacctctcgcgctgccgccgccaccaccgccgcccctgccgctgcccccgccgccatcaccgccgctagcggacgaacaacccgagccccggacgcggcgcagggcctacctgtggtgcaaggaattcctgcccggagcctggaggggccttcgcgaggaccagttccacatcagtgtcatcaggggtggtctcagtaacatgctgttccagtgttccttgccagactccatagccagtgttggtgatgaacctcggaaagtgctcttgcgactgtatggggcaatcttaaagatgggggctgaagcaatggttctggagagtgttatgtttgccattcttgcagagaggtcacttgggccaaaactctatggcatctttccgcaaggccgactggagcagtttatcccgagccggcgattggacactgaagaattatgtttaccagatatttctgcagaaatagctgaaaaaatggccacatttcatggtatgaaaatgccattcaataaggaaccaaaatggctttttggaacaatggaaaaatacctgaatcaagtactaagacttaaattcagcagggaggccagagttcaacaactgcacaagttcctctcttacaatctgcctctcgagcttgagaacctgaggtcattgctgcagtatactagatccccagttgtgttttgtcataatgactgtcaagaaggtaatatcttattgttggaaggccaagagaattctgaaaagcagaagttgatgctcattgactttgaatacagcagttacaattacaggggatttgacattggaaatcatttctgtgaatggatgtatgattatacctatgaaaagtatcctttcttcagagcaaacattcagaagtatcctacccgaaaacaacagctccattttatttcaagttacttgactacattccaaaatgattttgaaagcctcagcagtgaagagcagtctgctacaaaagaagacatgttgcttgaagtcaacagatttgcccttgcctctcatttcctctggggactttggtccattgtacaggccaagatctcatccattgaatttgggtacatggaatatgcccaagccaggttcgatgcctactttgaccagaagaggaagcttggtgtgtgaatggatggctccactcttcaccactggactgcaggaggtggctgcaccaggccctcagtggagcgctgctgtgaccactgccctgggcagaaggcctggacgtctcactactgagcaccgatgtgtatgatactacagactatattaaagtggagtaacatttctttcatctttgtttacactctcactaggactctgaaccatgattggaagcagaaatatagtgtgatagtgcaatagctcagaccccgcctaagcgggaggcctttcagctacatggctacagcttcagccacttaggccccagccagacagagcagtgctgtgtgggtactgagtgctgacttaggatattaatgtgctgcaacacgttcatgaccaggctttgaaggtgacagtctgacaatgtgttggagacactctgaagggcaagtgaacagacatactgtgaaatggctcgacaggaggagcctgaattgtggggtctgtggaggcagccagctgtttctgtacagggtacacttgactatgggtatgcatctgcaggcagtagctgcagccctcctgtgcctgtgtacacatgactacaggggccagtgtcactgactggccataactgcagtgtctcctaactgggtgtgctttatgcttcagcttcccggggaggagcagtggagccagcttcctcaccccttcttgccttctctctgcctgacctggaacttgggctttcgcccattgccctctgaagctgcttcccatctgatgtcactgggagacagcagctgtatgtgtggggtattggggtgcaggtagattagagctgtgaaatccatgtacattaatacccaatgggataaacctagaatttttttttttttactctgaactctgaattgttttgtgcacatatttctgctaccaccgaaactgtattatacagataaataaacaacttgaaacttaaaaaaaaa

SEQ ID NO: 3329 - DNA, 1681 bp, Rattus norvegicus
  Genbank Accession No. NM_017131
gaattccgcgcaggaccaaggaggtgagatcagcctctttgttccctaaccaagcttagcagcgtctccaagaaccttccatctgtcttccatgatctccgttctggggactgagaaacaagactcttcccaaatgaagaggatttacctgctcgtggtggggctttatctgctgtcctttagcagggcagaagaggggctgaacttccccacgtacgatgggaaggaccgagtggtcagcctttctgagaagaacttgaagcaagtgttgaagagatacgatttgctctgtctctactaccacgagcctgtgtcttcagacaaggtcgcacagaagcagttccaactgaaggagatcgtactggagcttgtggcccaggttctggaacataaaaacataggctttgtgatggtggattcaaggaaagaggccaagcttgccaagaggctgggcttcagtgaagaaggaagcctgtatgttctgaagggtggtcgcaccattgagtttgacggggaatttgcagcagatgtcttggtggaatttctcttggacctcattgaggacccagtagagatcgtgaacaacaagttggaagtccaagcctttgagcgcatcgaggaccagatcaagctgcttggctttttcaagaatgaggactcagaatattacaaagcgttccaagaggcagctgaacacttccagccttacatcaagttctttgccacctttgacaagggggtggcaaagaagttgttccttgaagtgaatgaagttggcttctatgagccatttatggatgaacccagtgtcatccctaacaagccctacacagaagaggagcttgtggagtttgtgaaggagcatcaaagacccaccctacgtccgttgcgcccagaggacatgtttgaaacatgggaagacgacttgaatggaatccacattgtggcatttgcggagaagagtgacccagatggctatgagttcctggagatcctaaaacaggttgcccgggacaacactgacaaccctgacttgagcatcttgtggattgacccagacgactttcctctgcttgttgcttactgggagaagactttcaagattgacctgttcaagccacagattggggtggtgaatgtaaccgatgctgacagtgtctggatggagatcccagatgatgacgacctgcccacagctgaggagctggaagactggattgaggatgtgctttctggaaagatcaatactgaagacgatgacaatgaagatgaagatgatgatggcgataatgacaatgacgatgacgatgacgacgatgataattctgatgaggataatgatgacagtgatgatgacgatgatgacgatgaataactccagccccgggtacttctgatgagagtgacatcacaaccaccccgtaccccattacagacagcccaaggggcagcaagcagtggtgcccacacctagtcagctctttttccttctccagcatcttttccaagtccgttcttggcaggagcagtacatttccgtgaatgcctttccaaacccagctgtcccactctgcagggacagaagggggaggggggcggtgattcccatgctgactccttttaactattgaggaacaaacagctcttgttctttgttagataatcaggggtcatggaattc

SEQ ID NO: 3330 - DNA, 1386 bp, Rattus norvegicus
  Genbank Accession No. NM_017134
ctcagctgcaggaaccctggatgagcatgagctccaagccaaagcccatagagattatcggagcgcctttctctaagggacagcctcgaggaggggtagagaaaggtcccgcagcattaaggaaagctggcctggtggagaagcttaaagaaacagagtacaatgtgagagaccacggggatctggcctttgtggatgtccccaatgacagcccctttcaaattgtgaagaacccacggtctgtgggaaaagccaatgaacagctggctgctgtggtagcagagacccagaagaatggaacaatcagtgtggtgctgggtggagaccacagtatggcaattggaagcatctctggccacgccagggtccaccctgacctatgcgtcatttgggtggatgctcacactgacatcaacactccgctgacaaccagctctgggaatctgcacgggcaaccggtggcctttctcctgaaggaactgaaaggaaagttcccagatgtaccaggattctcctgggtgaccccctgcatatctgccaaggacatcgtgtacatcggcttgcgagatgtggaccctggggaacactatataataaaaactctgggcattaagtatttctcaatgactgaagtggacaagctgggaattggcaaagtgatggaagagaccttcagctacctgctgggaaggaagaaaaggcccattcacctgagttttgatgttgatggactggacccagtattcaccccggctacgggcacacccgttgtgggaggcctatcttacagagaaggtctctacatcacagaagaaatttacaagacagggctactttcaggactagatatcatggaagtgaacccaactcttgggaagacaccagaggaggtgactcgtactgtgaacacggcagtgccgttgaccttgtcttgttttggaacgaaacgggaaggtaatcataagccagagactgactaccttaaaccaccgaaataaatgtgaatacatcgcataaaagtcatctggggcatcacagcaaaccgaacagaaccaggccaacgctgctcctcccaagggcttgttcttttagaaaaaagaatgttttttcccaatatgtatgtattctagcagttcctttctggaatgaaattcagggtgtgggaattaaaacagctatgaaattaggagacacgtacttcccattttagcagaagttatccttaagaagtagtataaattaatatctaattaaaaaatgcaccaggagttaaaatacacagtgatgtcaagtgtcaactcacggttggaagcaaaggcatctggagacgaggcctgcatccacgtcgttcaaaacatgtgatttttgtaataaactctttataat

SEQ ID NO: 3331 - DNA, 2199 bp, Rattus norvegicus
  Genbank Accession No. NM_017136
ccggaaggagttcggcaggtctcccggaccccctttgtgaactacattttgggtagaacattttaatcaccgaaacccttctgaggaaaaaaagactcccactgccccctgcaaaaaaacaaaagcaaaaacaaaaaaaccaaaccccaaacccccaaatctcagtcttagctggtgccaccaaagaagcttttgagccatgtggacttttcttggaattgctactttcacctatttttataagaaatgcggggatgtcaccctggccaacaaggagctcctgctgtgcgtactggtgttcctgtcgctgggcctggtgctctcctaccgctgtcgccatcgaaacgggggcctccttggccgccatcagagcggctcccagttcgctgccttctcagatattctctctgctttgcctcttattggcttcttctgggccaaatcaccccctgaatcagaaaagaaagaacagctggagtccaagaggcgcagaaaagaagtcaatctgtcagagacgacgttaacgggagcagctacctcagtatcgacatcatctgtgacggacccagaagtgatcatcatagggtctggtgtacttggctctgctttggcaacagtactctctagagatggaagaacggtgacagtaatcgagagagatttaaaagagcctgacagaatacttggagagtgtctgcagcccggtggctatcgagttcttcgagagctgggccttggagatacagtagaaagtcttaatgcccatcatatacacggctacgtaattcatgactgtgaaagcaggtctgaagttcaaattccatacccggtgtcagaaaacaaccaagtacagagtggggttgctttccaccatggcaagttcatcatgagtctccggaaagcagctatggcagagcccaatgtaaagtttatagaaggtgttgtgcttcggttactagaggaagatgatgctgtgattggtgtgcaatacaaggacaaggagactggggacaccaaggagctccatgccccgctcactgttgttgccgacgggctcttctccaagttcaggaagaacctcatctccaataaagtctctgtttcctcccacttcgttggcttcattatgaaggatgcaccacagtttaaagccaatttcgcggagcttgttctggtcgatcccagtccagttctcatctaccagatttcacccagcgaaactagggtgcttgtcgatattcgaggagaattgccaagaaacttaagagaatacatgacagaacaaatttacccacagatacctgatcacttgaaggaatcatttctggaggcctgtcagaatgctcgtctgcggaccatgccagcaagcttccttcctccttcctcagtgaacaaacgaggcgtcctacttctgggagatgcgtataacctgaggcatcctcttactggtggaggaatgacagtcgctttaaaagatataaaaatatggagacaactgttaaaagatattcctgacctttatgatgatgccgctattttccaggccaaaaagtcattcttttggtcaagaaaaaggagccattcctttgttgtgaacgtgctggctcaggcgttgtatgaactattttctgctacagatgattccttgcgtcagctccgaaaagcttgctttctttattttaaacttggtggagaatgtttgactggtcctgttgggttgctttctatattgtctcctgaccctctcctattgattcgacacttcttctccgttgcagtctatgccacgtatttctgcttcaagtcagagccatgggctacaaaacctcgggctcttttcagtagtggtgctatactgtacaaagcgtgctctataatatttcctctcatctattcagaaatgaagtatctggttcactgaaagggaaaccacatggaagtcattgggacttgaggaggatgtacatagcctaggactgtgtgtgtgacttctgcagtggtgactcaaggaccaagcttgtgtataagcatgtaaatatatgccttaattcacaattgagaatgaagggtcaataagctagatgtttaaaagaatgattgtttccacaaattaatgttaacactcaagtgtttggatttcagtattggggtgattcaattggggacaatgccaaataaaatgaaggagtggaactcctt

SEQ ID NO: 3332 - DNA, 1018 bp, Rattus norvegicus
  Genbank Accession No. NM_017138
gctggaacgggtccgtacggcgttgttcttggttcccatcgtaacttaaaagggaaacttacacaatgtccggaggccttgacgtcctgcagatgaaggaggaggatgtcctcaaattccttgctgcaggaacccacttaggtggcaccaaccttgactttcagatggagcagtacatctacaaaaggaaaagtgacggtatctacatcatcaacctgaagaggacttgggagaagctgttgttagccgctcgagctattgttgccattgagaaccctgctgatgtcagcgtcatctcctccaggaacactggccagcgagctgtgctgaagtttgccgctgccacaggagccactccaattgctggccgcttcacacctgggaccttcactaaccagatccaagcagccttcagggagccccggcttctagtggtgactgatccccgggctgaccaccagcccctcacagaggcctcttacgtcaacctgcccaccattgctctttgtaacacagattctcccctgcgctatgtggacattgccatcccatgcaacaacaagggagctcactcagtgggtctcatgtggtggatgctggccagggaagtactccgcatgcgaggaaccatctcccgggagcacccatgggaggttatgcctgatctttacttctacagggacccagaggagattgagaaggaggagcaggctgccgctgagaaggctgtgaccaaggaggaattccagggtgaatggacggcaccagcgcctgagttcactgctgctcagcctgaggtggccgactggtctgagggtgtgcaggtgccctctgtgcccattcagcagttccccacagaagactggagtgcacagccggccactgaggactggtcagcagctcccacagcacaggctactgagtgggttggagccaccactgagtggtcctgagctcctctgcaggtgcctgagcgaagggaaaaaaggtggaaggaaaataaagttcctgaaagctg

SEQ ID NO: 3333 - DNA, 1481 bp, Rattus norvegicus
  Genbank Accession No. NM_017140
ctctgaagagcctgatttagcccacattgctgtctgtcttttcctaggaacattttggagtcgcgttcctctgtgtgggccatggcacctctgagccagataagcacccacctcaactccacctgcggggcagaaaactccactggcgtcaaccgggcccgtccgcacgcctactacgccctgtcctactgtgctctcatcctagccatcatctttggcaacggcctggtatgtgctgctgtgctgagggagcgtgccctgcagaccaccaccaactacctagtggtgagcctggctgtggccgacctgctagtggccacgttggtgatgccgtgggtggtgtacttggaggtgacaggtggagtctggaatttcagccgcatttgctgtgacgtttttgtcaccctggatgtcatgatgtgtacagccagcatcctgaacctctgtgccatcagcatagacaggtacacagcggtggtcatgccagttcactatcagcacggcaccgggcagagctcctgtagacgtgtggcactcatgatcacagctgtgtgggtgctggcttttgctgtgtcctgccctctcctctttggtttcaacacaacaggggatcccagcatctgctccatctccaaccctgattttgtcatttactcttcagtggtgtccttctacgttcccttcggggtgactgtcctggtctatgccaggatctacatagtcctgaggcaaaggcaaagaaaacggatcctcactcgacagaacagccagtgcatcagtatcagacctggctttcctcagcagtcttcctgtctgaggctgcatcccattcggcagttttcaataagggccaggtttctgtcagatgccacaggacaaatggagcacatagaagacaaacaatatccccagaaatgccaggacccccttttgtcacacctgcagcccccctcacctggtcagacacatggggggctgaagcgctactacagcatctgccaagacactgccttgagacacccaagcttggaaggcggggcagggatgagccccgtggaaaggactcggaactccttgagccccaccatggcacccaagctcagcttagaggttcgaaaactcagcaacggcaggttatccacgtccctgaggctggggcccctgcagcctcggggagtaccacttcgagagaagaaggccacccagatggtggtcattgtgcttggagccttcattgtctgctggctgcccttcttcctgactcacgttcttaatacccactgtcaagcatgccacgtgtccccagagctttacagagccacaacgtggctaggctatgtgaacagtgccctgaatcctgtgatctataccaccttcaatgtggagttccgcaaagccttcctcaagatcctgtcctgctgaaggaggagaagagaccgcactcctttaccacttcgagatgccaggcagtttgaaccctg

SEQ ID NO: 3334 - DNA, 3298 bp, Rattus norvegicus
  Genbank Accession No. NM_017141
cggcaccatgagcaaacgcaaggccccgcaggagaccctcaacggcggcatcacggacatgctcgtggaactcgcaaactttgagaagaacgtgagccaggcgatccacaagtacaatgcatacagaaaagcagcatctgtgatagcaaagtacccacacaaaatcaagagtggagcagaagctaagaaattgccaggagtaggaacaaaaattgctgaaaagattgatgaatttttagcaactggaaaattgcgtaaactggaaaagattcgtcaggatgatacaagttcatccatcaacttcctgactcgagttactggcatcgggccatctgctgcaaggaagcttgtagatgaaggaattaaaacattagaagatctcaggaaaaatgaagataaattgaaccaccatcagcgaattgggctgaaatattttgaggactttgaaaagagaattcctcgtgaggagatgctgcaaatgcaggacattgttcttaatgaagttaaaaagctggatcccgagtacatcgctacagtctgcggcagtttccgaagaggcgcagagtccagtggagatatggacgttctgctgacccacccaaacttcacgtcagaatcaagcaaacagccaaagttgttacatcgtgttgtggaacagttacaaaaagtccgtttcattacagatactcgttcaaagggtgagacaaagttcatgggtgtttgccagcttcccagcgagaatgatgaaaacgaatatccacacaggagaatcgatatcaggttgatccccaaagatcagtactactgtggtgttctctacttcactggaagtgacatctttaataagaatatgagagcgcatgccctggaaaagggcttcacaatcaatgagtacaccatccgccccctgggggtcactggggttgctggggagccccttccggtggacagcgagcaggacattttcgattacatccagtggcgctaccgggagcccaaggacaggagtgaatgacgcctgccccacccaggcctatcccacgaggagtcctaagttattgcttaacctttgctatgtaagggttgggtgttttaggtgattgcctcttctctgtgcttcccatggactatcgtcaatgaacctcttgagcagctattcagtattttcttagcacatgtgtttaaacttagatatgtttgtgatcgcagtaccatggtttactagagaaacgtaagagccgatgtgataagcagtgtttaatgacctttcacttccacctcacattgcagccacagtcggccccacttgtccctatccaccctttatgggtcagctggtctcccagagccatctccagaagtcacttcattatccttagaaacaaggggcttccaggcatggtggtgcacatccttaatcccaggacttgggaggcagagacaggcagatctctgtgagttcaaggccagcccagactacatactgaattcagggtgccagagctacatagtgaggccctatctaaaaagaaaggggccttcatagctgtaagacttctgtgaccatttcccatttgcagtgtatactgataactagaagacagtgtgtgctttacctcaggggcagccttcccctcacagctcaatggcacctaactagcattcatcagtcgtctggtggacagtccactgtttatcaaataacattctgtgacacgaacaaagaacttcaagtttaagaaagatttatttgagcagattgagccactgtgtctggatggctttattgtagagtcctgtcatgttgtagatggtagtcacaaagtcagaagtaactcatcacagcgtctggtcactgtcagttgctagaagattcagctttatttatgtgctgggtataatgtacttgcctgtaatcccaagactcactcgaggcaagaggaacatgagttcgaagcccaccctgggctatatagcttactctgagaccctgtctcagaacccttacccctccccccaaaaattatccaggaggcagaggcaggtgggtctctatgagtgtaaggccagccagggctacacagcgagaccactgtctcagaaaacaaaataaaaaatagaataaaattagtgccagggattctgtgtgaacacgagggacaagtcccatgtctgtacaacttatattctttggcatactcttagccttgtatgttgtcggttaccagtcacctgacttcgacaggacagtccagggaccacagtcacagcgctggaagatttctggggcttgggcagtgtctttgtgccccctcctggaacacacttgtccctctagtagaactggcttgcaaattttggtccaaaaatggcgagcacagcaaagtccagggccgcagtcggaggttctgagacagctttctccctcctgtcctgtaacaaggtaggctcaggctctagaggtggcagatgggttaagggtgtgtgtgtgtgtgtgtgtgtgtgtgtgtgtgtgtgtgtgttatactaatgggttgagattgggatctaggaatgaaggcctatatagcctatatataaactagcaaagccaacaggacacaggtctcacagaataagggaaattagagccctactgaacaaagacatcaaggaatgattatctaccctgagaaataggtagcactccacaaagtttgctaatacagtttttcgtgagcatcgattcctttacttataaaggggccagctagtccaatatgtgagtaggagcggctgttgtacctctccactttcaaatactctgttattcaagactttaactcgagactcctatttttgtttaaaagaatttttgtaaatccccaagtgtggtggcagacacctttaatcccagcagaagccgtcgggtctctgagttcctgaacagtctggtctacacagtgagttctaggatagcagagctacagacccttttgtactatgtacaagtctggagtgaatgcatcttctttaatccactctgtatgctgaggctataggaaaggtacgtggcacttggtacaccccagcttagggaaagccatcggttggaggtttccttcctaagctgtcatcactagggtcttgccctggcctggccaatagagtcccttgaattgctccaagagctcacagacatgaggtaaaggagtttagcttcagcctgtggggctgggagggagaaaatggtttttaaaataaaatatgctctccttaaaaaaaaaaaaaaaaaaaaaaaaaaaaaaaaaaaaaaaaa

SEQ ID NO: 3335 - DNA, 1497 bp, Rattus norvegicus
  Genbank Accession No. NM_017143
gaattcccccacatcatggagagcccggtgcgactcagccttctctatgttgtcctggccagcctcctgctcccggggagaagtgtgtttattaaccgggaacgagccaacaacgtcctgcagaggattcggagagcaaactcattttttgaggagataaagaaaggaaatctggaaagggagtgtgtggaagaaatttgttcttttgaagaggcccgcgaagtctttgaggacaatgagaagacgacagaattctggaacaaatatgaagatggtgaccagtgtgagagcagtccttgccagaaccaaggcgagtgtcgagatggccttgggagttatacatgcacctgcacggagggattcgaaggcaaaaactgtgaactctttgttcggaaactctgcagcctagacaacggagactgcgaccagttctgccgtgaggagcagaactcagtggtgtgctcctgtgccaagggttacttcctgggtaatgacggcaagtcctgcctctccacagctcccttcccctgtggaaaaaccaataaaggacgcgcgaagaggtctgtggccctaaataccagcaacagtgaacctgaccctgaagacctcatgcctgatgcagatattctatatcctactgagagtccttctgaactgctcaatctcaacaagacagagcctgaagcaaacagtgatgacgttattcggattgtgggtggccaagaatgcaagagaggagaatgtccttggcaggctctgctctttagcgacgaagagactgatgggttctgtgggggcaccatcttgaatgagttctacatcctcactgccgcccattgtctccatcaagccaagcgattcaaggtgagggtaggggacctgaacacggaacaggaagacggcggcgagatggtgcacgaggtggatatgatcatcaagcacaacaagtttcagagggacacctacgacttcgacattgccatgctgaggctgaagacccccatcacgttccgcgagaacgtggcccctgcctgcttgcctcagaaagactgggccgaggccacactgatgacgcaaaagacaggcatcgtgagcgggtttggacgcacgcacgagaagggccgccagtccaaagtcctgaagatgatggaggtgccctatgtggaccgcaacacctgcaggctctccaccagcttcagcattacgcagaatatgttctgcgcaggctatgacgccaagcaagaggacgcctgccagggggacagcggtggccctcacgtcacacgattcaaagacacctactttgtgaccggcatcgtcagctggggagaggggtgtgcaaggaaagggaaatacggcatctacacgaaggtcacggccttcctcaaatggattgacaggtccatgaaagccagggtggggcccacctctgagaccccaaggttaacccatccaccctattaaagcagtccttctccagaaaaaaaaacggaattc

SEQ ID NO: 3336 - DNA, 830 bp, Rattus norvegicus
  Genbank Accession No. NM_017144
cgcttgagcagcacagaggggacccaaccctccaaggtcaccagggacacccttctaagaccctccaggaatctgcaatcccattctctacctctggagatcagcatggcggatgagagcagcgatgcggctggggaaccccagccggcgcctgctcctgtccgacgtcgctcctcggccaactaccgagcctatgccaccgagccacatgccaagaaaaagtctaagatctccgcctccagaaaacttcagttgaagactctgatgctgcagattgcgaagcaggagatggagcgtgaggcagaggagcgacgtggagagaagggccgcgttctgagcacgcgttgccagcccttggtgttggatgggctgggctttgaagagcttcaggacctatgccggcagcttcacgctcgtgtggacaaagtggatgaagagagatacgacgtggaagcaaaagtcaccaagaacatcactgagattgcagatctgacccagaagatctatgacctgcgtggcaagtttaagcggcccactctccgaagagtgagaatctcagcagatgccatgatgcaggcactactggggacccgggccaaggaatccttggacctgagggcccacctcaagcaggtgaagaaggaggacattgagaaggaaaaccgggaggtgggagactggcgcaagaatatcgatgcactaagtggaatggaaggccgaaagaaaaagtttgagggctgagcccatggctctcacactgtgctctgaagggcatctctgaggaataaatttctttaaactggaaaaaaaaaaaaaaaaaaaaaaaaaaa

SEQ ID NO: 3337 - DNA, 1039 bp, Rattus norvegicus
  Genbank Accession No. NM_017147
gaaacatggcctctggtgtggctgtctctgatggagtcatcaaggtgttcaatgacatgaaagttcgcaagtcttcaacgccagaagaagtgaagaaacgcaagaaggcagtgctcttttgcctgagtgaggacaagaagaacatcatcctggaggagggcaaggagattctggtaggagatgtggggcagactgtggacgacccctacaccacttttgtcaagatgctgccagacaaggactgccgctatgctctctatgacgcaacctatgagaccaaggagagcaagaaggaggacctggtattcattttctgggcccccgagagtgcaccccttaagagcaaaatgatctatgccagctccaaggatgccatcaagaagaaactgacaggaatcaagcacgaattacaagctaactgctacgaggaggtcaaggaccgctgcaccctggcagagaaactaggtggcagcgccgtcatttccctggagggcaagcctttgtgagccacctccagccccctgcctggagcatctagcagccccagacctgctcttgggtgttgcaggctgcccttttcctgccagaccggaggggctgggggggttccagcagggggagggttttcccttcaccccagttgccaaacatccctcccaccccctggaccgtccttttccctccatccctgacggttctggccttcccaaactgcttttgatcttctgattcctcttgggttgaagcagaccaagtcccgtcctaggcacccagtttggggggagcctgtatttttttttttaacgacacccctactcctgatctgtcccatcccatgctgccaacttctaaccacaatagtgactctgtgcttgtctgtttagttctgtgtgtaaatgaactgtggaaatgaccctccctgcaccagctggttgccctcccctttccctttgatcttggccactcatggaagcaggaccagtaagggaccttcaatttaaaaaaaaaaaaaaacacaataaaaaggctaattaacaaa

SEQ ID NO: 3338 - DNA, 630 bp, Rattus norvegicus
  Genbank Accession No. NM_017150
tcttccggtcccaggcgctcggggagccgcggcttaccgtgcagacatggccaagtccaagaaccacaccacacacaaccagtcccgcaaatggcacagaaatggcatcaagaaaccccggtcacaaagatacgaatctcttaaaggggtcgaccccaagtttctgaggaacatgcgctttgccaagaagcacaacaagaaaggcctgaagaagatgcaggccaacaatgccaaggcagtgagtgcacgagcagaggccatcaaggccctcgtgaagcctcaggctgtcaagcccaagatgccaaagggctccagccgcaaactcagccgtctggctttcatcgctcaccccaagcttgggaagaagattcgaagctacatggccaagggtcgtaggctctgccaaccaaagcccaaggttcaaaccaaggcagaggccaaagctccagctaaggcccaggccaaagctccagcccaggctcccaagggtgcccaggcccctgtgaaggccccatagaacaggctcctgccagtgtgaagacagacagactgctgtgacacacccacctacacactatctgcagatgaccagtgtcctatgctgtttttacaaataaacttgagacaaga

SEQ ID NO: 3339 - DNA, 487 bp, Rattus norvegicus
  Genbank Accession No. NM_017151
tttttcccagcagccgccaagatggccgaagtggagcagaagaaaaagcgaaccttccgcaagttcacctaccgtggcgtggacctcgaccagctgctggacatgtcctatgagcagctgatgcagttgtacagcgcccggcagagacggcgcctgaaccgaggcctgcggaggaagcagcactcactgctcaagcgcctgaggaaggccaagaaggaggcgccacccatggagaagccggaggtcgtgaagacccaccttagggacatgatcattctgcccgagatggtcggcagcatggtgggtgtgtacaacggcaagaccttcaaccaggtggagatcaaacccgagatgatcggccactacctgggcgagttctccatcacctacaagcctgtgaagcacggccggcccggcattggtgccacccactcctcccgatttatccccctcaagtagtggggacaataaagactcgttttcagcc

SEQ ID NO: 3340 - DNA, 466 bp, Rattus norvegicus
  Genbank Accession No. NM_017152
cctcttttaccgagacccgtcaacatgggccgcgttcgcaccaagactgtgaagaaggcggcccgggtcatcatcgagaagtactacacgcgcctgggtaatgactttcacaccaacaagcgcgtgtgcaaggagatcgccatcatccccagcaaaaaccttcggaacaagatagccggctatgtcacgcatctgatgaagcggattcagagaggtcctgtgagaggcatctccatcaagttgcaggaagaagagagggagaggagagataattatgttcctgaggtctcagccctagatcaggagatcattgaggtagatcctgacaccaaggaaatgctgaagcttctggactttggcagtctctccaacctccaggtcactcagcctacggttgggatgaatttcaaaacaccacgtggagctgtttaatccattatgccatattttcaataaacctgaaaac

SEQ ID NO: 3341 - DNA, 880 bp, Rattus norvegicus
  Genbank Accession No. NM_017153
ccttttggctctcagagcggcaccatggcggtcgggaagaacaagcgcctgacgaaaggtggcaagaagggagccaagaagaaagtggttgatccattttctaagaaagactggtatgatgtgaaagctccagcaatgttcaatattaggaacatcgggaaaacactagttacaaggactcaaggaaccaaaattgcatcagatggcctcaagggtcgtgtgttcgaagtgagtcttgcagatctacagaacgatgaagttgcatttagaaagttcaagctaattactgaggatgttcagggcaaaaactgtctgactaacttccatggcatggatcttacccgggacaaaatgtgctccatggtcaaaaagtggcagaccatgattgaagctcatgttgatgtgaagacgaccgatgggtatttgctccgacttttctgtgttggtttcactaagaaacgtaacaaccagattagaaagacatcctatgcgcagcaccagcaggtccgccagatccgcaagaagatgatggagatcatgacccgagaagtgcagacaaatgacttgaaggaagtagttaataaactgattccagacagcattgggaaagacatagagaaggcttgccagtccatctatcctctccatgacgtttttgttaggaaagtcaaaatgctgaagaaacccaagtttgaattgggaaaactcatggagctccatggtgaaggcggtagttctggcaaaacaactggtgatgagacaggtgctaaggttgaacgagctgatggctatgaaccaccagtccaagaatccgtttaaaatccagatttttaatagcgacaaataaaaagtcctatttgtgaaaaaaaaaaaaaaaaaa

SEQ ID NO: 3342 - DNA, 4198 bp, Rattus norvegicus
  Genbank Accession No. NM_017154
agagctcagtgactccagcagccacgatgactgcggatgagttggtcttctttgtgaatggcaaaaaggtggtggagaaaaatgcggaccctgaaacaacacttctggtctacctgagaagaaagttggggctatgtgggaccaagcttggctgtggagaaggtggctgtggggcatgcaccgtgatgatctccaagtatgaccgtcttcagaacaagattgttcatttttctgtcaatgcctgcttggctcccatctgctccttgcaccatgttgctgtgaccaccgtggaaggcataggaaacacccagaagctgcatcctgtacaggagagaattgccagaagccatggttcccagtgtgggttctgcactcctggcattgtcatgagtatgtacacactgctccggaaccagcctgagcctactgttgaggagatcgagaatgccttccaaggaaacctctgtcgctgtacaggctacagacccatcctccagggattccggacctttgccaaggatggtgggtgctgtggagggagtggaaacaacccaaactgctgtatgaaccagacgaaagaccaaacggtttctctctcaccttctttattcaacccagaggatttcaaacctttagatcccacgcaagagcccatcttccccccagagttgctgaggctgaaagacactccccagaagaagctgcgttttgaaggggaacgtgtgacctggatccaggcttcaactatggaggagctgcttgacctgaaagctcagcaccctgatgccaagctggtggtgggaaacacagagataggcattgaaatgaaatttaagaatatgctatttcctctgatcgtctgcccagcctggatccctgaactgaattcagtggtgcatgggcctgagggaatctccttcggagcttcttgcccccttagcttggtggaaagtgtcctggcggaggagattgctaaacttccagagcaaaagacagaggtgttcagaggcgtgatggagcagctgcgctggtttgccggcaagcaggtcaagtccgtggcgtccatcggagggaacatcatcactgccagccccatctctgacctcaaccctgtgttcatggccagtggagccaagctgactctggtgtctagaggtaccaggagaactgttcggatggatcataccttcttccctggctacagaaagactctgctcagaccagaggagatattgctgtccatcgagatcccctatagcaaggagggagagtttttctcagccttcaagcaggcctccaggagggaagatgacattgccaaggtgactagtggcatgagagtcctgttcaaaccggggaccattgaagtgcaggaactgtccctttgcttcggagggatggccgacagaactatctcagccctcaagaccactccgaagcagctatcgaagtcctggaatgaggagctgctgcagagcgtgtgtgccggcttggcagaggagctgcagctggcccccgatgcccctggtggtatggtggaattccggcgcaccctcaccctcagcttcttcttcaagttctacctgacagtgctccagaagctgggcagagcggaccttgaggatatgtgtggtaaactggaccccacctttgccagtgccaccctgctctttcagaaggaccctccagctaatgtccagcttttccaagaggtgccaaaggatcagtctgaggaggacatggtgggccggcccctgcctcacctggcggcaaacatgcaggcatcgggagaggccgtgtactgtgatgacattccccgctatgagaatgagctctctctcaggctggtcaccagcacccgggcgcatgctaaaatcacgtccatcgacacttcagaagccaagaaggtgccagggtttgtttgcttcctcaccgcagaggatgtccctaatagtaatgcaaccggccttttcaatgatgaaactgtctttgcgaaggatgaggttacttgtgttgggcacatcattggtgctgtggtcgctgacaccccagaacacgcacagagagctgcgagaggggtgaaaatcacctatgaagatcttccagccattatcacaatccaggatgctataaacaacaactccttttatggctctgagataaaaattgagaaaggagatctcaagaaaggcttttcagaagctgacaatgttgtctcaggagagttgtatatcggtggccaggagcacttctacctggagaccaactgcaccattgccgtgccaaaaggcgaggcaggcgagatggagctgttcgtgagcacacagaacaccatgaaaacccagagctttgttgcaaaaatgttgggcgttccggacaacagaatcgtagtccgagtgaagaggatgggtggaggctttggagggaaggagacccggagcactgtggtgtccacagcactggccttggctgcacacaagactggccggcccgtacgttgcatgttggaccgagatgaggacatgctgataactggtggcagacatcccttcctggctaaatacaaggttggcttcatgaagactgggactgtagtggctctcgaggtggctcacttcagcaatggtggtaacactgaggatctctctcggagtataatggaacgagctttgttccacatggataacgcctataagatccccaacattcgaggcactgggaggatttgcaagactaatctgccctccaacacagccttcagaggttttgggggtcctcaggggatgctaatcgcagaatactggatgagcgaggtcgccataacctgtgggctgcctgcagaggaggtacggaggaaaaacatgtacaaagaaggggacctgactcacttcaaccagaagctggaggggttcaccttgcccaggtgctgggatgaatgcatcgccagctctcagtatcttgctcgcaagagggaagtggagaaattcaacagggagaattgttggaaaaagagagggctgtgtataatcccaactaagtttggaataagctttacacttccttttctgaaccagggaggcgctctggttcacgtgtacactgatggttcggtgctgttgacccatggagggactgagatgggccaaggccttcacaccaagatggttcaggtggccagcagagctctgaaaatccccacctccaagattcatataagtgagacaagcactaacaccgtccccaacacttctcccacagctgcctctgccagtgctgacctcaatggacagggtgtttatgaagcatgccagaccatactgaaaaggctggaacctttcaagaagaagaaacccaccggcccctgggaggcatgggtgatggacgcctatacgagcgcagtgagtttgtccgcaactggattttataagacacccaaccttggctacagctttgagacaaactccggaaatcccttccactatttcagttatggggtggcttgctctgaagtagaaattgactgcttaacaggggatcataagaatctccgtacggatatcgtcatggatgttggttccagcttgaatcctgccattgatattggacaagtagagggggcatttgtccagggccttggtctcttcactatggaggagctgcactactcccctgaggggagcctgcatactcgtggccccagtacctacaaaatccctgcatttggtagcatccccattgagttcagagtatccctactccgggactgccccaacaagagggccatctatgcatccaaggctgttggggagccacctcttttcctggcttcctctatcttctttgccatcaaagatgccattcgtgcagctcgagctcagcacggagataacgcaaaacaacttttccagctagacagccctgccactccggagaagatccgaaacgcctgtgtggaccagttcaccaccctgtgtgtcactggagtaccagaaaactgtaaatcctggtctgtgaggatctgaagagaaggtctccaccattggtttgtaccgcaccaggattccttggagccacaagcacatcctgtagtatccagatttccgcatgccgcgtgggactcagcaggatgacattttcaggaagatggacattttgacccaaataagagctgcaaacaaaccaataagcaaatggggag

SEQ ID NO: 3343 - DNA, 1731 bp, Rattus norvegicus
  Genbank Accession No. NM_017158
ggcatcagtaaggagggtctccatggatctggtcactttcctggtacttactctctcctctctcattctcctctcactctggagacagagctctaggagaaggaagctccctcctggccccactcctctcccaataattggtaatttcctccagatagatgtgaagaacatcagccaatccttaaccaagttttcaaaaacctatggccctgtgttcactctgtatttgggctcacagcccactgtcatattgcatggatatgaagcaataaaggaagctctgattgataacggggagaagttttctggtagaggaagctatccaatgaatgaaaatgttactaaaggttttggcattgtttttagcaatggaaacagatggaaagagatgagacgattcacaatcatgaactttcggaatttgggaattggaaaaaggaacattgaggaccgtgttcaagaggaagcacagtgcctagtggaagaactgaggaaaacaaaaggctcaccctgtgacccctccttgatcctgaactgtgctccatgcaatgtcatctgctccattactttccagaatcattttgattataaagataaggaaatgcttacgttcatggaaaaagtgaatgagaatctcaagattatgagctccccatggatgcaggtctgcaatagttttccttcactcattgactattttcctggaactcatcacaaaatagcaaaaaatattaattatatgaaaagctatttgttgaagaaaatagaagaacaccaggaatcattggatgttacaaaccctcgtgattttgttgattattacctgattaaacaaaaacaggcaaacaacatcgaacaatcagaatattcacatgaaaatctgacatgcagtatcatggatctcattggtgcagggacagagacaatgagcacaacattgagatatgctctcctgcttctgatgaagtacccacatgtcacagctaaagtccaggaagagattgaccgtgtgattggcagacatcgcagcccctgcatgcaggatagaaaacacatgccctacactgatgccatgattcatgaggtacagagattcattaactttgtcccgaccaacctgccccatgcagtgacctgtgacattaaattcaggaactacctcatcccgaagggaacaaaagtgttaacatcactgacatcagtgctgcatgacagcaaggagttccccaacccagagatgtttgaccctggccactttctagatgagaatggaaactttaagaaaagtgactactttttgcctttctcagcaggaaaacgagcttgtgttggagagggcctggcccgcatgcagttgtttctattcttgacaaccattttacagaactttaacctgaaatctctggttcacccaaaggacattgatacgatgccagttctgaatggttttgcctctctgccacccacttaccagctctgcttcattccttcctgaatagatcaggcattttggcttctactgtgttgccttctgcaatccccttcaggtttttatccagtcccttccctctatcatccatcctgactcttgtcttaagatccagaaagcacatgcagtttctggagttatagcacaaatccacttgtattatctctttcatataacaatttatgatcccttgtgtcattgtgtatccattcctgagttaaaataaagcttcactataaaat

SEQ ID NO: 3344 - DNA, 2136 bp, Rattus norvegicus
  Genbank Accession No. NM_017159
ggtgagccatgcctaggtacacggtgcacgtgcgtggggaatggctggcggtaccctgccaggacgggaagctcagtgttggctggctgggccgcgaggctgtgcggcgctacatgaagaacaagccggacaacgggggcttcacctcggtggatgaagtgcgattccttgtgcgccggtgcaagggcctgggcctgttggacaatgaggacctgctggaggtggccctggaggacaatgagttcgtagaagtggtgattgaaggcgatgtaatgtctcctgatttcattccatcacagccagaaggcgttttcctttacagcaaataccgggagcctgaaaagtacattgccttggatggggacagtctgagcacggaggatctggtcaacctaggcaagggacattacaagataaagctcacttcaatagctgagaagaaagtgcagcagtcccgggaagtcattgacagcatcataaaagaaagaacagttgtttacggcatcaccacgggttttggaaaatttgccagaactgtgatccctgccaataagctacaggagcttcaggtcaacttagtccgttcccattcttcaggtgttgggaagccactcagtcctgagaggtgtcggatgctcttggctttgaggatcaatgtcttagccaaaggatacagtgggatttccttggagaccctgaaacaagtgattgaagtatttaatgcctcctgcctgtcctatgttccagagaaagggaccgttggtgccagcggagaccttgccccactctcccatcttgctttggggctcattggagaaggaaagatgtggtccccaaagagtggctgggccgatgccaaatatgtcttagaagcccacggattgaaaccaattgttctgaaaccaaaagaaggcctggcactcatcaacgggacacagatgatcacttccctgggctgtgaagccgtggagcgagccagcgccattgcccggcaagcggatatcgtggctgccttgaccctcgaggtgctgaagggcaccaccaaagccttcgataccgacatccacgccgtccgccctcaccgcgggcaaattgaagttgctttccggttccggtccctcttggactcagatcaccacccgtcagaaattgcagaaagccacaggttctgtgatcgtgttcaggatgcgtacaccttacgctgctgtccacaggtccacggtgtggtgaacgatacaattgcctttgtgaaggacatcatcaccacagaactgaacagtgccacagacaatcctatggtctttgccagtcgaggggagacaatttcgggaggaaacttccacggtgaatacccagccaaagccctggactatttggccattggcgtccatgaacttgcggcaattagtgaaagaagaatcgaaaggctgtgtaatccttccctcagtgagctgcccgccttcctggtggctgaaggaggtctcaattctggattcatgatagcccactgtaccgcagcagccctggtgtctgagagcaaggctctgtgccacccttcatctgtggactcactctctaccagtgctgccacggaggaccacgtctccatgggaggatgggcagccaggaaagctctcagggtcatcgagcacgtggaacaagtgctggccattgagcttctcgcggcctgccagggcatagagtttctgcgccccttgaaaacaaccactccgctggagaaggtgtacgacctggtgcgctccgtagtaaggccctggatcaaagatcgcttcatggccccggacatcgaggcagcacacaggttgcttcttgaccagaaggtttgggaggtggctgccccgtacatcgagaaatacagaatggagcacattccggaatccagaccgctttctccaacagcgttttcactagaatctctgaggaagaattcagccacaatcccagagtctgacgatctttaacgggcttcctcgagaacaggcacatgtgtcggatctgggcacatcactggtgtggtgacggagagtctcaggaaccgcccatgatgtgtagaactcatctcttttcaaacaaactctggttaaatcatggcagcaatacagtcattgaacccag

SEQ ID NO: 3345 - DNA, 801 bp, Rattus norvegicus
  Genbank Accession No. NM_017160
gtcggctgtgtcaagatgaagctgaatatctccttccctgccactggctgtcagaaactcatagaagtggatgacgaacgcaagcttcgtacgttctatgagaagcgcatggccacagaagtagctgctgatgctcttggtgaagagtggaagggttatgtggtccggatcagcggtgggaatgacaaacaaggttttcccatgaagcaaggcgttttgacccatggcagagtgcgcctgcttttgagtaaggggcattcttgttatagacctaggagaactggagagaggaagcgcaagtctgtccgaggatgcattgtggatgccaacctgagtgttctcaacttggttattgtaaaaaaaggagagaaggatattccaggactgacagataccactgtgcctcgtcggttgggacctaaaagagctagtagaatccgaaagctttttaatctctccaaagaagatgatgtccgccagtatgttgttagaaagcccttaaacaaagaaggtaagaagcccaggaccaaagcgcccaagattcagcgtcttgttactccccgtgtcctgcaacacaaacgccgacgtattgctctgaagaagcaacgcactaagaaaaacaaggaggaggctgcagaatatgctaaacttttggccaagagaatgaaggaagccaaagagaagcgccaggaacagattgccaagagacgtaggctgtcttcgctgagagcttctacttctaaatctgagtccagtcaaaaataagtctttaaagagtaacaaataaataatgagaccttg

SEQ ID NO: 3346 - DNA, 1859 bp, Rattus norvegicus
  Genbank Accession No. NM_017161
ggcacgagcggtctcggcgctgtggccatgcctggcggcaccttagcggctgtcctgagcccgacacaaccccggtagaggactccccgggcccggctggcccggccatgcagctagagacgcaggacgcgctgtacgtggcgctggagctggttatcgccgcgctggcagtggcgggcaacgtgctggtgtgcgctgcggtgggagcctcgagtgctttacagacccccaccaactactttctggtgtccctggcgacggcggacgtggctgtgggactcttcgccatcccctttgccatcaccatcagcctgggcttctgcacggactttcacagctgcctcttcctcgcctgcttcgtgctggtgctcacacagagctccatctttagcctcttggcggtggctgtcgaccggtatctggccattcgcgtcccgctcaggtataaaggtttggtcactggaacacgagcaagagggatcatcgctgtcctctgggtccttgcctttggcattggactgactcctttcctgggttggaacagtaaagaccgtgccaccagcaactgcacagaacctggggatggcatcacgaataagagctgctgccctgtgaagtgtctctttgagaacgtagttcccatgagctacatggtttatttcaacttctttgggtgtgtccttcctccactgctcatcatgatggtgatctacatcaaaatcttcatggtggcctgcaagcagcttcagcacatggaactgatggagcactccaggaccacgctgcagcgggagatccacgcggccaagtcactggctatgattgtgggcatctttgctctgtgttggctccccgtgcatgccatcaactgcatcaccctcttccatccagccctggccaaggacaagcccaaatgggtgatgaatgtggccatcctcctgtcacacgccaattcagttgtcaatcccattgtctatgcctacaggaaccgggacttccgctacagtttccacaggatcatctccagatacgttctctgccagacggacaccaagggtgggagcgggcaggccgggggacagtcaactttcagtctgagcttgtgacctaggctctggcctttgggagaagaaggcttaaaataaacaatggactggacacagctggtgacctcactgtggaggacaactaccctctcaagcatgtggcccacctgccctgaacgcttgccaggagtcacacaagtctggctcacacgtacatgcaactaggaggccctgaggctaacagatacacttaggaatctattcagctgctcttacttactgtgtggatggcgggcggctagaactgattccaaaaactgttttatttttaagaatctgcctcattcgtggtagaaaaatgactgaaacttaccttactgtgaaacactgtgaactatataatgtaagtatttttcacttacagcaatgggaaaataaaagttggctctattaacatatactcattccggggacagcaactcagaaaactgaagtataattcttcagtcaagatactgtagtgttaatttagggaatggtactaccctaagtttgaaagtagaattatgtaacaaaacaatttgagttcagtatcttccttgcccacaaaacactagaggtggaaacttggagagctgggtccttcctccactgcacccctgctttagagctaggtactagagtttgcttctctctcacattacagtttattggatcccaaagtatgaaaattttactgagcaaaatcccctagctgtgtattatatccagtgaaataaaactttgaaaggtgaaaaaaaaaaaaaaaaaaaa

SEQ ID NO: 3347 - DNA, 872 bp, Rattus norvegicus
  Genbank Accession No. NM_017165
gactcggcctcgcgcgtccattggtcggctgcgtgaggggaggagccgctgcccgccgagatgagctggggccgtctgagccgcttattgaagccagcactgctgtgcggggctctggctgtgcctggcctggctggcaccatgtgtgcatcccgcgatgattggcgctgtgcgcgctccatgcacgaattctcagccaaggacatcgatgggcacatggtttgcctggataagtacaggggttgcgtgtgcatcgtcaccaacgtggcctcgcaatgaggcaaaaccgacgtaaactacactcagctagtcgatctgcatgcccgatacgccgagtgtggtttacgaatcctggccttcccttgcaaccagttcgggaggcaggagccaggaagtaatcaagaaatcaaggagtttgcagccggctacaatgtcaggtttgacatgtacagcaagatctgtgtaaatggggacgatgcccacccactgtggaaatggatgaaagtccagcccaagggcaggggcatgctgggaaatgccatcaaatggaactttaccaagtttctcattgataagaacggctgcgtggtgaagcgctatggtcccatggaggagccccaggtgatagagaaggacctgccgtgctatctctagccctacaagtgttggcccctgcaccgagcccccctgccctgtgacccctggagccttccaccccggcactcatgacggtctgcctgaaaaccagcccgctggtggggcagtcccgaggacctggcgtgcatccccgccggaggaaggtccagacgctgtggccccgggctcgaggcttcaccttggctgccttgtgggaataaaatgtagaaatgtgc

SEQ ID NO: 3348 - DNA, 1054 bp, Rattus norvegicus
  Genbank Accession No. NM_017166
ggtccgagccgcctggcttaggcggaggcgacggcagggtagggagcagccgggaacgcggcgagcccctagccggggacacgggacgggcggagacctcgagccctgggctttccttgccagtggattgtgtagagtgtacagccagtctcttgtcttctgtccaacatggcatcttctgatattcaggtgaaagagctggagaagcgagcttccggccaggcttttgagctgattctcagccctcgatcaaaagaatctgtccccgagttccccctttcccccccaaagaagaaggatctttccctggaggaaattcagaagaaattagaagctgcagaagaaagacgcaagtctcatgaagcagaagtcttgaagcagctcgctgagaagcgggagcatgaaaaagaagtgctccagaaagccattgaggagaacaacaacttcagcaaaatggcagaggagaaactgacccacaaaatggaggctaacaaagagaaccgggaggcgcaaatggctgccaagctggagcgtttgcgagagaaggacaagcacgttgaagaggtgcggaagaacaaagaatccaaagaccccgcggacgagaccgaggctgactaagttgttccgagaactgactttctccccgaccccttcctaaatatccaaagactgtactggccagtgtcatttactttttcctccctgacaaatattctagaagctgatgtaggaaccgtataggtagatccagaccgtgagatgttttaggggctcaaggggagaaactgaaagtgttttgctcttttttaaagtgttggtctttctaacgtagctatttttctcgttgcatcttttcctctcgggcacactcggtgtgctgggttaatggctagtgctgtattgactgtggaagacgttcgtgaagagtatgtagtggcttcttccaacccattagatgctgagtatctgttcactttgcgatcccaattctgtcccaatctcaccagatgctactgtactggaatggttaataaactgcacagtgctgttggtc

SEQ ID NO: 3349 - DNA, 931 bp, Rattus norvegicus
  Genbank Accession No. NM_017170
atctgaagagcatagggggccaccacactttcgtcccatacccaagcaacagctgctgctgctgtcataccctggaccaagcatggacaagctgctgctttggatgtctgtcttcaccagccttctttcagaagcctttgctcagacagacctcaatcagaaggtatttgtgttccccagagaatctgaaactgattatgtgaagctgatcccatggctagaaaaaccgctgcagaattttacactgtgtttccgagcctacagtgacctttcccgctctcagagtcttttctcctacagtgtcaacagcagagacaatgagctactaatttataaagcaaagttggaacaatatagcctatacattggaaattcaaaagtcacagtccgtggtttagaagaattcccttctccaatacatttctgtaccagctgggagtcctcctctggtattgctgaattttgggtcaatggaaagccttgggtaaaaaagggtttgcagaagggatacactgtgaaatcctcacccagtattgtcctgggacaggagcaggatacgtatggaggagggtttgataagacacagtcctttgtgggagagattgcagatttgtacatgtgggacagtgtgctgaccccagagaacattcattctgtggacagaggtttcccacccaatcctaatattttggattggcgggccctgaattatgaaataaatggttatgtagtcatcaagccccgtatgtgggacaacaaaagctcatgaaaatgagatgatcagggtgttcgaggtcaaggtggcagaactcactctatctggagttttttcttctttatgaatgtcctgtctaaatatctgccaaataaaaatcctatcaaattctaaaaaaaaaaaaaaaaaaaaaaaaaaaaaaaaaaaaaaaaaaaa

SEQ ID NO: 3350 - DNA, 2741 bp, Rattus norvegicus
  Genbank Accession No. NM_017172
ccgggagcaggcgtgtgggactcctgaccggagagccggaggctgcgccttccccgcaccgggaccttcacgacacaacagatcctagtccttgccccgtgcgaacgcccacgatgaccaccaccctcgtgtccgccaccattttcgacttgagcgaagttttatgcaagggtaacaagatgctcaactacagcactcccagtgctgggggctgcctgctggacaggaaggcagtgggcacccctgctggcgggggcttccctcggaggcactcggtcactctgcccagctccaagttccatcagaaccagcttctcagcagtcttaagggtgagccggccccgaccctgagctcacgcgacagccgctttcgagaccgctctttctccgaagggggcgagcggctgctgcccactcagaagcagcctgggagcggccaggtcaactccagccgctacaaaacggagctgtgccgccccttcgaagaaaacggtgcctgtaagtacggggacaagtgccagttcgcgcacggcatccacgagctccgcagcctgacccgccaccccaagtacaagacggagctgtgccgcaccttccacaccatcggcttttgcccttatgggccccgctgccacttcattcacaacgccgaggagcgacgcgccctggcggggggccgggacctctccgctgaccgtccccgcctccagcatagctttagctttgctgggtttcccagtgccgctgccaccgccgctgccacggggctgctggacagccccacgtccatcaccccaccccccatcctgagcgccgatgacctcttgggctcacctaccctgcccgatggcaccaataaccccttcgccttttccagccaggagctggcgagcctctttgctcctagcatggggctgcccgggggaggctcccccaccaccttcctcttccggcctatgtccgaatcccctcacatgtttgactctccccccagccctcaggattctctctcggaccatgagggctacctgagcagctccagcagcagccacagtggctcagactcccctaccttggacaactcaagacgcctgcccattttcagcagactctccatctcagatgactaagccagggtagggagggaccccctgcctccttcacctctccaccctgcaccccatcccataccttcacctccccaccccctaactttccttcaaaccctacattcatacatttaagctcaacccctttcccagaaccttggtatgttacccttcccccaacataaggacaagtcaatttgttggtagcttctggcttgaaaaccccctccctccatttcatagcccacttaaccacgcataacagagtcccatctttgtcagtagatgccttttttttcggcttaagccttaagtgccaaatcacaaaagaaaaaaagcagtaaccgtttacagaagcaacttagtgccttgtaatctaactttggtcactgtgactacattacctcttcaacgccagggggcacccgtgggcctcccagagcctctgcccgtggggtttgggggcgggggagcggtgacccgcaaccagcagctccctcagctggccacacaagtgcaccttcctttcagtctcccgcacattcttcctcttccttgtagatacttgcctccctcagagaattgttgctggacttggggggggcgggggtttgggtgggtggggacctattttgacattcaaaaccttttttttcccagctcgaacccctgttgactaatcttgcctgggtttgtgtaggtctccagggacaaaggttgaacaagttggacgaaggttttgacataagtgggactttgtgatttaatttcttttttttctttttctttcttttttttttaagtggggaggaaggggaaactagatggactatgagagacttgattttggtgctaaagttccccaattcatatgtgtacatcttaaaaatgacaacaaatgagagaaaagctaaaaaaaaaaaaaaaaaaaaaagaagaaaacctatgtaaggggtgagcagtaatggtattcattccacatacaatatctgtgtaaaaacaatttcctgtagacgtagctttaatggattttgctctagaataccttaggtctaccttagagccctcacgccatgcttttgtccctgggtttaaacttcatctaactttcagaaattggagagcaaaaatgttgctttatcactgcacatcaatataaaaaagcttatttaacttatcaagacgtatttattgccaaactatgctttttttttgttaattttgttcatatttatcgggatgacaaatccatagaatatattcttttatgttaaattatgatcttcatattaatcttaaaattttgtgacgtgtctttccttttttttttccacagttttaatatattattcttcaacaacatttttgtaactttacacttttttttggttattttattttaaaaaaatgaaaaattaatttaaaaaaaatgcaaaaaactgttggattatttattttagaaattctcccctttgtgttggactgcaaattgagtttctttctccttaggcctttcacaggtaggactgagaatgtataagttctgtgacagtacagaaggaaaaccaccatttatgtatagcttctaaaagggaaaacaaaaaaaaaaagagagagagagaaaaacccttt

SEQ ID NO: 3351 - DNA, 3035 bp, Rattus norvegicus
  Genbank Accession No. NM_017175
gaattccgccgagcgcagcaggccggatcgcgcagcgcgccagggaaggtctgggctccgcgcttcccgccccacacgccgacgcgctcgcaagccctccctcggcgctgggacccctggcggacatggccggcgacgccgtgcagagtgaacctcgcagctggtcactgctggagcagctgggtctggctggggcagacctggcagcccctggggtgcagcagcagctggagttagagcgagagcggctgaagcgggaaatccgaaaagagctgaagctgaaggagggcgctgagaacctgaggcgggccaccactgacctgggccgcagcttggcccctgtggaactgctgctgaggggctccgctagacggcttgacttgctgcaccagcagctgcaggagctgcatgcacatgtggtgctgcccgaccctacagcggggagtgatgctccccaatcccttgcagagggcagccctgtctgctcatccaccaacctgagccgagtggctggcctggagaagcagctggccattgagctcaaggtcaaacagggggcagaaaacatgatccagacctacagcaatggcagcaccaaggaccggaagctgctgttgacggcccaacagatgctgcaggatagtaagaccaagattgacatcatccgcatgcagcttcgccgggcgctacaagcactccaggctggccagctggagagtcaggcagctcctgatgaggcccacggagatccagacctgggagccgtagagctacgcattgaggagctacgacaccattttcgagtagagcatgcagtggcagaaggcgccaagaatgtcctgcgtctgctcagtgctgcaaaggccccagaccgcaaagcagtcagcgaggctcaggagaaattgactgagtccaaccagaagctgggcttgctgcgggagtcactggagaggcgcttgggggaactgcctgctgatcaccccaagggacgcctgcttcgggaggagctcactgcggcctcatcggcagccttcagtgcaatactgcctgggcccttccctgccactcactacagcaccttgagcaagcctgcaccactcacagggaccctggaagtacgagtggtgggctgcaaaaaccttcccgagaccatcccttggagccctcccccctcagtcggggcatctgggacccccgacagccgcactcctttcctgagtcgtccagctcggggcctttacaaccgaagtggaagccttagtggacggagcagcctcaagggggaggcagagaattccactgaggtcagcaccgtgctcaagctggacaacactgtggtggggcaaacagcctggaagccatgcggccccaatgcctgggaccagagcttcaccctggagctggagagggctcgggagctggagttggctgtgttctggcgtgaccagaggggtctgtgtgctctcaaatttctgaagttggaagacttcttggacaatgagaggcatgaggtgcagctggacatggaaccccagggctgcctggtggctgaggtcaccttccgtaaccccatcatcgagcggatccctaggctccaaaggcagaaaaaaattttctccaagcagcaagggcagacatttcagcgtgccagacacatgaacatcgatgtggccacctgggtgcggctgctccggagactcatcccgaacgccgtggccactggctccttcagccccaatgcatctccaggctctgagatccggagcactggagacatatccatggagaaattgaatctcggtgctgactcagacagctcgtcccagaagagccccgcagggctgccctccacctcatgtagcctgagttctccaacccacgaatccaccacctctccagagctgccttcagagacccaggagaccccaggccctggcctgtgcagtcccctgaggaagtcgcccctgacgcttgaggacttcaagttcctggcagtgcttggtcggggtcactttggaaaggtgctgctgtctgaattccactccagtggggagctctttgccattaaagccttgaagaaaggtgacattgtagcccgggatgaggttgagagcctgatgtgtgagaagcggattttggcgaccgtgaccagggcaggacatcccttccttgtgaaccttttcggctgtttccagaccccagagcatgtgtgctttgtgatggagtactcagccggtggggacttgatgctgcatatccacagcgacgtgttctcagagcctcgggctggcttctattcggcctgtgtggtgctgggactgcagttcctccatgaacacaagattgtctacagggacctgaagttggacaatttgctcctggatactgagggctacgtcaagatcgcagactttggcctctgcaaggaggggatgggctatggggaccggaccagcacattctgcggaactccggagttcctggcgccggaagtgctcacagacacatcctacactcgagccgtggactggtggggactgggtgtatttctctatgagatgctggttggagagtctccgttccctggggacgacgaggaggaagtatttgacagcatcgtcaatgatgaggttcgttatccccgcttcctgtctgcggaggccatcggcatcatgagaaggctactgcggaggaacccagagcggaggttgggatccactgagcgtgatgcagaagatgtgaaaaaacagcctttcttcaggactctggactgggatgccctgctggcccgtcgcctgcctccacccttcgtgcctacactttcggggcgcacagacgtcagcaacttcgatgaggagttcactggggaggcccccacactgagccctccccgggatgcacggcccctgacagctgcggagcaggcggccttccgggatttcgactttgtggcaggaggctattagccctaagcccctgccttgcccaagagttcttggtttttaaaaaagcctttggggtttactccggaattc

SEQ ID NO: 3352 - DNA, 1679 bp, Rattus norvegicus
  Genbank Accession No. NM_017177
gactgataggcgtgtcgggcgggaccagagcgcgccccactcagcgaaagctgccgtccctctttgccttgagcgccgcagccctgagaatcgcatctggcttggaaacagtcctaagactggagtctcgaagaaagccggagacagtcgcgaagaacggaggacgcccagagactcttcggcttcccggaagtggaaccgagcatacccggaaggagctaatcccacctgaagattgctgagcacccgcaggcgttaagcctaacggagtccacgtcatggcggcggatgggacaggtgtagtcggaggaggggctgtcggcggccccctgtccaaggacggtttgctggatgctaagtgcccagaaccaatccccaatcggcggcgctcttcctcgctgtcccgtgacgcgcagcgccgagcctatcagtggtgccgggagtacctgggcggagcctggcgcagagcgcggccggaggagctgagcgtttgccccgtgagcggaggcctcagcaacctgctcttccgatgctcgctaccgaaccacgtgcccagtatgggcggggagccccgggaggtgctgctacggctgtacggggctatcttgcagggtgtagactccttggtattagaaagcgtgatgttcgccattcttgcagagagatctctagggccccaactttatggagtgtttccagagggccgcttggaacagtacctcccaagccggccattgaaaactcaagagctccgggacccagtgttgtcaggagccattgcaacaaagatggcccgtttccatggtatggagatgcccttcaccaaggagccccgctggttgtttgggaccatggagcggtacctaaagcagatccaggacctgccgtccactagccttccccagatgaacctggtggagatgtacagcctcaaggatgagatgaatcacctcaggacgttgctagacgctacaccgtccccagtggtcttctgccacaatgacatccaggaaggaaacatcttactgctctcagagccagacagtgatgacaacctcatgttggttgatttcgagtacagtagttacaactacaggggctttgacattgggaatcatttctgtgagtgggtttacgattacacttacgaggagtggcctttctacaaagcaagacctgcagactaccccactagagaacagcagctccttttcatccgtcattatctggcggaggttcagaaaggtgaggtcctctccgaagaggagcagaagaaacaggaagaagatttgctgatagagatcagccggtatgccctggcctctcatttcttctggggcctatggtccaccctccaggcttccatgtccactatagagtttggctacttggaatacgcccaatctcggttccagttctacttccagcagaaggggcagctgaccagcttcctatcaccttgaggatccaacccccacctcagatttctcctggagcctccggggcaggccctcggagggaggggcaaagagcagaagcccccagagcttgggctgtgcctctaagtgagactgtcgttgaagtagctgacctccgtactcctttcttagtacttgcccaaggggggcatctgacagcccctggggctgtgcacctaaataaatgaacttcacaaatac

SEQ ID NO: 3353 - DNA, 1275 bp, Rattus norvegicus
  Genbank Accession No. NM_017178
ggcacgagaatggacgtgccccctagtgcttcttagacggactgcggtctcctaaaggtcgaccatggtggccgggacccgctgtcttctagtgttgctgcttccccaggtcctcctgggcggcgcggccggcctcattccggagctgggccgcaagaagttcgccggggcatcgcgccccttatcccggccttcggaggacgtcctcagcgagtttgagttgaggctgctcagcatgtttggcctgaagcagagacccacccccagcaaggacgtcgtggtgcccccctatatgctcgacctgtaccgccggcactcgggccagccaggagcgctcgccccagaccaccggctggagagggcagccagccgcgccaacaccgtgctcagcttccatcacgaagaagccatcgaggaactttcagaaatgagtgggaaaacttcccgacgcttcttcttcaatttaagttctgtccctactgatgagtttctcacatctgcagagctccagatttttcgggaacaaatgcaggaagctttgggaaatagtagtttccagcaccgaattaatatttatgaaattataaagcctgccacagccagctcaaaatttcctgtgaccagactattggacaccaggttagtgactcagaacacaagtcagtgggagagctttgatgtcaccccggctgtgatgcgatggacagcacagggacacaccaaccatgggtttgtggtggaagtggcccacttagaggagaagccaggtgtctccaagagacatgtgaggattagcaggtctttgcaccaagatgaacacagctggtctcaggtaagaccactgctagtgacttttggccacgacggtaaaggacatccactccacaaacgagaaaagcgtcaagccaaacacaaacagcggaagcgtcttaagtccagctgcaaaaggcaccctttgtatgtggacttcagtgatgtggggtggaatgactggatcgtggcccctccaggctatcatgccttttactgccatggggaatgtccttttcccctggctgatcacctgaactccaccaaccatgccatagtgcagactctggtaaactctgtgaattccaaaatccctaaggcatgctgtgtccccactgagcttagcgcaatctccatgttgtacctagatgaaaacgaaaaggttgtgctaaaaaactatcaggacatggttgtggagggttgcgggtgtcgctagcacagcaagaacaaaaaaaaaaaaaaaaa

SEQ ID NO: 3354 - DNA, 1386 bp, Rattus norvegicus
  Genbank Accession No. NM_017181
ctgctgcccagtgctcttcagcatgtcctttattccggtggccgaggactccgactttcccatccaaaacctgccctatggcgttttctccactcaaagcaacccaaagccacggattggtgtggccatcggtgaccagatcttggacctgagtgtcattaaacacctctttaccggacctgtcctctccaaacatcagcatgtcttcgatgagacaactctcaatagctttatgggcctcggccaagcggcatggaaggaggcaagagcatctttacagaacttactgtctgccagccaagcccagctcagagatgacaaggagcttcggcagcgtgcattcacctcccaggcttctgccacgatgcaccttcctgctaccataggagactacacggacttctactcctctctgcagcatgccactaacgttggcattatgttcaggggcaaggagaatgcgctgttgcccaattggctccacttacctgtgggataccatggccgagcttcctccgttgtggtgtctggtaccccaattcgaagacccatgggacagatgagacctgataactcaaagcctcctgtgtacggtgccagcaaacgcttagacatggagttggaaatggctttctttgtaggccctgggaacagattcggcgagccaatccccatttccaaggcccaggagcacattttcgggatggtcctcatgaacgactggagtgctcgagacatccagcaatgggagtacgtcccccttgggccattcctggggaaaagttttggaaccaccatctccccatgggtggtgcccatggatgctctcatgccctttgtggtgccaaacccaaagcaggaccctaagcccctgccatatctctgccacagccagccctacacatttgatatcaacctgtccgttgctttgaaaggagaaggaatgagccaggcagctaccatctgcaggtccaactttaagcacatgtactggaccattctgcagcaactgacacaccactctgttaatggatgcaatctgagacctggggacctcttggcttctggaaccatcagtggatcagaccctgaaagctttggctccatgctggaactgtcctggaagggaacaaaggctatcgatgtggggcaggggcaaaccaggacctttcttctggacggagatgaagtcatcataacaggtcactgccagggggatggctaccgtgttggttttggccaatgtgctgggaaagtgctgcctgccctctcgccagcctgaagctccagaatccacagaacacagccttgccttgtgaggatcatactgcaactgcatgagtcaggaatgaataaagctattttgattggggaaaaaaaaaaaaa

SEQ ID NO: 3355 - DNA, 1072 bp, Rattus norvegicus
  Genbank Accession No. NM_017187
ggcacgagggaaggaagtctctctgtggaggtctgagggaagagctcgcgccaggtagacgctgcgccgtcatcatgggcaagggggaccccaacaagccgcggggcaagatgtcctcgtacgccttcttcgtgcagacctgccgggaggagcacaagaagaagcatcccgactcgtcggtcaacttcgccgagttctcgaagaaatgttcggagagatggaagaccatgtctgccaaggaaaagtcgaagtttgaggatttggccaagagcgacaaagctcgttatgacagggagatgaagaactatgttcctcccaaaggtgataagaaaggaaagaaaaaagatccaaatgctcccaagagaccaccgtctgccttcttcctgttttgctctgaacatcgcccaaagatcaaaagtgaacaccccggcctgtctattggagatactgcaaagaaactgggggagatgtggtctgagcaatctgccaaagataaacaaccgtatgagcagaaagcagctaaactaaaggagaagtatgaaaaggatattgctgcataccgtgccaagggcaaaagtgaagtaggaaagaagggtcctggtaggccaacaggctcaaagaagaagaatgaaccagaagatgaggaagaggaggaggaggaagaagatgatgaagatgaagaggaggaagatgaggatgaagaataagtatctgtcctaaagtgtggagtatatgtgctcaggcaattattttgctaagaatgtgaaattcaagtgcagctcaacattagcttcagtataaaaactgtacagatttttgtatagctgatgagattctttgtagagaaaatactttttaaaaagggtttgtagctttttcaggggctacaacgtacagttagatttaaagcttttgatgttgaatgtttctaaatatttaatggtttctttaatttcttatgatagcaaaaaaaaaaacttcataggaatttctattaccagtaaaagaattttttttttaggatgttgcatttttgtttttttttaaaatttgtaataaaataatgtatatt

SEQ ID NO: 3356 - DNA, 1290 bp, Rattus norvegicus
  Genbank Accession No. NM_017189
tcttagcacaaacccaattctagctctaaggaaatctcaattcagtcccagatctgtctccagcctgagggcccatcatggagaaggactttcaagatatccagcagctggactctgaggaaaacgaccatcagctcattggcgatgaggaacaaggctctcatgtgcagaatcttaggacagaaaatccacgttggggaggacagcctccttccaggccctttccacagcgcctctgctccaagttccgcctcagtctgctcgccctggccttcaacattctcctgctggtggtcatctgtgtggtttcatcccaaagcatgcagctgcaaaaggagttctggaccctgaaagaaaccttgagcaacttctccaccaccaccctgatggagttcaaggctctggactcccacggaggtagcaggaatgacaacttgacttcttgggaaaccatactggagaaaaagcagaaggacataaaagcagatcactccacgctgctcttccacctgaagcacttccccctggatctgcgaaccctgacctgtcagctggcgttcttcctgagcaacggcacagaatgctgccccgttaactgggtggagtttggtggaagctgctactggttttctcgggatgggctcacctgggctgaggctgaccagtactgccaaatggagaatgcccatctgctggtcatcaactccagggaggagcaggaattcgttgtaaagcacaggggcgcgtttcacatttggataggtctcaccgacaaggatggctcctggaaatgggtggatgggacggaatatagaagtaacttcaagaattgggctttcactcagccagataactggcagggccatgaagaggggggaagtgaagactgtgctgaaatcctgtcagatggcctctggaatgacaacttctgccagcaggtgaaccgctgggcttgtgaaaggaaacgggacatcacctactaggagtctgctctactatgtctttgtcaaccctccccccaacccccgcatcactcattaggagtctgctctaccatgtctctgccccaccccatcaccgcatcaccccaacattttcactggggatattggagcaagaaagagagacagagtcccaggcatgaggggggttatgggagaatggaaagggggtggctctatggtctcatacgttaggaagactgagattccacccctcttcacaacttattacaattgttataaatttcaacaatggagtaggaaagaaaaaaataaacaataccagaaa

SEQ ID NO: 3357 - DNA, 1828 bp, Rattus norvegicus
  Genbank Accession No. NM_017193
gtggcactccgcagcactacccggagacagctaacagtgcagcccgagtgatctgggaagccgttctcagtgaccgacttttctagtcctgttccacgcgaccagcagagacatgaattactcaaggttcctcactgcaacgagcctggccagaaagacatcccctatcagagctacagtggagataatgagtagagcacccaaagacatcatctccctggctcctggatctccgaacccgaaagtgttcccctttaagtcagctgtcttcactgtggagaacggaagcaccatccggtttgaaggagagatgtttcaaagggccctccaatattcctcaagctatggaattccagaacttctgtcctggctaaaacagttgcaaataaaattgcataatcctccgactgtcaactactcacccaacgaaggacagatggacctctgcatcacatctggctgtcaagacggtctctgtaaggtgtttgaaatgctcatcaatcctggagacactgttctggtcaatgaaccactgtattcaggagccctttttgcaatgaaaccactgggctgcaattttattagtgtccccagtgatgactgtgggattattccagagggtctcaaaaaagtactttcccagtggaaaccagaagattccaaggatcccacaaaaaggactccaaaatttctgtatactattccgaatggcaacaaccctacaggcaactcgttgactggtgaccgcaagaaagaaatctatgagcttgcaagaaaatatgacttcctcataatagaagacgatccttactattttctccagttcaccaagccttgggaaccaacctttctctccatggatgttgatgggagagttatcagagctgactccctttcaaaagttatctcctcagggctgagagtggggtttataactggccccaagtccttgatacagaggattgttctccacacacaaatctcatcactgcatccctgtactttatcacagctcatgatatcggagcttctataccagtggggagaagagggtttcctggcccatgttgacagagctattgatttctacaagaaccagagggattttatattggcagctgcagacaagtggttacgtggtttggcagagtggcatgttcccaaagctggcatgtttctatggattaaagttaacggaatctctgatgcaaaaaaactaattgaagaaaaggctattgaaagagagatcttgttagttcctggaaatagtttcttcgtcgataattcagccccctcctccttcttcagagcatccttctctcaggttactccagcgcagatggacttagtcttccagagattggcccaactcataaaagacgtttcataaagaaatcaaactcagcattgaacttataattttaaaataaatttcctatactttgctgaagaaatggctgacaggatggatccagtttgtgaaatatctgtggcaatttcactgaacaactttgaagccccttaaaatccaccgcattgccaaaataactttctgatatacttttgccctttgattaattatgaactaacaaaacatcaaatttcattgttaaagacctctgtagctgcttaataatgtccaataaatttttttgagcctaacatagactaactaacatagtaaattgcaagggaattagttaaaatggcctataatatgcaggtttttttctactttaaggaaatttcatgagcatttactgcaaaaattgttgtaatttgacaattataaattactttgtaaccgaaaaaaaaaaaaaaaaaaaaa

SEQ ID NO: 3358 - DNA, 757 bp, Rattus norvegicus
  Genbank Accession No. NM_017199
ggaaacggacacgtcagtgccgccagcgacgtcaccatgcccgacccagcccgccgacgcacgattgggtgctgaggccgcttacgcgtcgcgcttcctcgtctgctccgcatgttcagggcggcttgctctcttttcccctcggcagagaagaggcgatggcggcgatggcatctttcggcgccctggcgctactcctgctgtccggcctatcttgctgctcagcagaggcctgcctggaaccccagatcaccccttcttactatacaacttcagatgccgtcatttctacagagactgtattcatcgtggagatctcactgacctgcaaaaacagggtccagaatatggctctttatgccgacgttagtggaaaacaatttcctgtaacccgcggccaggatgtgggtcgatatcaggtgtcctggagcctggagcacaagagcgcccatgcaggcacctatgaggtcagattcttcgatgaagagtcctacagcctcctaaggaaggctcaaagaaataatgaagacgtttccatcatcccaccactgttcacagtcagtgtggaccatcggggtacctggaatgggccttgggtctccacggaggtgctggctgcagcaattggcatagtgatctactacctagctttcagtgcaaagagccacatccaggcctgagggcagcaacctcagccctccattgcttctttcaataaacagtcactatttgaaaaaaaaaaaaaaaaaaaaaaaaa

SEQ ID NO: 3359 - DNA, 2029 bp, Rattus norvegicus
  Genbank Accession No. NM_017201
ctcactctagcggacttcgccagcatggctgataaactgccctacaaagtcgcggacattggactggctgcctggggacggaaggccctggacatagctgagaacgagatgccaggtttgatgcgcatgcgggagatgtactcagcctccaagccactgaagggcgctcgcattgctggctgcctgcacatgactgtggagactgctgtcctcattgagactctcgtggccctgggtgctgaggtgcggtggtccagctgcaacatcttctccactcaggaccatgcagcggctgccattgccaaggctggcattccagtgtttgcctggaagggagagacggatgaagagtacctgtggtgcattgagcagacgttgcacttcaaggacggacccctcaacatgattctggatgatggcggtgaccttactaacctcatccacaccaaacacccacagcttctgtcaggcatccgaggtatctctgaggagaccacgactggcgtccacaacctctacaagatgatggccaatgggatactgaaggtgcctgccatcaacgtcaacgattctgtcaccaagagcaagtttgacaacctctatggctgccgggagtccctcatagatggcatcaaacgggcaacagatgtgatgattgcgggcaaggtggcagtggtagcaggctatggtgatgtgggcaagggttgtgcccaggccctgcggggtttcggggcccgagtcatcatcaccgagattgaccccatcaatgcactgcaagctgccatggagggctacgaggtaaccaccatggacgaggcctgtaaggagggcaacatctttgtgaccaccacgggctgtgttgatatcatccttggtcggcactttgaacagatgaaggatgatgccattgtctgtaacattggacacttcgacgtggagattgatgtgaagtggctcaatgagaacgctgtggagaaggtgaacatcaagccccaggtggaccgctacttgctaaagaatgggcaccgcatcatcttgctggctgagggccgtctggtcaacctgggttgtgccatgggccaccccagcttcgtgatgagcaactccttcacaaaccaggtgatggcacagattgagctgtggacccacccagacaaataccccgtgggggttcacttcctgcctaagaagctggatgaggcagtggctgaagcccacctgggcaagctgaacgtcaagctgaccaagctgactgagaagcaggctcagtacctgggcatgcccattaacggccccttcaagcctgatcactaccgctactgagagctgggactgcccttcaccttccagctgccatccttgttccaggccctacctctcgttcccaagagcaaatgtcaccaactttgcagttacttctccggtgttctgctccctcccccggccctcatccacactgtgactggtctttctgtctttggcttctgctgtacccctcatactgttccctatgtggcatagagaacagagaggtacctgggaggcatccacaggggatctgagctcttggaaggtctgaggctggatgttgctggtggtcacaagcccatgcaccttactatccaaactctcgcttggtctttagatccgtgtgcttggtttacagaccaatggtttctcggcccaggacccaagaaggagctctaccatgggggaaggaaccactggagtttgaaggctcctgagagcttggcctttttactgttgggctgtctcttaaacctcctaatactgagttggctacttttggtccctatttcacaagggttaggacagattaaccaagaaaggacaagtgacagagactgaaaggggctggaaaaacaaatagggaaaggcctgtcacctacggtataattgatggttcctatcacaagcctggatcacaaacagattaatttgttctatgtttatatactgtttagaatgttaacacaggaaggtggataaaatacagtttctagtgcct

SEQ ID NO: 3360 - DNA, 696 bp, Rattus norvegicus
  Genbank Accession No. NM_017202
gctcttccggtgcgggacccgctcttccggtcgcgagcacccggggtgtagagggcggtcgcggcggtcgcctgggcagcagtggcagaatgttggctaccagggcacttagcctaattggcaagagagccatttctacttcggtgtgccttcgggcacatgggagtgttgtgaagagtgaagactatgctctcccatcttatgttgatcggcgtgactaccccttgcctgatgtggcccacgtcaagctgctgtctgccagccagaaggccctgaaggagaaggagaaggccgactggagcagcctttccagggatgagaaagtccaattgtaccgcatccagtttaacgagagcttcgctgagatgaacaagggcaccaatgagtggaagacagtggtgggcctggccatgttcttcatcggcttcactgcgcttgtgctgatctgggagaagagctacgtgtatggccccatccctcatacctttgatcgtgactgggtggccatgcagaccaagcggatgctggacatgaaggtcaaccccattcagggcttctccgccaagtgggactacaacaagaatgaatggaagaagtgagagcctgctgctgtgggctcctccctccctccctccctcagcatgctggaagctgctgtgtccaatggtccatgttaataaatgaccagtttacgtg

SEQ ID NO: 3361 - DNA, 3581 bp, Rattus norvegicus
  Genbank Accession No. NM_017204
gcggaggccgttgtgctctctgctctgtctgggttggaggtgaccgctgccaagcctcgctaggcggccggctgaaccagacggaaaggagacagaagcctgtttgcagatcctgcccagccctctcgctgcgccatggcttaagcccacagcctccttgccaagcatctccttgctcggccggggtctgctagacaccgcagtcgcagagagggcgcgcccagacgccctaggcctggactctgggacgccgagcctcgctcccattcttcactggtcacagcaggtcctctgcagaaggcgtttacagccggtaatcgagggactttacggactttcagtggtacctcgtccccgggtgctttttgagggaggaggacgaggcaaagggcttttaaggggaggaagcagtgggatccacattggcgggtctgggttggagttaaagggagatcggaggtttgatttaggaccacaaaaaggctttgcgactagcattatggcgtggccgtgcatcactagggcctgctgcatcgcccgcttctggaaccagctggacaaggcggacattgcggtgccgctggttttcaccaagtactcggaggccaccgaacatccaggcgcccctccgcagccaccagcgccgccgcagcccgggttagcgcccccctcgcgtgctgtcgccatagagacgcagccagcccagggagagtcggatgcagttgcccgggcaacagggccggcacccgggcccagcggtgaccgcgagactgcagccgcccccggccggagcgggctgggcttgggcgcggcctccggctccacttccggctcaggcccggcggactcggtgatgcgacaggactaccgtgcctggaaggtgcagcggcccgagcccagctgccggccgcgaagcgagtaccagccgtccgacgcgcccttcgagcgcgagacccagtaccagaaggacttccgcgcctggccactgccccgccgcggggaccacccctggatccccaagcccgtgcagatccctgcgacttcgcagccttccccgcctgttctcgggatgcccaagcgtcggcctcaaagccaagagcgcgggcccatacaactttctgctgatgcccgggacccggagggtgctggaggagccggggtgccggcggccggaaaggcgtccggtgcagaccagcgtgacacacgccggaaggcagggccagcatggatggtgactcgcaccgaagggcacgaggagaagcctctgcccccggcccagtcccagacccaggaaggcggtcctgcagctggaaaggcgtccggtgcagatcagcgtgacacacgccggaaggcgggacccgcgtggatggtgactcgcaccgaagggcacgaggagaagcctctgcccccggcccagtcccagacccaggaaggcggtcctgcagctggaaaggcgtccggtgcagatcagcgtgacacacgccggaaggcgggacccgcgtggatggtgactcgcaccgaagggcacgaagagacgcctctgccacccgcccagtcccagacccaggagggcggccctgccgctggaaaggcgtccggtgcagatcagcgtgacacacgccggaaggcgggacccgcgtggatggtgactcgcaccgaagggcacgaagagacgccgctgccacccgcccagtcccagacccaggagggcggccctgccgctggaaaggcatctggtgcagatgaacgcgacacgaggaggaaggcggggccggcctggatggtgcgtcgctccgaggggcacgagcagacgaccgctgcccatgcccaaggcacagggcccgaaggaggcaaagggcgcgcggtggctgatgccctcaacaggcaaattcgggaggaggtgacgagtacagtaagcagctcctacaggaacgaattcagagcgtggacagacatcaagcctgtgaaaccaatcaaagccaagccccagtacaagcccccagatgacaagatggttcacgaaaccagctacagtgcccagttcaaaggggaggccagtaagcccaccacagcggacaacaaggtcgtggatcgcagaagaatacgaagcctctacagtgagcctttcaaggaatccccgaaggtggagaaacctagtgttcagagttccaaaccaaaaaagacctcaacgagccagaagcccctgaggaaggccaaagacaagcaggtggcgtcgggccaggccgccaagaaaaagaccacagagagccccagtgccaccaaacctgacgacaaggagcaaagcaaagagatgaacaataaactggctgaggcgaaagagagccgggtcaaacccaccagtgataagaatcaaggtcctgtagccaaagagccacacaaggatcaaggtcctgtggccccaggtcttccgaaaggccaaggtcctgcggtccaagagcctttgaaggatcaaggccccatggtgccaggactgccaaaggaccaagcccctgtagtcccagggtccttaaagggtcaaagccctacagccccaggcccgccaaaggatcaaggtgctgtgctcttagggcccatgaaggatctaggtccagtggccccagcatccgtcaaggatcaagaccatatggcgtctgagcttctaaagaataaagattctgtccccttagcaccagccaaagcccaaagccctctgttgccagagcctctgaagaatcagagtcctgtggttccagcaagagctaaggatcaaagcttcccagcaccagcaccaacacctctgaaggacccaggtcctgtgatccctgagcctgagaaagatggagctcccatggtcccagagcgtaggaaggaccagaatgcctccatcatggcatctctgaagaacgaagctcctgtggcctctgagtctgtgaagaatcaaggcttaggaggcccagagccagccaaagacacaggtacggatctgaaaggacatggttctgtgtttgtagcacctgtgaagagccaaggtccagtggttcctgagccaactaagggccaagaccccattatcccagcactagccaaggaccaaggtcccatactcccagagcctccaaagaatcaaggaccccctgtggtccttgggcctataaagaatcaagaccctgtaattccagtacctctgaagggtcaggatcccgtggtgccagccccaaccaaggacccaggtcctacagcccctgaccctctgaagtctcaaggtcccagaggccctcaactgcccacggtctcaccttcacccccagtcatgatcccaacagtcccccatgcggaatatattgagggatccccttgattcccttgaaatgccatggaggagctggcagtggaagtgcttccctcctggggaggcaaagacatatatttaatctgcatgaaaccgtgctgtatagtcttgctggaatctaataaaactggttcctctggctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3362 - DNA, 1302 bp, Rattus norvegicus
  Genbank Accession No. NM_017209
tgtcagtgctggaagcggcatgttggtcagccggcgactgacaggggcgcgagcccgggcacctctgcttgcgagtctcctcgaggcttggtgccgccagggcaggaccacctcctcctactccgctttctcggagccgtcgcatgtgcgggcgctggtctatggcaaccacggggatccagccaaggtcatccaactgaagaacctggagctcactgctgtggaaggatctgacgtccatgtgaagatgctggcagcccctatcaatccatctgacataaatatgatccaagggaactatggcctccttcccaagctgcctgctgttggagggaatgaaggtgttggacaggtgatagcagtgggcagcagtgtgtctggattgaagccaggagattgggtgatcccagcaaatgctggtttgggaacctggcggactgaggcggtgttcagtgaggaagcgctgattggagtccctaaggacatccctctccagagtgctgccaccctaggtgtcaacccctgcacagcctacaggatgttggtggactttgaacagctacaaccaggggactctgtcatccagaatgcgtccaacagtggagtagggcaagcagtcattcagatcgcctcagcccttggcctaaagaccatcaacgtgatccgagacagacctgacatcaagaagctaactgacagactgaaggatctaggagctgattatgtcctcacagaggaggagctaaggatgcccgagaccaaaaacatcttcaaggacctgccgctgccccgactggctctcaactgtgtcggtgggaagagttccacagagctgctccggcacctagcgcccggaggaaccatggtgacctatggaggaatggccaagcagcctgtaacagcctctgtgagtatgctcatttttaaggacctcaaacttcgtggcttttggttgtcccagtggaagaagaaccatagtccagatgagttcaaggagctgattctcattctctgcaacctcatccgccaaggccagctcacagcccctgcctggtccgggattccactgcaggactaccagcaggctttggaagcctccatgaagccttttgtgtctttgaagcagattctcactatgtgattactccagaggaccaggaggaaagcaggagaggcaggccagcaagattggctggctgctggccctccatgaggactccagactgcctcaccctcactgcctcttcctaccaggagggtgggaggccaaccccagggtccctaataaaccctggacttccc

SEQ ID NO: 3363 - DNA, 1821 bp, Rattus norvegicus
  Genbank Accession No. NM_017210
ggtcggagaaggtgaagggcccccgggggcttcggggcccgcggccaccatgctgcgctccctgctgcttcactctctgaggctctgcgcccagaccgcctcgtgcctcgtgctgttcccgcgcttcctaggcacggccttcatgctctggcttttagatttcttgtgcatccgcaagcatttcctgcgccgtcgtcatcctgaccaccccgagcccgaagtagagctcaacagtgaaggtgaggagatgccccctgacgacccacccatctgcgtatccgacgacaaccggctgtgcaccctggcctctctcaaggccgtgtggcatggccagaagttggatttcttcaagcaggcccatgagggtggcccagcacctaactcggaggtcgtccggcctgatggcttccagagccagcgcatcctcgactacgcacaagggacccgcccgttggtgctcaattttggcagctgtacctgaccaccgttcatggcgcggatgagcgccttccagcgcctggtcaccaagtaccagcgcgacgttgacttccttatcatctacatcgaggaagcccacccatccgatggctgggtcaccacagattcaccctacgtcatcccacagcaccgcagcttggaggaccgtgtcagcgcagcaagagtacttcagcaaggcgcacctggctgtgctctggttctggacacgatggccaactccagcagttccgcatatggtgcctattttgagcgcctctacgtcatccagagcggcaccatcatgtaccagggaggccgtggccccgacggttaccaggtgtctgagttgcgcacttggttggagcgctatgacgagcagttgcatggtactaggccacgtcgactctaaaaaaccaagggacaagtgactgaattggtgggctgggtcttctgggccttcgaagctcatgtgcgaatgctccaaaagaagtcaaggttttcaggggtcccgtgacacagatgagcacagccacagaactcaggctgagtctggctaacttgagactctgctatagtgactcccttttggtactttttggcttgctttctggagcattgctgtggctcgaactggcaactttgtccctgctgaagtttacctgctggactttctgacacctgctccccagcgctatttcagcaaagcgcaataagtcgccagcatctcacagctcgggacttgttggccacgcccgcgcgccctgagcgcagctgggttccagcagcgcctccggctctagctagttgcctggcacccacctgtcgagagcagggagtcctgctgcttttgtgtttatttcttatccctgggttgggggaggggctcaagataaagggtgggcagggtaatttccccgcctagctttaggtgcgctggaaccctggctgctgatgacgaaccgcctctaactgggcttgaccacgggtcggctctgaattgcagaggggctcgaaacagcgcctaaagtaagagggggaaagtgctctgggttccacggggaaccgtcaaaaacagggtgaaagagggacatggtaaggggtgggcttcaggaccaaaggaagcggcttggggcactggcgaggttcgcaggtccccaagagggaggctaggactccttggagaagggattaattggttcgaagacaaggagatggggaagagcctgggagtcctaagcagaaagagcgggttgtggggtggggtgaaaaccagtcagtgaatgttgtgttggaaacgttccttgtgtataaacttttaagttacaataataaagacttgaagga

SEQ ID NO: 3364 - DNA, 5240 bp, Rattus norvegicus
  Genbank Accession No. NM_017212
cctcccctggggaggttcgcgttcccgtggctcgcgcctgctgcccgccggcctcgagaacgcgctctctcggccgcggcgctcacagtctccgccacccaccagctccagcaccagcagcagcgccggcgccaccgcccaccttctgctgtcgccgccgccacaaccaccttcccctccgctgtcctcttctgtcctcgcctcctgtcgattatcaggctttgaagcagcatggctgaaccccgccaggagtttgacacaatggaagaccaggccggagattacactatgctccaagaccaagaaggagacatggaccatggcttaaaagctgaagaagcaggcatcggagacaccccgaacatggaggaccaagctgctgggcatgtgactcaagctcgagtggccggcgtaagcaaagacaggacaggaaatgacgagaagaaagcgaagggggccgatggcaaaacgggggcgaagatcgccacacctcggggagcagccactccgggccagaaaggcacatccaatgccaccaggatcccagccaagaccacacccagcccaaagactcctccaggatcaggtgaaccaccaaaatccggagaacgaagcggctacagcagccccggctcgcccggaacccctggcagtcgctcccgtaccccatccctaccaacgccgcccacccgagagcccaaaaaggtggcagtggttcgcactccccctaagtcaccgtctgccagtaagagccgcctacagactgcccctgtgcccatgccagacctaaagaacgtcaggtccaagattggctccactgagaacctgaagcaccagccgggaggcggcaaggtgcagataattaataagaagctggatcttagcaacgtccagtccaagtgtggctcaaaggacaatatcaaacacgtcccgggcggaggcagtgtgcaaatagtctacaagccagtggacctgagcaaggtgacctccaagtgtggttccttagggaacatccatcacaagccaggaggtggccaggtagaagtaaaatcagagaagctggacttcaaggatagagtccagtcgaagattggctccttggataacatcacccatgtccctggaggagggaataagaagattgaaacccacaagctgaccttcagggagaatgccaaagccaagacagaccatggagcagaaatcgtgcacaagtcacctgtggtgtctggggacacatctccacggcacctcagcaacgtctcctccacgggcagcatcgacatggtggactctccacagcttgccacgttagccgatgaagtgtccgcctctttggccaagcagggtttgtgatcaggcccctggggccgtcactgatcatggagagaagagagagtgagagtgtggaaaaaaaaaaaaaaagaatgacctggcccctcaccctctgccctccccgctgctcctcatagacaggctgaccagcttgtcacctaacctgcttttgtggctcgggtttggctcgggacttcaaaatcagtgatgggaaaaagtaaatttcatctttccaaattgatttgtgggctagtaataaaatatttttaaggaaggaaaaaaaaaacacgtaaaaccatggccaaacaaaacccaacatttccttggcaattgttattgaccccgcccccccctctgagttttagagggtgaaggaggctttggatagaggctgcttctggggattggctgagggactagggcaactaattgcccacagccccatcttaggggcatcagggacagcggcagacatgaaagacttgggacttggtgtgtttgtggagccgtaaggcgtatgttaactttgtgtgggtttgagggaggactgtgatagtgaaggctgagagatgggtgggctgggagtcagaggagagaggtgaggaagacaggttgggagagggggcattgcgtccttgccaaggagcttgggaagcacaggtagccctggctgcagcagtcttagctagcacagatgcctgcctgagaaagcacagtggggtacagtgggtgtgtgtgccccttctgaagggcagcccatgggagaaggggtattgggcagaaggaaggtaggccccagaaggtggcaccttgtagattggttctctgaaggctgaccttgccatcccagggcactgctcccaccctccaggaggaggtctgagctgaggagcttccttttcgatctcacaggaaaacctgtgttactgagttctgaagtttggaactacagccatgattttggccaccatacagacctgggactttagggctaaccagttctttgtaaggacttgtgcctcttgcgggaacatctgcctgttctcaagcctggtcctctggcacttctgcagtggtgagggatgggggtggtattctgggatgtgggtcccaggcctcccatccctcgcacagccactgtatcccctctacctgtcctatcatgcccacgtctgccacgagagccagtcactgccgtccgtacatcacgtctcaccgtcctgagtgcccagcctcccaagcccaatccctggacccctgggtagttatggccaatctgctctacactaggggttggagtccagggaaggcaaagatttgggccttggtctctagtcctacgttgccagaatccaaccagtgtgcctcccacaaggaaccttacaaccttgtttggtttgctccatcaggcgtttggcgccatcgtggatggagtccgtgtgtgcctggagattaccctggacacctctgctttttttttttttactttagcggttgcctcctaggcctgactccttcccatgttgaactggaggcagccaagttaggtgtcaatgtcctggcatcagtatgaacagtcagtagtcccagggcagggccacacttctcccatcttctgcttccaccccagcttgtgattgctagcctcccagagctcagccgccattaagtccccatgcacgtaatcagcccttccataccccaatttggggaacataccccttgattgaaatgttttccctccagtcctatggaagcggtgctgcctgcctgctggagcagccagccatctcagagacgcagccctttctctcctgtccgcaccctgctgcgctgtagtcggattcgtctgtttgtctgggttcaccagagtgactatgatagtgaaaagaaaaagaaaaagaaaaaagaaaaaagaaaaaaaaaaaaggacgcatgttatcttgaaatatttgtcaaaaggttgtagcccaccgcagggattggagggcctgatattccttgtcttcttcgtgacttaggtccaggccggtcgagtgctaccctgctggacatcccatgttttgaagggtttcttcttcatctgggacccctgcagacactggattgtgacattggaggtctatacattggccaaggctgaagcacaggacccgttagaggcagcaggctccgactgtcagggagagcttgtggctggcctgtttctctgagtgaagatggtcctctctaatcacaacttcaagtcccacagcagccctggcagacatctaagaactcctgcatcacaagagaaaaggacactagtaccagcagggagagctgtggccctagaaattccatgactctccactactatccgtgggtcctttccaagccttgcctcgtcaccaagggcttgggatggactgccccactgatgaaagggacatctttggagacccccttggtttccaaggcgtcagccccctgaccttgcatgacctcctacagctgaaggatgaggcctttaaagattaggaacctcaggcccaggtcggccactttgggcttgggtacagttagggacgatgcggtagaaggaggtggccaacctttccatataagagttctgtgtgcccagagctaccctattgtgagctccccactgctgatggactttagctgtccttagaagtgaagagtccaacggaggaaaaggaagtgtggtttgatggtctgtggtcccttcatcatggttacctgttgtggttttctctgtatacccccatttacccatcctgcagttcctgtccttgaataggggtgggggtactctgccatatctcttgtaggcagtcagcccccaagtcatagtttggagtgatctggtcagtgctaataggcagtttacaaggaattctggcttgttacttcagtgaggacaatcccccaaggccctggcacctgtcctgtctttccatggctctccactgcagagccaatgtctttgggtgggctagatagggtgtacaatttgcctggaacctccaagctcttaatccactttatcaatagttccatttaaattgacttcaatataagagtgtatccatttgagattgcttgtgttgtggggtaaaggggggaggaggaacatgttaagataattgacatgggcaaggggaagtcttgaagtgtagcagttaaaccatcttgtagccccattcatgatgttgaccacttgctagagagaagaggtgccataaggctagaacctagaggcttggctgtccaccaacaggcaggcttttgcaaggcagaggcagccagctaggtccctgacttcccagccaggtgcagctctaagaactgctcttgcctgctgccttcttgtggtgtccagagcccacagccaatgcctcctcaaaaccctggcttccttccttctaatccactggcacatcagcatcacctccggattgacttcagatccacagcctacactactagcagtgggtaagaccacttcctttgtccttgtctgttctccagaaaagtgggcatggaggcggtgttaataactataggtctgtggctttatgagccttcaaacttctctctagcttctgaaagggttacttttgggcagtattgcagtctcaccctccgatggctgtagcctgtgcagttgctgtactgggcatgatctccagtgcttgcaagtcccatgatttctttggtgttttgagggtggggggagggacatgaatcatcttagcttagcttcctgtctgtgaatgtccatatagtgtactgtgttttaacaaacgatttacactgactgttgctgtacaagtgaatttggaaataaagttattactctgattaaacaaaaaaaaaaaaaaaaaaaaaaaaaaaaaaaa

SEQ ID NO: 3365 - DNA, 4224 bp, Rattus norvegicus
  Genbank Accession No. NM_017218
agttgcagtttgcaacctccgctgcggccgcagctacctattcgctggctgttcaggtggctttcgcttcgatgtcctcctaatcttggggcccccgggccagactcgggagggctcccttcaccatccgctggaatcatgagggcgactgggactctgcaggtgctgtgcttccttctcagcctggcccggggttccgagatgggcaactctcaggcagtgtgtcctgggactctgaacggactgagtgtgaccggagatgcagacaaccagtaccagacgctgtacaaactgtatgaaaagtgtgaggtggtcatgggtaacctggagattgtgctcacaggacacaatgctgacctttccttcctgcaatggatccgagaagtgacaggctacgtcctcgtggccatgaatgaattctctgtgcttcccttgcctaacctccgagtggtccggggaacccaggtctacgatgggaagttcgccatctttgttatgttgaactacaacaccaactccagccatgctctgcgccagctcaagttcactcagctaacagagattctgtcagggggcgtttacattgaaaagaatgacaaactttgccacatggatacaattgactggagagacatcgtgagggttcgaggcgctgagatagtggtgaagaacaatggtgcgaactgtccaccctgtcatgaggtctgcaagggacggtgctggggtcctggaccggacgactgccagatattgaccaagacgatctgtgcccctcagtgtaacggtcgctgcttcgggcccaaccctaaccagtgctgtcacgatgagtgtgctgggggctgctctggacctcaggacacagattgctttgcctgccgacgcttcaatgacagtggggcctgtgtgccccggtgtccagagcctcttgtgtacaacaagctaacgtttcagcttgaacccaacccccataccaagtatcagtatggaggagtctgcgttgccagttgtccccataactttgtggtggaccagacgttttgtgtcagggcttgtcctcctgacaagatggaagtagataagcacggactgaagatgtgtgagccttgcggagggctgtgccccaaagcctgtgaggggacaggctctggaagccgctaccagactgtggactcaagcaacattgatgggttcgtgaactgtaccaagatcctgggcaatctggacttcctcatcaccggcctcaacgttgacccctggcataagatacccgcactggacccggaaaagctcaatgttttcagaacagtccgggagatcacaggttacctaaacatccagtcctggccccctcacatgcacaacttcagtgttttttccaatctgacaaccatcgggggcagaagcctctacaaccggggcttctccttgttgatcatgaagaacttgaatgtcacatccctgggtttccggtccctgaaggaaatcagtgctgggcgtgtctacataagtgccaatcagcagctttgctaccaccactctctgaactggaccagactgcttcgggggccctcggaagagagacttgacatcaagtacgaccggcctctgggagaatgcttggcagagggcaaagtgtgtgatccactgtgttcctctgggggatgctggggcccaggccctggtcagtgcttgtcttgtcgaaactacagccgggaaggtgtctgtgtgactcactgcaacttcctgcaaggggaaccccgggagtttgttcatgaggctcaatgcttctcctgccatccagaatgcctacccatggagggcaccagcacatgcaatggctcgggctctgacgcttgtgcacgatgtgctcattttcgtgacgggccccactgtgtgaacagctgcccccatggaatcctaggtgccaaaggtccaatctacaagtatccagatgctcagaatgagtgtcggccctgccacgagaactgcacccaagggtgtaatggaccagaactacaagactgtttaggccaagcagaggtgttgatgagcaaacctcatctggtaatagcggtgacggtgggactggccgtgatcctcatgattctgggaggctcttttctgtattggcgtggacgcaggattcagaacaaaagggctatgagacgctacttggagcggggtgagagcatcgagcctctggacccaagcgagaaggcaaacaaagtcttggctagaatcttcaaagagacagagctgaggaaacttaaagtgcttggctctggcgtctttggaactgtccacaaggggatttggattcctgagggtgaatccatcaagattccagtctgcattaaagtcatcgaggacaagagtgggcgccaaagttttcaagctgtgactgaccatatgctggccgttggcagcctggaccatgcccacattgtacggctgctaggactgtgcccagggtcatctctgcagcttgttactcagtacttgcccctgggctccctccttgatcatgtgaaacagcaccgtgagacattgggaccacagctgctgctcaactggggagtacaaattgccaagggcatgtattacctcgaggaacatagcatggtgcacagggaccttgcgctccggaacgtgatgctcaagtcaccaagtcaggtccaggtggcagattttggtgtggctgacttgctgccaccagatgacaagcagttgctacatagtgaggccaagactccaattaagtggatggcccttgagagtatccactttgggaaatacacacaccagagtgatgtctggagttatggtgtaacagtttgggagttgatgaccttcggggcagagccctatgcagggttacgactggctgaaataccagacctgctagagaagggagagcggttagcacagccccagatctgcaccattgacgtctacatggtcatggtcaagtgctggatgattgatgagaatattcgcccaacctttaaagaactagccaatgagtttaccaggatggcccgtgacccaccaaggtatctggtcatcaagagagcgagtgggcctggaacacctcctgcggcagaaccctctgttctgaccaccaaagagttgcaggaggcagagctggagccagaactggacctagacctagacttggaggcagaggaggagggcctggccacctccctgggttctgctctcagcttgcctacgggaacgctcacccggccacgtgggagccagagccttttaagtccctcatctgggtacatgcccatgaaccagagcagtctcggagaggcttgtctggattctgcggttttggggggtcgtgaacagttctcccgtcccatctctctgcacccaattccacgggggcgtccagcatcagagtcatcagagggccacgtgacaggctctgaggctgaactccaagagaaagtgtcagtgtgtaggagccgaagccggagtcggagcccgcggcctcgtggggacagtgcctaccattcgcagcgacacagcctgcttactcctgtgaccccgctctccccaccagggttagaggaggaggacggcaatggctacgtcatgccagatacacacctcagaggtgcgtcctcctcccgggaaggcaccctctcgtcggtaggtctcagttctgtgttgggtactgaggaggaagatgaagatgaggagtatgaatacatgaaccggaagagaaggggtagccctcctcggccccccaggcctggctccctggaagaactgggttacgagtacatggatgtgggttcagacctcagtgcttctctgggcagtacacagagctgcccgctccatcccatggccatcgtgccctctgctggcacaactccagatgaagactatgagtacatgaaccggaggcgtggtgcgggtggcgccggaggggactatgcagctatgggggcctgcccagcagctgagcaagggtacgaggagatgcgagctttccaggggcctggacatcacgccccccatgttcgttatgcccgcctcaaaactctgcgtagtttagaagccaccgactctgccttcgacaaccccgattactggcacagcaggcttttccccaaggctaatgcccagagaacgtaaacttctgctccgtgacgctctgcgggcgtgtggcggcagctagtgcctcttcgagggtacccaatg

SEQ ID NO: 3366 - DNA, 1176 bp, Rattus norvegicus
  Genbank Accession No. NM_017220
cggtcccggaagccggaacccgtagcttgtgggtctttggtctgaagaccatgaacgcggcggttggccttcggcgccgcgcgcgattgtcgcgcctcgtgtccttcagcgcgagccaccggctgcacagcccatctctgagtgctgaggagaacttgaaagtgtttgggaaatgcaacaatccgaatggccatgggcacaactataaagttgtggtgacaattcatggagagatcgatccggttacaggaatggttatgaatttgactgacctcaaagaatacatggaggaggccattatgaagccccttgatcacaagaacctggatctggatgtgccatactttgcagatgttgtaagcacgacagaaaatgtagctgtctatatctgggagaacctgcagagacttcttccagtgggagctctctataaagtaaaagtgtatgaaactgacaacaacattgtggtctacaaaggagaatagatcttaggtttaatattgtagaaaagctaatttcttttcttactagaaaaagctctttgtccttttaaagtacacagcagtcatcacctacccgtgtctccatgttgtgttctggtgtgcctgagcgttaaagggattgtgaggtctgtatgtaaatgcattaagaagcaaattcgaagtgcatcctgagtgtattcttggtgagaaagcaggggagaactgaggattgaagcccgggcctcacacatgtgaaacatatactctgctccgacatgcatcccagtccgccaaggccgtttagaggatctttacctagagatagagattgttttatcttcagctggagagacagctcagtggttaggagcactgactgcttctccagaggtcctgagttcaaatccaccagacggtggtggctcacaaccatctgtaatgggatccgatgctctcttctggtgtgtaggtgtacatacagacaaagcattcctacatttaagaaaatacataaataagtttcaaaaattatttcatctggggctggggatttagctcagtggtagagcgcttacctaggaagcgcaaggccctgggttcggtccccagctccgaaaaaaagaaccaaaaaaaaaaaaattatttcatctgagcaaaatgttttgatgtggaattatgtaaaggtaaaataaac

SEQ ID NO: 3367 - DNA, 4269 bp, Rattus norvegicus
  Genbank Accession No. NM_017222
ttaaaagtttggcgtgttgaaagtaagcattactcagctggcaatagagacagaaccaggggactggtgcttctgtggacttggccatttgcacagcacaagcagtgatggataactcctccgtctgttccccaaatgcaactttctgcgaaggtgattcctgcctagtaactgaaagcaacttcaatgccattctcagcacagtgatgagcaccgtgctcaccattcttctagccatggtgatgttttctatggggtgcaatgtggaaatcaacaagttcctaggacacataaagcggccatggggcatcttcgtgggcttcctctgtcagtttggaatcatgcctctcacaggatttatcctgtctgtggcctctggcatccttcctgtgcaggctgtggtggtgctaattatgggttgctgccctggaggaactggctccaatatcctggcctattggatagatggtgacatggacctcagtgttagcatgaccacttgctccacactgcttgctcttggaatgatgcccctttgcctcttcatctataccaagatgtgggttgactcaggaacgattgtgatcccctacgatagcattggcatttctctggttgcgcttgttattcctgtttccattggaatgtttgtaaatcacaaatggccccaaaaagcgaagattatacttaaaattggatccatcgcaggtgcaattctcattgtgctcatagctgtggttggaggaatactgtaccaaagtgcctggatcattgaacccaaactatggattataggaacaatatttcctatagctggctacagccttggtttcttcctggctagactagctggtcaaccctggtacaggtgccgaacagttgccttggaaactggaatgcagaacactcaactgtgttccaccattgtacaactctcctttagccctgaggatctcaaccttgtgttcaccttcccactcatctatactgttttccagctcgtctttgcagcaataatattaggaatgtatgtcacatacaagaaatgtcatggaaaaaatgatgctgagtttctagagaaaacagacaatgatatggaccccatgccatcattccaggagacaaacaagggatttcaaccagatgagaaatagacactaaggaggcaaaagaagaaagcttctggaacaacattcattaaacgaaaactaaaattatttcttttggtggaataatcagcagaaaaacaaatttaaaagttaaattcaaatttaaattattgggtttttttgtataaagggactagtgatccattcttttgtgtgacaaaggggtgtgtgtgtgtgtgtgtgtgtgtgtgtgtgtgtgtgcgcgcgcgcgcacgtgcgcgcgcacgtgcatgtgtgtttacaggagtcatttttctgtatccatggtcagattggtcacaagatattccttgattccaaattcacagaagcttaagcctcttttataaaaaggcaaagtgtttgtattaatctcctatatacttcaaatcaatattatcttactaaaatatttaacatgatgtaaatgttgtgtaaatagttgtccactgtattgtttagaaaatgattgttttatgtttagtacagatatcatttttcaatattttggccatagttaaaatcatagatgtcaaacatctttgggaggccaaagacatgtacatagaatgtatagatagatagatagatagatagatagatagatagatagatagatagatagatagatgatagacagacagaagataggcagacagagagatagctgattatcattaatatattatcagaaaacatctatagacctaacttgatataggtcaaacttgaaactttgtcatatgtaagctgaattcagagttaaatactttggtatgtaaaaatatagcatattactactgtaaaatgattttttcttgagtgcttatgattgtaagaagattgatgtgaatgaattttaattatgaattttaaatttttgcaacatatttacttgtgattttggactatactctggcaaatgtctatatttatattttagaaaagtagcttcaaatgacattctagaagtagaaatgagagaaagcattactaattaattcaataacaaattagaattggattaacttatctttttttttatccattcgcatacctctaggatccattgatactcattttatctttccagaaatagggctaattcaatacagtttaaatttgacaataatttttggaactctggagaggtttattcaaatatgacctgtatgaagcaggtccaaatgggccaatatgatagctattcagctcataggaggtgccataccagccaccacgagcaggaagatgtcagaagttacaaaggaaaaaaggtatcagtctagaaaatgacaatggagagacaaataatacaatgacaaataatacaatggagagacaaagaagcataaagaaaaagaaaaagataaaagaaatattgccaaaacttaatatggcaaaactgatgtgtgacaggaagtagatacaggaagattcatatctgaaagtgagatttgaagaagatgagaagtctccaggcagcaaagcaggaaagtcacccctcagatgtcacagatatacctataaatatgcctgtatatatccataatgatagaaaacaaataagatttggtaaaaatcagcaagattttatgactgccatagggaaggaatttgtcaagtgctgggtcttgagacccaacttggtttacttttcttcattttggagcagatacatgtttttaactagcctttagtggttggtcttatggaaacttttgatacccccatattcttgtggattcctttaacttataatgttctgccttcaaagagtatattacatttgattgatcttactttagatcacgaagaaggcttctggttgtagacttaaaatgttgcaatatatttaattggagatattgtcactgtctgtacagcatgtttgttccgacagcatgagggtctgagcttgactatcaacactcatataaaaatgctaagtatgataatgtgcagccgtaatcccagtgctagaaaggagaagccaggaggattagatccagtctagccaatcagtgggctctatgttcagtgagagaccatgttggaaatactaaaatgaacagctataaagggagttgcttacaattgaccacatacacatcacacacacacacacacacacacacacacacacacacacacggagcatcttctatcactagacaaaagaagtaagttgaactcagaatgtttgctttttgtgtgtgtaagtctaatttatttttttcttaaattgaactgattatggaatgtgaaggttaatttcttttttttttacttttttttattaacttgagtgtttcttatttacatttcgagtgttattccctttcctggtttcggggccaacatccccctaatccctccacctccccttctttatgggtgttcccctccccatcctccccccattgccgccctccccacaacaatcacgttcactgggggttcagtcttagcaggaccaagggcttccccttccactggtgatcttactagaatattcattgctacctatgaggtcagagtccacggtcagtccatgtatagtccttaggtagtggcttagtccctggaagctctggttgcttggcattgttgttcataaggggtctcgagctctatcaagctcttcagaactcagaatgttttaaagcactgggcattgactgggatacaagagactggattttcttctcagtaatgtcaagaaagtacctccaaggatacgaaaggaaatctagctgttaaaataccttgtgcactttcctcatcaagaagaaaacagacagatacactaaagacaccctgtgaatttctatcaagttttcaacatacccaatgtgcctggatgccagcagctgattcagctgggttttcttccctaatgattaaagaatgtgagtgacatagatctttgttttcttaccaggtagggtggcttgtgtttatttttcccctaatactctagaaggaagaaaaatagttaagctttctaaaatgacaaatctctatttttaaatgatttgggaaaagctgattaactcatgtatattattgcctctgtttcatattaaatgaatatttatattttaaaggaaagaataaa

SEQ ID NO: 3368 - DNA, 4507 bp, Rattus norvegicus
  Genbank Accession No. NM_017226
cctgtagcaggtgctcattcccgggagcagcgcggactgcagccgcctctgcggggaaagatgctgcgggagcggaccgtacggctgcaatacgggagccgcgtggaggcggtgtacgtgctgggcacgcagctctggaccgatgtctacagtgcagcgcctgctggggccaaaaccttcagcctgaagcactcggagggtgtgaaagtagaggtcgtgcgcgatggagaggcagaggaggtagtcaccaacggcaagcagcgttgggccctgtcacccagcaccacactgcgactcagcatggcccaggccagcaccgaggccagcagcgacaaggtcaccgtcaactactatgaagaggatggcagtgcccctattgaccaggctgggctcttcctcactgccattgagatctcactggatgtggacgcagaccgggacggagaagtggagaagaataatcctaagaaggcatcctggacctggggtcctgagggccagggggccatcctgctggtgaactgtgaccgagacacaccctggttgcccaaggaggactgcagtgatgaaaaggtctacagcaaacaagaccttcaggacatgtctcagatgatcctgaggaccaaaggccctgaccgcctgcccgccgggtatgaaatagtcctctacatttctatgtcggactcggacaaagtgggcgtgttctacgtggagaacccgttctttggccagcgctacatccacatcctgggccggcagaagctctaccacgtggtgaagtacaccggtggctctgcagagttgctgttcttcgtggaaggcctccgtttcccagacgagagtttctcaggcctggtttccatccacgtcagtctgctggagtatatggccgaggacatcccattgacacccatcttcacagacaccgtgacgttccggattgccccatggattatgacacccaacatcctgcctcccgtgtcagtgtttgtgtgctgcatgaaggacaattacctgttcctgaaagaggtgaagaacctggtggagaaaaccaactgcgagctgaaagtttgtttccagtacatgaatcgtggcgaccgctggatccaggatgaaattgagtttggctacattgaggcacctcacaaaggcttcccagtagtgctggactcccctcgagatggaaacctgaaggacttccccattaagcaactcctgggcccagatttcggctatgtgacccgggagcccctctttgagactgtcaccagccttgactccttcgggaatctggaggtcagtcccccagtgaccgtgaatggcaaggcatacccgcttggccggatcctcatcgggagcagtttccctctgtctggaggcaggaggatgaccaaggtggtgcgtgacttcctgcaggcccagcaggtgcaggcgcccgtggaactctactcggattggctgactgtgggccacgtcgatgagttcatgaccttcgtccccatcccaggcaaaaaggaatttcggctgctcatggccagcacctcagcctgctaccagctcttcagagaaaagcagaaggaaggccacggggaggccattatgttcaagggtctggggggcatgagcagcaaacgaatcaccatcaataagatcctgtccaatgagagcctcacgcaggaaaaccagtactttcagcgctgtctggattggaaccgtgacatccttaagaaggagctggctctgactgagaaggacatcattgacctgcctgctctcttcaagatggatgaagaccgtcaggccagggctttcttccctaacatggtgaacatgatcgtgctagacaaggacctgggtatccccaagcctttcgggccccaggtcgaggaggagtgctgcctggagacacatgttcgaggcctgctggagcccctgggccttgcctgcaccttcattgatgacatctctgcataccacaagtttctgggagaggttcactgtggcaccaacgtgcgcaggaagcccttcaccttcaagtggtggcacatggtgccctgactgccaggggccctggccttccttccttccctgcgatctccaggtccttcctgtgtccccaagtccttcccctacaagaagcgggtgggattgggattgtgccttgctgtcccctggagaaggactttagtgtccattgaagccaccccgagtaagtccaaccgttccctacccctgaaaatagctagacatgtggttagtgtgcagaactttggaagggaaaaccagacttcaacaaatcatgtagtcgcactgtcccccaaagaattctcagcctctactccagatcagaaggaggggagagagaagggagactctgaggtcattggctcgcccagcacccatctgacattcaagatagaccaggaggaccagggccagggtcctggcgtacctcggatggtaccatcttttcaagcttacctaccttggggcctcctggtcggatccttcgcccattcattccttaaggcttcccatacacactgtgtccccaccccacccccaccccctgagggtccaatcattcagcttagaatcatccggaaatgggtcttagcagaggagaggtcttcactttctgtggattcgggctgcccaattttgggaggacggggaggtctcggactagcatccgatgtccaaagttcagtagacaaagatgcacctgtgtatcgacactatttctgttctctcccccggtcctcagttctctggccagtccgtgagcctctctttccattgttcttctgtttctgacactggccttcctattctggatgttgcccctccagcagctacagtttcttcaccaccagccagattcaggcctcccgagggcctgagaagtagccaatcccactgtccaaggatgctgaggatgctggcaatgccccagcctcactgatcacttcccggctagctactgctccagaggcagaattttccagcacactttccgaaggccttccatccagatacaggcaaatggatcccccctcccccaacctgcttcatttagaaaggcctccaggagctgtagagatggctcggcagttaaaaatgctccctgctcttcaaggggacccaagttcagttcccaacacccacggtgctctgtaactccagatccagaggatccaatacccttttctggtctctgagggcacttcacgcatgtgcacaaacccatagacataaatcaatgtttgagagtctggagagatggcccagtggttaaaagcacttgctgctcttgcggaggacctgggttcagttctcagcacccagttggtggctcacaaccaactataactctagtcccagggggtccgatgctctcctctgacctccataggcttctgcacacaggtggttcacatacacaccctcaagcacacatacaagtaaagtaaagtaaacgatgcttaaaaaatagaaacaaggaaaatatgtctcttaaaatagagaaggtccttttaaggccaagaaggtaggaaatggtaattctgctttggagggttaaacggtcccattttatagctgaagaaaagggttacacccacattcttaggggaacaagatttttaccttgcattatttcctcagtaggttgtatgctactgagtagtgggcacagacttggacgctgataacacaagctagccatagactcgcttgtcccaacagacaaaacccacgtctgcatagccaccctccgcccttgctgtggtaacactacccagtatattcaagaagcattcaggacaacagtcactgccttcaacaattaggaggtgtcctcttttctgtccagctggcctaatgcaccatgccaggtcaggccccagagcctccaaagctgtcatcctctgtctctggggacagaggttcctgcccttgagggcaaagccccaaatcctgtctcctgctccagagtggaaaacacaggcacctctctgagggaggtggtctggggatgtggcggtttgtcgtgtgtggtgttccgttaaagtggcttttactgcttttatttttatctgcgttaagaggaagtgagccctccccacgtggaggccacgacgtgtcttttgtaggttgtgttggtgtttggggaatttctggaactccaggactccgcctgtcccatctcacttactcacccagtgtgaccccctcaagtgtggacgccccatcccgaggactccttgctcttctccacctccattgtttgttggtgttttttttttttaaacttatgcccagaggcttctgggctatgccagttcctgtttcaatgttaattttgaaatgctctgctgagggtgggggtaacggcaggaagatggcgggaatggggcagtatgaacttcctggaaaaaaagccaagatggagtctgaggagtgtctgggggaagagccaaaataaagagcaataaaataagccgtc

SEQ ID NO: 3369 - DNA, 4381 bp, Rattus norvegicus
  Genbank Accession No. NM_017229
agcgcccggaacggggagggcgcggggtcggcgagcgccagcggcctcccggcagcccggggctatgaggaaggacgagcgcgagcgggacacgccagccatgaggtccccgccgccgccgccgccgccggccacggccacggccgcctcgccccccgagagcctgcgcaacggctacgtgaagagctgcgtgagcccgctgcggcaggaccctccgcgcagcttcttcttccacctctgccgcttctgcaacgtggagccgccggcggcctcgctccgcgccggggcacgcctctcgctcgccgctctggccgcctttgtcctggccgcgctgctgggcgcggggcccgagcgctgggcggccgcggcgaccgggcttcggacgctgctgagcgcttgctcgctcagcctcagcccgctcttcagcatcgcctgtgccttcttcttcctcacctgcttcctgacgcgcgcgcagcgcggcccggaccgcggcgccggctcctggtggctgctggcgctgcctgcctgctgctacctgggcgacttcgcggcgtggcagtggtggtcgtggctgcgcggggagccggcggcggcggcggccggccggctctgcctggtgctgagctgcgtggggctgctgacgctcgcgcctcgcgtgaggctgcggcacggagtcctggtgctgctcttcgccggcctggtgtggtgggtgtccttctccggcctcggggctctgccgcccgcgctcaggcctctgctgtcgtgcctggtcgggggcgcgggatgcctgctagccctgggcttggaccacttctttcacgtccggggagcctcacctcccccgcgctcggcgagtaccgcggatgaaaaagtgcctgtgatcagaccccggaggaggtccagctgcgtgtcgctgggagaaagcgcggccggttactatggcagtggcaagatgttcaggagaccgtcgttgccttgtatttctcgagaacagatgattctctgggactgggacttgaagcagtggtgtaaacctcattaccagaattctggaggtggaaatggagttgatctttcagtgctaaatgaagctcgcaatatggtgtcagaccttctgattgacccaagccttcccccacaagtcatttcttctttgcggagtatcagtagcttgatgggtgctttctcaggttcctgtaggccaaagattaattctttcacaccatttcctggattttatccctgttctgaagtagaagatccagtagagaaaggcgatcgaaaacttcacaaggggttgagtagcaaacccagtttcccgactgcacagctgaggaggagctcaggagcgtcaggattgctgaccagtgagcaccactcacggtgggatcgcagcggtggcaaaaggccttaccaagaactcagtgtttcaagtcatggatgccacctaaatgggccttttagttcaaatcttatgacaattccaaagcagaggtcatcatctgtgtcgctgacgcaccatgcaggtctgagaagagctggtgctttgcccagccccagtcttctgaattcttcaagccatgtacccgtgtctgctggctgtctaactaatcgatcacccgtaggatttcttgataccagtgattttcttactaagccaagtgttactttacatagatcactgggcagtgtatccagtgcagcagatttccatcagtaccttaggaactctgacagcagtctgtgtagcagctgtggacaccaaatactcaagtatgtttcgacatgtgaacctgatggtacagaccaccacaatgaaaaatcaggtgaagaagacagcactgttttctcaaaagaacgattgaacattgtggaaactcaagaagaagagacagtgaaggaagactgcagggaattatttttggaaggtgatgatcacctaatggaagaggcccagcaaccgaatattgaccaggaagtgttattggacccgatgttagtggaagattatgattcattaatagaaaagatgagcaactggaactttcagatttttgagcttgtagaaaaaatgggagaaaaatcaggaaggattctcagtcaggttatgtatactttatttcaagatactggtttattggaaacatttaaaattcccactcaagaatttatgaattattttcgtgcactagaaaatggctaccgagatattccatatcacaatcgtgtgcatgccacagatgtcctacatgctgtttggtatttgacaacacgaccaattcctggcttacagcagctccataataaccatgaaacagaaaccaaagcagattcagatgctagacttagttctggacagattgcttacctttcttcgaagagttgctgtattccagataagagttatggctgcctgtcttcaaacattcctgcgttagaactgatggctttatatgtggcagctgccatgcacgattatgatcacccaggaagaacaaatgcattcctagtggctacaaatgcacctcaggcagttttatacaatgacagatctgttctagaaaatcatcatgccgcatcagcgtggaatctgtatctttctcgcccagaatacaacttcctccttaaccttgatcacatggaattcaagcgttttcgatttttagtcatagaagcaatccttgctacagatctcaaaaaacattttgatttccttgctgaattcaatgccaaggccaatgatgtaaatagtaacggtatagaatggagcagtgaaaacgatcgactcttagtctgccaggtgtgcatcaaattagcagacatcaacggcccagcaaaagatcgggatcttcatttgagatggacagaaggcattgtgaatgagttttatgagcagggagatgaagaagcaaccctgggtctacctattagtcccttcatggatcgttcttctcctcaactagcaaaactccaagagtcatttatcacccacattgtgggccccctgtgcaactcctatgatgctgctggcttgctgcctggtcagtggatagaagcagaagagggtgacgatacagaaagtgatgatgatgatgatgatgatgatgatgatgatgatgatgatgatgaagagttagattcagatgatgaagaaacagaagacaatctaaatcctaaaccacaaagaaggaaaggcaggcggcgaatattttgccaactaatgcaccacctcactgaaaaccacaagatctggaaggaaatcatagaagaggaagaaaaatgtaaagctgaggggaacaaactgcaggtggataatgcctccttacctcaggcagatgagattcaggtcattgaagaagcagatgaagaggaagaacaaatgtttgaatgagaagaaaactcatgctgaagaagcctggggtgctcttcccagggtcgttacctagtgctcaccgtactgattctcaactgaccattcccatgtggacaggccttaatactgtgaggggatccttgctaccttggtagttctcactcctaagcactttgattacagactagagactgaccttagagctttctgcagttgagtgatgctgcagagccttctccaagccttcactggtgtgtaaatagtgtgtcataatgctgctttgctgggtagtgagctctcgtttgtcatggtgagggagggaggtagggagggagggagggatggagggatggagggaaggagggagggctaacacagaaaagtcaagtgaccttggttttcaaagtgaccataattcttttatgaaaacaggatacctcgggtatttccaaatatatcttctatgtctttgtttgggggtgggatggggccagaaacaaacttctatgcttaatccaaaaaggaatttatcacggcctttctgagtgatttctgctcgtggcagtacactgttccatgtggttctcctagcttcatccgtgaaggactgaggacctttgttatacttaacaaaacccagatgcatcaatttctgatgctttttactgttgtgtataatctacttaagtgttttatttctgccgaaagtattcaggtttgctgtggacatcaggagtctgaattctgttcttactgattttgttccatggttgaattttaaaagtgtttaacaatgaaggaactttattctttagtcaaaactgttatttttattcttgctcaggatacataattttaaacattaattattataaacgtggcatagatttgccagaaaaaaaacattgtcctaatattgatgttaccttttatgaaatgagcaccattttcttttaattaaagccaagaaaaaggagatgactatcttttgccttagtggaaaatcaa

SEQ ID NO: 3370 - DNA, 4404 bp, Rattus norvegicus
  Genbank Accession No. NM_017232
  misc_feature (1)..(4404): n = a or c or g or t
cttcaggagtacgaagaccctgcctacgaaggaactcagctctgtgttcctgccagctcccccgccagcttcacttgccaccaacgctgccacaactgctgccaccaccgctgccacctctgcgatgctcttccgagctgtgctgctctgcgcttgccctggcctcagccatgcagcaaatccttgctgttccaacccatgtcaaaaccgtggtgaatgtatgagcataggatttgaccaatataaatgtgactgtacccggactggattctacggtgaaaactgtactacgccgagattcctgacaagaatcaaattaccgctgaagcccaccccaaacacagtacactacatcctgacccacttcaagggagtctggaacattgtgaacaacattcccttccttcgaattcaatccatgagatacgtgttgacgtccagatcacatttgattgacagcccaccaacttacaatgtgcactacggttacaaaagttgggaagctttctccaacctctcctactacaccagggcccttcctcctgtggctgatgactgcccaactcccatgggtgtgaaaggaaataaggaacttcctgattcaaaagaagttctggaaaaggttcttctgaggagagagttcatcccggatccccaaggcacaaatatgatgttcgcattctttgcccagcacttcactcatcagtttttcaagacagatcagaagcgaggacctgggttcacccgaggactgggccatggagtggacttaaatcatgtttacggtgaaactctagacagacaacataaacttcgacttttccaggatggaaaattgaaatatcaggtcatcggtggagaggtgtatcctcccacagtcaaagacactcaggtagacatgatctaccctccccacgtccctgagcacctgcggttcgctgtggggcaggaagtctttggtctggtgccgggtctgatgatgtatgctaccatctggcttcgggagcacaacagagtgtgtgatattctcaaacaggagcatcctgagtgggatgacgagcgactgttccaaaccagcaggctcatactgataggagagacgatcaagatagtgatcgaagactacgtgcaacacctgaggggttaccacttccaactcaagttcgacccagacctgcttttcaaccagcagttccagtatcagaaccgcattgcctctgaattcaagacactctatcactggcatccgctgctgccggacaccttcaacattgaagaccaggagtacactttcaaacagtttctctacaacaactccatcctccttgaacacggacttgctcactttgttgagtcattcaccagacagattgctggccgggttgctgggggaaggaatgttccaatcgctgtacaagcagtggcaaaggcctccattgaccagagcagagagatgaaataccagtctctcaatgagtaccgcaaacgcttctccctgaaaccttacacatcgtttgaagaacttacaggagagaaagaaatggctgcagagttgaaagccctctaccatgacatcgatgccatggaactgtatcccgccctgctggtggaaaagcctcgnccagatgctatctttggggagaccatggtagaacttggagctccattctccttgaaaggccttatgggtaatcccatctgttctcctcaatactggaaacctagcaccttcggaggagaagtggggtttaggatcatcaacactgcctcaattcagtctctcatctgcaataatgtgaaagggtgtcccttcgcctctttcaatgtgcaagacccgcaggctaccaagacagccaccatcaacgcaagtgcctcccactccagactagatgacattaaccctacagtactaatcaaaaggcgttcaactgagctgtaagagtctactgaccatatttatttatttatatgaacaatttaatttaattatttaatattatacagaatgcttttttttcacttaacatcttctataacagaaggcaatattcttgaacaatgttccatttgtgaagattcctgtgttgtacttttaaatatggttatccgaaagtgaaagggaaaaaaaagaacactttcatttttcggcataagccagtgagaagggaaatgaattttgatatctttatacttgaatgtcagctcatgactagccttaattaagaacaaatgaaaggtgtatgaatatttaaatgctgttacaaggagggaaatgtgaatatttaaatgctgttacaaggagggaaatgctgcattgttggttatgactgtgtcatccttactatgttaggagcaaccgatgtggaattgtttttaaatcttgcatatctttatctcatcaaagcaaaggggtacaagtccagttttaaatgaacatgaaggcagataccggcaactgtctttttattttttaaaagcaatctttgaaacaaatgatttgcaatgtctaaatcgggagttggaatcactttcgaaagcccttactttcttgagctgtcaaatttgtacccacacagattaagcagctaccataaacacaaatctaaaactggggaaaactattatgactgatggttaagataccatgtcagggatctttcttttctcaggagtagtgaaaagctactatgacaatcagaccttccttgtacgtcagattgctggcgtaggaaggtggcggagcccgtgatgttctgtcctaaacgatggaaaagctttaaagcttgtgtgtgagtggtagccagcaaaacctatcatagcaacaaaagagtccacaaacaaaataaccaagaacaaagaagggttcccaagcttaaagaccgcatcgagggttaaactttttggaagggagacttttcagatcctcctgtgggtgcttggcttgtgactttggcaggctggattttaaagagtttttctgttgcacagtatgacacaacagcccatctctcaatgcaaaaggtatcagtgggcttcttcaaaactttgaaatgtcttccagctcacggtaccagaagtgcagtaggccccatgcaatgtgtgagttcagcctggatgccagcatgatgctctccttactctgtttcttgtagtcattttgctctgagaaactgctgattgatctgtttttgtagctgtgttccaggctcttagtattctttctttaacctccattaatattttctctacttgaagttttacattcaggaaaaacctcagctcaggactactgtgtagctccccttcggaggaagaagttactttagacaaaagggaaaaaaaattaaatgtatttttcatttgtaattaaatggaagggccctaccaagattctagaattggagggggttctgacaagaaagttacattcttgtcctgaagaattgctttcttatttaaaaacagagtcagttagtgggtagttctgggcaatagaaataaatataaaacaataatgacaatcattctctacatctcattatcagctgaggtactgtatattactgaatttactgaagatagttatgtctttcagacattgttgttataaactatgtttaagcctactacaagtgtttcttttttgcattatgtcagaattgatgtaccttttttttaatgattacctccctgtactactgtgcgaacaatcaaacaaaatgatgagattaatggtcatggataaatttcaagaaaactagtgtatttgattgaaaagtttaaagttagaacttaggccattggaatttactcatatagcaaactgcgtagagccaatattgactcacctacacacgttatacagattgacattttagacatttggaaggccccgtaggtattttattagttagaacttaattttttgaaaaaacatatccaaagcacaataggcattagaatttgtgcatcgagaactgattacaaataatattgatatgtatgtaaataactgagaagtatgtcttatgaagaaatatattttattacaaaaaattataaaacattttcaagattatatgctttaaaagtttaagatcagaaaataatcaactttagaaaaacacgtttaaaaattgttaacatcattgattaaaaaaaaaaaaaaaaaagccaacatgattgttgtgaacatcaacctgctgactgaacctgggaattcaggttaagtatgtgactgctgccgtgcctcagagaaatttgtatttaaattaacttatgtaaaaaaaaatcttagaacaaatgtttgtttatttttatacttatttaagaaattgaaaacttctgaaaataaagtttgattgtgtctttaaaaaaaaaaaaaaaaaaaaaaaaaaaaaaaaa

SEQ ID NO: 3371 - DNA, 1361 bp, Rattus norvegicus
  Genbank Accession No. NM_017233
tccagtactctggtagaggtctgaccaccatcaaccatgacaacctacagcaacaaaggaccaaagcctgagagaggccggttcctccatttccactctgtgaccttctgggttggcaacgccaagcaggctgcctccttctattgcaacaagatgggcttcgaaccgctggcctacaagggcctggagacgggctcccgggaggtggtcagtcatgtcatcaagcaagggaaaattgtgtttgttctctgctctgctctcaatccctggaacaaagagatgggtgaccacctggtgaagcatggtgatggcgtaaaggacatcgcattcgaggtggaagactgtgaacacattgtgcagaaagcccgagaacggggcgctaaaattgtacgggagccatgggtggaggaagacaaattcgggaaggtgaagttcgctgtgctgcagacgtatggagataccacgcacaccctggtggagaagatcaactacaccggtcgtttcttacctggattcgaggccccaacatacaaggacaccctacttccaaaactacccagctgtaacctggagatcatcgaccatattgtaggcaaccagcccgaccaggaaatggagtctgcctcagaatggtacctgaaaaacctgcagttccaccggttctggtctgtagacgacacacaggtgcacacggagtatagctctctgcgctccatcgtggtggccaactatgaggagtccatcaaaatgcccattaatgaaccggccccgggcaggaagaagtctcagatccaggaatatgtggactataatgggggtgctggggtccagcacatcgctctcaggaccgaagacatcatcacaacgatccgccacttgagggaacgaggcatggagttcttggctgtcccgtcttcttactacagactgcttcgggagaatctcaagacctccaagatccaagtgaaggagaacatggatgtcttggaggagctaaaaatcctggtagactacgatgagaaaggctacctcctacagatcttcaccaagcccatgcaggaccggcccacgctcttcttggaagtcatccaacgccacaaccaccagggctttggagcaggtaacttcaactctctgttcaaagctttcgaagaggagcaagccctacggggtaacctcactgacctggagaccaacggtgtgaggtctggaatgtaagctccacccacacccagaccgcgcaaggcgctggacaagtcaatcagctccaactggctgaaaggctggacctcagggctccacccacaccatggccacgccccctctacggcaaggcttctcctgatccgtttcgagtaaac

SEQ ID NO: 3372 - DNA, 1647 bp, Rattus norvegicus
  Genbank Accession No. NM_017235
gcaaggcgtgaatgatgcggaaggtggttttgattaccggggcgagcagtggcattgggctggccctttgcggtcggctgttggcagaagacgatgaccttcacctgtgtttggcgtgtaggaacctgagcaaagcaggagctgtccgtgatgccctgctggcctctcacccctccgccgaggtcagcattgtgcagatggatgtcagcaacttgcagtcggtggtccggggagcagaggaagtcaagcgaaggtttcaaagattagactacttatacctgaacgccggaatcatgcctaacccccagctaaacctcaaagcgtttttctgtggtatcttttcaagaaatgtgattcatatgttctccacagcggaaggacttttgacccagaatgacaagattactgctgatgggttccaggaggtgtttgaaaccaatctctttggccactttatcctgattcgggaactggaaccacttctctgccacagtgacaacccctctcagctcatctggacgtcttctcgaaatgcaaagaagtctaacttcagtcttgaggacatccagcacgccaaaggccaggaaccttacagctcttccaaatacgctactgacctcctgaatgtagctttgaacaggaatttcaatcagaagggtctgtattccagtgtgacgtgtccaggggtcgtaatgaccaatctgacgtatgggattctgcccccctttgtttggacgttgcttctcccggtgatatggctccttcgcttttttgcacatgcgttcactgtgacaccgtacaatggtgcagaggcattggtgtggcttttccaccaaaaaccggagtctctcaaccctctgaccaaatacttgagcggcaccacaggattagggactaattatgtcaagggccaaaagatggacgtagatgaagacactgcagaaaagttctacaagaccttactggagctagaaaagcaagtcaggatcaccattcagaaatcagatcaccacagctgacagcgacgttccccagagcatccagtccgcgtacgccctggtgcgcgcagctttctatcatactgggtgatacatgtttgtagtaaaccataagccatgatgatctctcctcctactttttagaatggtctccaagactgcgtgggtgcacttgtgagaaaggcgtcgcaaagcagaggggccagctgaataccctccagagtagtgtcctgtcagaattgctaaaggcttcccgcagagcatcctcggatagcattctgccacccggagcccagtagtttagacttgcgtgatggggacacagtacagcctgaatcttcttttagtcccagcgaggagaggcaatgctactgactaggacttctacttcctttgcttttctccatgatccctttttttttttttttaactctctttacattcttcatatgctgcttcggataatctcatacgttgtctgagcacgtggccccacgtgaccgcccacgcagtcattttcaggaacaaagtatgtttgtgtttgggccacaagcatggtttctgatctttaataacatccacagatgtattcattatgaacagcttatcgtcacgatcatagttcactggaattaaacttgtagcaaac

SEQ ID NO: 3373 - DNA, 1075 bp, Rattus norvegicus
  Genbank Accession No. NM_017236
gtttaactgcactcgggactcggcgcgcgcgtgtgtctgttctctccatcgtcatggccgccgacatcagccagtgggccgggccgctgtcattacaggaggtggatgagccgccccagcacgccctgagggtcgactacggcggagtaacggtggacgagctgggcaaagtgctgacgcccacccaggtcatgaatagaccaagcagcatttcatgggatggccttgatcctgggaagctctacaccctggtcctcacagaccccgatgctcccagcaggaaggaccccaaattcagggagtggcaccacttcctggtggtcaacatgaagggcaacgacattagcagtggcactgtcctctccgaatacgtgggctccggacctcccaaagacacaggtctgcaccgctacgtctggctggtgtatgagcaggagcagcctctgaactgtgacgagcccatcctcagcaacaagtctggagacaaccgcggcaagttcaaggtggagtccttccgcaagaagtaccacctgggagccccggtggccggcacgtgcttccaggcagagtgggatgactctgtgcccaagctgcatgatcagctggctgggaagtaggggcgctgcagagcccgcagccccggggaccccacagtacagtcaagtcgtataaagcatgtctgtggggtgtccccccacgcccatccttccttcccaccctctcatagggagttctcagttgtgctaggttacagctctaggatgtcttccactttgtccaggaccaggcccagtaacatcttttggggtgggcttatcaatcctcccatctcggctgagccctgaccgcccaggtcagatggctgcatagttatcaatattcctgggctgctgctacgcagtgctgctgtgtggaggccaggctgtggagagagaccctgttagccccttacatcccagtgggataagcaaaagtcaccggagttgctgggcgtgttaaacctcatcaaatacaaataaagggcattgcattcagaaaaaaaaaaaaaaaaaaaaaaaaaaaaaaaaaaaaaaaa

SEQ ID NO: 3374 - DNA, 856 bp, Rattus norvegicus
  Genbank Accession No. NM_017237
ggcgcttgttcttccctgtgccactccgcaaagatgcagctgaaaccgatggagattaaccccgagatgctgaacaaagtgttggccaagctgggggtcgccgggcagtggcgctttgccgacgtgctagggctggaggaggagatcctgggctcagtgccatctcctgcctgcgccctgctgctgctgtttcccctcacggcccagcatgaaaacttcaggaaaaaacaaattgaggaactgaagggacaagaagttagccctaaagtttacttcatgaagcagaccatcgggaactcctgtggtaccattgggctgatgcacgcagtggccaataaccaagacaacctgggatttgaggatggatcagtcctgaaacagtttctgtctgaaacggagaagttgtcccctgaagacagagccaagtgtttcgagaagaacgaggccattcaggcagcccatgactccgtggcccaggagggccagtgccgggtagacgacaaagtgaatttccattttatcctgttcaataatgtggacggccacctctacgagctcgatgggcgaatgcctttcccggtgaaccatggcgccagttcagaggactctctgctgcaggatgccgccaaggtctgcagagaattcactgagcgcgagcagggagaggtccgcttctccgcagtggctctctgcaaagcagcctaagtagggagagagaaccagccgctcccccatccctgggcaggtgcgcgctgccctgcccttggtttgcagctttagcacttaacaaccacagctgtcttcttgcgttctactgccccgtcccctccaccccacccaggccaccagggagctc

SEQ ID NO: 3375 - DNA, 5930 bp, Rattus norvegicus
  Genbank Accession No. NM_017239
tctgtgaaaagattaaccggagtttaagagtgataggatgacggatgcccagatggctgacttcggggcggcacgatacctccgcaagtcagagaaggagcgcctagaggcccagacccggccctttgacatccgcacagagtgcttcgtgcctgatgacaaggaggagtatgtcaaggccaagatcgtgtcccgggaagggggcaaggtcactgccgaaactgaaaacggcaagacggtgactgtgaaggaggaccaggtgatgcagcagaaccctccgaaattcgacaagatcgaggacatggccatgctgaccttcctgcatgagccagctgtgctctacaatctcaaggagcgctatgcggcctggatgatctatacctactcaggcctcttctgtgtcaccgtcaacccctataagtggctgccagtgtacaatgcggaagtggtagctgcctaccggggcaagaagaggagcgaggctccaccccacatcttctccatctctgacaacgcctatcagtacatgctgacagatcgggagaaccagtccatcctcatcactggagaatccggagcggggaagactgtcaacacgaagcgtgtcatccagtactttgctagcattgcagccataggggaccgtagcaagaaggacaatcctaatgcaaacaagggcaccctggaggaccagattatccaggctaaccctgctctggaggcctttggcaacgccaagactgtccggaatgacaactcctcccgctttgggaagttcatcaggatccactttggagccacaggaaagctggcttctgcagacatagagacctaccttctggagaagtcccgggtgatcttccagctaaaggctgagaggaactaccatatcttctaccagatcctgtccaacaagaagccggagctgctggacatgctgctggttaccaacaacccgtacgactatgccttcgtctctcagggagaggtgtctgtggcctccattgatgactccgaggagcttttggccactgatagcgcctttgatgtgctgggcttcacagcagaggagaaggccggtgtctacaagctgacaggcgccatcatgcactatgggaacatgaagttcaagcagaagcagcgggaggagcaggcggagccagacggcacagaagatgctgacaaatctgcctacctcatggggctgaactcagccgacctgctcaagggtctgtgtcaccctcgggtgaaggtgggtaacgagtatgtcaccaaggggcagagtgtacagcaggtgtactattccatcggggcactggccaagtcagtgtacgagaagatgttcaactggatggtgacacgcatcaacgcaaccctggagaccaagcagccacgccagtacttcataggtgtcctggacatcgccggctttgagatctttgatttcaacagctttgagcagctgtgcatcaacttcaccaatgagaagctgcagcagttcttcaaccaccacatgttcgtgctggagcaggaggagtacaagaaggaaggcatcgagtgggagttcattgacttcggcatggacctgcaggcctgcatcgacctcatcgagaagcccatgggcatcatgtccatcctggaggaggagtgcatgttccccaaggccacagacatgaccttcaaggccaagctgtacgacaaccacctgggcaagtccaacaacttccagaagcctcgcaatgtcaaggggaagcaggaagcccacttctctctggtccactatgctggcaccgtggactacaacatcttgggctggctggagaagaacaaggaccctctcaacgagacggtggtggggctgtaccagaagtcctccctcaaactcatggccacactcttctccacctatgcttctgctgataccggtgacagtgggaaaggcaaaggaggcaagaagaaaggctcatccttccagacagtgtctgctctccaccgggaaaatctgaacaagctgatgacaaacctgaggaccacccatcctcactttgtgcgctgcatcatccccaatgagcggaaggctccaggggtgatggacaaccccctggtcatgcaccagctgcgatgcaacggagtgctggagggtatccgcatctgtaggaagggcttccccaaccgcattctttatggggacttccggcagaggtatcgaatcctgaacccagcagccatccctgagggccaattcattgatagcgggaaaggggctgagaagctgctgggctccctggacattgaccacaaccagtacaagtttggccacaccaaggtgttcttcaaggcggggctgctggggctgctggaggagatgcgagatgagaggctgagccgcatcatcaccagaatccaggctcaagcccgaggccagctcatgcgcattgagttcaagaagatggtggagcgcagggacgccctgctggttatccagtggaacatccgcgccttcatgggggtcaagaattggccgtggatgaagctctacttcaagatcaagccgctgctgaagagcgcagagacagagaaggagatggccaacatgaaagaggagttcgggcgagtcaaagatgcactagagaagtctgaggctcgccgcaaggagctggaggagaagatggtgtccctgctgcaggagaagaatgacctgcagctccaagtgcaggcggaacaagacaacctggcagatgccgaggagcgctgcgaccagctgatcaagaacaagatccagctggaggccaaggtgaaggagatgaccgagaggctggaggacgaggaggagatgaacgccgagctcacggccaagaagcgcaagctggaagacgagtgctcagagctcaagaaagatatcgatgacctggagctgaccctggccaaggtggagaaggaaaagcacgcaacagagaacaaggttaaaaacctgacagaggagatggccgggctggacgagatcattgccaagctgaccaaggagaagaaagctcttcaagaggcccaccagcaagccctagatgaccttcaggctgaggaagacaaggtcaacacactgaccaagtctaaagtcaagctggagcagcaggtggatgatctggagggatccctggagcaggagaagaaggtgcgcatggacctggagcgagcaaagcggaagctggagggtgacctgaagctgacccaggagagcatcatggacctggagaacgacaagcttcagctggaggaaaagctcaagaagaaagagtttgacatcagtcagcagaacagtaaaatagaggacgagcaggccctggcccttcagctgcagaagaaactgaaggaaaaccaggcacgcatcgaggagctggaggaggagctagaggcggagcgcacagcccgggccaaggtggagaagctgcgctcagacctgacccgggagctggaggagatcagtgagaggctagaggaagccggtggggccacatctgtgcagatagagatgaacaagaagcgcgaggccgagttccagaagatgcggcgggacctggaggaagccacgctgcagcatgaggccacagccgcggccctgcgcaagaagcacgcagacagcgtggccgagctgggcgagcagatagacaatctacagcgggtgaagcagaagctggagaaagagaagagcgagttcaaactggagctggatgacgtcacctctcacatggagcagatcatcaaggccaaggcaaacctggagaaagtgtcccggacactggaggaccaggcgaatgaataccgggtgaagttggaagaagcccagcgctccctcaatgacttcaccacacagcgagccaagctgcagacagagaatggcgagttggctaggcaactggaagaaaaggaggcactgatttggcagctgacccggggcaagctctcctatacccagcagatggaggacctcaagaggcagctggaggaggaaggcaaggccaagaatgccttggcccacgcactgcagtcagcccggcatgactgcgacctgctgcgggaacagtacgaagaagaaatggaggccaaggccgagctgcagcgtgtcctgtccaaggccaactcagaggtggcccagtggaggaccaagtatgagacggacgccatacagaggacggaggagctggaggaagccaagaagaagctggctcagaggcttcaggatgctgaggaggcagtggaggccgtcaacgccaagtgctcctcgctggagaagaccaagcacaggctgcagaacgagatcgaggacctgatggtggatgtggagcgctccaatgcggccgccgcagccctggacaaaaagcagaggaacttcgacaagatcctggctgagtggaagcagaagtatgaggagtcccagtcagagctggagtcttcccagaaggaggcgcgctccctgagcacagagctcttcaagctcaagaatgcctatgaggagtctctggagcacctggagaccttcaagcgggagaacaagaacctccaggaggagatctcagacctgactgaacagctgggagaagggggtaaaaatgtgcacgagctggagaagatccgcaaacagctggaggtggagaagctggaactgcagtcagccctggaggaggctgaggcctccctggagcatgaggagggcaagatcctccgagcccagctggagttcaaccagatcaaggcagagatcgaaaggaagctggcagagaaggacgaggagatggagcaggccaagcgcaaccacctgcgggtggtggactccctacagacctccctggatgccgagacacgcagccgcaacgaggccctgcgggtgaagaagaagatggagggcgacctcaatgagatggagatccagctcagtcaggccaatagaatagcctcagaggcccagaagcacttgaagaacgcccaagcccacttgaaggacacccagctccagctggatgacgcagtccgtgccaatgacgacctgaaggagaacatcgccatcgtggagcggcgcaacaccctgctgcaggcggagctggaggagctgcgggccgtggtggagcagacagagcggtctcggaagctggcagagcaggagctgatcgagaccagcgagcgggtgcagctgctgcactcccagaacaccagcctcatcaaccagaagaagaagatggatgcagacctctcccagctccagacagaggtggaggaggcggtgcaggagtgtaggaacgcagaggagaaggccaagaaggccatcacagatgccgccatgatggccgaggagctgaagaaggagcaggacaccagcgcccacctggagcgcatgaagaagaacatggagcagaccatcaaggacctgcagcaccggctggacgaggcagagcagatcgccctcaagggtggcaagaagcagctgcagaaactggaggcccgggtccgggagctggagaatgagctggaggctgagcagaagcgcaatgcggagtcggtgaagggcatgaggaagagcgagcggcgcatcaaggagctcacctaccagacagaggaagacaagaagaacttggtgcggctgcaggacctggtggacaagctgcagttgaaggtgaaggcctacaagcgccaggctgaagaggcggaggaacaggccaacaccaacctgtccaagttccgcaaggtgcagcacgagctggatgaggcagaggagagggcggacattgccgagtcccaggtcaacaagctgcgggccaagagccgtgacattggcgccaagcagaaaatgcacgatgaggaataacctgtccagcagaaagagcctcgctgttgctatcccacaataaatatgaatgcttgactttgcctgtaaaaaaaaa

SEQ ID NO: 3376 - DNA, 1981 bp, Rattus norvegicus
  Genbank Accession No. NM_017243
caacgcggttctgttggtgttcaggttccctactgacttcccttccagtggcagcggcggaggcggcagtggcagcggcaagcactgagcacgtttgggtagttgtccaagatgccgaatatcaaaatcttcagcgggagctcccaccaggacttatcccagaaaattgctgaccgcctgggcctggagctaggcaaggtggtgactaagaaattcagcaaccaggagacctgtgtggaaattggggagagtgttcgtggagaggatgtctacattgttcagagtggctgcggtgagataaatgacaatctaatggagcttttgatcatgatcaatgcttgcaagatcgcttctgccagccgggttactgcggtcatcccatgcttcccttatgcccggcaggataagaaggataagagccgggctccaatctcagctaagcttgttgcaaatatgctatctgtagcaggtgcggatcatattatcaccatggatctacatgcatctcagattcagggcttctttgatatcccagtggacaatttatacgcagagccagctgtcctgaagtggattcgggagaacatatctgagtggagaaactgtactattgtctcacctgacgctggcggagccaagagagtgacctccattgcagaccgattgaatgtggattttgctttgattcacaaagaacggaagaaggccaatgaagtggaccgcatggtactagtaggagatgtgaaggatcgtgtggctatacttgtggatgacatggctgacacttgtggtacaatttgtcatgctgctgacaaacttctctcagctggagctaccagagtttatgccattttgacgcatgggatcttttctggtccagccatttctcgcatcaacaatgcatgctttgaagcagtagtagttaccaataccatacctcaggaggacaagatgaaacactgctccaaaatccaggtgatcgacatctctatgatccttgcagaagccatcaggagaacccacaatggagaatctgtctcctacctgttcagccatgttcctctataatatcataaattctgaagcgttttcaaaatgaaaccacccccaccccttgtttttcttgtatttggtgagttgggcagaagagccagcttgcttcagtgtagctttttacagcccacattagctacattaggatttatcctaattggagaaagacagactgctattaactgctaggacaccctacgtgcattgttgcagcctggctttcttgtttattttgtgatccttgcagctttaaattgagttccactgttgaaagctgcatagactgttaaaagagagagtattccccaaggtccttaggatggaattgtggagctcatactccattgcatgtgaaggctttggagtttccttcattcagaataactagcgacaaagccagccctcgtgtgatacattttcagaggtgtatgctacactgcagcaagttccctgtgcatccttaaacagagttcgcctgctgagcaccctgtacggcaggggcgggtagctcaatgcagtaatcaatttttgggaggaagaagcctgatctattatcatctgtttaattctctgtagcttggattctctatgcctattcctttcctgttggcttcaccttcagctatctcgaccctttcctggacaaatatcttgaactcagtgatcattgtttgtgacaaaattttctgtaagacagacttgcttcttgctatgtaactgctaacgttgacattaggtaacttgctatagcacaatcttccttagcccgctctctctgagttagtgggttttaggtggtgtgtgtgtcgtagtgccttttgattaatttaagtatttaatttttatcttccttcgatctgtttggcttaacaatttgatcttattgtctcatgtagaagaaacttaataaaatgtctgtcatgtgtac

SEQ ID NO: 3377 - DNA, 2626 bp, Rattus norvegicus
  Genbank Accession No. NM_017245
cgcttccctgttcacctctgtatttgagaatccgacgccatctgccaccatggtgaacttcacagtagatcagatccgtgccatcatggacaagaaagccaacatccggaacatgtcagtcatcgctcacgtggaccacggcaagtccacgttgaccgactcccttgtgtgcaaggctggcatcatcgcctctgcccgagccggtgagacacgcttcactgacactcgaaaggatgagcaggagcgctgcatcaccatcaagtccactgccatctccctcttctatgagctctccgagaacgacctgaacttcatcaagcagagcaaggatggctctggcttcctcatcaacctcattgactctccaggtcatgtggacttctcctcagaggtgaccgctgctctgcgtgtcactgatggagcactggtggtggtggactgtgtgtctggtgtctgtgtgcagacagagacagtgctgcggcaggccatcgctgagcgcatcaagcccgtgctgatgatgaacaagatggaccgggccctgctggaactgcaactggagcctgaggagctctaccagaccttccagcgcatcgtggagaacgtcaatgtcatcatctccacctatggcgagggcgagagtggacccatgggcaatatcatgatcgatcctgtcctgggcactgtaggctttggctctggcctgcatgggtgggccttcacactgaagcagtttgcagagatgtatgtggccaagtttgcagccaagggtgagggccagctgggtgcagctgagcgggccaagaaggtagaagacatgatgaagaagctgtggggagaccggtattttgacccggccaacggcaagttcagcaagtcagccaatagcccagacgggaagaaacttccccgcaccttctgccagctcatcttggaccccatcttcaaggtgtttgatgccatcatgaacttcagaaaggaggagacagccaagctgatcgagaagctggacatcaagctggacagtgaggacaaggacaaggagggcaaaccactgctgaaggctgtgatgcgtcgctggctccctgctggtgacgccctgctacagatgatcaccatccacttgccgtccccggtcactgcacagaagtaccgttgtgagctgctgtacgagggcccacctgatgacgaggccgccatgggtattaagagctgcgaccccaaaggccccctaatgatgtacatctccaagatggtgccaacatctgacaaaggccgcttctatgccttcggtagagtgttctctggggtggtgtccacaggtctgaaggtccggatcatgggccccaactatacacctgggaagaaggaggacctgtacctgaagcctatccagaggaccattctgatgatgggccgctatgtggaacccattgaggatgtgccctgtggcaacattgtggggttggtcggggtggaccagttccttgtgaagaccggcaccatcactacctttgagcacgctcacaacatgcgggtgatgaagttcagcgtcagccctgtagtcagggtggcagtggaggccaagaacccagctgacctgcccaagctggtggaggggctgaagcggctggctaagtctgaccctatggtgcagtgcatcatcgaggagtctggggagcacatcattgctggtgctggagagctgcacctggagatctgccttaaggacctggaggaggaccatgcctgcatccccatcaagaaatctgaccctgtcgtgtcctaccgggagacagtcagtgaggagtccaacgtgctctgtctttccaagtccccaaacaagcacaacaggctgtacatgaaggccaggcccttccctgatggcctagcagaggacatcgataagggtgaggtatctgcccgccaggagctcaaggcgcgtgcccgttacctggccgaaaagtatgagtgggatgttgctgaagcccgcaagatctggtgctttggacctgatggcactggtcccaacattctcaccgacatcaccaagggtgtgcagtacctgaatgagatcaaggacagtgtggtggctggattccagtgggccactaaggagggtgctctttgtgaggagaacatgcgtggtgtgcgatttgatgtccatgatgtgaccctgcatgctgatgccatccaccgaggaggtggtcagatcatccccacagcgcgccgctgcctctatgccagtgtgctgactgcacagccccgcctcatggagcctatctacctggtggagattcagtgtcctgagcaagtggtgggcggaatctatggtgtcctcaacaggaagcgtggccatgtctttgaggagtcccaggtagctgggacccccatgttcgtggtcaaggcctacctgcctgtcaatgaatcctttggcttcactgccgaccttcgatccaacactggtggccaggccttcccccagtgtgtgtttgaccactggcagatcctgcctggggacccctttgacaacagcagccgccccagccaagttgtagctgagacccgcaagcgcaaaggcctgaaggagggcatcccagcgctggacaacttcctggacaaactgtag

SEQ ID NO: 3378 - DNA, 1742 bp, Rattus norvegicus
  Genbank Accession No. NM_017246
atacattccccttgtcacttcttggggctcctaagtaggggccagtcggtactccttgccgcaggatgtgagaccctttaacctgtaatgctgtggctggcccttggcccctttcgtgccatggagaaccaggtgctggtgattcggatcaagattccaaatagtggcgcggtggactggaccgtgcactccgggccgcagttactcttcagggacgtgctggatgtgataggccaggttctgcctgaagcaacgacgacagcctttgaatatgaagatgaagatggtgataggattacagtaagaagtgacgaagagatgaaggcaatgctgtcctactattattccacagtaatggaacagcaagtaaatggccagctaatagagccgctgcagatctttccaagagcctgcaagcctcctggggaacggaacatacatggcctgaaggtgaatacacgggctggaccatctcagcacaccagccctgtggtctcagattcacttccaagcaatagcttgaagaagtcctcggctgaactgagaaagatactggccaacggccagatgaatgaacaagacatacggtatcgagacacccttggtcatggcaacggaggcacagtctacaaagcatatcatgtcccaagtgggaaaatcttagctgtaaaggttattctgttagacatcacactggagcttcagaagcagatcatgtctgagttggaaattctttataagtgtgactcatcgtatatcataggattttacggggcattttttgtagaaaacaggatttcgatttgtacagaattcatggatggggggtctttggatgtatataggaaaattccagagcacgtcctcggaagaattgcagtagcagttgttaaaggccttacctatctgtggagtttaaagattttacacagagatgtgaagccttccaacatgcttgtaaacacaagcggacaggtcaagctgtgtgacttcggcgtgagcacccagctggtgaattctatagccaagacgtatgttggaacaaatgcttatatggcacccgaaaggatttcaggagagcagtatgggatccattccgacgtgtggagcttagggatctctttcatggagattcagaaaaaccagggatctttaatgcctctccagcttctgcagtgcattgttgatgaggattcgccggtccttccgcttggagagttctcggagccgtttgtacatttcatcactcagtgcatgaggaagcagcccaaggaaagaccagcgcccgaggagctgatgggtcacccattcatcgtgcagttcaatgacggaaacgccactgtggtgtccatgtgggtttgccgagctctggaggagagacggagccagcaggggcccccatgagacctcagcaggacactgaccacccaggaccaggcatcaaggtcacaacaagccgcgacccctctgtctgctgcctgattgggaagagatgtactgggcacagctcctgctttcaccttctaccttacctgggagtcttcaagaagggtggtctctgccgaacccctcaccactggtagggaggaggcactgacaatggcaggtggagatggtgcagggttggggtgatgaggttatggaacctcctctggccccaccctcatctctccctactgttgtaaagggtcagcctatcagcagcactgatgggaataaagtattactgctttggattgtag

SEQ ID NO: 3379 - DNA, 1696 bp, Rattus norvegicus
  Genbank Accession No. NM_017248
cgctgaacgctctcatcatcctaccgtcatgtctaagtcagagtcccccaaggaaccggaacagctgcggaagctcttcattggagggctgagcttcgaaacaaccgacgagagtctgaggagccattttgagcaatggggaacactcaccgactgtgtggtaatgagagatccaaacaccaaaagatccagaggctttgggtttgtcacatatgccactgtggaggaagtggatgctgccatgaatgcaagaccacacaaagtggatggaagagttgtggaacctaagagagctgtgtcaagagaagattctcagagaccaggtgcccacttaactgtgaagaagatctttgttggcggtattaaagaagacactgaagaacatcacctacgagattattttgagcagtatgggaaaattgaagtgattgaaattatgactgacagaggcagtggaaaaaagaggggatttgcgtttgtcacctttgatgaccatgactctgtggataagattgttattcagaaataccatactgtgaatggccacaactgtgaagtaagaaaggctctgtgcaaacaagagatggctagtgcttcatccagccagagaggtcgaagtggttccggaaactttggtggtggtcgtggaggtggtttcggtggcaatgacaattttggtcgaggagggaacttcagtggtcgtggtggctttggtggcagccgtggtggtggtggatatggtggcagtggggatggctataatggatttggcaatgatggaagcaattttggaggtggtggaagctacaatgattttggcaattacaacaaccagtcatcaaattttggaccgatgaaaggaggaaactttggaggcaggagctctggcccttatggtggtggaggccagtactttgctaaaccacgaaaccaaggtggctatggaggttccagcagcagcagtagctatggcagtggcaggaggttctaattacagccaggaaacaaagcttagcaggagagccagagaagtgacagggaagctacaggttacaacagatttgtgaactcagccaagcacagtggtggcagggcctagctgctacaaagaagacatgttttagacaatactcatgtgtgtgggcaaaaactccaggactgtatctgtgactaattgtataacaggttattttagtttctgttctgtggaaagtgtaaagcattccaacgaagggttttactgtagacctttttcacccatgctgttgattgctaaatgtaaaagtctgatcatgacgctgaataaatgtgtcttttttttttttttttaatgtgctgtgtaaagttagtctactctgaagccatcttggtaaacttccccaacagtgtgaagttagaattccttcagggtggtgccaaattccatttggaatttatttatggttgcttgggtggagaagccattgtcttcaaaaaccttggtgttgctaaactgccagttactgttgtaacttaatgagtttcaccatttaaagggtcatccaagcaagatcacaatttggttataaaatggttgttggacacctatgaagagaaaattgaataacggtctcagataaaataagagatgggaatgaagcttgtgtatcatccattatcatgtgtactcaataaacgatttaattctcttgaatgg

SEQ ID NO: 3380 - DNA, 1485 bp, Rattus norvegicus
  Genbank Accession No. NM_017251
cgcagtgccagggaggtgtgaatgaggcaggatgaactggacaggtctatacaccttgctcagtggcgtgaatcggcattctacagccattggccgagtatggctgtccgtcatctttatcttcagaatcatggtgctggtggtggctgcagagagcgtgtggggtgatgagaagtcttctttcatctgtaacaccctccagccgggctgtaacagcgtctgctatgaccattttttccccatctcccatgtgcgcctgtggtccctgcaactcatcttggtttccaccccagctctcctcgtggcaatgcacgtggctcaccaacaacacatagaaaagaaaatgctacggcttgaggggcacggggacccccttcacctggaagaggtaaagaggcacaaggtgcacatctcagggacactgtggtggacctatgtcatcagtgtggtgttccggctgctgtttgaggctgtcttcatgtatgtcttctatctgctctacccgggctatgccatggtgcggctggtcaagtgtgaggccttcccctgccccaacacggtggactgcttcgtgtcccgccccactgagaaaaccgtcttcactgtctttatgctcgccgcctccggcatctgcattatcctcaacgtggcggaggtggtgtacctcatcatccgggcctgtgcccgccgtgctcagcgccgctccaatccgccctcccgcaagggctcgggcttcggccaccgcctctcacctgaatacaagcagaatgagatcaacaagctgctgagcgagcaggatggctctctgaaagacatactgcgccgcagtcctggcactggggccgggctggctgagaagagcgaccgatgctcagcctgctgatgccgagtaccaggcaacctcccatccaacccctccctcaccccacccaggcctgcccctccttctcctatgctggtgagcaggcctctgcctcctagggattactccatcaaaccttccctccctccctactccccttcctcagagagtcttctgtcaaagacctggccggcttgggagtggggagccacttctgcaccagggctcaaggttattgagggtgtgggcaattctttctgcctataccctttcctcttccctctccctgagatgagggatgagatgttctgaaggtgtttccaattaggaaacgtaatcttaacccccatgctgtcaggtaccccactttgggagtcatgtcagtggggagggctgtgagcaagcagagtggaggaggggctctgcactgtggatggagaagggaggggagcttgccttgctgcctgctacaaggaaaaggaggacacatctagggtgggggagttctggagggagaagcaggcagataaatcagagtgggggttggtcagggctgcccccagtccccagttcccaaggcctctctctctgaaaatgttacacattaaacaggattttacagt

SEQ ID NO: 3381 - DNA, 1370 bp, Rattus norvegicus
  Genbank Accession No. NM_017253
gcaaccccgggctctcggcagcgccgctgtgccacgcatttccacgcgcccgcagctttgtcatggcctacttgtcccgggcaactgcaaccctggcccgccaggactgcagtaatggatgttcggcatcgtatgctgaagaagaagaattagaagcttcgaccgagtcgtatgatgaagaaggaggatcagaagcttcgacccagacgtttagggccaaagatctcattatcacaaaagccgatgtcttaaaaaagaagcccgaccccagctcgctggtctttggagcttcgttcactgaccacatgctgatggtggagtggacctccaagtatggatgggataagcctcacatcaagccttttgaaaacttgtccatacatcccgctgcctctgttttgcactatgctgtggaattgtttgaaggcttgaaggcttttcggggagttgataacaagatccgattgttccggccggacctcaacatgaaaagaatgtgccgatctgccgtgaggaccactctgccggagtttgacaaggaggagcttctgcaatgcgttcttcagctcatacagctcgaccgagagtgggtcccctactcaacctctgccagtctgtacatccgccccacattcatcgggattgagccatcgcttggagtcaagaagccttctaaagctctgctctttgtgattttgagccccgtgggatcttatttttctaatgggaccttttctccggtgtccctgtgggccaacccaaagttcgtcagatcctggaaaggtgggactggagacttcaagatgggctgcaactatggatcttcccttctggcgcagtgtgaggcggcagagaacggctgtcaccaggtcctgtggctgtacggcaaggaaaaccggataactgaagtgggcacgatgaatctcttcctctactggataaacaaagatggagaagaagaactggcgacgcctccgctagatggcgtcattctcccaggagtcactcggcagagcatcctggagctgggagaagagtggggcgagtttaaggtgtgcgagagacacatcaccatggatgacctgtccaccgccctggaggagaacagagtgaaggagatgttcggctcggggacagcctgcgttgtctgcccagttgccagtattctgtacaagggccagatgctgcacattccaaccatggagaatggccacaagctttcaagtcgcatcatggcaaagttgactgatatccagtatggacggatcaagagcgaatggacactggagttgccctaatgggagagctcagggtatcggtgacggggtgccacagaagaccgactcctgtcctcgagctgggacaacctc

SEQ ID NO: 3382 - DNA, 2011 bp, Rattus norvegicus
  Genbank Accession No. NM_017255
ggcacgaggcggcggcggcgcctggaggggaccagtgcggcggggagatgacggggacctaaagaggaacgaacaccgggagaggccgccaagtgcggcctgaggacaggcgcgcctgtcgactcagcgccaaacagggagagcccattacgtgactctgtcccgagggcctgggctcccagcccttgtactgcgcaaaactgggcggtgagagccggctgccggcgcgctgttgaactttgttttctctagagcgtggacctcggagccctccaggcagctgcttgccttgaaaaatgctggaggctgggcgggggcccaggcccgggaacctgttcttcctgtttcctgcctcagtcccagtagctggtccaggcctgtgcacatgcgagtgaagaactggaacggacgctgagcatccaagagcacctgctgcagcacctgctgtcacaccaagagcaggagctgatcgggtccagggcaatggcagcaggcctggactcctggaatagtaccatcaatggcacctgggagggggacgaactgggttacaaatgtcgcttcaacgaggacttcaagtatgtgctgctgcccgtgtcctatggcgtggtgtgcgtgctcgggctgtgcctgaacgtcgtggccctctacatcttcctgtgccgcctcaagacctggaacgcctccaccacctacatgtttcacctggcagtttctgactctctctacgcagcctccctgccgctgctggtttattactacgcccagggtgaccactggccatttagcacagtgctctgcaagctggtgcgtttccttttctacactaacctctactgcagcatcctcttcctcacctgcatcagcgtgcaccggtgcctgggggtcctgcgccctctgcactccctgagctggggccatgcccgctatgcccgccgagtggctgcggttgtgtgggtgctagtgctggcctgccaggcacccgtgctctactttgtcaccaccagcgtgagagggacccgaatcacctgccacgacacctcggcccgagagctctttagccattttgtggcttacagctctgtcatgctgggtctgctttttgctgtgcccttttccatcatcctggtctgttacgtgctcatggcccgacggctgctcaaaccggcttatgggaccacaggtctgcctcgggccaagcgcaagtctgtgcgcaccatcgccttagtactggccgtcttcgccctctgcttcctgcctttccacgtcacccgcaccctctattactccttccgatcacttgacctcagttgccacaccctcaacgccatcaacatggcgtataagatcacccggccactggccagcgccaacagttgccttgaccctgtgctctacttcctggcagggcagagactggtccgctttgcccgagatgccaagcccgccacagagcctacacccagcccacaggctcgtcgcaagctggggctgcacaggcctaacagaactgacactgtgaggaaagatttgtcgatcagcagtgatgactcaagaaggacagagtccacaccagctggaagtgagactaaggacattcgtctatagcagctcagtcaggtgtcagttcatgtaggggagagctgtaggggaccaaagcttgttcaaaggggctgatatcctctgatatgatatcaacggctctcatttggcagggactcaggatactcatcctgtggtcccaagagtgacaggaccccaaagtccccaatcatttgtatgtgtgagttggggaatcgtatctaaggcaacgccacctgactcccatgcaaacagctgccattcctgccaaggtacctaggccgagcttcagcctcttaaatccaagggagaagcaggcccagggagaacacagcagagtccagactagctacctggattagaagtagaatcgcggggttggggatttagctcagcggtagagcgccctgggttcagtccccagctccgg

SEQ ID NO: 3383 - DNA, 1464 bp, Rattus norvegicus
  Genbank Accession No. NM_017258
atgcatcccttctacactcgggccgccaccatgataggcgagatcgccgccgcggtgtccttcatctccaagttcctccgcaccaaggggctcacgagcgagcgacagctgcagactttcagccagagcctgcaggaactgctggcagagcattacaaacatcactggttcccagaaaagccgtgcaagggatcaggttaccgttgtattcgcatcaaccataagatggatcctctgattggacaggcagcccagcggattggactgagcagtcaagagttgttcaggcttctcccaagtgaactcacactctgggttgacccctacgaagtgtcctacaggattggagaggatggctccatctgtgtgctgtatgaagcctcaccagcgggaggtagctctcaaaacagcaccaacgtgcaaatggtagacagcagaatcagctgtaaggaggaacttctcttgggcagaacaagcccttccaaaaactacaatatgatgactgtatcaggttaagatatagtctatggatggatcatcttataatggatggatagatttgattttttgctttgggtgggctcctcttggggatggattatggaataaccatgtcacagctgtgaagatctggcacaagatagagtggtaataatttttttttttaaagtgacagtgccatagtttggacagtacctttaagtgatttaagtagcctgtgagtccaagtaaaggatcactttatttggtagggagtgaagtcgcagggtggtttcagtttctcccagaccttatacccaatttgtcacaccagtccctttaaggaaattctgtatttcaaagaaccctcttttgcagtcagtcaaccttgcaggggaatttgcactatttacacttgaaagttaccagtaacttttttttggcagctcaataggaaagctcaatgttctaagcatggtagtactggaaatattacacggagacttttacctagcacttaaaaatgtataaatgtacataaagacacttagtacgcatgacctgggggaaatggtcagaccttgtgtttttggctttgagagtagcaagtgaccggaatctgccatgacaacaggcttttaaaagacccttacaaagacactgtctcaactgtggttagcaccagccagctctctgtacattcgcttgtagttttctaagattgagtgagtaaacttcttatttttagaaagtggaggtctggtttgtaactttccttgtactcaattgggtaagagtctttttccacaaaccgccatctattttgtgaactttgttagtcatcttttatttggtaaattatgaactggtgtaaatttgtacagttcatgtatattgattgtggcaaagttgtacagatttctatattttggatgagaaatttttcttctctctataataaattgtttcttatcttggcatttt

SEQ ID NO: 3384 - DNA, 2519 bp, Rattus norvegicus
  Genbank Accession No. NM_017259
agagcccgtgaggcggccggaccatcatcgtcctgctaatacagctacttcctcaaccaccggtatgagccacgggaagagaaccgacatgctcccggagatcgccgccgccgtaggtttcctcaccagtctcctgaggactcggggctgcgtgagcgagcagagactcaaggttttcagtagggcgctccaggacgcactgaccgatcattacaaacaccactggtttccagaaaagccatccaagggctccggctatcgctgtatccgcatcaaccacaagatggaccccatcatcagcaaggtggccagccagatcggactcagccagccccagctgcaccagctcctgcccagcgagctgaccctgtgggtcgatccctacgaagtgtcctaccgcatcggggaagatggatccatctgcgtgctgtatgaggaggcgccggtggccacctcctacgggctcctcacctgcaagaaccagatgatgctgggcaggagcagtccatcgaagaactacgtgatgactgtctccagctagagaggagccgccccgccctggcactctactgttctcatgctgccctgacaacaggccaccgtatacctcaacctggggaactgtatttttaaagtgaagagctatttatacatgttatttttttttttaagaaaagaggaggaaaaaaaccaaaagtttttttttaaaaaaacaaaaaagaaaaaacaattcgttaacgggagctgcttggaagtggtctccccaggtgcctttggagagaactgttcttgattgagtctatgagccagtgtttgcctaggggagtgggttggggattggcctagccaaggtaaaaggggattcttggctgatcccccaggaggtggtggaagggagcaaggttagcaactgtgaacgagaggggtcagggtctgctctgggttaccgttcccgctgggatgcctgtattcctggtccctctcttactcaggggcattcaagcctggtctcaaataatactacattgcctaatcttctcttttgtttttctgctgagatcctgggcacacggaaaggcctctcctgtcccttccgtctgagcagagtttcttgaaactgtgtctcgtttctgatcctaccctcggggtcctgaagaggtggtttcccggcctagaatctatctaaacgtttttggagggtgggctataaggcagatataatggaggggaaccgcacaaaccctttgctttgctctgtgctgctttgtatggatggatggttaataacttagggatgatttgcaatggaattttgggacccaaagagtatccaatgggggtgggtgttttggacctaagccctccttttgggaaccacgtgacagtctgaatgctgctaccattattcctttgagaggtggctcaaagctccagggaactccaggtcctttcttactgccttctcttcaagagcaacctcccccatttcttttccctctttcctgcggttgggtcctggagggccccatttcctaggacaagagttctcaatcactgtgcaatagtcccaggaagctctggaactgggcctcccagcccctcctgattcctggtgggttttaggaccccgccttccccgttcttctgactggctggtgggccttgaggagatctccctcggccgcagggagggcacctgtgcactgcaggactacctggtactcctgtggggctgccacggagagccaaaccttaggcatagctttgtctcctcggtgctcagagcacctgcagggggaggttgcccccctcagtaaaaatccaaatttatttgtagatgtgtgcaatatttactgttctgggttggagaaaatcgggaaacactgggaagaagtggccttccttcaggttcagtgacactgatgagggcttctcagaaggcctcgagtctctcaaaccaaaggacagagctagagccagccagtcacccttagtgaggatccccttccccatgtctctccactgccgtggcatcccatgtcctggatttctcaattcctcagtttctactcaaaggtgctacttaccaaacactctgcccgtcccgctctccccagcttcgcacagccgtcccaggtggcttcgtctctcctgctttaaagttaactttgggcccacagacccgagagctgtgggttgaagcaaagctgtgaatcgctccagatggtccctgtgttctgtccacacacaggtccccgcctttttagaagcagcctcctggtctcatgcttaaatctgttcctcactgcccgtgttcactttagaaatggcagaaccacagagctggactgttgagcaggcctgtctctctcattaaatagaaataagtaagtttgtaagctattccgacagaagagacaaaggttactgattgtacaatagcgcttttatatggaagactgtacagctttatggacaaatgtaaaacttttttgtttttaataaaaatgtagcagacc

SEQ ID NO: 3385 - DNA, 921 bp, Rattus norvegicus
  Genbank Accession No. NM_017264
ctcgcgtgcggcgttcagccccggctctggccatggctacactgagggtccatcctgaagcccaagccaaggtcgatgtgtttcgtgaggacctgtgtagtaagacagagaacctgcttgggagctattttcccaagaagatctcagagttggatgccttcttaaaggagccagctctcaacgaagccaacctgagcaatctgaaggctccattggacatcccagtccctgatcccgtcaaggagaaagagaaggaggagcggaagaagcaacaggagaaggaagagaaggacgaaaagaagaaaggggacgaagacgacaaaggtcctccctgtggtccagtgaactgcaatgagaagattgtggtcctcctgcaacgcctaaagcccgagatcaaggatgtcattgagcaactcaacctggttactacctggttgcagctacagatacctcggatagaggatgggaataattttggcgtggctgtccaggcaaaggtgtttgagctgatgaccagccttcataccaagctggaaggcttccaaacgcagatctctaagtacttctccgagaggggtgatgccgtggccaaagcagccaagcagcctcatgtgggtgattatcggcagctggtgcatgagctggacgaggcggaataccaggagatccggctgatggtcatggagatccgtaacgcttatgctgtgttatatgacatcatcctgaagaactttgagaagctcaagaagccccgtggagagacaaaggggatgatctattgagccccctctctcgttctatgatgggtataacagaaaccttcctactcttgactaggaactctagactgcacccagtcttcttcctgctggggtctcctccctcactctgccttccaaacacaataaatacatagttgcc

SEQ ID NO: 3386 - DNA, 3275 bp, Rattus norvegicus
  Genbank Accession No. NM_017268
cccagggtccgatcgcgtttggtgcctgaaggaggaaccggtgacagacctggagactacagttctctgtccttcacacagctctttcaccatgcctgggtcacttcctttgaatgcagaggcttgctggccaaaagatgtgggaatcgttgcccttgaaatctactttccttctcagtatgttgatcaagctgagttggaaaaatacgatggtgtagatgctggaaagtataccattggcctgggccaggccaggatgggcttctgcacggatcgcgaagacatcaactctctctgcctgactgtggttcagaaactgatggagagaaatagcctttcctatgactgcattgggcggctggaagtcgggacagagacaatcatcgacaaatcaaaatccgtgaagtctaatttgatgcagctgtttgaggagtctgggaatacagatatagaaggaatagatacaactaatgcatgctatgggggcacagccgcagtcttcaatgctgtgaactggatcgaatccagctcttgggatggacgatacgctttggtagttgcaggagacatcgctatatatgcctcaggaaacgccaggcctacaggtggagttggagctgtggctctgctaattgggccaaatgctcctgtaatttttgaccgagggcttcgtgggacacacatgcagcatgcctacgacttttacaagcctgacatgctctctgaataccctgtggtagatggaaaactctccatacagtgctacctcagcgcattggaccgctgctattctgtctaccgcaaaaagatccgggcccagtggcagaaagagggaaaggataaagattttaccctgaatgattttggcttcatgatctttcactcgccatactgtaaactggtgcagaaatctctagctaggatgttcctgaatgactttcttaacgatcaaaacagagacaaaaacagtatttacagtgggctggaagcctttggggatgtgaaattagaagatacttacttcgacagagatgtggaaaaggcatttatgaaggctagtgctgagctattcaaccagaaaacaaaggcatctttgcttgtatcgaatcaaaatggaaacatgtacacatcctctgtatacggttcccttgcttctgttctggcacagtactcacctcaacagttggccgggaagaggattggagtgttctcttacggttctggcttggctgccacactctactcccttaaagtcacacaagatgccacaccaggatctgctcttgacaaaataacagcaagtttatgtgaccttaagtcaaggcttgactcaagaacgtgtgtggcaccagacgtctttgctgaaaacatgaagctcagagaggacacacatcacttagccaactatattccccagtgttcaatagattcactcttcgaaggaacatggtatctagtcagagtggatgaaaagcacagaagaacttacgcccggcgtccctccacaaatgaccacagtttggatgaaggagtgggacttgtgcattcaaacacagctacagagcatattccaagcccggctaagaaagtgccaagacttcctgcgacctcgggcgaacctgagtcggctgtcatcagtaacggggagcactgagagccgtggccttcacagaggctcggggctggatggggtatgggaaacgttagaggaatggatgtcttgggacaattttacagattacgtgttgcttaaaaatgtaatgtaactgacacagagcccagaaaactgttgtgtttttggagaagtctcgctgagctcctaacacacttcctgctgtgggctggccaatggtgaatgtactgcgatggtgttaagggctctgcagaacgtcatacctcgctgcatgtttacacgcatgcgggttaggcttcaaactcggtctgaactgagtgcttctgactgcaaaggcagaggtactgctgtccagtttaaaaaattgttttttttttttttaatgtgtaagaatttttatacttaaataaaaaaaagtacctgtagcttttgggggaaaaaaaaaaacctttttctaggttggggattgtggaatttaaatgttacacataaactctgcttaatggcaaggcaaacatttatctttttcgaagatttataaatcctgaagagaaaaaaagagggtatggttctaggatctggatgaaccatcagtgagaaaggttagtcataatcaagtgagcagaaggatgctggcgttgagcaggcctctgtcacagcaaccagggctctgtgggcacagctgagggaactttctggccaggtgcccgtgactgctgctcagctgcactgagatgcagtggagctgctgcacggaagcttgctgtggtgctgaacgccttacctgcggataaagtgtaaagtaggagggatgggcagggcactattaggttacagtgttacagacccaggttatagacttgacagctcaaactcaccagacacctttttccctttgtggtttgtgtattttttgtgttttgtttgtttttttttatattgttcaatttaaaaaatttagaaaattttaaccttacgttttcacatagtgtgattagccaaaaggaatttcacttcaagatctagaaatagaattcataacattttttcctaaactttgacttttaaaacaacgaaaattaccacatgagatgaacaagaaaattcattagaaagttctctgggtgatttttggtgctgaactgacatgagcctcatagactgtaaaacagaggtagttgaaactaatgtacagaactacattttttaattttatttgcatttaattctgtgaagtttcagttatctaaaataaacacataaacgtgtaatgtttcagattgcaaggtgagatgtaatgtagcatttgtaagatattcttgtcaatattaactggtaggattttgatttgtacagttttaattggttaaaatgatctcattttaacatccactgctatagatgaatgatgtaagctcagatttaatgaatggtggggaaatggtgcatgtaattttttcgcaagtatcgagagttctgtatgttttgaaaagaataatttaacgtttgggttgccaggaagggggctttcccagagtccattgccaggcgttgggcaagcctcgcaatgttggcacggagcgttaaccacaccttactaatagcaaggggaataactttgaaataaagttttagacaaata

SEQ ID NO: 3387 - DNA, 1294 bp, Rattus norvegicus
  Genbank Accession No. NM_017271
ggaattcccggaaaccgttgggcccgagcgaaccgtaccgagcgcgggcatcgcagagcgcgagtgcggagctcggagcgcagcacgatgggaggggagcaggaggaggagcgcttcgacggcatgctgctggccatggcgcagcagcacgagggcggcgtgcaggagcttgtgaacaccttcttcagcttccttcgacgcaaaacagactttttcattggaggagaagaggggatggcagagaagctcatcacacagacttttaaccaccacaaccagctggcacagaaggccaggagagagaagcgagctcggcaggagacagagcgtcgggagaaggcagagcgggcagccaggctggccaaggaggccaaggcagagactcccgggccacagatcaaggaactgactgatgaggaggcagagagactgcagctggagattgaccagaaaaaggatgcagagaaccatgaggtgcagcttaagaacggcagtcttgactctccagggaagcaggatgctgaggaagaggaagacgaggaagacgagaaggacaaaggaaagctgaaacccaacctaggcaatggggctgacctgcccaactaccgctggacccagaccctgtcagagctggatctggcagtgcccttccgagtcagcttccggctgaagggaaaggatgtggtggtggacatccagcggcggcacctccgggtgggcctcaaaggacaggcaccagtgattgatggagagctctacaatgaagtaaaggtggaggagagctcgtggctcatcgaggatggcaaggtggtgacagtgcatctggagaagatcaataagatggagtggtggaaccgcttggttaccagtgaccccgaaatcaataccaagaagattaaccctgagaactccaagctctcagacctggacagtgagactcgcagcatggtggaaaaaatgatgtatgaccagaggcagaagtccatgggcttgcccacctctgatgagcagaagaaacaggaaatcctgaagaagttcatggatcagcacccagagatggatttctccaaggccaaattcaactagctcctgttcaccttcctgaactcttgcagttgagcccgtagccactcaacttcctttcctgagacccaggagccttagggctgggcaggcgtgggacttcccaggcatgtgagctccagggattcactggagaagggctgggtcttgggggtcttgtccttgctatttgtcctgttacacattaaaactatttactctgttccaaagg

SEQ ID NO: 3388 - DNA, 2024 bp, Rattus norvegicus
  Genbank Accession No. NM_017272
caatttgctgagcctgtcacctttgttccaggagccaaaccagcaatgtcttcccctgcacagcctgcagttcctgccccactggccaacttgaagattcaacacaccaagatctttataaacaatgaatggcacaactcattgaatggcaagaaatttcctgtcattaaccctgcaactgaagaggtcatctgccatgtggaagaaggggacaaggcagatgttgacaaagctgtgaaggctgcaagacaggctttccagattggctccccctggcgcaccatggatgcttcagagagaggatgcctgctgaacaagctggctgacttaatggagagagatcgcgtgctgctggctacaatggaatcaatgaatgctggaaaaatctttactcatgcataccttttggatacagaggtcagcataaaagccttaaagtactttgcaggctgggcagacaagattcatggccaaacaattccaagtgatggagatgttttcacttatacaagacgtgaacctattggggtgtgtggccaaatcattccttggaatggtccgttgattttattcatttggaagataggcgctgcccttagctgtgggaacactgtgattgtgaagccagcagagcaaactcctctcacagctctttacatggcatctttaataaaagaggcagggtttcctcctggtgtggtgaacgttgtccctggttatggatcaactgcaggggcagccatctcttctcacatggacatagacaaggtgtctttcacaggatcaacagaggttggcaaattaatcaaagaagctgcagggaaaagcaatctgaagagggtcaccctggagcttgggggaaagagcccttgcattgtgtttgcagatgctgacttggatagtgctgttgagtttgcacaccaaggagtattcttccaccagggtcagatttgtgtcgcagcatccagactttttgttgaggagtccatttacgatgaatttgttaggaggagtgtggagcgggctaagaaatacgttctaggaaatcctctggactcaggaataagtcaaggtcctcagattgacaaggagcaacatgctaaaatccttgatctcattgagagtgggaagaaagaaggcgccaaactggagtgtggtggaggacgctgggggaacaaaggcttctttgtccagcctacagtcttctccaatgtgaccgatgagatgcgcattgccaaagaggagatatttggaccagtgcaacaaatcatgaagtttaagtccatagatgaggtgatcaagagagccaacaatactccctatggtctagcagcaggagtcttcacaaaagacctggacagggccatcactgtgtcttctgctctgcaggccgggacagtgtgggtgaattgttatttgactctctctgtccagtgcccatttggtgggttcaagatgtctggaaatgggcgagaaatgggtgaacagggtgtttatgaatacactgagctcaagacagtcgcaatgaaaatatctcagaagaactcctaaagaagccagcagagtgacgagaaactctcagcagtagctacatgtctcctacaatcaccagcagagggttgttttattacagggtcttctgttgatttcttaaacataaggaatccatcagcattactgtaactcatagaaaatgtatagtttaattcttctaatacatgaccctaatacatacccaagaagaaagggatacatttaggtacatgctctttgtaacccagtcatgaaaaagtgcttttcattgtagctacttgtctacagccctcatttgatgtgatttaaactctgtttctcggtgacttcttgccactactcaccatgcacaactgaaaagtcagccactgttcttggagttattgttctgagtattgtgaaatatttttagaatgacatacctgcttgtcaaatgaaatgcttagctgtaattagagtgcaaagtttaataaaggcaaaatctcacatga

SEQ ID NO: 3389 - DNA, 2646 bp, Rattus norvegicus
  Genbank Accession No. NM_017274
cacgaataagcctctggaggagctgctgaatcacccccgccccaggctgtcttctgaagctgtctggggatagctttgctaatcaactgactggaaataattccagacaccacatcaaggatacagctcatgttttgtttgggacttccacgttgagtcatggaggagtcttcagtgacaattggcacaatagacgtttcttatctgcccaattcatcagaatacagccttggccgatgtaaacacacgaatgaggactgggttgactgtggcttcaaacctaccttcttcagatccgcaacgctgaaatggaaggagagcctcatgagccggaagaggcccttcgtgggaaggtgttgctattcatgcacgcctcagagctgggaaaggtttttcaaccccagtatcccatctctgggtttgcggaatgttatttatatcaatgaaactcacacaaggcaccgaggatggctggcaagacggctttcttacatcctttttgttcaagagcgcgatgtccacaagggcatgtttgccaccagtatcactgacaatgtactgaatagcagcagagtccaagaggcaattgctgaagtggctgcagaattgaacccggatggatctgcccagcagcagtccaaagccatccagaaagtgaaaaggaaagccaggaagatcctccaggaaatggttgctacagtctcccccgggatgatcaggctgactggctgggtgttactaaagctcttcaacagcttcttctggaacattcagattcacaagggtcaacttgagatggtgaaagctgcaactgagacgaatctgccgctcttgtttctgccggtgcacagatcccacatcgactacctgctgctcaccttcatcctcttctgccacaacatcaaagctccatacatcgcctcgggcaacaacctcaacatccccatcttcagtaccttgattcacaagcttgggggctttttcataagacggaggcttgacgaaactccagatggacgcaaagacattctgtacagagcgttgctccatgggcatatagttgaactcctccgacagcagcagttcctggagatcttcctggaaggcacccgctcccgcagtggcaagacctcctgtgcccgggccgggctcctgtcagtggtagtggatactctgtcatccaacaccatccctgacatcctggtcatccctgtgggcatctcgtatgatcggataatcgaaggtcactacaatggtgaacagttgggcaagcccaagaagaatgaaagtctctggagtgtggcaagaggcgttatcagaatgctgcggaaaaactacggctatgtccgagtggactttgcacagccattttctttgaaggaatatttagaaggccaaagtcagaaacctgtatctgctcccctctctttggagcaagcactgttaccagcaatccttccttcaagacctgatgctgctgctgccgaacatgaagacatgtccagtaatgagtcgagaaacgcggcagacgaagccttccgaaggaggctgatcgcaaacctggcggagcacattctcttcaccgccagcaagtcctgcgctatcatgtccacccacattgtggcctgcctgctcctctacagacacaggcagggaatccacctctccacgctggtggaagacttctttgtgatgaaggaggaagtcctagctcgggattttgacctgggcttctccgggaattcagaagatgtagtcatgcatgctattcagcttctggggaactgtgtcacaatcacccacactagcaggaaggatgaattctttattactcccagcacaactgtcccgtccgtctttgaactcaacttctacagcaatggggtacttcatgtctttatcatggaagccatcatagcttgcagcatttatgcagtccagaataagaggggttccggagggtctgccggaggccttggcaacctgatcagccaggagcagctggtgcggaaggccgccagcctgtgctaccttctctctaatgaaggtaccatttctctgccctgccagacattttaccaggtttgtcaagagacagtaggaaagttcatccagtacggaattctcacagtggcagagcaagatgaccaggaagatgtcagtcctggccttgcagagcagcagtggaacaagaagcttccggagcctctgaactggagaagtgacgaagaagatgaggacagtgactttggtgaggagcagcgtgattgctacctgaaggtgagccaggccaaggagcaccagcaattcatcacctttctgcagaggcttctggggcccctgctagaagcctacagctctgctgccatctttgtccacaccttccgcggcccagtcccggagtctgagtacctgcagaagctgcacaggtaccttctcaccaggacggagaggaacgtcgcggtgtacgctgagagtgccacatactgtcttgtgaagaatgctgtgaaaatgtttaaggacatcggggttttcaaagagaccaagcagaagcgagcgtctgtcttagaactgagcaccactttcctacctcagggcagccggcagaagctcctggaatacattctgagcttcgtggtgctgtag

SEQ ID NO: 3390 - DNA, 3679 bp, Rattus norvegicus
  Genbank Accession No. NM_017277
tgacatggtaaagagtctggccacagataaaggaccgaaatgactgactcaaaatacttcacaacaaccaagaaaggggagatcttcgagttgaaggcagagcttaacagtgacaagaaggagaagaagaaggaggcagtaaagaaagtgattgcatcaatgaccgtgggcaaagatgtcagtgctctcttccctgatgtggtgaactgcatgcagacagacaacctggagctaaagaagctggtgtacctgtacttgatgaactatgccaagagtcagcctgacatggccattatggctgtcaacaccttcgtgaaggactgtgaggaccccaacccccttatccgggccctggctgtgaggactatgggctgcatccgagttgacaagatcacagagtacttgtgtgaaccactccggaaatgcctgaaggatgaagacccatatgtgcgcaagacagcagctgtgtgtgtagccaagctccacgacatcaacgcccagctggtagaggaccagggtttcctggacacactcaaagacctcatctctgactctaaccccatggtggtagcaaatcgagtggctgccctgtcagagatcgctgagtctcaccccagtagcaacctgcttgacttgaaggcacagtctatcaacaagctgctgacggcccttaatgagtgcaccgagtgggcccagatcttcattctggactgtctgggcaactacatgcccaaggatgaccgtgaggcccagagcatctgcgagcgggtcactcctaggctttcccatgccaactctgctgtggtgctgtccgcagtgaaggtcctgatgaagttcatggagatgctgtctaaggacctggactactatgccacactactcaagaagctggcccctcccctggtcaccctgctgtcagcagagccagagccgcagtatgtgcctctgcgcaatattaacctcattgtacagaaaaggccagagattttgaagcatgaaatgaaggttttctttgtgaagtacaatgaccccatctatgtgaagctggagaaactggacattatgatccgcctggcctcccaggccaacattgcccaggttttggcagaactcaaagagtacgcgacagaagtagatgtggattttgtacggaaggcagtgcgtgccattggccgctgtgccatcaaggtggagcaatctgcagagcgctgtgtgagcacattgcttgatctcatccagaccaaggtcaactatgtggtccaggaagccattgtggtcattaaagacatcttccgcaagtaccccaacaagtacgagagtgtgatagccacactgtgtgagaatctggactcgctggatgagcctgaggctcgcgctgctatgatctggatagtgggcgagtatgctgagcggattgacaatgcggacgagctgcttgagagcttcctcgacggcttccatgacgagagcacccaggtccagctacagctgctgacagccattgtgaagctcttcctgaagaagccaacagagacgcaggagctggtgcagcaggtcctcagtttggccactcaggactcggacaatccagaccttcgggaccgtggctacatctactggcgcctgctctccacggaccctgtagctgccaaagaggtggtactggctgagaagcccctcatctcagaagagacagaccttattgagcccacactgctggatgaactcatctgctacattggcacactggcctctgtctaccacaagccacccaatgcctttgtggagggcggccggggagtggtgcacaagagtctgccacctcgcactgcctcgagcgaaagcacagagagccctgaggcagcccctgccggagcacctgctagtgaccagcctgatgtcattcctgcccagggtgacctgttaggtgacctcctcaacctggaccttgggcccccagtgagtggcccacccttggctgcctcctcagtgcagatgggagctgtggatcttcttggtggtggcctcgacagcctgatgggggatgagcctgaagggattggagacagcaactttggggcacctccagcatcagtggcggcggcagcaccagccagacttggagcacccgtcagcagtggcttaagtgacctctttgacctgaccagtggagtgggcaccctctcagggtcctatgtcgctcccaaagcagtttggctccctgccatgaaggccaaggggctggaaatctctggcaccttcacccggcaggttggctccatctccatggatctgcagctgactaacaaggccctgcaggtcatgacagatttcgctatccagtttaatcggaacagctttggcttggcccccgctgcgccactccaagtgcacgccccactgagccccaaccagacggtggagatctccctgcctcttaacacggtgggctcagtcatgaagatggagcctctgaacaatcttcaggtggctgtgaagaacaacattgacgtcttctacttcagcactttgtacccactgcatgtcctcttcgtggaggacgggaagatggaccggcagatgttcctggccacatggaaggacattcccaacgagaatgaagcccagttccagatcagagactgcccgctgaacacagaggctgcaagcagcaagctgcaaagcagtaacattttcactgtcgccaagaggactgtggagggccaggacatgctctaccaatctctgaagttgaccaatggcatctgggtgctggcagagctgcggatccagccaggcaaccccagtttcacgctgtccctgaagtgtcgagccccagaggtgtcccagcatgatatccaggcctacgagaccatcctcaagaactgaagtccctctcgctccaccccagccttctccttctgccagcccagccatggaaccctgtggtggcagcacctcctcctttctttggggagaagccagtgggctcctgacccacccaggaggcctcccctgatcctaactgagggcctggagcagggccaggtctcctagagtgaaatctccgtgcatctccagtggctgcttttttctattgctgttgatgtgggatcaaaggaagtggatccagcacagcatcagaagctggacgggggccacagggtgctcttccttccttctgctctcctggggtgaacatggaaccctcctggggtcccagcccataatccctgccctgtctcctcagtgagcctgtctgggtagagtcctctgggtgccaatattactgtttgggactctgagagctggaggtggtgatggacagacatgagcccaggggagcaacctgggctggcactgtctgccccatataacaccagttggtgctctgtgaccacctgcatggcccagagcccgatctaggattctgttcccttaggccctggaggatggtcactgcctaccaaacattcctcggtgtcctctctgtgagtccagggctctcagaccagaagtggggtgaaaggtggggcaaggggcagtgggaccgcttctagtgtgagctcctgacccactggctgccctggctccccagtctgtgtgtgacagtgacaggttgatcgtcgctactgtttgataataaagagttctgcttttggcaaaaaaaaaaaaaaaa

SEQ ID NO: 3391 - DNA, 1174 bp, Rattus norvegicus
  Genbank Accession No. NM_017278
ccgcagccttctttgacgatcaccgaaccgtagttgaggccgtgttcctgtgtccgctgctgtgtctggttgtaacctcgccggagctatgtttcgcaaccagtatgacaacgatgtcactgtttggagccctcagggcaggattcatcaaatcgaatatgcaatggaagctgtaaagcaaggctcagcgacagtcggcctgaagtcgaagacacatgcagtgctggtcgcgctgaagagagcacagtcagagcttgccgctcaccagaagaaaattctccacgttgacaaccatattggtatctcaattgcgggtctaactgctgatgccagactgttatgtaactttatgcgccaggagtgtttggattccagatttgtatttgacagaccacttcccgtatctcgccttgtgtctctaattggaagcaagacccagataccaacacagcgatatggccggagaccgtatggtgttgggctgctcattgctggttatgatgacatgggccctcacgttttccaaacctgcccatctgctaactattttgactgcagagctatgtccatcggagcccgttcccagtcagctcgcacttacctggagagacacatgtctgaatttatgcagtgcaatttggatgaactggttaagcatggtcttcgcgccttaagagaaacactccctgcagaacaggacctgaccacaaagaatgtttccattgggattgttggtaaagacttggaatttactatctatgatgatgatgatgtgtctccattcctggatggtcttgaagaaagaccacagagaaaagcacagccttcacaggctgctgatgaacctgcagaaaaagctgatgaaccaatggaacattaagtgataaaggttatgaggacatgaggatgcaggggcatacactggtgacaataatctgtattttaaaccaacagctgtaatgtattgggtggtatgttttagaaatcagtccaactgtgagttttctctaagcagcttcacagaaaccatataatggggtgcattttctttgaaagggtctacataatcattttctaggacgtataggtatctatatcaatgtttttatatgaagaaaataagtgtctttgcagttttaaagacaactgtgaaataaaattgtttcaccacctg

SEQ ID NO: 3392 - DNA, 852 bp, Rattus norvegicus
  Genbank Accession No. NM_017279
gtaaagatggcagaacgcggttacagcttctcgctgactacattcagcccatctggtaaacttgtgcagattgaatatgctttggccgctgtagctggaggggccccttcagtgggaattaaagctgcaaatggcgtggtattagccactgagaaaaagcagaaatccatcctgtatgatgagaggagtgtacacaaagtggagcccataaccaagcacatcggtttggtgtacagcggcatgggtccagattacagagtccttgtacacagagctcggaaacttgctcagcagtactaccttgtttaccaagaacccattcccacagcccaactggtacagcgagtagcgtctgtgatgcaagagtatacccagtcaggtggtgttcgtccatttggtgtttctttacttatttgtgggtggaatgagggacgaccatatttatttcagtcagatccatctggagcttactttgcctggaaggccacagcaatgggaaagaactacgtgaacgggaaaactttccttgagaaaagatataatgaagacttagaactggaagatgcgattcacacagccatcttaacccttaaggaaagctttgaagggcagatgacagaagataacatagaagttgggatctgcaatgaagctggctttaggaggctcaccccaactgaagtgagggattacttggctgctatagcgtaatgaagatgtgccggaacaacaaggaacactcattctacttattcatttttaaagtatgttttgtttgtgcagacttatttctacatgctttaatggatttcacatttttaaataataatcataataaactgttaaaaccag

SEQ ID NO: 3393 - DNA, 1121 bp, Rattus norvegicus
  Genbank Accession No. NM_017281
cttggccatccgggttggttcttctccagctgagtaaagcggcgctgatctgcaccctcactgtcttcctccggatccacataaaattcagaagccatgtctcgaagatatgactccaggaccacaatattttctccagaaggtcgcttataccaagtggaatatgccatggaagccattggacacgcaggcacttgtttgggaattttagccaatgatggcgttctgcttgcagcagagaggcgcaacatccacaagcttcttgatgaagtctttttttctgagaaaatttataaacttaacgaggacatggcttgcagtgtggcaggcataacatctgatgccaacgttctgactaatgaactcaggctcattgctcaaaggtacttattacagtatcaggagccaattccctgtgagcagttggttacagcactgtgtgatatcaaacaggcgtacacacagtttggaggcaaacgtccctttggtgtttctttgctgtatattggctgggataagcactatggctttcagctctatcagagtgacccaagtggaaactacgggggatggaaagccacatgcattggaaacaacagtgctgcagcggtatcaatgctgaaacaagactacaaagaaggagaaatgactctgaagtcagcgctggctctggctgtcaaggtgctaaacaagacaatggatgttagtaaactgtcagctgaaaaagtggaaatcgccacactaacaagagagaatggaaagaccgtgatcagagtcctcaagcaaaaggaagtggaacagttgatcaaaaaacatgaagaggaagaagcgaaagctgaacgggagaagaaagaaaaagaacagagagaaaaggataaatagacagaatcatggattttataactccttagaggcgccagttcacttaggagctgtcctggccttcccctggaagtgttttcttgtattttcttccttaccttggccatcggggaaatgggacattgcatactgaattgggtccatgtctgtccagctggatgctttattgtaatgatggacatctttataaacatcttaatctcgacacataatttttggaataaaacctggaaagattg

SEQ ID NO: 3394 - DNA, 970 bp, Rattus norvegicus
  Genbank Accession No. NM_017282
gcggtgtggttgagtagggtgctgctttcagtcgtgtggcctttggaactccgcgtagcactgccgcctcctcctgtcctcgccatgttcctcactcggtccgagtacgacaggggtgtgaacactttttctcctgaaggaagattatttcaagtggaatatgccattgagggccataagcttggttctacggccattggcatccagacatcagagggtgtatgtctagctgtggagaagagaattacctcgccactaatggagcctagcagcattgagaaaatcgtagagattgatgctcatataggttgtgccatgagtgggctaattgctgatgctaaaactttaattgataaagccagagtggagacacagaaccactggttcacctataatgagacaatgacagttgagagtgttacccaggctgtgtccaatctggctttgcagttcggagaagaagatgcagatccaggtgctatgtctcgtccctttggagtagcattgttgtttggaggagttgatgagaaagggccccaactgtttcacatggacccatctgggaccttcgtacagtgtgatgctcgagcaattggttctgcgtcagagggtgcccagagctccttgcaggaagtttaccacaagtctacgactctgaaggaggccatcaagtcttcactcatcatcctcaagcaagtcatggaggagaagctgaacgcaactaacatcgagctggccacagtgcagcctggtcagaatttccacatgttcacaaaggaagaactggaggaggtgatcaaggacatttaaggaggggccatcctcgaacttctgtgggacagtttcagttctaatggctcttagactttatttccaactccacgtcgtgaaaatatccagtatatgtatgtgtgtttttttatgatgtctgtacataacagcaattctgaaataaaaaaaatttacaaat

SEQ ID NO: 3395 - DNA, 932 bp, Rattus norvegicus
  Genbank Accession No. NM_017283
gtgtgtgtgcgctacggggtgwagactgtgtctgaaatagcgggaacgccatgtcccgtggttccagcgccggttttgaccggcacattactattttctctcccgagggccgactctaccaagtagaatatgcttttaaggctattaaccagggtggacttacatctgtagctgtcagaggaaaggactgcgcagttattgtcacacagaagaaagtacctgacaaactactggattccagcaccgtgactcacttattcaagataacggaaaacattggctgtgtgatgacaggaatgacagctgacagcagatcccaggtacagagggcacgctatgaagcagctaactggaaatacaaatatggctatgagattcctgtggacatgctgtgtaaaagaattgctgatatttctcaagtctacacacagaatgctgaaatgaggccacttggttgttgtatgattttaattggtatagatgaagagcaaggccctcaagtgtacaagtgtgatcctgcaggctactactgtggctttaaagccaccgcagcaggagtgaagcagacagagtcaaccagcttcctcgaaaaaaaagtgaagaagaaatttgattggacatttgaacagacagtggaaactgcaatcacatgcctgtctactgttctgtcgattgatttcaaaccttcagaaatcgaagttggagtagttacagttgaaaatcctaaattcaggattcttacagaagcagagattgacgctcaccttgtggctctagcagagagagactgaacactcttatcagcttaccagatccatgatgccatgtgcctatgtgtttagtaacaacaaaccgacatcttagaggccctggattgaagatggaaactctcccactcctcctgccactgactggttaggactctgtataaa

SEQ ID NO: 3396 - DNA, 828 bp, Rattus norvegicus
  Genbank Accession No. NM_017285
aattccgttgctgtcggaaagccagaaccggtttgtaggcagctcagtggagatcgggttcctattacagtgcaatcatgtctgttatgtcctataatggaggggccgtcatggccatgaagggaaagaactgtgtggccatcgctgcagacaggcgtttcggaatccaggcccaaatggtgaccacggacttccagaagatctttcccatgggtgacaggctctacataggcctggccggcctggccactgacgtccagacagttgcccagcgtctcaagttccgactgaacctgtacgagctgaaggaaggacggcagatcaagccttacaccctgatgagcatggtggccaacctcttgtatgagaaacggtttggtccctactacacagaacctgtcattgctggcttggacccgaagacctttaagcccttcatttgctctctggacctcattggctgtcccatggtgacagatgacttcgtagtcagtggcacctgctctgaacaaatgtatgggatgtgtgagtctctctgggagcccaacatggatccagagcacctgtttgagaccatttctcaggccatgctgaatgctgtggacagggatgccgtgtcgggcatgggcgtcattgtccacatcattgaaaaagacaagatcaccaccaggacactgaaggcgcggatggactaacctgtgctctggccccgtctcccttttgttgtttttctttttaataaaatctcctttctttcatgcctgcccgcccttgtttctgcgactttgtccccatcagggagagcccaatacagagcgactttatctc

SEQ ID NO: 3397 - DNA, 1490 bp, Rattus norvegicus
  Genbank Accession No. NM_017288
cgcagcctggatgcgccctgtggcgcacgcacgcagcatcccgagcctcccgccgcgcgcgggatgcctgctctccgggccccggggcttggccccggcggtaaccggagcgggggggcgcgcccccccagcagcagctgcggcgcccgcgcccgggccagtcgccgccggggcccatctcctgtcgccgcgctctgcgacccaccgccttgcgcggccatggggacgctgctggctctcgtggtgggcgcggtgctggtatcctcagcctgggggggctgcgtggaggtggattctgagaccgaggcagtgtatgggatgaccttcaaaatcctgtgtatctcctgtaagcgtcgtagtgagaccaccgccgagaccttcacggagtggaccttccgccagaagggcacagaggaatttgtcaagatcctacgctatgagaatgaggtgctgcagctggaggaagatgagcgctttgagggccgtgtggtgtggaacggtagtcggggcaccaaggacctgcaggacctgtccatcttcatcaccaatgtcacctacaaccactctggcgactacgaatgtcacgtctaccgtctcctcttctttgataattacgagcacaacaccagcgtcgtcaagaagatccacctggaggtggtggacaaggccaacagagatatggcatccatcgtgtcagagatcatgatgtacgtgctcattgtggtgttaaccatatggctcgtggcggagatggtgtactgctacaagaagattgctgctgccacggaagctgctgcacaagagaatgcctcggaatacctggccattacttccgagagcaaagagaactgtacaggcgtccaggtggctgaatagcgctggctctgggctccgcctcaaggaagagccagcctacgggtaccctccagccctgcagtggggatcagcccctggtgggtaccctcccctggcagtggggatcagcccatcggtctccccagcctcacagttctgcagtggagccaccagggtgggagcgggcagggactgatcccacctcacccaccgcctcccacctaccctcccaccgccatgcatgatgggtgaagcaatatggccgccccaccctgcttttgctgcctgtttgggggagggggcggtgaggcgagggggcaggccccgcccccttctttttgctgatttgcacataggccacttccacacgcactgccaggccagccggcccacccctgcttgatggggtgaagaggggtcgggacagggacagtagtgggcagggggttctgggcctcatctcccctccgcttcctccggctggacctggggttcccttcctgtgacacctcctagccctggcccacccgccctctctcaccagccttcaattgtggtctcttgggaaggcctcttcggcctcctatctttacagaagtagtttttgttcatgaaataaagattcttggactcga

SEQ ID NO: 3398 - DNA, 5648 bp, Rattus norvegicus
  Genbank Accession No. NM_017290
cggagccgtccccgacgccacctcccgtctcctccgccgcagtttcctccgccgctgtcgggggtgcagagctgaggggctcgggcagcgcgccgcgcagctcctctccagtcgcccgcctcgccgtcctccccaccgagggctcgcccgggcgcccctcctcagccgcgccgggtctcctcgcgcagcgccgcggcctgcgctacctgcggccggctggcaacagaggcaacgcacactcgcggcggggcgggaggctcgcagcccctcgggcgggctcggcgaggcccggccgcgtgcggcggtttctgggggagggggctcgggtgattcagcgcccggtcaggcggaagcggccgccgccgcggaggaggaggagaaagaggaggggacagctgtccgcgcccgggcgcccgcggtggcacgagcccgcggcccgagtgcgaggcggaggcgaggaggccgcggggacgcgaggcgaggccggccggggcccccgcagccatggagaacgctcacacaaagaccgtggaggaggtgctgggccacttcggcgtcaacgagagcacggggctgagcctggagcaggtcaagaagctcaaggagagatggggctccaacgaattgccggctgaagaaggaaagaccttgctggaacttgtgatcgagcagtttgaagacttactagttagaattttattgctggcagcatgtatatctttcgttttggcttggttcgaagaaggtgaagaaacgattacagcctttgtagaaccttttgtaattctgcttatattggtagccaatgcaattgtgggtgtatggcaggagagaaacgctgaaaatgcaatagaagctcttaaggagtatgaacctgaaatgggcaaggtgtatcgacaggacagaaagagtgtgcagcggattaaagcgaaagatatagttcctggggatatagtggaaattgctgttggtgacaaagttccggctgacattagattgacatccatcaagtctacaactctgagagttgaccagtcgattcttacaggtgaatctgtctcggtcatcaagcatactgaccccgtccctgacccacgagctgttaatcaagacaaaaagaacatgctcttttctggcacaaacatcgctgctggcaaagctatgggagtggtggtggcgactggagtcaatactgagatcggcaagatccgggatgaaatggttgcaacagaacaggagagaacacccctacagcagaagctggacgagtttggggaacagctttccaaagttatctccctcatttgcattgcagtctggatcatcaacatcgggcatttcaatgacccagttcatggtggctcttggatcagaggtgccatctactactttaagattgcagtggccctggctgttgctgccatccctgagggtctgcctgctgtcatcaccacctgcttggctcttggaactcgaaggatggcaaagaaaaatgctattgttcgaagtctgccttctgtggaaacccttggttgtacttctgttatctgctcagacaagaccggcacacttaccacaaaccagatgtccgtctgcaggatgttcattctggacaaagtagaaggtgatacttgttcccttaatgagtttaccataactggatcaacctatgcacccattggagaagtgcaaaaagatgacaagccagtgaaatgccatcagtatgacgggcttgtagagttagcaacgatctgtgctctgtgtaatgactctgctttggattacaatgaggcgaagggtgtgtatgaaaaagttggagaagccacagagactgctctcacgtgcctggtagagaagatgaatgtattcgacacggagctgaagggactttctaaaatagaacgcgccaacgcctgcaactcggtcataaaacagcttatgaagaaggaattcacgctagagttttcacgtgatagaaaatcaatgtccgtctactgtacaccaaacaaaccgagccggacgtccatgagcaagatgtttgtgaagggtgctccagaaggtgtcatcgacaggtgcacccacatccgagttggaagtaccaaggtccccatgacgcctggtgttaaacagaagattatgtctgtcattcgggagtggggcagtggcagcgacacactgcggtgcctggctctggccactcatgacaacccgctgaggagagaggagatgcacctggaagattctgcgaacttcatcaaatatgagaccaatctgactttcgttggctgtgtgggcatgctggaccctcccaggattgaagtggcctcttctgtgaagctgtgccggcaagcgggcatccgagtcatcatgatcactggggataacaaaggcactgctgtggccatctgtcgccgcattggcatctttgggcaggatgaggatgtgacatcaaaggcttttacagggcgagaatttgatgaattaagcccctcagcccagagagacgcctgcttaaatgcccgttgttttgctcgagttgaaccttcccacaagtctaagatcgttgagttcctgcagtcctttgatgagatcacagctatgactggtgatggtgtgaacgacgcgcccgctctgaagaagtcggaaatcgggattgccatgggctcagggactgcagtggctaagacggcctctgagatggtgctggccgacgacaacttctccaccatcgtggccgctgttgaggaggggcgcgccatctacaacaacatgaagcagttcatccgctacctcatctcctccaacgtgggggaggtggtctgtatcttcctgacggcagcccttgggtttcctgaggctttgattcctgtccagttactctgggtcaatctggtgacggatggtctgcctgccactgcgctggggttcaatcctccagatctggacatcatgaacaaacccccacggaacccaaaagaaccgctgatcagcgggtggctctttttccgttacctggctattggctgttatgttggcgctgccaccgtgggtgctgctgcgtggtggttcatcgctgctgacggtggtccgagagtctccttctaccagctgagtcatttcctgcagtgtaaggaggacaacccagacttcgaaggagtggattgtgcaatctttgagtccccgtatccgatgacaatggcactttctgttctagtcaccatagagatgtgcaatgccctcaacagcttgtctgaaaaccagtccctgctgaggatgcccccctgggagaacatctggctcgtgggctccatctgcttgtccatgtcccttcacttcttgatcctctacgtggaacctttgccactcattttccagatcacaccgctgaatctgacccagtggctgatggtgctgaaaatctccctgcctgtgatcctcatggacgagacgctcaagtttgtggcccgaaactacctggagcctggtaaagagtgtgcgcagcctgccaccaaaccctcctgctccctgtcggcatgcaccgacggcatttcctggccctttgtgctgctcattatgcccctggtggtctgggtctacagcacagacactaactttagtgatatgttctggtcttgactgacagcgctacatgcagaagatgtttaacttaatcaattaattttttattgtttaaagcaactgtctatttctgctgaattttcacatgaacatattggctggtgaaggaggtttcatatctagattttgttttgctttttctgactccagtgggacaagattttccttttttttatacacataattaaagtgtccattgacatgtacagagaactaacactattttatgcagatatttttttgtagatgaaaaaagcatgtacagtgttctgtttcatactcatacttgtacaaagatcgttgagccagcagacattgtcagcaagttaattggcagcagacttaggaaatgaatgtgtgtggtttttaaaagaaaaaaaactaaatagcatgtattgtgtcttttgcatgattctctggatttaatttggtatcacagtctaatttttattcataagccaatttttctgcactgagcagagtcctgctacctcagtcagtatttttggtttgccactccctgcaccctcagcctctgtcacccccagcccaccctggcccgctcggctgcttctgtaggtctgatggttctgtttacatctgtcttcacgaggtttgcctgtctcgcttgtgcagaaaacattgctccagatccaatcgactgggtttctgtcccttcgcctagtttttaaggttatttatttaaatgtctaatgtattttattgtaacagacattgttttgccaacattgcctattcagtggcacttcacaatctagtttaaaagaaaaataaaacattttaaatggacagaggaaaataactgtcttgttcttaatggccttgaactacccatgatcagttcaaattcctgagcttctcagctcggagccttagtttcctgttcctgagaagaacgtgtactgctgcacagtagggattatctataatgtacaggcacgatcgtcatgtgacaaacatttactcaagtttctgctggcctggtgtatgtaggctggtgtaagggcaagtgtgtgtgtgtatgtgtgtgtgtgttctgtaaaatctgtaaatagcacatgaccaaatgaactgtatagaaatatttttatttgaatatggcactaaccaccaccaccatgactgaccggacgtttgcgcatgttcaaggtcagtcttaacggcagtgtgagtcattaacagtcctaactgtggtgttttcctccaatgccttccaacatccatcaactaaccaatactggagtaaccgcttcctaaacattgcagaaatgtaagggtgttcgggtgcgtgcatgtgcgttgttagcaacacatcttccagccctctgcatgactgagcttggggaaagagaaatagaacagcccccagctcactgtgtgatgtggaggaaatgtgtattacaagtggggttttagctgttgagtcaaaataataacaagtgtacaatttagcataaggaatcggagagcctctccagagaagtcggtttctttgctgcaagaagaatgaggttctgaacccttatccaagaacagaagccatcagccaagtctccacatttctctgcaaaatgttgtagcctctataactgtatgatagtgtaatgcatgccttcagttgtaagtggccagatcgcgctacagtgacattgaaacctgctctctaattggccctgtacagtttgcttatttataaattcatttaaaacactacagctgttgaatggttacaacctaggcctccggtcctaacttcagttgttctcctcggtgtgcagccagctgttccacactgtattattgtaacttatttagtgaagtcagaagcagtagacagatgttggtgcaatacaagtattgtgtgcatttatcgtaataaagtgctccgcgtcggttcagttcctcacagcttctcacagtgcatgtctgactgtagtctgtaaatagaggtcagtgtccgtgctgctaacaggtatcgatcgcacaga

SEQ ID NO: 3399 - DNA, 3244 bp, Rattus norvegicus
  Genbank Accession No. NM_017293
ccgcttccggtgtcatggcagcctgaggtcccgggagtcggtgcgggcgctgcaggcccctccctgcggagccgcgggtccgggcggggatgtgacggcgggcgccgcgggcctgcctggcgcatcgtgtcggctcgcgtgtcctcgccccagcccgcaccatggccgggtccggctgcgcgtggggcgccgagccgccgcgcttcctggaggccttcgggcggctgtggcaggtacagagccgcctaggcagcggctcctcggcctcggtgtaccgggtgcgctgctgcggcactccaggctcgccccccggcgccctcaagcagttcctgcctccgggaaccaccggggctgccgcctcggctgcggagtatggtttccgaaaagagagggcagcgctggagcagttgcagggtcacaggaacatcgtgactttatacggagtctttaccatacacttctctccaaatgtgccatcacgctgtctgttgcttgaactcctggatgtcagcgtttcggaattgcttgtatattccagtcaccagggttgctccatgtggatgatccagcactgtgccagagatgtcctggaggcccttgcttttcttcaccatgagggctatgtccatgcagacctcaagccacgaaacatcctgtggagtgcggagaacgagtgctttaagcttattgactttggactcagcttcaaagaaggcaatcaggacgtgaagtatattcagacagacgggtatcgagctcctgaagcagaactgcagaattgcttggcccaggccggcctgcagagtgatacagagtgtacctcagctgttgatctctggagccttggaatcattttactggaaatgttctcaggaatgaaactgaaacatacagtcagatctcaggagtggaaggcaaacagttctgctattattgatcatatatttgccagtaaagcagtggtgaatgccgcaattccagcctatcacctcagagaccttatcaaaagcatgcttcatgacgacccaagcagaaggatccctgctgagatggccttgtgcagcccattctttagcattccttttgcccctcatattgaagatctggtgatgcttccaactccagtgctcagactcctcaatgtgctggatgatgactatcttgaaaatgaagatgaatatgaagatgttgtagaagatgtaaaagaagagtgtcagaaatatggaccagtggtttctctgcttgttccaaaggaaaatcctggcagaggacaagtctttgttgagtacgcaaacgctggagattccaaagctgctcagaaattgctgactgggaggatgtttgacgggaagtttgttgtggctacattctacccgctgagtgcctacaagaggggatatctttatcaaaccttgctttaatcagtaacctaaggactatttcctgtttctcctcttccatttcttggattattatattccacagctgaatgcaggagcaccctctccccattttaaagggtacttgtacatttattatcctaccaatgtgcagcctttgcccaaacagtgaccacattgcaaacacggcactgagtaggacaagacctctcagctatacattgagggggttagagcacccatgtgggcaccctttatttgtgcagtagggtgggtgctgctctttactatgtaacctaaaaagatgtcatttcatgtgctgatgaagcaaagatgagtcatttgtcatagtgaatattattaacaaatctgttagggctggtgacatcacagaatatttgtttgtattgtcaggtgtatctccttgttattctagctggcactgaatgctctaataatgttaagtcattgtcaagcaacagttacctaccgtgttcttaacaatgagttgtgaatttttctaaaggagtgctgtaggacttaatattcctctgaagaaactgcagtgagcctatcaatgtttttaaaattactattaaggcttttaaaatagaaagctgatgcttgatcttgcacaatttttatgtctagtatgtatgcttgagtgggtgtgcaagtgtgaaagactggagatgcctgagtcagtgtactttacagtgagtcttgtgagctaatacagtctgtaaccatttcctcctaccagttcacacttgagagacttgggctatgggtttcttgaaagttggtgtgacagatagaatgtaaatgacaaaagagttcattactgtaaaatgtagaacaaagtgtctagaccagggttccacgcaattcttcgaagtgactggaacaaagaaagtgtgggtacgtgtaagctaccccattctctacttcagacccaagactggctcatctcttttgtactgaacctcttgtgataattgtaacatttttccagatgtgattcttttctgctataatgaaattgaagtgggtcagaaaaaaaggtagatgcacagagacaggacaagagaaaggtgtagagaaggcagctaaccacggacgcttctccctgtctgccctgcctgccatcttgttctccttgcccttggctcttgccactgcagttggagggtttttgactggaagcgaggaaagaaaggctgacgggttttaaggtggaagtagaaaagaagaaaacgcagtgtctaagagaacaacagcagtccagtgtgtccttgatagaggccgcctgctggcatgagtttgtgggcacactgtgggttgaggagtgtgagcgtgcagtcttcctcttccgtagtggcgtacacttatgaaacgtttgtaaagcactggttatgcagataacccacaagttgtatatctgttacagaattttcctattcctgacctggatgaaaggttatttatttatttcccttaggaaagagtgtgtttcttttcctgctggcagcctgcttgtgtagtctcttgttcatactgttcaagttcctgagaacgccattaaaacttgcattttacaggatgaattattttacgctgattagacatttactgtccaacatttgttagcataatcaaatttttcagagctccctcttatgaagttaaatttggtataagggcctttaatgatgaattacatctgctcttatgtcatggtccctgatgtgtgtcttaggaagaaggcttttccaggggttcattgggcggttggttttcaagtcagacttgaggaacatagaatcaggactgtaaagtcctaa

SEQ ID NO: 3400 - DNA, 7986 bp, Rattus norvegicus
  Genbank Accession No. NM_017298
gaggggaccaagccaattctcctttgcagcaaaaaaaagagaaaaaagaaaaaaaagaaaaatttacatgtatatattactaagataatatatacatctgattttattttttacaaaaagtttattttgctccatttttcaaaaaaagaaggagcgtgggtggcaggcggtttttataaattattcttatttttgattatttgtctctgtccttccccaccccctgctgaagcgaaaataagggcagggaccgcgggctcctacctatcagtaacctcccatacccgttcctccccctccctaacgctgagcatagtgccctgcacacagtaggcgctcaataaatgttcgtggatgatgatgatgatgatgatgaaaaaaatgcagcatcaacggcagcagcaagaggaccacgcgaacgaggcaaactatgcaagaggcaccagactccctatttctggtgaaggaccaacttctcagccgaacagctccaagcaaaccgtcctgtcttggcaagctgcaattgatgctgctagacaggccaaggccgcccagaccatgagcacgtctgcacccccacctgtaggatctctctcccaaagaaaacgtcagcaatacgccaagagcaaaaaacagggtaactcgtctaacagccgacctgcccgtgccctcttctgtttatccctcaataaccccatccgaagagcctgcattagtatagtggattggaaaccatttgacatatttatattattggctatttttgccaattgtgtggccttagctatttacatcccgttccctgaagatgattctaattcaacaaatcataacttggaaaaagtagaatatgccttcctgattatttttacagtggagacatttctgaagattatagcgtccggactgctgctgcatcctaatgcttccgttaggaacggatggaacttactggattttgttatagtaatagtaggattgtttagtgtaattttggaacaattaaccaaagaaacagaaggcgggaaccactctagtggcaaatcaggaggctttgatgtcaaagccctccgtgccttccgagtgttaagaccgcttcgacttgtatcaggagtgcccagtttacaagttgttctgaactccattataaaagccatggtccccctcctccacatagcccttttggtgttattcgtaattatcatctatgcgattatagggttggaactttttattggaaaaatgcacaaaacctgtttttttgctgactcagatatagtagctgaagaggacccagctccatgcgcgttctcagggaatggacgccagtgtgccgccaatggcacggaatgtaggagcggctgggtcggccccaatggaggcatcactaattttgacaactttgcctttgccatgctcactgtgttccagtgcatcaccatggagggctggacagatgtgctctactgggttaatgatgcgataggatgggagtggccatgggtgtattttgttagtctgatcatccttggctcatttttcgtccttaacctggttcttggtgtccttagtggagaattctcaaaggaaagagagaaggctaaagcacgtggagatttccagaagcttcgggagaagcagcagctggaagaggatctcaagggctacttggactggatcacccaggcagaagacatagatcctgagaatgaagaggagggtggagaggagggcaaacgaaacactagcatgcccaccagtgagaccgaatctgtgaacacagagaacgtaagtggtgaaggcgagacccagggatgctgtggaagtctctggtgctggtggaaaagaagaggcgcggccaagactgggccctctgggtgtcggcggtggggccaagccatctcgaaatccaagctcagatcgcacggggcccgcgaggctttgtgtgtgtgccggtgcagccttgaatctctcgtgaaactatggacgtctaggttctcagcccacttgcaggctgcatatgtcagaccctacagccgtcggtggcgtcgctggaaccggttcaatcgcaggagatgcagggcagctgtgaagtctgtcacgttttactggctggtgatcgttctggtgtttctcaacactctgacgatttcctctgagcactacaatcagccagactggctgacgcagattcaagatatagcgaacaaagtgctcttggctttgttcacctgtgagatgctggtgaagatgtacagcctgggcctccaggcctacttcgtctctctcttcaaccgcttcgattgctttgtggtgtgtgggggaatcaccgaaaccatcctggtggaactggagctcatgtctcccctgggcgtctctgtgttccggtgtgtacgtctcctgaggatcttcaaagtgaccaggcactggacttccctgagcaacttggtggcgtccctgttaaactccatgaagtccatcgcctctctgctgttgctgctcttcctcttcatcatcatcttctccctgctggggatgcagctgttcggagggaagttcaatttcgatgagacacagaccaagcgaagcaccttcgacaacttcccacaggcgctcctgactgtgttccagatcctgacgggcgaagactggaatgcggtgatgtatgacggcatcatggcctacggaggcccgtcctcctctggaatgattgtctgtatttacttcatcatccttttcatctgtggtaactatatcctgctgaagctcttcttggccattgctgtagacaatttggctgatgctgaaagtctgaacactgctcagaaagaggaagccgaagaaaaagaaaggaaaaaaattgccagaaaagaaagcctagaaaacaaaaaaaacaacaaaccagaggtcaaccagatagccaacagtgacaacaaggttactattgatgactatcaagaggaggctgaagataaggacccttatccaccctgcgatgtgccagtaggtgaagaggaagaggaggaggaagaggacgagcctgaggttcctgctggtccccgtcctcgaagaatctcagagttgaacatgaaggagaaaattgcgcccatccccgaaggaagcgcattcttcattcttagcaagaccaacccgatccgtgtgggttgccacaaactcatcaaccaccacatcttcaccaacctcatcctggtcttcatcatgctgagcagcgctgccctggccgcagaggatcccatccgcagccactccttccgcaacactatactgggctactttgactatgctttcacagccatctttacggttgaaatcctgttaaagatgacaacttttggagcgttcttgcacaaaggggctttctgtaggaactacttcaatttgctggacatgctggtcgttggggtgtctctggtgtcatttgggattcaatccagtgccatctcggttgtgaagattctgagggtcttaagggtcttgaggcctctcagagcaatcaacagagcaaaaggacttaagcacgtggtccagtgtgtctttgtggccatccgaaccatcggcaacatcatgatcgtcacgaccctgctccagttcatgtttgcttgcattggggtccagctgttcaaggggaagttctaccgttgcacagatgaggccaaaagtaaccccgaggagtgcagggggcttttcatcctttataaggacggcgatgtcgacagtcccgtggtccgtgagaggatctggcaaaacagtgatttcaatttcgacaatgtcctttcggctatgatggcgctcttcacggtctcgacttttgagggctggcccgcgttgctgtacaaagctatcgactcaaacggagagaacgttggtcctgtctacaactaccgtgtggagatctccatcttcttcattatctacatcatcatcgtggccttcttcatgatgaatatcttcgtgggcttcgtcatcgtcaccttccaggagcagggagaaaaggagtataagaactgtgagctggacaaaaatcagcgtcagtgtgtggaatatgccttgaaggcccgccccttaaggagatacatccccaaaaacccataccagtacaagttctggtacgtggtgaactcctcgcctttcgaatatatgatgtttgtcctcatcatgctcaacacgctctgcctggccatgcagcactatgagcaatccaagatgttcaatgacgccatggacattctgaacatggtcttcacgggggtcttcaccgttgagatggttttgaaagtcatcgcatttaagcccaaggggtattttagtgacgcctggaacacgtttgactccctcatcgtaatcggcagcattatagacgtggcactcagcgaagctgacaactctgaagagagcaatagaatctccatcacctttttccgtcttttccgagtgatgcggttggtgaagcttctcagcagaggggaaggcatccggactctgctatggaccttcattaagtccttccaggcactcccatatgtcgccctcctcattgccatgctcttcttcatctacgccgtcattggcatgcagatgtttgggaaggttgccatgagagataacaaccagatcaataggaacaacaacttccagacgtttccccaggcagtgctgctgctcttcaggtgtgcaacaggggaggcctggcaggagatcatgctcgcctgcctccctgggaagctgtgtgacccggactcagattacaacccaggagaggaatatacttgtgggagcaactttgccattgtctacttcatcagcttttacatgctctgtgcgttcctgatcatcaacctcttcgtggctgtcatcatggacaattttgactatctgacgagggactggtctattctggggcctcaccacttggacgaattcaaaagaatatggtctgaatatgaccccgaggcaaagggaaggataaaacaccttgatgtggtcactttgctccgacgtatccagcctcccctgggatttggaaagttgtgtccacaccgagtggcgtgtaagagattggtcgccatgaacatgcctctcaacagtgatgggacagtcatgttcaatgcaactctgtttgctttggtacggacggctctcaagatcaagactgaaggcaacctggagcaagctaatgaagagctccgcgctgtgataaagaaaatctggaagaagacaagcatgaagctacttgaccaagttgtccctccagctggtgatgatgaggtaaccgtggggaagttctatgccactttcctgatacaggactactttaggaaattcaagaagcggaaagagcaaggcctggtggggaaataccctgcgaagaacaccacgatcgccctacaggcgggattaaggaccctgcatgacattgggccagaaatccgacgggctatatcctgtgacttgcaagatgacgaaccagaagactccaaaccagaagaggaagatgtattcaaaagaaatggtgccctgcttggaaactatgtcaatcatgttaatagtgataggagagagtcccttcagcagaccaataccacccaccgtcccctgcatgtccaaaggccttcaattccacctgcaagtgatactgagaaaccgctgtttcctccagcaggaaattcggtgtgtcataaccatcataaccataattccatagggaagcaagttcccacctccacaaatgccaatctcaataacgccaatatgtccaaagctgcccacggaaagcggcccagcattggggaccttgagcatgtgtctgaaaacggccattactcctacaagcacgaccgagagcttcaaagaaggtccagtattaaaagaacccgctattatgaaacttacattaggtctgagtcaggagacgagcagcttccaaccattttccgtgaagaccctgagatacacggctacttccgagacccccgctgcttcggggagcaggaatatttcagtagcgaggagtgctgtgaggatgacagttctcccacctggagcaggcaaaactacagctattacaacaggtacccaggcagctccatggactttgagaggccccgaggctaccatcacccccaaggtttcttagaagatgacgactctcccattggctatgactcacggagatctccaagaagacgccttctacctcctaccccaccatcccatcggaggtcctccttcaactttgagtgtctgcgcaggcaaaacagccaagatgacgtccttccgtcgcctgccctgcctcaccgcgctgccctgcccctgcaccttatgcagcagcagatcatggccgttgcaggcctagattccagtaaagcccagaagtactcgccgagccactctacccggtcatgggccacccctccagcaacccctccgtaccgagactggaccccatgctacacccctttgatccaggtggatcgctcagagtctatggaccaggtcaatggcagcctgccgtcgctacaccgcagttcctggtatacagatgaacccgacatctcctataggactttcacaccggccagcctgaccgtccccagcagcttccggaacaaaaacagcgacaagcagaggagtgcagacagcctggtggaagcagtcctgatatccgaaggcttgggacgctacgcaagggacccaaaatttgtctcagcaacaaaacatgagatcgccgatgcctgtgacctaaccatagacgagatggagagcgcggccagcaccctgctcaatggaagcgtgtgtcctcgagccaacggggacatgggccccatctcacaccgccaggactatgagctccaggactttggtcctggctacagtgacgaggaaccagaccctgggcgagaggaagaggacctggcagatgaaatgatttgcatcaccaccttgtagcccagcgagagcaggcttggctccagcctgggatgggcacaggagggccagggataaagtgccacataattaggaaagtttaggcactagttgggaggaaaatgctcaattagacttttgtacgagtgatttcacgcctcaaggaagccataaacctggtaggagcaggttctcagcggccaggcatgtgcgtacgcatgccacatgctcgggcccagccccagaagacagaatgtctggccccaccgagaggatgggcgagagcagcagcctggcctgcacagagaccaggactgcccaggagtccatgtctgccacccagggctcatgcccacgcccctttgcctgcagacacgagagaggtcaaaggtgatgacagtcaccatgcctgtgtcgttacctcaaccatcggtctagcatatcagacgctcgctgggcccggcatatccgtgtctgagcccccctcccccagagcactggttcctggtttctgtgcagccgttctgagtggcgcacaccagaacccagccgctagtggtcgcgatgaggggagtgggaccggaaccgttttgttaagcgatgccagtttacataaagagaacatcactcagacggtcagttctgtcacattaagggcaattgtaaactggaagggtagcgcacttgcaaaccaggtaaaacttagatacattagtttgtttaaaaattatagatttactgtacatgacttgtaatatacgatttgtatttgtaaagagatggtctatattttgtaattatcgtaccgtatttgaactgcagcaatatcccacgggtcctaacaatcgtagtttcccaccaaaacctagaaattattagtatttttactcgggctaaacagaactaggagaattagaggcaattctcacatattcagtaaaaagaatcttttggggataaacttttgagttcataagaacttgacacttcagaactttttctaaagtattttgagttactataaacctatctttacataag

SEQ ID NO: 3401 - DNA, 1879 bp, Rattus norvegicus
  Genbank Accession No. NM_017300
aagactttttccccagccttaactggatagtctgaagttttcaaaactcttatccacaaagttgtcagaaccttgattgggaagtcctgtgcatctgtgctaacctacagggcctccttatccagagcactctgcatttcagagggtcgctgtcgaactacggttttggcgaagacattcctgaagaattgtctgaggtttcctctgcaaaaatggccaagctgacagctgttcctctcagtgcacttgttgatgagcctgtgcatatccgggtcacaggcctgacccccttccaggtggtgtgccttcaggcatcactgaaagatgataagggaaacctgtttaattctcaggccttctacagggccagtgaagtgggtgaggtagatctggaacgtgattcctctcttggaggagactacatgggggtccaccccatgggtcttttctggtccatgaaacctgaaaagctattgactagattggtaaaaagagatgtgatgaataggccccacaaagtccacataaaactttgccatccatactttccagtagaaggcaaagttatcagttcctccttggatagtctgattctggaaaggtggtatatggcacctggtgtcactaggatccatgtaaaggaaggccgaatccggggagccctgtttctgcctccaggagaaggtcctttcccaggggtcattgacttgtttggaggagctggtggactgtttgagttccgggccagcctcctggccagtcatggctttgccactttagctctggcttactggggctatgatgacctgccctctcgactggagaaggtagatctagagtattttgaagaaggtgtagagtttctcctgagacatcctaaggtcctgggcccaggggttggcatcctttctgtgtgcattggagcagagattggactttctatggctattaacctaaaacagataacagccactgtacttataaatgggcctaattttgtttctagcaatccacatgtatatcgtggtaaggtcttccagcctacaccctgcagtgaagaatttgtaaccaccaatgctttgggacttgtagagttctatcgaacctttgaggaaactgcagataaggatagcaaatactgttttcccattgaaaaagctcacggacattttcttttcgtggtgggagaagatgataagaacctcaacagcaaagtgcatgctaagcaagccatagcccagctgatgaaaagtggaaagaagaactggactctgctgtcttaccctggggcaggtcacctgattgagcctccctactccccactgtgctcagcctcaaggatgccctttgtaatcccaagcatcaactggggaggagaggttatcccacacgcagctgcgcaggaacattcttggaaggagatacagaaatttctcaagcagcatcttaatccaggtttcaacagtcagctgtgagtggacttgattatattactggaaagaggagctgggcatctcctggccagctccactcctcacttccatagaggaatgtctttaatctcttatcacatgaggaagaagagtaccaccagaaaatgccgaaggacagagagtgataacctcatgactttggaaggggagacatgttttccatggaataaaatgtccctcagtgagagtcctatatctgtataaataaaatcttagggttttcctaaaatgttcaacaccacagcaactttctgtgatgataattatcaaggaaattatcactgataatccacaggatactttagtttataaaagagacatgaaaagaattatatattgttacttattaatttcttaaaactcacattaaatatgcttagatcatc

SEQ ID NO: 3402 - DNA, 1382 bp, Rattus norvegicus
  Genbank Accession No. NM_017305
gaattccggccttccctccgtggctccggcgctgcccggtcccctcgggcggcagctgccatgggcaccgacagccgcgcggccggagcacttctggcgcgggccagcaccctgcacctgcagaccgggaacctgctcaactggggccgcctgcggaaaaagtgtccgtccacgcacagcgaggagcttcgagactgtatccaaaagaccttgaatgaatggagctcccaaatcagccctgatttggtcagggagtttccagatgttttggaatgtaccatgtcccatgcagtggaaaagataaaccctgatgaaagagaagaaatgaaagtttctgctaaactgttcattgtaggatcgaattcttcatcatcaactagaaatgcagttgacatggcatgctcagtccttggagttgcacagctggactctgtcatcatggcttcccctccaattgaagatggagttaatctttccttggagcatttgcagccttactgggaggaattagaaaacttagttcagagcaagaagattgttgctataggcacctcggatctagacaaaacacagttggagcagctgtaccagtgggcacaggtaaaacccaatagtaatcaagttaatcttgcctcctgctgtgtgatgccaccagatttgactgcatttgctaaacagtttgacatacagctactgactcacaatgacccaaaagaactgctctctgaggcaagtttccaggaagctcttcaagaaagcatccctgacattgaagcccaggagtgggtgccactgtggctgctgaggtactcggtcatcgtgaaaagcagaggaatcatcaagtcaaaaggatacattttgcaagccaaaagaaagggttcttaactacagctcaagctcacaactcaggggccttgtatttatctggaacataagataaaaattcatgataaaattgagatgtgtaaaaaaaaatctagctctcgcctacaaaaagcgtcactgaggcgtgaatgtggtggtttggcaatgtgttgagtttaagtacctccctggcgtctgcagcagcgcactcacaggaagcattgtattctcttcattaaactcttggtttctaactgaaatcgtctataaagaaaaatacttgcaatatatttcctttatttttatgagtaatagaaatcaagaaaatttgttttaagatatattttggcttaggcatcagggtgatgtatatacatattttttatttctaaaattcagtaactgcttcttactctatacttctataactaagcaattacattacagttgttaagacatactggaagagatttttttcctgtcgtttgacaaaataatctatctcagagtcggaattc

SEQ ID NO: 3403 - DNA, 987 bp, Rattus norvegicus
  Genbank Accession No. NM_017306
cccaccgatatccaaaatggcgctggctgctgcgcgtcgcgttctgctgcaggccggatcccgcctcggccgcaggggggccgtggacggcgcgcgtcgcttctctaacaagcgggtgttggtggagaaggagggcgaggcaggaatcgcagtgatgaagttcaagaaccctccagtgaattccctcagcttggagtttctgacagagttcgtcatcagcctggagaagctggaaaatgacaagagcatccgaggtgtcatcctcacttcggagcgcccgggtatcttctcggctggcctggacttgatggagatgtatggccggaacccagcccactatgctgagtactggaaggctgtgcaggagctgtggctgaggctctacttgtccaacctgaccttgatatctgccatcaatggcgcctctccagctggaggctgcctcatggctctcacctgtgactacaggataatggcggacaactccaagtataccataggattgaatgagagcctgctgggcattgttgcccccttctggttaaaagacaactacgtgaacaccatcgggcaccgagcagccgagcgtgcccttcaactggggacgcttttcccaccagcagaggccctcaaggtgggtttggtggatgaggtggtacctgaggatcaggtacacagcaaggctcgctcagtgatggccaagtggttcaccattccggaccattctcggcagctgacgaagagcatgatgcggaaggccacggcggacaacctgatcaagcagcgagaggctgacatccagaacttcaccagtttcatctccagagactccatccagaagtccctgcacgtgtacttggaaaagctcaagcaaaagaagggctgacctaagggtgccacacgggtgtttagttacacgtgccttctaggacccatggtcccaaggattatcaataaggtatttttcaatttaaaaaaaaaaaaaaa

SEQ ID NO: 3404 - DNA, 1575 bp, Rattus norvegicus
  Genbank Accession No. NM_017307
gggtccgggcgcccctcctcctgcccgccatggctgcgcctcgcgcaccccgcgctctgacggctgccgctcccgggtccgggaaagccaaactgacgcaccccgggaaggcgatcctagcaggcggcctggctggaggcatcgaaatctgcatcaccttcccgaccgaatacgtgaagactcaactacagctagatgaacgcgcgaacccaccgcggtaccggggcattggggactgcgtgcggcaaactgtccgcagccatggcgtcctgggcctgtaccgcggcctcagctccttgctctacggctccatccccaaggcggctgtcaggtttgggatgttcgagttcctcagcaaccacatgcgggatgcccaaggtagactggacagcaggagaggactgctgtgcggtctgggtgccggcgtggcagaggcagtggtagtcgtgtgccccatggagaccgtgaaggtgaaattcatccatgaccagacttcctccaatccaaagtaccgaggatttttccatggggttagagagattgttcgggaacaagggctaaaggggacataccaaggcctcacagctactgtactgaagcagggctcaaaccaagccatccgattcttcgtcatgacctccctacgcaactggtaccaaggagacaaccccaacaagcctatgaacccactgatcaccggggtctttggagctgtcgcaggtgcagccagtgtctttgggaacacacccttggatgtgatcaagaccaggatgcagggcctggaggcacacaaataccggaacaccctggactgtggagtgcagatcctgaagaatgaggggcccaaggcattctacaagggcaccgttccccggctgggccgagtctgcctggacgtggccatcgtattcgtcatctatgatgaagtggtgaagctgctcaataaagtgtggaagacggactaaccctggagggtgcaatggggcgtcccagctcctccaggccacctactcttgacgattccagtgcagtagtgccaaaaggccccttcctttgtccctcaagttctgtggcctggtgtgtcatagtgactgtcatgtgttccttagtactgtactcccatgtggtctatgtgtaacactactattgtatctgtgtccagcctggccgtggctgggtgtctctttggcctgtgaagacgtgctcacttacccatgtgcttgcttgtgagccatgtgcctgtttcatgttctatgtcatgtgaccctgtgccccacttcctggggtgcctatgtgccctggtccatggccttggagccatggtcaggtcacagtccggtgccttccaccccctatggcaagggcgccctgccctggcctaccacagctgcctctgggcttcggcctggcttcaccgcattccaggggctataggcccccctgcttctcccgccattggccttaaatggccctcgggccctccctctgcccggaacagggtggcaccagccactctcaggaccaccttgccaaggagaataaaccggatcctgttgcaaaaaaaaaaaaaaaaaa

SEQ ID NO: 3405 - DNA, 796 bp, Rattus norvegicus
  Genbank Accession No. NM_017309
gaagatccgggtacgccgcgtcccaaggaacctacagccgccgccagcgccgcccgcctagcaagatgggaaatgaggcgagttaccctttggaaatgtgctcacacttcgatgctgatgagattaaaaggctaggaaagagattcaagaagcttgacttggacaactctggttctttgagcgtggaggagttcatgtctctgcctgagttacaacagaaccctttagtacagcgggtcatagatatattcgacacagacgggaatggagaagtggacttcaaagaattcattgaaggagtctctcagttcagtgtcaaaggcgataaggaacagaagttgaggttcgctttccgtatctacgacatggataaagacggctatatttccaatggagagctcttccaggtgttgaagatgatggtgggcaacaacctgaaagatacgcagttacagcagattgtagacaaaaccataataaacgcagataaggacggggacgggagaatatcctttgaggagttctgtgctgttgtaggtggcctagatatccacaaaaagatggtggtggatgtgtgactctttgaagactctaccacccagcacttttgctttcttctccatctctgaagatctgctcaagacgtccagcagtgctctctgtgtgtgtaaatggaagtatttttctctgtgaagccacattttccaacatgagcctcatgaagccaacgaagtgttattgaactcctaccctctcaataactcagtgtagcactttcaagtttgaggccatggtg

SEQ ID NO: 3406 - DNA, 561 bp, Rattus norvegicus
  Genbank Accession No. NM_017311
gtgtgctgtgggccgagcaggggctgcaggggagtgggagtgcagattgaaaaatgcagaccacgaaggcactgctcatttctccagttctgatccgctcctgtaccaggggtctaatcaggcctgtgtctgcctccctcctgagtagaccagaggctccatctaaaaagccttcctgctgcagctcccctctccaggtggccagacgggaattccagaccagtgttatttcccgggacattgacacagcagccaagtttattggtgctggggccgccacagttggtgtggctggatcaggggctggcattggcacagtgtttggtagcttgattattggctatgccaggaacccgtctctcaagcagcagctcttctcctatgccatcctgggctttgccctgtctgaggccatggggctcttctgtttgatggtcgccttcctcatcctcttcgccatgtgaggctccatggggtcacccggccgtccctgctgctttgactccatgccagtcctggtgctggagtgtgctgagctttaccattaaactacgtttctct

SEQ ID NO: 3407 - DNA, 2545 bp, Rattus norvegicus
  Genbank Accession No. NM_017314
cttttgtgaggactgcagccaacaccgctgacaatgcagatctttgtgaaaaccttaactggtaagaccatcaccctggaggtcgagcccagtgacaccattgaaaatgtcaaggcaaagatccaggacaaggagggcatcccccctgaccagcagaggctgatctttgcaggcaagcagctggaagatggccgcaccctgtcagactacaacatccagaaggagtccaccctgcacctggtcctgcgcctcagagggggcatgcagatctttgtgaagaccctgacaggcaagaccatcaccctggaggtcgagcccagtgacaccattgaaaatgtcaaggcaaagatccaggacaaggagggcatcccccctgaccagcagaggctgatctttgcaggcaagcagctggaagatggccgcaccctgtcagactacaacatccagaaggagtccaccttgcacctggtccttcgcctcagagggggcatgcagatctttgtgaagaccctgacaggcaagaccatcaccctggaggtcgagcccagtgacaccattgaaaatgtcaaggcaaagatccaggacaaggagggcatcccccctgaccagcagaggctgatctttgcaggcaagcagctggaagatggccgcaccctgtcagactacaacatccagaaggagtccaccctgcacctggtccttcgcctcagagggggcatgcagatctttgtgaagaccctgacaggcaagaccatcaccctggaggtcgagcccagtgacaccattgaaaatgtcaaggcaaagatccaggacaaggagggcatcccccctgaccagcagaggctgatctttgcaggcaagcagctggaagatggccgcaccctgtcagactacaacatccagaaggagtccaccctgcacctggtcctgcgcctcagagggggcatgcagatctttgtgaagaccctgacaggcaagaccatcaccctggaggtcgagcccagtgacaccattgaaaatgtcaaggcaaagatccaggacaaggagggcatcccccctgaccagcagaggctgatctttgcaggcaagcagctggaagatggccgcaccctgtcagactacaacatccagaaggagtccaccctgcacctggtccttcgcctcagagggggcatgcagatctttgtgaagaccctgacaggcaagaccatcaccctggaggtcgagcccagtgacaccattgaaaatgtcaaggcaaagatccaggacaaggagggcatcccccctgaccagcagaggctgatctttgcaggcaagcagctggaagatggccgcaccctgtcagactacaacatccagaaggagtccaccctgcacctggtccttcgcctcagagggggcatgcagatctttgtgaagaccctgacaggcaagaccatcaccctggaggtcgagcccagtgacaccattgaaaatgtcaaggcaaagatccaggacaaggagggcatcccccctgaccagcagaggctgatctttgcaggcaagcagctggaagatggccgcaccctgtcagactacaacatccagaaggagtccaccctgcacctggtccttcgcctcagagggggcatgcagatctttgtgaagaccctgacaggcaagaccatcaccctggaggtcgagcccagtgacaccattgaaaatgtcaaggcaaagatccaggacaaggagggcatcccccctgaccagcagaggctgatctttgcaggcaagcagctggaagatggccgcaccctgtcagactacaacatccagaaggagtccaccctgcacctggtcctgcgcctcagagggggcatgcagatctttgtgaagaccctgacaggcaagaccatcaccctggaggtcgagcccagtgacaccattgaaaatgtcaaggcaaagatccaggacaaggagggcatcccccctgaccagcagaggctgatctttgcaggcaagcagctggaagatggccgcaccctgtcagactacaacatccagaaggagtccaccctgcacctggtcctgcgcctcagagggggcatgcagatctttgtgaagaccctgacaggcaagaccatcaccctggaggtcgagcccagtgacaccattgaaaatgtcaaggcaaagatccaggacaaggagggcatcccccctgaccagcagaggctgatctttgcaggcaagcagctggaagatggccgcaccctgtcagactacaacatccagaaggagtccaccctgcacctggtcctgcgcctcagagggggcatgcagatctttgtgaagaccctgacaggcaagaccatcactctggaggtcgagcccagtgttaacaccaagaaggtcaaacaggaagatactcgtacctttctcaccacagtatctagaaagagcccttcttgtgcttgttcttgggtttgatggggaggtgtcttagttttccctatcttttaagctgttaacaagtttcattgcactttgaataaagttcttgcattcc

SEQ ID NO: 3408 - DNA, 2472 bp, Rattus norvegicus
  Genbank Accession No. NM_017315
cagagatgaaagctcaggaggaccccgggagctcaaagcagcatgaatgcccagattcagcagggacttccaccagggaccagcaggcacctttgcccgcggagcccaagtttgacatgttgtacaagattgaggacgtgccaccatggtacctgtgtatcctgctgggcttccagcattacctgacatgcttcagtggtaccattgctgtgcccttcctcctggctgaggcgctgtgtgtgggccgcgaccagcacatgatcagtcagctcattggtaccatcttcacctgcgtgggtatcaccactctcattcagactacagtgggcatccggctgccgctgttccaggccagtgcctttgcgtttctggttccagccaaggctatcctggccttggagaggtggaagtgtcctccagaagaggagatctacggtaactggagtatgcccctgaacacctctcatatctggcatcctcggattcgggaggtccagggtgcaatcatggtgtccagcgtggtagaggtggtgattgggctgttggggctgcctggggccctgctcagctacattggacctctcacagtcacccccactgtctcccttatcggtctctctgttttccaagctgctggcgaccgagctggctcccattggggcatttcggcttgctccattctactgatcgtcctgttctcccagtatctacgcaacctcaccttcctgttgcctgtttaccgatggggcaagggtcttactctcttccgcatccagatctttaagatgtttccgatcgtgctggccatcatgaccgtgtggctactctgctatgtgctgactctgacagacgtgctgcccgcagatcccacagtctacggtttccaggctcgaactgatgcccgaggggacatcatggctatctctccctggatccggatcccctacccatgtcaatggggcctacccacagtgaccgtggctgcagttctgggaatgttcagcgccacactggcgggcatcatcgagtccatcggtgattactatgcctgcgcccggttggctggagcaccaccccctccagtccatgctatcaacagggggattttcaccgaaggcgtctgctgcatcatcgctgggctactgggcacaggcaacgggtccacctcttccagccccaacatcggggtcctagggattaccaaggtgggcagccgaagagtcgtgcagtatggtgcaggtatcatgctaatcctgggggccattggcaaattcacagctctcttcgcctcactgccggaccccatcctgggagggatgttctgcactcttttcggtatgatcaccgctgtgggactgtccaatctgcagtttgtggacatgaactcctcccgcaacctctttgtattgggattctccatgttcttcggcctcacgctacccaactacctggattccaacccaggtgccatcaacacaggcgttcctgaagtggatcagatcctaactgtgctgctgaccacagagatgtttgttggtggctgtcttgctttcatactggacaacacagtaccagggagcccagaggaaagaggtctgatacagtggaaagccggggcacacgccaacagtgagacgctggccagtctcaagagctacgatttcccgttcgggatgggcatggtaaaaaggaccaccttttttagatacatccccatctgcccagtcttcagaggattctctaagacagaaaatcagcctgcagttctagaagacgctccagacaacacagaaactgggtctgtgtgtaccaaggtctgaaactacctctatgaaaggaggcacggtgtgtatcaggaaaacaaactacccaggagacagaagacctgagttggagatctcagctgtccctattctaaattcccatggaagactggacagatcaccctctctttgactccattttcgtgacagcccaagtctctaagtcctcgggagacctgtatttgcactgctctgattccttacttccactttcctaagcatgcatgtcaaggaggaagagctggagaaaaaaaaggaaacccagagagattctagggcttcatgtagacatgaagatagggttaaaaacaaaccaaacaaaaccccctgaattccaatgctatgtattttaagaccaaaacagtattaaataatatactggaccaataatttagataagtttagataagtattctcccttcacacagggaaaataaatttatactttcagactagctcagtgataaagatgtctatttagaatgttccagaactgggcttgaccttcaacattaaatatacagaaataaaaacccttaagaggaaaaaaaaaggggttggggatttagctcagtggtagagcgcttgcctagcaagcacaaggccctgggttcggtccccagctccgggaaaaaaaaaaaaaaaaaaa

SEQ ID NO: 3409 - DNA, 1330 bp, Rattus norvegicus
  Genbank Accession No. NM_017320
gggactctctcatgccgccatacggagatggctgttttgggtgcccctggtgtgctctgtgacaatggagcaactgcagagagacctaccctggaccaccactgggatctctggaagaaaactcgcatgagaaggaatacagatcagaatgaagaagacgtacgacgtctcatctgggaaaagaatctcaagtttataatgcttcacaatctggaacattctatgggaatgcattcatacagtgtgggcatgaaccacatgggagacatgacacctgaagaagtcataggttatatgggctctctgagaattcccaggccctggaatagaagtggcactctcaagtcaagctctaatcagacattgcccgactctgtggactggcgagaaaagggctgcgtcactaatgtgaaataccagggctcttgtggttcctgctgggctttcagcgccgagggggcccttgaagggcagctgaagctgaaaacggggaagctggtgtctctcagtgctcagaacctggtggattgctcaaccgaagaaaagtacgggaataaaggctgcgggggtggcttcatgaccgaagctttccagtacatcatcgatacgagcatcgactcagaagcttcctatccctacaaagccatggatgaaaagtgtctctatgacccaaaaaatcgagctgccacgtgttcaaggtacattgagctccccttcggcgatgaagaagctctgaaagaagcagtggccactaaagggcctgtctctgtgggcatcgacgacgccagccattcctccttcttcctctaccaaagtggtgtctatgatgacccctcctgtaccgagaatatgaatcatggtgttctcgtggttggctatgggactcttgatgggaaagactactggcttgtgaaaaacagttggggccttcactttggtgatcaaggatatattcggatggcgagaaataacaaaaatcactgcgggattgctagctattgctcttacccagaaatctaaaccgtttcttctttttctaatgggtcacaaagacggaatacactctaatttaattttgtctgctccatccggaggacccaagtgtgtcgtgatcagtgtgtacatactgtgctaactggcttacagcttgtttgttttataactttacctctctctgaaaagtctgtaagcaaggacgcgctgaggatggagctggcagtctgtcctagatattctttctatgcttgcaccctgtcgtctaatgtgtctaataaccctttgtaacacagatatccccaaagtgcctaataaaatctgtcatttcaagctc

SEQ ID NO: 3410 - DNA, 3564 bp, Rattus norvegicus
  Genbank Accession No. NM_017321
cgctgagtagatcactgttaagtttgagacttgtttcaaactaaaaaatgatgagggatatagcccagtagtaaagttacatgcctagatttctcagtgagtgccttggagcatgactcagtggtggagccctgcctagaatccccagtgagggcctgggttcttgcttgcacccgcctgtgtgctccgtgctccgtgagccccgctgtgagcgagacacgtgaccgtcagtaatcatgaagaatccatttgcgcaccttgccgagcccttggaccctgcacagccaggaaagaaattcttcaacttgaataaattggaggactcaagatatggacgcttaccgttctctatcagagttctcctggaggccgccgttcggaactgtgacgagtttttggtgaagaagaatgacattgagaatatcctgaactggagtatcatgcagcataagagcatagaagtgccgtttaagccagcccgagtcatactgcaggactttacgggcgtgcctgctgtggttgattttgcagcaatgcgcgatgctgtgaagaagttgggaggaaatccagagaaaataaaccctgtctgccccgctgaccttgtaatcgatcattccatccaggttcatttcaacagaagggcagacagtttgcagaagaatcaagacctggaatttgaaaggaatagagaacgatttgaatttttaaagtggggttcccaggccttttgcaacatgaggattattcctcctggctcaggaattattcaccaagtgaatctggagtatttggcaagagtagtgtttgatcaggatggatgttactacccagatagcctcgtgggcacagattctcacaccaccatgattgatggtctgggagttcttggttggggtgtaggtggtattgaagcagaagctgtcatgctgggtcagccaatcagcatggtgcttccccaggtgattggctacaagctgatggggaagcctcaccctctggtaacctccacggacattgtgctcaccattaccaagcacctccgacaagttggggtcgtgggcaaattcgtggagtttttcgggccaggagtggcccagctgtccattgctgaccgagctacgattgccaacatgtgcccagagtacggcgcgacggcagccttcttcccggtcgacgacgttagcatcgcgtacctggtgcagacaggtcgtgaggaagacaaagtaaagcacattaaaaggtatcttcaggctgtaggcatgtttcgagacttcagtgactcctctcaagacccagacttcactcaggtcgtggagttagatttgaaaacagttgtgccttgctgcagtggacctaaaagacctcaggacaaagttgctgtgtctgagattgaaaaggactttgaaagctgccttggagccaagcaaggatttaaaggttttcaagttgctccagaccatcacaatgaccacaagacgtttatctataacgacagtgaattcactcttgctcatggctccgtggtgatcgccgccatcactagctgcacaaacaccagcaatccgtccgtgatgttaggcgcaggattgttagcaaagaaagccgtagaggctggcctgaatgtgaagccttacgtcaaaaccagcctgtctcctgggagtggagtggtcacctactaccttcgagagagtggagtcatgccttacctgtcccagttagggtttgacgtggtgggctacggctgcatgacctgcatcggcaacagtggacccctccccgaacctgtggtggaggctatcacccagggagaccttgtggctgttggggtactgtctggaaacaggaattttgaaggacgagtccatcctaacacccgggccaactacttagcatctcccccactagtaatagcatatgcaattgcaggcaccgtcaggatcgacttcgagaaagagcctttgggagtgaacgcacagggccaacaagtgtttctgaaggatatctggccaactcgagatgagatccaggaggtggagcggaagtatgtcatccccggcatgttcaaggaggtctatcagaagatagagactgtaaacaaaagctggaatgccttagcagccccttcagagaagctgtatgcgtggaaccccaagtctacttatatcaagtcaccgccattctttgaaagcttgactttagatctccagccccccaagtctatagtggatgcctatgtgctactaaatctaggagattccgtaacaacggaccatatctctccagcggggaacattgcaagaaacagccctgccgctcgctacttgacgaacagaggcctgacgccacgagatttcaactcctacggctcccgccggggtaacgacgccatcatggcacgggggacatttgccaacattcgcttgctgaacaagtttctgaacaagcaggcccctcagactgtccaccttccttcaggagaaaccctcgatgtgttcgatgccgctgagcggtaccagcaggctggacttcccctgattgttctggctggcaaagagtacggttcaggcagctcccgagactgggcagccaaaggtcctttcctgctgggaatcaaagctgtcctggcagagagctacgagcgcactcactgcagcaacctggttggcatgggggtgatcccccttgagtatctccccggcgaaactgcagactctctgggactcacgggtcgggaaaggtacacgatccacattcccgaacaccttaagccccgcatgaaggttcagataaagctggacaccgggaagaccttccaggccgtgatgaggttcgacaccgacgtggagctcacttacttccacaatggaggcatcctgaactacatgatccgaaagatggcccagtaggtgctggcctctcaggagacccgcgcttggtgctagacccaatgaggtaccaggcctccgctggtggaggcctgcgagcagccacctctacttctcgtgagggtgctagcaagatgagcaagtgggccctgccattcctggaggctcagcggcaggagtctctagttcggtgatttgttaatcttttatccttttctgtaatccggaatctagaatcatgggaaggtccatagtcccaaagagagctaccttctctttaaagtcactcatcaccggtcattgatttttttcactctgactaatcttcagcagaactagccagtatctcagaagtgtctcctaccctttctgttactctgtctgtctgtgctcagtgacacccttccctggagagcccattcctccgtgtatcacaccagtgttaacgacatagcttcagactctgtcacacttcaaattcatagtaatctgtgtgatcccttccttccaagtgagcgaagaccttgtggcatggctggccgtcccaagtgtttgattacctaccttccaatcaccgtgagttgtcttttaccattttcaacatttgttgacagggtttgaaagtaaccggggagcgagacaggatttctaattgaataagattaaatatattttcatg

SEQ ID NO: 3411 - DNA, 2622 bp, Rattus norvegicus
  Genbank Accession No. NM_017322
tgtatgacactacatcatgagtgacagtaaaagcgatggccagttttacagtgtgcaagtggcagactcaactttcactgttctaaaacgttaccagcagttgaaaccaattggctctggagcccaaggaattgtttgtgctgcttttgatacagttcttggaataaatgttgctgtcaagaagttaagtcgtccttttcagaaccaaacgcatgcaaagagagcctaccgtgaacttgtcctcctaaagtgtgtcaatcataaaaatataattagcttgttaaatgtgttcacaccacaaaaaacgctagaagaattccaagatgtgtacttggttatggagttaatggacgctaacttatgtcaggttattcatatggagctggaccatgaaagaatgtcatacctcctctaccagatgctttgtggcattaagcacctgcattcagctggcataattcatagggatttgaagcctagcaacattgtagtaaaatcagactgtactctcaagatccttgactttggcctggcacggacagcctgtaccaactttatgatgactccctatgtggtaactcgctactatcgggctccagaagtcatcctgggcatgggctacaaggagaatgttgatatctggtcagtgggttgcatcatgggagagctggtgaaaggttgtgtgatattccaaggtactgaccatattgatcaatggaataaagttattgaacagctaggaacaccatccgcagagttcatgaagaaacttcagccaactgtaaggaattatgtggaaaacagaccaaagtaccctggaatcaaatttgaagagctctttccagattggatatttccgtcagaatccgaacgagacaaaataaaaacaagtcaagccagagatctgttatcgaaaatgttagtgattgatccggacaagcggatctctgtggacgaagccttgcgccacccgtatattactgtttggtatgaccccgctgaagcagaagcgccaccacctcaaatttatgatgcccagttggaagaaagagagcatgcgattgaagagtggaaagaactaatttacaaagaagtgatggactgggaagaaagaagcaagaatggggtgaaagaccagccttcagatgcagcagtaagcagcaaggctactccttctcagtcgtcatccatcaatgacatctcatccatgtccactgagcacaccctggcctcagacacagacagcagtctcgatgcctcaaccggacccctggaaggctgccgatgaaacctcgcagatggcgcacttgtctgtgaaggactctggcttccatggccctgagcacatgggagctggtggaacaaatcaagaagctccatgttctgcatgtaagaaacacgacgccttgcccccactcagttccagtaggattgcctgcgtagactgtaacatgaggcagacgatgtctggagaaaaagtacaaaccacactgttagaaattttgttcaagatcattcaggtgagcaattagaatagccgagttcttttcaagtcgtgtggtgtccttggtgacagatcatgtgtaactgtggggactcgtatgcatgtgaccacaaatgcttgcttgaacttgcccatgtagcactttgggaatcagtatttaaatgccaaataatcttccaggtagttctgcttctagaataatctcttaatcctctttagtaatttggtgtctgtccacaaaaaaatagattatgtgtgtatgaattggccactatcatattatcatattttacccacttttatggtatgatttattctgtcttttgtatttcagaaggaatataattaaatttatttaataaataaaactacagcttttcttaaatttgtgatgttttaggctgagaattaccactgctttatatcgacactctgtgtcctttaaactgcccactatgggaaactttacgtacagctttctgcatgacaaagttccaagttgtatttcactctgcttaacgacttatgtcaccttgaatcctgaccacacatttcctttttcttggtcctctgaacttggatctagaatccctcacagaacttcaccttctttatcacaaagcaccccatctcagtagaatgaatcggcagattcctgagccccgctgcctaatgtagagctgacagggtggcttccccagaacggtgggtgggtgcatccttccctgagcccacccatcctttgctcccctctctttatttaaggtgaaaggtgattgggtctcatagcctttccttttgtagcattgcctaacttgtctttctcactgacagaagccaccacgtccagccagagcacatggtctcttaggagaccgggcttacttaccatgcatgtttgctgctgtccttttccattttgtggaggcatttcctttttctaagggaattcctcagatgttctagaaacattcagaagaacgcagaagaaatattctagagaattgggggttcattcttgaatattttctgatttaaaactgctcacctgaaattgatactttcagatcctgatcttgtaaattactcgagatttggtaagatgctgagttctctgt

SEQ ID NO: 3412 - DNA, 2006 bp, Rattus norvegicus
  Genbank Accession No. NM_017325
gaattctccaaatctagtttgtttttttttctggtcattttttttaattctgcgcataaatattttaggacgcatacgggaattttgcctccgggaccgtttgtaatagccaaagactgaactccaaactctgaaagcgaggctccttggggcatttgactttgaattctgggttgcccacttttcaatgcactaagcggccagttgctaaccctgcctgggtgtaaggccgatccgcgtaactagatctcagtcctgctacccccacaaccctccggtagtaataaaggctcctgaacttgtatgttggtctcccgggagcagcttgcagaagatccgagtccctgtcgccgtctagtaggagctgttttcagggtccttactcaatcggcttgttgtgatgcgtatccccgtagatgccagcacgagccgccgcttcacgccgccttccactgcgctgagccccggcaagatgagcgaggcgctgccgctgggcgccccggatggcggcgccgccctggccagcaagctgaggagcggcgaccgcagcatggtggaggtactagctgaccaccccggcgagctagtccgcaccgacagccccaacttcctctgctccgtgctgcccactcactggcgctgcaacaagaccctgcccatcgctttcaaggtggtagcgctgggcgacgttccggatggcactctggtcaccgtcatggcgggcaatgacgaaaactactcggcggagctgagaaacgccaccgcggccatgaagaaccaagtggcgagattcaacgacctcaggtttgtcggtcggagcggcagaggcaagagcttcactctgaccatcaccgtctttacaaaccccccacaagttgccacctaccatagagccatcaaaatcacagtggacggcccccgagaaccccgaagacatcggcagaaactagatgatcagaccaagcccgggagtttgtccttttccgagcggctcagtgaactggagcagctgcggcgcacggccatgagggtcagcccgcatcacccagcccccacgcccaaccctcgggcctccttgaaccactccactgcctttaaccctcagcctcaaagtcagatgcaggatgccaggcagatccagccgtccccaccgtggtcctatgaccagtcttaccagtacctggggtccatcacctcttctgtgcacccggcgacacccatttctcccggccgagccagtggcatgaccagcctctcagcggaactttccagtcgactctcaacagccccggacctgacagccttcggcgacccgcgccagttccccacgctgccgtccatctccgacccgcgcatgcactacccaggcgccttcacctactcgcctcctgtcacatcgggcatcggcattggcatgtcagccatgagctcgacctctcgctaccacacctacctgccgccgccctacccaggctcctcgcaggcgcaggccgggcccttccagaccggctcgccctcctaccacctgtactacggcacctcggcaggctcctaccaattctccatggtgggcggcgagcgatcacccccgcgcatcctgccgccctgcaccaacgcgtccaccggagccgcgctgctcaaccccagcctccccagccagagcgacgtggtggaaaccgagggcagccatagcaactcgcccaccaacatgccacccgcgcgcctggaggaggctgtctggcggccctactgagcgccttcgggggactgagcccgccgtccatgcacagaccccgccaggagagcccttggaggccaacaggagggaaactgtgaatgcttctgatttagtaatgctgtgaataaaagaaagattttatacccttgacttcactttttaaccacgttgtttattccaaagagtgtggaatgttttcggttccgggtggggaagacgcagcccatcctgtttggcatctatttcttttccgcaccttattgattgc

SEQ ID NO: 3413 - DNA, 9136 bp, Rattus norvegicus
  Genbank Accession No. NM_017332
agagacggcagcagcgtcccgtccagttcgcctgccgcgctcgcttgtcgtctgcctccagatcccagacagagaagagccatggaggaggtggtgatagccggtatgtccgggaaattgcccgagtcagagaacctgcaggagttctgggccaacctcattggcggtgtggacatggtcacagacgatgacaggaggtggaaggctgggctctatgggttgcctaagcggtctggaaagctgaaggatctgtccaagttcgacgcctccttttttggggtccaccccaagcaggcacacacaatggacccgcagctccggctgctgctggaagtcagctatgaagctattgtggacggaggtatcaacccggcctcactccgaggaacaaacactggtgtctgggtgggtgtgagtggttccgaggcgtcggaggccctgagcagagatcctgagactcttctgggctacagcatggtgggctgccagagagcaatgatggccaaccggctctctttcttcttcgacttcaaaggacccagcattgccctggacacagcctgctcctctagcctactggcactacagaatgcctatcaggctatccgcagtggggagtgccctgctgccattgtgggcgggatcaacctgctgctaaagcctaacacctctgtgcagttcatgaagctaggcatgctcagccccgatggcacctgcagatcctttgatgattcagggaacgggtattgccgtgctgaggctgtcgtggcagttctgctgactaagaagtccttggctcggcgagtctatgccactattctgaatgccgggacgaacacagatggctgcaaggagcaaggcgtgacattcccctctggagaagcccaggaacaactcatccgttctctgtatcagccgggcggtgtggcccccgagtctcttgaatatattgaagcccatggcacgggcaccaaggtgggggacccccaggaactgaacggcattactcggtccctgtgtgctttccgccagagccctttgttaattggctccaccaaatccaacatgggacaccctgagcctgcctcggggcttgcagccctgaccaaggtgctgttatccctagaaaatggggtttgggcccccaacctgcatttccacaaccccaaccctgaaatcccagcacttcttgatgggcggctgcaggtggtcgataggcccctgcctgttcgtggtggcatcgtgggcatcaactcgtttggcttcggaggtgccaatgttcacgtcatcctccagcccaacacacagcaggccccagcacctgccccacatgctgccctaccgcatttgctgcatgccagtggacggaccatggaggcagtgcagggcctgctggaacagggccgccagcacagtcaggacttggcctttgtgagcatgctcaatgacattgcagcaacccctacagcagccatgcccttcagaggttacactgtgttaggtgttgagggccatgtccaggaagtgcagcaagtgcctgccagccagcgcccactctggttcatctgctcagggatgggcacacagtggcgtggaatggggctgagccttatgcgcctggacagtttccgtgagtccatcctgcgctctgatgaggctctgaagcccttgggagtcaaagtgtcagacctgctgctgagcactgatgagcacacctttgatgacatcgtgcattcctttgtgagcctcaccgccatccagattgccctcatcgacctgctgacgtctatggggctgaaacctgatggcatcattgggcactccttgggagaggttgcctgtggctatgcagatggctgtctctcccagagagaggctgtgcttgcagcctactggagaggccagtgcattaaggatgccaaccttccggctggatccatggcagctgttggtttgtcctgggaagaatgtaaacaacgctgccctcctggtgtggtgcctgcctgccacaactctgaggacactgtgaccatctctggacctcaggctgcagtgaatgaatttgtggagcagctaaagcaagagggcgtgtttgccaaggaggtgcgaacaggtggcctggccttccactcctacttcatggaaggaattgcccccacgctgctgcaggctctcaagaaggtgatccgggagccacggccacgctcagcacgctggctcagcacctctatccctgaggcccagtggcagagcagcctggcccgcacatcttctgctgagtacaacgtcaacaacctggtgagccctgtgctcttccaggaagcactgtggcacgtccccgagcacgccgtggtgctggagattgcaccccatgcactgttgcaggctgtcctgaagcgaggcgtgaagcctagctgcaccatcatccccttgatgaagagggaccataaagataacttggagttcttcctcaccaacctcggcaaggtgcacctcacaggcatcgacatcaaccctaatgccttgttcccacctgtggaattcccggttccccgagggactcctctcatctcccctcacatcaagtgggaccacagtcagacttgggatatcccagttgctgaagacttccccaacggttccagctcctcctcagctacagtctacaacattgacgccagttccgagtcatctgaccactacctggtcgaccactgcattgacggccgtgtcctcttccctggcactggctacctgtacctggtgtggaagacactggctcgaagcctgagcttgtccctagaagagacccctgtggtgtttgagaacgtgacatttcatcaggccaccatcctgcccaggacaggaaccgtgcctctggaggtgcggctgctagaggcctcacatgcatttgaggtgtctgacagtggcaacctgatagtgagcgggaaagtgtaccagtgggaagaccctgactccaagttattcgaccacccagaagtcccgatccccgccgagtccgagtctgtctcccgcttgacgcagggagaagtatacaaggagctgcggctacgtggctatgactatggccctcatttccagggcgtctatgaggccaccctcgaaggtgagcaaggcaagctgctctggaaagacaactgggtgaccttcatggacacaatgctgcagatatccatcctgggcttcagcaagcagagtctgcagctacccacccgtgtgactgccatctatattgaccctgcaacccacctgcagaaggtgtacatgctggagggagacactcaagtggctgacgtgaccacgagccgctgtctgggcgtgaccgtctctggtggtgtctacatttcgagactacagacaacagcaacctcacggcggcagcaggaacagctggtccccaccctggagaagtttgtcttcacaccccatgtggagcctgagtgcctgtctgagagtgctatcctgcagaaagagctgcagctgtgcaagggtctggcaaaggctctgcagaccaaggccacccagcaagggctgaagatgacagtgcctgggctagaggaccttccccagcatggactgcctcgactcttggctgctgcctgccagctgcagctcaacgggaacctgcaactggagttaggtgaggtactggctcgagagaggctcctgctgccagaagaccctctgatcagtggcctccttaactcccaggccctcaaggcctgcatagacacagccctggagaacctgtctactctcaagatgaaggtggtggaggtgctggctggagaaggccacttgtattcccacatctcagcactgctcaacacccagcctatgctgcaactggagtatacagccaccgaccggcacccccaggccctgaaggatgttcagaccaagctgcagcagcatgatgtagcacagggccagtgggacccttctggtcctgctcctaccaacctgggtgctcttgaccttgtggtgtgcaactgtgcgttagccaccctgggggatccagccctggccctggacaacatggtagctgccctcaaggatggtggtttcctgctaatgcacacagtgctcaaaggacatgcccttggggaaaccctggcctgcctcccttctgaggtgcagcctgggcccagcttcttaagccaggaagagtgggagagcctgttctcaaggaaggcactgcacctggtgggccttaaaaagtcattctacggtactgcgctgttcctgtgccgccgtctcagcccacaggacaagcccatcttcctgcctgtggaggatactagtttccagtgggtggactctctgaagagcattctggccacatcctcctcccagcctgtgtggctaacagccatgaactgccccacctcaggtgtggtaggcttggtgaactgtctccgaaaagagccgggtggacaccggattcggtgtatcctgctgtccaacctcagcagcacatctcacgtccccaagctggaccctggctcttcagagctacagaaggtgctagagagtgatctggtgatgaacgtgtacagggacggtgcctggggtgccttccgtcacttccagttagagcaggacaagcccgaggagcagacagcacatgcctttgtaaacgtccttacccgaggggaccttgcctccatccgctgggtctcttctcccctgaaacacatgcagccgccctcgagctcaggagcacagctctgcactgtctactatgcctcactgaacttccgagatatcatgctggccacgggcaagctgtcccctgatgccattccaggtaaatgggccagccgggactgcatgcttggcatggagttctcaggccgtgataagtgcggccggcgtgtgatggggctggtacccgcagaaggcctggccacctcagtcctgttatcacccgacttcctctgggatgtaccctctagctggaccctggaggaggcggcttctgtgcctgttgtctacaccaccgcctactactccttagtagtgcgtggtcgtattcagcacggggaaactgtgctcattcactcgggctccggtggtgtgggccaagcggccatttccattgcccttagcctgggctgccgagtcttcaccactgtgggctccgctgagaagcgagcttacctccaggccagattccctcagctggatgacaccagctttgctaactctcgagacacatcgtttgagcagcatgtgttactgcacacaggtggcaaaggggtggacctggtcctcaactccctggcagaagagaagctgcaggccagtgtgcggtgcttggctcagcatggccgcttcctagagatcggcaaatttgatctttctaacaaccaccctctgggcatggccatcttcttgaagaacgtcactttccatgggatcctgctggatgcactttttgagggggccaacgacagctggcgggaggtggcagagctgctgaaggccggcatccgtgatggggttgtgaagcctctcaagtgtacagtgtttcccaaggcccaggtggaggacgccttccgatacatggctcaaggaaaacatattggcaaagtccttgtccaggtacgggaggaggagcccgaggctatgctgccaggggctcagcccaccctgatttccgccatctccaagaccttctgcccagagcataagagttacatcatcactggtggcctaggtggctttggcctggaactggcccggtggcttgtgcttcgtggggcccaaaggcttgtactaacttcccgatctggaatccgcacaggctaccaagccaagcacgttcgggagtggaggcgccagggcatccatgtgctagtgtcgacaagcaatgtcagttcactggagggggcccgtgctctcatcgctgaagccacaaagcttgggcccgttggaggtgtcttcaacctggccatggttttaagggatgccatgctggagaaccagactccagaactcttccaggatgtcaacaagcccaagtacaatggcaccctgaaccttgacagggcgacccgggaagcctgtcctgagctggactactttgtggccttctcctctgtaagctgcgggcgtggtaatgctggccaatccaactatggcttcgccaactctaccatggagcgtatttgcgaacagcgccggcacgatggcctcccaggtcttgccgtgcaatggggtgccattggtgacgtgggcattatcttggaagcgatgggtaccaatgacacagtcgttggcggcacactgccacagcgcatctcctcctgcatggaggtgctggacctcttcctgaatcagccccacgcagtcctgagcagttttgtgctggttgagaagaaagctgtggcccatggtgatggtgaagcccagagggatctggtgaaagcagtggcacacatcctaggcatccgcgacctcgcagggattaacctggacagctcgctggcagacctcggcctggactcgctcatgggtgtggaagtgcgccagatcctggaacgtgaacatgatctggtgctacccattcgtgaagtacggcaactcacactgcggaagcttcaggaaatgtcctccaaggctggctcagacactgagttggcagcccccaagtccaagaatgatacatccctgaagcaggcccagctgaatctgagtatcctgctggtgaaccctgagggccctaccttaacacgactcaactcagtgcagagctctgagcggcctctgttcctggtgcaccccattgaaggttccatcactgtgttccacagcctggctgccaagctcagtgtgcccacctacggtctgcagtgcacccaagcggcccccctggacagcattccaaacctggctgcctactacattgattgcatcaagcaggtgcagcctgaggggccccaccgagtggctgggtattcttttggagcttgtgtagccttcgagatgtgctcccagctgcaggcccagcagggcccagcccccgcccacaacaacctcttcttgtttgatggctcacacacctacgtattggcgtacacccagagctaccgggcaaagctgaccccaggctgtgaggctgaggctgaagctgaagccatatgcttcttcattaagcagtttgttgatgcagagcatagcaaggtgctagaggccctgctaccactgaagagcctggaggaccgggttgctgctgctgtggacctcatcactagaagccaccagagcctggaccgccgtgacctgagctttgctgccgtgtccttctactacaagcttcgagccgccgaccagtataaacccaaggccaagtaccacggcaatgtgatcctgctgcgggccaagacaggtggcacctacggcgaggacttgggtgccgattacaacctgtcccaggtgtgtgatgggaaggtgtctgtgcacatcattgagggtgaccatcgtacgctgctggagggcaggggcctggagtctatcatcaacatcatccacagctccctggctgagcctcgagtgagtgtacgggagggctagacctgcctaccatgaagccacgacccacaccggccaccagagatgctccgatccccatcacaccctgagtgcagggactggggagggtcctgctggtgggaccccctcaccccagtggcccagcaccaccccctcccctggtggctgctacaaacaggaccatcacatgtgtcccagccacttagtggggttcccagagccactgacttggaggcaccctggtctgtgaagagtcagtggaggccagcaagagccaaactgagccttttctgccaagtgacatttgtcacactggttgtttctccattaaattctcatatttattgcattgctgggaaagaccgcccaccccagggttaactcattccagaacccctaaagtgggaaaagccatgtggggaaggctgctggctggagcccctttttgtcttagccctgtacccgctcactgcagggcagggtatggagagggctggttcccggggaacgaggaccccagcagacactgtagcccatggcccttggtccccagcactcccggctgcacccatgatgcagggcctaccagactctgcggaccgcaccgggcactcactgtatttgttttccaagattcaaattgctgcttgggttttgaatttactgcagctgtcagtgtaaagaaacatgtctgaactgtgtcctttttacaccaacctggtaaaaatgctcttgatgctgtcccgttgccacaattaaactgcacgtgagctctggcttccgttcagtctctttccagtcccagacctgagtccccagagcctccacagctcttacagtgagaatcaaattggcccactccttggaaggcgtggcattctgtcagagtaaaaggaaagtagagtgtgctgattcacgttcagcgtgtggggctggctagagaccttggcactgtagtgaacagaatgtgtccacctttaagtcaccctgaaggcatcaccatagctacagcctcacccaggggtagagaatagtactgtctacttgttgactacctggcagttggtgccagcccctatagaggaaaacagcagtgtgtggccactgtgagaagcatatccctggaaacaggtgaccagagcagagggctaatgcctacctgagtcacacaaaactgaccaggcttgagtgtccagaagagtctatcagaaggccacagcattcagtcctatccacagagagcagcagactaagttgtctccttgccagcttagaaaactgcagtgctggggtacaggtagggtgttcaggaggtccgggccccagtgattagtctaagactgaagcatctggttggctgtggtcccacctagaaaattcttaaagctcttgtcatgtacttcctgggaaggacctaccctgtctcaataatgtctctagctcgttggagtctactgactcaaacatttataaagtgtcctagaaaggcctgactcccctacaaggctgtgtgatccttcaaactcacatatgtgagccaataaaaccttgagactct

SEQ ID NO: 3414 - DNA, 2018 bp, Rattus norvegicus
  Genbank Accession No. NM_017333
ccccgagcgaactgctgaggatccgctgtctggcattctctcagccttttgtccgagccagagctgcattcagaggagagaggcccgctaaggagcagctggactcctgctgcgagccgaaagccccctaaggcagttgaggacctgggaaggaggctccctgctggtggcgcttctcctggtgcttccaatccgtgcgagactgaaaacggcggagcggctacgggactctcacaggagcaagctgcaacatgcaatcgtccgcaagccggtgcggacgcgccttggtggcgctgctgctggcctgtggcttgttgggggtatggggagagaaaagaggattcccacctgcccaggccacaccatctcttctcgggactaaagaagttatgacgccacccactaagacctcctggactagaggttccaactccagtctgatgcgttcctccgcacctgcggaggtgaccaaaggagggagggtggctggagtcccgccaagatccttccctcctccgtgccaacgaaaaattgagatcaacaagacttttaaatacatcaacacgattgtatcatgcctcgtgttcgtgctaggcatcatcgggaactccacactgctaagaatcatctacaagaacaagtgcatgagaaatggtcccaatatcttgatcgccagcctggctctgggagatctgctacacatcatcatcgacattcccattaatgcctacaagctgctggcaggggactggccatttggagctgagatgtgcaagctggtgcccttcatacagaaggcttctgtggggatcacagtgttgagtctatgtgctctaagtattgacagatatcgagctgttgcttcttggagtcgaattaaaggaattggggttccaaaatggacagcagtagaaattgttttaatttgggtggtctctgtggttctggctgtccctgaagccataggttttgatgtgattacgtcggactacaaaggaaagcccctaagggtctgcatgcttaatccctttcagaaaacagccttcatgcagttttacaagacagccaaagactggtggctgttcagtttctacttctgcttgccgctagccatcactgcgatcttttacaccctaatgacctgtgagatgctcagaaagaaaagtggtatgcagattgccttgaatgaccacttaaagcagagacgagaagtggccaagacagtattctgcctggtcctcgtgtttgccctctgttggcttccccttcacctcagcaggattctgaagctcaccctttatgaccagagcaatcctcagaggtgtgaacttctgagttttttgctggttttggactacattggtatcaacatggcttctttgaattcctgcattaatccaatcgctctgtatttggtgagcaagagattcaaaaactgctttaagtcgtgtttgtgctgctggtgccaaacgtttgaggaaaaacagtccttagaggagaagcaatcctgcttgaagttcaaagctaacgatcacggatacgacaacttccgctccagcaataaatacagctcatcttgaaggaaggaacactcactgaatctcattgtcctcatcgtggacagatagcattaaaacaaaatgaaacctttgccaaacccaaacggaaaaccgtgcttgcggaaaggtgtgcacgcatgggagagggattgttttttaaccgttctaactttccacacctgatatttcacgggctgtttacaacctaagaaagccatgggaatgaatgaagcctcgggaaagcacttagattcttagtcagcacttcagcacggctcttaaaagccctcactgcactcacagcccacttacatttaaaaacaagaactcaaactctattcaggggtttattatccagtcctatgaatctggatacaggaatgcatgacattgcaaaacaattcttaaagcaaagtttcaattgctcgatttgagacaaaaaacaaaacaaaaaaaaaa

SEQ ID NO: 3415 - DNA, 1060 bp, Rattus norvegicus
  Genbank Accession No. NM_017339
cagatatgggagacatgggcgatccaccaaaaaaaaaacgtctgatttccctatgtgttggttgcggtaatcaaattcacgatcagtatattctgagggtttctccggatttggaatggcatgcggcatgtttgaaatgtgcggagtgtaatcagtatttggacgaaagctgtacctgctttgttagggacgggaaaacctactgtaaaagagattatatcaggttgtacgggatcaaatgcgccaagtgcagcataggcttcagcaagaacgacttcgtgatgcgcgcccgctctaaggtgtaccacatcgaatgtttccgctgtgtagcatgcagccgacagctcatcccgggagacgaattcgcgctgcgggaggatgggcttttctgccgcgcggaccacgatgtagtggagagggccagcctaggagctggagaccctctcagtcccttgcatccagcgcggcctctgcaaatggcagccgagcccatctccgctaggcagccagctctgcggccgcacgtccacaaacagcccgagaagaccacccgagtgcggactgtgctcaacgaaaagcagctgcacaccttgcggacctgctacgcagccaaccctcggccagatgcgctcatgaaggagcaactagtggagatgaccggcctcagtccccgagtcatccgggtctggtttcaaaacaagaggtgcaaggacaagaaacgcagcatcatgatgaagcagctccagcagcagcaacccaacgacaaaactaatatccaggggatgacaggaactcccatggtggctgctagtccggagagacatgatggtggtttacaggctaacccagttgaggtgcaaagttaccagccgccctggaaagtactgagtgacttcgccttgcaaagtgacatagatcagcctgcttttcagcaactggtcaatttttcagaaggaggaccaggctctaattccactggcagtgaagtagcatcgatgtcctctcagctcccagatacacccaacagcatggtagccagtcctatagaggcatgaggaac

SEQ ID NO: 3416 - DNA, 3741 bp, Rattus norvegicus
  Genbank Accession No. NM_017340
acacgggtcgttgctttggtgtctgtcacttctgtcgccacctcctctgccaacaccaacactgacctccgtcatgaaccccgacctgcgcaaggagcgggcctccgccaccttcaatccggagttgatcacgcacatcttggatggcagtccggagaatacccggcgccgtcgagaaattgagaacttgattctgaacgacccagacttccagcatgaggactataacttcctcactcgaagccagcgttatgaggtggctgttaagaagagtgccaccatggtgaagaagatgagggaatatggcatctcggaccctgaagaaatcatgtggtttaaaaaactatatttggccaattttgtggaacctgttggcctcaattactccatgtttattcctaccttgctgaatcagggcaccactgctcagcaggagaaatggatgcgcccgtcccaagaactccagataattggcacctacgcccagacggagatgggccacggaactcatcttcgaggcttggaaaccactgccacatatgaccccaagacccaagagttcattctcaacagccctactgtgacttccattaagtggtggcctgggggacttgggaaaacttccaatcacgcaatagttctggctcagctcatcactcaaggagagtgctacgggttacatgcctttgttgtccctatccgtgaaattgggacccacaagcccttgccaggcatcactgtcggggatatcggtcccaaatttggttatgaagagatggataacggctacctgaagatggacaattaccgtattcccagagagaacatgctgatgaaatacgcccaggtgaagcctgatggcacatatgtaaagcctttgagtaacaagctgacgtatgggaccatggtttttgtgaggtccttcctcgtgggaaatgcagctcagagtctgtccaaggcttgcacaatcgccatacgatacagcgctgtgaggcgccagtctgaaatcaagcaaagcgaaccagaaccacagattttggattttcaaacccagcagtataaactcttcccgctcctggccactgcctatgccttccacttcgtaggaaggtacatgaaggagacctaccttcgaattaatgagagcattggccaaggggacctgagtgaactgcctgagcttcacgccctcactgctgggctgaaggcttttactacttggacagccaatgctggcatcgaagaatgtcgaatggcctgcggcgggcacggctattctcacagcagtgggattccaaatatttacgtcacttttaccccggcctgcaccttcgagggagagaacactgttatgatgctgcagacagccaggttcttgatgaaaatctatgaccaggtgcggtcggggaagttggtgggtggtatggtgtcatacctgaatgacctgccgagtcagcggatccagccacagcaggtggcagtctggccaactatggtggacatcaacagcctggagggcctgacagaagcctacaagcttcgtgcagccagattggtagaaatcgctgcaaaaaaccttcagactcacgtgagtcacaggaagagcaaggaagtagcatggaacctaacctctgtcgaccttgttcgggcaagtgaggcgcattgccactacgtggtcgttaaggtcttctcagacaaactccccaagattcaagacaaagccgtccaagctgtgctgaggaacctgtgtctcttgtattctctctatgggatcagccagaaaggaggggactttcttgaggggagcatcatcacaggggctcagctgtcacaagtaaacgctcggatcctggagctgctcaccctgatccgccccaatgctgttgctctggtggatgcctttgactttaaggacatgacacttggctctgttcttggccgctatgatggaaatgtgtatgaaaacttgtttgagtgggccaagaaatccccactgaacaaaacagaggtccatgaatcttaccacaagcacttgaagcccctgcagtccaagctttgaagtttccctgggacacgtctgagctccacaagcagcagaaactctctcctctactcactaatccttgtgaaatcgtcatcaaatttgtgtagctacagagcaaatgatgggtttcttttcctccctataagtaaagagaaatgaacagactttagagattaaatgagaaattcggtgttgtaagtgcagtaatgcagacagagacgtaggaactcagaaagcttcagagctgtggtctgacttgcatttgtactgctgctaatctcagtaggccttgactctggagaattaacagagttttaactacaaatacttacttattttcacatttttactgctaatcactggatatatgttttttaaacaaaagtgttatatagagtggaattttccaggcattcgtgcctaccactttctgatctactgctaagagcaggagtttgggggccagaaactaatagaaaccttgatgtgggtgtgtggctgtcacacaggccgctgctgcctgccatgtgggtgtgtcacccctattaactgtcacattaacatagtcaacaagaggactccttcaacacccacccaccaagaaaccagagttcccgatgggcacaagcacccactccaggctcagccttcgtggtagtggcactactgtgcctttgaccccactttttgacacagttaagttacttgtcttacctccaggctttcagccattgcctggatttcagtcatggtggctgaccttccctttcttgcttgccttccttctcctgaaagagataaaagagatagtagtcagcctctcctcatagattaagtatatggagagccctcagctatggtattactgtattttggtgactttgttaagtaaatttcctgggacaatcctgatttgaaagattctgtattctgttgcacaagctattaaaatgctcagtggtcaccaaagtatttcacacacacacactcacaaatcactcaggtcaccttttacactagaaataacaggaaagccctggccacagccatctgctgagagtgttagttgagatgtttcgttgaagatggctgaagaaagtgcaggccctggggagtttctccttgctgagagccggctctgtggtgagcccctagcagccttacgaggcggtgaaacggccccttcagatgggagcagcctctacaatcattctgagcttaaaggtgaaatatgcaccttttgtcctataaatgtcctataaatgcttggggggaggggtaatgttttgttttttttttcttgaaacagagcccagaatggccttgaactctgatcctcacagcctggtaaatgctgggcctacaggtgtgcgccgacatgtctggctgatcggagctctttattcttaaaagcacagtagggagatgattgtaacattaagtctgtgtctgtggcattcgcattgtgagagcagttccttagaacagttctgagagcacagcatcaatgtagtgaaaacgatgtcgacgcctgacatgaaatcacaaccctccgggtcatcgacacaagccttaacctttctcctggaatgactggtaatcccttaagattgacagtacacagcatgtcaccttgttggggtttctattgacagtaattcatattctggaaaggaactaataaatataaatgaccg

SEQ ID NO: 3417 - DNA, 1139 bp, Rattus norvegicus
  Genbank Accession No. NM_017343
agatttgaaccgccaccatgtcgagcaaaaaagcaaagaccaagaccaccaaaaagcgccctcagcgcgcaacgtccaacgtgttcgccatgtttgaccagtcccagatccaggagttcaaagaggccttcaacatgatcgaccagaaccgggacggcttcattgacaaggaggacctacacgacatgctcgcgtctctggggaagaaccccaccgacgcctacctggacgccatgatgaacgaggccccgggccgcatcaatttcaccatgttcctcaccatgtttggagagaagctgaacggcaccgacccagaggacgtcatcagaaacgccttcgcttgcttcgatgaggaagccacaggcaccatccaggaggattacctgagggagctgctgaccaccatgggtgaccgcttcacagatgaggaagtggatgagctgtacagggaggcccccatcgacaaaaagggcaatttcaactacatcgagttcacgcgcatcctcaagcacggagcgaaagacaaagatgactgaagaggctgcagctgacattcctgttgagtttccttattcacttcatgtctcagacacagcccccataggacctactgtgtgccactttgtgtccctcagacaccccctcccataggcctactgtgtgccgcttagtccctcagacaccccctcccataggcctactgtgtgccacttagtccctcagacaccccctcccataggcctactgtgtgccatttgtccctcagacaccccctcccataggacctactgtgtaccacttggtttctcagacagccccacccccaaacccccctaaggacctactgcgggccacttagtttcacagcctttcctttttttaatgtatttattccagaccctttctgccacttagcatgtgtataatcagactggaatggggacaatgttgtaattgtactgaaaatgagatgcaaataaaaaaatcaaccaatgtgaaagcccaggaaaatatatcggcatttctggttttgctggatttttttacatttttatataataaaaatgttattttgaaataaagattatgctgactcaaggtggagtataaaacaaaaaaaaaaaaaaaaaaaaaaaaaa

SEQ ID NO: 3418 - DNA, 5093 bp, Rattus norvegicus
  Genbank Accession No. NM_017345
cccacccccgtcagcaggtaccgctggaaccaaccaccagtgagagggtgagtggaatctggccagttgtgctgcactgatctgctgagctgacaggaagatggtcatgatgctgtggtacgtgttgcctcttctcctctgcagcccctgcctgctcatacagattcctgatgaatataaaggacaccatgtactggagccacctgtcatcacagaacagtctccacggcgcctggttgtcttcccaacagatgacataagcctcaaatgtgaagccagaggcagaccccaagtggagttccgctggacgaaagatggcatccacttcaaacctaaggaagaattgggtgtagtggtacacgaggcaccctattctggctccttcaccatcgaaggcaacaacagctttgcccagaggtttcagggcatctatcgctgctatgccagcaataatctaggaactgccatgtcgcatgagatccagctcgtggctgagggtgcccccaaatggccgaaggagactgtaaaacccgtggaagtggaggaaggagaatcagtagttctaccttgcaatcctccacccagtgcagccccacttaggatctactggatgaacagcaagattttgcacatcaaacaagatgagcgggtgtccatgggccagaacggagacctatattttgccaatgtgcttacctcagacaatcattcagactacatctgcaatgcccacttccctggcacccggaccatcattcaaaaggaacctattgacctccgggtcaagcccaccaacagcatgattgaccggaagccacgcctgctcttccccacaaactccagcagtcacctcgtggccttgcagggccagtcattaatcctggagtgcattgctgagggattccctacacccaccatcaagtggctgcaccccagtgaccctatgccaacagaccgtgttatctaccagaaccataacaagacactgcagctcctcaatgtgggcgaggaagatgatggcgagtatacctgccttgctgagaactcactgggcagtgctcggcatgcctactatgtcactgtggaagctgccccatactggctgcagaagccccagagtcatttgtatgggccaggagagactgcccgcctagactgccaagtccagggcaggccccaaccagaggtcacctggagaatcaacggaatgtctatagagaaggtgaacaaggaccagaagtaccggattgagcaggggtctttgatcctgagtaatgtgcaaccaagtgacacaatggtgacccagtgtgaagctcgcaaccagcatgggctcctactagccaatgcctatatctatgttgtccagctgccagccaggatcctaacaaaagacaatcagacatacatggcagtagagggcagtactgcttacttgctgtgcaaagcctttggagctcctgttcccagtgtccagtggctggatgaggaaggaaccacagtgcttcaggatgaaagatttttcccctatgccaatggacacctgggcatcagagatctccaggccaatgacactggacgctatttctgccaggctgccaatgaccagaacaatgtgaccattttggctaacctacaggttaaagaagcaacccagatcacacaaggaccccggagcacaattgagaagaaaggtgcaagggtgacattcacgtgccaggcctcctttgacccctctttacaagccagcatcacttggcgtggagatgggagagacctccaggaacgtggagacagtgacaagtatttcatagaagatgggcaacttgtcatcaagagcctggactacagtgaccagggagactacagttgtgtggccagcactgaactggatgaggtggagagcagggcacaactcttagtggtgggaagccctgggccagtgcctcacctggagctgtccgaccgccacttgctgaagcagagccaggtgcacttgtcttggagccctgctgaagaccacaactctcccattgagaaatatgacattgaatttgaggacaaggaaatggctcctgagaaatggttcagtctaggcaaggtgccaggaaatcagacctctactaccctcaagctgtccccctatgtccactacacctttcgggtcactgccattaacaaatatggtcctggagaacccagccctgtctctgagactgtagtcacacctgaggcagccccagagaagaaccctgtggatgtgagaggggaaggaaatgagaccaacaatatggtcatcacatggaagccccttcggtggatggattggaatgccccccagattcagtaccgtgtacagtggcgaccactgggcaaacaagagacctggaaggaacagaccgtgagcgaccccttcctggtggtgtctaacacttccacatttgtgccttatgagatcaaagtccaggcagtgaacaaccaggggaagggccctgagccccaggtcaccattggctattcaggggaagactacccccaggtgagccctgagcttgaagacatcacaatcttcaactcaagcactgtgctggtcaggtggaggcctgtggacttggcccaggttaagggccacctcaggggatacaatgtaacgtactggtggaagggcagtcagagaaagcacagcaagaggcatgtccacaaaagtcacatggtggtacctgcgaacaccaccagtgccatcctcagtggtttgcgtccttacagctcttatcatgtagaggtacaggcctttaatgggcggggcttagggcctgcaagtgaatggaccttcagcaccccagagggagtgcctggccaccctgaggcattacatctggagtgccagtcggacactagcctgctactgcactggcagccaccactcagccacaatggagtgctcactggctacctgctctcttaccatcccttggatggggaaagcaaagagcagttgttcttcaacctttcggacccagagctccggactcataatctcaccaacctcaaccctgatctacagtaccgcttccagcttcaggccaccacccatcagggtcctggtgaggccattgtgcgtgaaggaggcactatggccctatttggcaagccagattttggcaacatttcagtcacagcaggtgaaaactacagtgtggtctcctgggtccctcgggagggccagtgcaatttcaggttccacatcctgttcaaagccttgccagaagggaaagtgagccctgatcaccagcctcagcctcaatatgtgagctacaatcagagctcctacacacagtgggacctacagcctgacaccaaatatgagatccacctgatgagggagaaggtcctcttgcaccatctggctgtgaagactaatggcactggccccgtgcgagtttctactacaggtagctttgcctccgagggctggttcatcgcctttgtcagtgctatcattctcttgctcctcatcctgctcatcctctgcttcatcaaacgcagcaagggcggcaaatattcagtgaaggacaaggaggacactcaggtagattccgaggcccggcccatgaaagacgagaccttcggcgagtacagtgacaatgaagagaaggccttcggcagcagccagccatctctcaatggagacatcaaacccctaggcagtgatgacagtctggctgattatgggggcagtgtggatgtccagttcaatgaggatggctctttcatcggccaatacagtggcaaaaaagagaaggaggcagcgggaggcaatgacagctcaggggctacctctcctatcaatcctgcagtagccctagaatagcaaggtccagtcatgtgaggcaggaccaagctgggcccagggccagaggtgcagaagagccaggggccaagacacctggccaatgcaccatgccattggcctgctgactttgggatcgagggtccttccttctttccacagaggcatggaagacttgactggaggcagagaggaactgtgacttcgagtctctttcttaccacctgctaccctctttattgccaaaacccagctgcaccctttcctggcgatacgctgctttgcccgctcagggcagttcactcccatatcagggatcttcaggtgctgccttgccgacccatttagacagagaggccatagtttgtgggagaagacaaaggagagtcctctgagccatctctgagaagctgtcctcactttctgactggaaacaggcatggtggggtctgttcaggactagcttggcacctcttctttctccctggctagcctgactggagacagaactctgtccccaccatctgctccctttgccatttttgatccaatcaggatggggacctgagcaagctggccgcctgtgtagaagaggccatctggaaagcccagagtcgtcccccacccccttagcacactagtttacaccctcctcccattgctattccactttcaggacacacacacacacacacacacacacacacacacttactcatattgccttcgatacccaccagagaacatcgaagtggcttctctcactgctggagataggcagacctcttcctactggaattggctagacttttccctgctgccaccataccccaggaccccttagcagccctgcctgcccccagttcttgtcctcagccccttcccctgttcctcacgttgggaatgtaaatacaccgtgactttgaaagtttgtgctgttgccctttccccatatgccactagcttgtaggcagatgtctgagtctctaggtggtttccccattttatagcagttagctttgatgatctcactccaagaaaaataaaagcagacacacacacaaaaaagcaaagattgcgtgtcccagcactgctgtggttcgctcagcagctgtgctcttcctgtatgcctttgcttggtctgttgatgagccctctacaaaaaacaaatatatatatatgtacataatatcagaatataacaggcaaataaaaacctggaaatgaaaaaaaaaaaaaaaaaaaa

SEQ ID NO: 3419 - DNA, 2783 bp, Rattus norvegicus
  Genbank Accession No. NM_017351
ctcagcaatggtgactctgtggtggccctgccttgtcttggctctgctctctggcttggagacctctggctttccaaggagtcccctccggctgcttgggaaacggagccttccagaaggggtggtggatggcattgagatctacagcaccaagatcagctgcaaggtgacctcccgctttgctcacaatgttgtcaccacaagggctgtcaaccgtgcagacaaggccaaggaagtttcctttgatgtggaactgcccaagacagccttcatcaccaacttcaccttgactattgatggtgtcacctaccctgggagtgtcaaggagaaggaagttgcgcagaaacaatatgaaaaggctgtgtcccagggcaagacagccggtttggtcaaggcctccgggaggaagctggagaagttcacagtgtctgtcaatgtggccgcaggcagcaaggtcatctttgagctgacctatgaagagctgctcaagagaaacaagggaaagtacgagatgtaccttaaggtccagcccaagcagctcgtcagacactttgagatcgacgcacacatttttgagccacagggcatcagcatgttggacgccgatgcctcatttatcactaatgacctcctgggaagtgccctcaccaagtccttctcagggaaaaaggggcatgtgtctttcaagcccagcttagaccagcagcgctcatgcccaacctgtacggactcccttctcaacggggacttcaccatcgtctatgatgtgaacagagagtctccaggaaatgtgcagatagtcaatggctacttcgtgcacttctttgcaccccaaggcctcccagtggtgcctaagaacatagcctttgtgattgacgtcagtggctccatgtctggtcggaaaatccagcagaccagggaagcccttctcaaaatcctggatgatatgaaggaagaggactatctgaatttcatcctcttcagcactggtgtgaccacctggaaagatcacctagtcaaggccacacctgcaaacctcgaggaggccagggcgtttgtgaagaacatccgtgatcgaagcatgaccaacatcaatgacgggctgctgaggggtattgaaatgctgaacaaggcccgagaagaccaccttgtcccggagaggagcacctccatcctcgtcatgttgacagatggggatgctaatactggcgagagcagacctgaaaagatccaggaaaacgtccggaacgccatcaggggcaagttccctttgtataacctgggttttggcaacaatctgaattataatttcctggagtctctggccctggagaaccacgggtttgcccggcgtatttatgaagattctgatgccagcttacagctgcagggcttctacgaggaagtagctaatcccttgttgactaatgtggagttagaataccctgagaatgccatcctggacctcaccagaaacagttacccccacttctatgatggctctgagattgttgtagcagggcgtctggtggacaggaacgtggacaacttcaaagcagatgtgaagggtcatggggccctgaatgacctgaccttcacagaggaggtagacatgaaggaaatggacgcggccctgaaggagcaaggctacatctttggggactacattgagcggctctgggcctacctcactattgagcagttactggagaaacgcaagaatgcccgtggggatgagaaggagaacatcacagcagaggccctggagctgtccctcaagtaccactttgtaactccactgacctccatggtggtgaccaagcctgaggacaacgaggaccaaacagccattgctgacaagcctggggaagaagccatctctgcgtccacggcctacctgaccagtcagcagtccagccatagcccctactattatgtggatggggacccccacttcatcatccaagtcccgggaaaaaatgacaccatctgcttcaacatcgatgagaagcctggcacggtgctgagccttattcaagacccagtcacaggcatcgcagtgaccgggcagatcattggagagaagggaaataatgcttcttccaggacagggaaaacttactttggcaaactgggcattgccaatgcttggatggactttcggattgaggtgaccacggagaagatcatcctggggaacggggatgcactgagcacgttcagttggctagacaccgtcacggtcacacagacagggctgtctgtgacaatcaacaggaaaaagaatatggtggtgtccttcgaagatgggattagctttgtgatcgtcctacaccaggtttggaagaaacatccggttcaccaggacttcctagggttctacgtggtggacagtcaccggatgtcagcacagacacatgggctgctgggccagttcttccaaccctttgactttaaagtgtttgacgtccgcccaggctctgaccccatgaagccagacgccacaatggtggtgaagagtcatcggttgacagtcacaaggggctcccaaaaagattacaggaaggatgccagtgtcggcaccaaggtcgtctgctggtttgtccataacaatggggaagggttcatcgacggtgtccacaccgactatattgtccccagcttgttctgagtacacatgccagctgctgctgcagtagaaggcctggaacaggacacagaatggggctcgtgggaaggactgggacaataaagtgggtaaaccaaaaaaaaaaaaaaaaaaa

SEQ ID NO: 3420 - DNA, 1130 bp, Rattus norvegicus
  Genbank Accession No. NM_017355
gtggagcggctgccagccggggaacaggcgcggccgcggcgccatattgcggccctcagcggtcgccaccgagccatggctgagacctacgacttcctcttcaaattcctggtgattggcagtgccggaactggcaaatcatgtctcctccatcagtttattgagaataagttcaaacaggactccaaccacactattggcgtggagtttggatccagggttgtcaacgttggggggaagactgtgaagctacagatttgggatactgctggccaggagcggtttcggtcggtgacacggagttattaccgaggggcagctggagccctgctggtgtatgacatcaccagccgggagacatacaactcgctagctgcttggctgaccgatgcccggacgctggccagccccaacatcgtggtcatcctctgtggcaacaagaaggacctggatcctgagcgtgaggtcactttcctagaggcttcccgctttgctcaggagaatgagctgatgttcctggagaccagcgctctcacgggtgaaaacgtggaagaagctttcctgaagtgcgcacgcaccatcctcaacaagatcgactcaggtgaactagatccggagaggatgggctcaggcattcagtatggtgacatatctcttcgccagctgcggcagcctcgcagtgcccaggccgtggcccctcagccctgtggctgctgagacgtgcagagccagctcacctgttcttctggaccagccctgctcgaaggctggggctcagaaccaggccccaagaggccaggccccaatctgccccagtcccagaaaagttactccatcacccatccccctcccctggcctgctggggcctggctttggggcaagattgagccacaggggaaaggggaccccatacctgctgctgcttcctctgtcttggctaactctagtccccctccccgagcccctaaccatacctgaagaactcccaaagcttgagaccagggccaattggccccaacgtcctgcctggccccgctgttgcaagtctgtgttatttattacctggaggcctgttccatcctgtcccagtcctccataaagcattgtttacacctgtgaaaaaaaaaaa

SEQ ID NO: 3421 - DNA, 1015 bp, Rattus norvegicus
  Genbank Accession No. NM_017356
cgctacacctcgctctctcctgggccggcggatccttttgtctctccaagcggtgaaggtcgcagagtcggcgcggcggttgcgggcgcactgacgcccgttctattggttatctccccagcctcagccaccgccgaacttgagctcgagaagccagcggatcgcgtccagttccggagccggggcatggtctagcagctcagtcaagcctgtgcatcatctgatccccagcagttctggtcccccttggcctctacttggctctaggtttagtctccactgccagctgccatgggcaagcagaacagcaaactgcggcctgaggtgctgcaggacctgcgggaacacacagagttcactgaccatgagctgcaggagtggtataagggcttcctcaaggactgtcccaccggccacttgacagtggacgaattcaagaagatctacgccaacttcttcccctatggcgacgcctctaagtttgccgaacacgtcttccgcacctttgacaccaacagcgatggcaccatcgacttccgggagttcatcatcgcactgagcgtgacctctcggggcaagctggagcagaagctcaagtgggccttcagcatgtacgacctggacggcaacggctacatcagccgcagtgaaatgctggagattgtgcaggccatctacaagatggtgtcctccgtgatgaagatgcccgaggatgagtccacacccgagaagcgaacagacaagatcttcaggcagatggacacaaacaatgatggcaaactgtccctggaagaattcatcaaaggtgccaagagcgacccgtccattgtccggttgctgcagtgtgaccccagcagtgctagccagttctgaggggaacgggcttttggacagttgtgagaaacacaggcttgacctgccatcttcagctttgcttgcaaaagtggattcctccgtgatctctcctgctctcccaggacctgggccaggcagcacatcacacccacccgacctg

SEQ ID NO: 3422 - DNA, 991 bp, Rattus norvegicus
  Genbank Accession No. NM_017359
ggcaccggcgccgccaccgtcggggcttcctcgacgaggccgttcggaagatctcccgctccgtctcgagagctgctttctctcccgcacacgcttccccgctgctgaggccccagaacgcccgggtgaggagttggccgtagtgagcagcaccgatcccttggggctaccggcggcgagcgcccgagccgctcctcccaatggcgaagaagacgtacgacctgcttttcaagctgctcctgatcggggactcgggagtgggcaagacctgcgtcctttttcgtttttcggatgatgccttcaataccacctttatttccaccatagaaatagactttaagatcaaaacagtggaactacaaggaaagaagatcaagctacagatatgggacacagcaggccaggaacgatttcacaccatcacaacctcctactacagaggagcaatgggcatcatgctagtgtatgacatcaccaacggtaaaagttttgaaaacatcagcaagtggcttagaaacatagatcagcatgccaatgaagatgtggaaaggatgttactacggaacaagtgtgacatggaccacaagagagttgtaccgaaaggcaaaggagagcagattgcaagggagcatcgtattaggttttttgagactagtgcaaaagcaaatataaacatcgaaaaggcgttcctcacattacctgaagacatcctccgaaagacccctgtaaaagaacccaacagtgaaaacgtagatatcagcagtggaggaggtgtgacgggctggaagagcaaatgctgctgagcgctctcccgtccatctgttcccatccaccatccgtttctcttcttgctgcaaaataaaacactctgtccatttttaactctaaacagatatttttgttcctcatcttaactattcagtccacctattttatttgtctttcatctgtgactgcttgcgactattataattttcttcaacaaaaaaaa

SEQ ID NO: 3423 - DNA, 2277 bp, Rattus norvegicus
  Genbank Accession No. NM_017361
aagagcggagagcactgggcgtcgcgccaccggagccggggaccacttaagtgctgctcccgcgacatggcattcaattttggggctccttcgggcacttcgggcacctctacagccaccgcggcaccggcgggcgggtttggcggatttggaacaacaactacaactgcaggctctgcattcagcttttctgccccaacaaacacaggcagtacaggccttctcggcggcactcagaacaaaggttttggctttggcactggttttggcacatcgacgggtactggcactggtttaggcactggcttgggaaccggacttggattcggaggatttaacacccagcagcagcagcagcagcagcagacttctttaggcggtctcttcagtcagcctgcacaggcccctgcgcagtccaaccaactcatcaacactgccagcgctctttctgctccaacgctattgggggatgagagagatgccatcttggcaaagtggaaccagttgcaggccttctggggaacaggaaaaggatatttcaataataacattcctccagtggagtttacacaggaaaaccccttttgccgatttaaggctgtcggttacagttgtatgcccaataacaaagatgaagatggactagtggttctaattttcaacaaaaaagaaacagatattagaagccaacaacagcagttggtagaatcattgcataaagttctgggaggaaaccagaccctcactgtcaatgtggagggcattaagacactgcccgacgatcagacagaagttgtcatttacattgttgagcgctctccaaatggcacctcgagaagagttccagcgacaacgctgtatgcccactttgagcaagccaacattaaaacacagcttcagcagcttggcgtgaccctttctatgaccagaacagagctgtctcctgctcagatcaagcagctcctacagaaccctcctgctggtgttgatcccattatttgggaacaggccaaggtggataacccggattctgaaaaattaattcctgttccaatggtgggtttcaaagaattgcttcgaagactgaaggttcaagaccagatgactaagcagcaccagaccagattagatatcatatctgaagatattagtgaactgcaaaagaatcaaactacaactatggccaaaatagcacaatacaagaggaaactgatggatctctcacacagaaccttacaggtcctaatcaagcaggaaatccagaggaagagtggctatgccatccaggctgaggaagaacagttgcgggttcagctagatacgattcaaggagagctgaatgcacccactcagttcaaaggtcgactgaatgaactgatgtcccagatcaggatgcagaatcattttggagctgtgaaatctgaagaaaagtattacatagatgcagacctattacgagagatcaagcagcatttgaaacagcaacaggaaggccttagccacctgattagcatcataaaagacgacctggaagatatcaagctggtagagcatggactgaatgagaccatccacagcagaggcggggtctttagctgaccattgcgctgtccagaggttcataaagctgtctgcttgctacgtcaggccttctttacgatgaccacatggacaggaaaagggttcttttcctcactgggatgtttgaggctcctcagaaattactgtacattaaatctgaaatggtcaccacaaagctcttcaaagagagtctttgaaaagtttttgtctaaaagctgtatttactttttgaaaagtattacccagagcataaacactgttgttcattttataacagcgttaagtgtggtcgtggggcttggtggtcattctccactcttcccatagcacaggatgaggccgagctgcttcctacgtaacacgacaagctaatcccctgccagttggagactgttcagagtctgttcagagtataaatgcgtctcagcttctatatctgtgaaatcagctgtgggagtaaagaaaatcccaaagtatttaatgatttgtgtggttttccttttgttctataaagacttgaaaatatatttttatattattttacttatttagaacttacagaaaatacctaaccagttaggatataacaaaatcaccacttttgcaagcttttttttttttaatttttatttctaaaaatgaaatccttaaaataaattgttaaattgtaattttaaaaaaaaaaaaaaaaaaaaa

SEQ ID NO: 3424 - DNA, 3465 bp, Rattus norvegicus
  Genbank Accession No. NM_019124
acgctgcttccccgcccatccccgttctccaggccgcccactggccatggcgcagccgggcccggctccccagcctgacgtttctcttcagcaacgggtagcagaattggaaaaaattaatgcagaatttttacgtgcacagcagcagcttgagcaagaatttaatcaaaagagagcaaaatttaaggagctgtatttggctaaagaggaggatctgaagcggcaaaatgcagtattgcaagctgcgcaggatgacttgggtcaccttcggacacagctgtgggaggcgcaggcagaaatggagaatatcaaggcgatcgccacagtctctgagaacactaagcaagaagctatagatgaagttaaaaggcagtggagagaagaagttgcttcacttcaggctgtaatgaaagagactgtgcgtgactatgagcatcagtttcacctgaggctggagcaggaacgagcgcagtgggcacagtatcgagagtctgcagaccgggagatagctgacctaagaagaaggttgtctgaaggtcaagaggaagaaaatttagaaaatgaaatgaaaaaggcccaagaggatgccgagaagcttcgctctgtcgtgatgcccatggagaaggaaattgcagccctgaaagataaactgacagaagctgaagacaagattaaagagctggaggcctcaaaggttaaggaactgaatcattatctggaggccgagaagtcttgcaggactgatctggagatgtatgtagctgttttgaacacccagaaatctgttctacaggaagatgctgagaaattgaggaaagaactgcatgaagtttgccatctcttggagcaagagcgacaacaacacaaccagttaaaacacacgtggcagaaggccaacgaccagtttttggaatctcagcgcttgctgatgagagacatgcagcgaatggagatcgtgttaacttcagaacagctacgacaagttgaagaactgaagaagaaagatcaggaggaggatgaacaacaaaggatcaataagggaaaagataacaagaaaatagacactgaagaagaagtaaaaataccagtagtatgtgctttaactcaagaagaatcttcaaccccactatcaaatgaagaggagcatttagacagcacccatgggtcagtccattccttagatgcagacttgctgttaccatctggagatccattcagtaaatcggacaatgacatgtttaaagagggactccggagagctcagtctacagacagcttgggaacctcaagctcattgcaatccaaagctttaggctataactacaaagcaaaatctgctggaaatttggatgagtcggattttggaccactggttggagcagattctgtgtctgagaactttgatactgtgtcccttgggtcactgcagatgccaagtggatttatgttaaccaaagatcaagaaagagcaattaaggcaatgacacctgaacaggaggagacagcatccctcctctcaagtgtcacacagggtatggagagtgcatatgtctctcctagtggttaccgcttagtgagtgaaacggaatggaatctcctgcagaaagaggtacataatgctggaaataagcttggtagacgttgtgatatgtgttccaattatgaaaaacagttacaaggaattcagattcaggaagctgagacaagagaccaggtgaaaaaactgcagttaatgctcaggcaagctaatgaccagctagagaagacaatgaaagagaaacaggagctagaggacttcctcaggcagagtgccgaggactcaagccaccagatatctgcacttgttttaagagcccaagcctctgaggtattacttgaagagttacaacagagtttttcccaagcaaagagggatgttcaggagcagatggcagtgctgatgcagtcacgtgaacaggtctcagaagagctggtgaggttacagaaagacaatgacagcctccagggaaagcatagcttgcatgtgtcattacaactagcagaagacttcattcttccagatactgtgcaggtgctccgggaactggttttaaaatatcgtgagaacattgttcatgtgcggacagcagcagaccacatggaagagaagctgaaggctgaaatactttttctaaaagagcaaattcaggcggaacagtgtttaaaagaaaaccttgaagagacattacagctggaaattgaaaactgcaaggaggaaatagcttccatttctagtctaaaagctgaattagaaagaataaaagttgaaaagggacagttggaatctacattaagagagaagtcgcaacaacttgagagcctccaagaaataaaagttaatttagaggaacagttaaagaaggaaactgctgctaaggccactgttgaacagctcatgtttgaagagaagaacaaagctcagaggttgcagacagaattagatgtcagtgaacaagtccagagagattttgtaaaactttctcagactcttcaggtgcagttagagaggatccggcaagcagactccctggagaggatccgggcaattctgaatgataccaaactgacagacattaaccagctccctgagacatgacaccctgatggcaggattctgacctgcattttgggtttttaactcatctttagaataacattaattattatttaactcttaatggaagaagtcacagcaaaaggaggactggagaaatgcagttctggagggagaaggctgctgtgtgcagggacagccaacagacgtttcaaagggaacactaatgagacactggactcgattccaacaggcgtgggatcagattgggtgccagaaaagtgctgtttccttgcctgcttcctccagcgtggactctggaacataattcctgccatgaaagcaacttcccaatagtgtttggaattacgttttctgttcatacaaactgggagagaaaagtttctttctcctgtggtctggggctcatcagtagcagtgttcagctagcagagaggtgtagtgcgctgtgtgagtattttatattaaaatgtggagtgagagcaggccattggctattgattgtgtttcccttgttcaatgcattttgtttcctttttaaccattccttctattggaagaccttaaatgctattgtaacttgcttgagaactataggaccatggcaaacaaaagcaattaaaattaggagaatctgaatctttggctgaggccaatatatattatatatatatcaatttatggaaaaaaagcacaaataaccttggaagcactttgtctgcacaccatgatgaacttcctgggcccaaaggtaccagggcaaataactggcaccatctaccctttcgaagtgttttagttactggatcagtggaaaataatactaataaaacaagctatctcttacatct

SEQ ID NO: 3425 - DNA, 2761 bp, Rattus norvegicus
  Genbank Accession No. NM_019126
gagcagcattgacagtggtagggacagagcagtgccttggacactgaccccactatccacagctcataggattttgagaagtgctcctgcctgggaaaaaactcagctctgaaaaaggaaggacagcagaggccaggagccttgttggagctgaaggtcttctcctcagagcaagggcagtatagtgaggagagacatggaggtgtcctctgtgcttctctgttcagggtgtagcccttggcaggggttcctgctcacagcctcacttttaacctgctggctcctgcccaccactgcccaagtcaccctcaagtcctcaccgccccaggtggttgaaggagaaaacgttcttctaagtgctgacaatctgccagagaacattatagctttcgcctggtacaaaggggagaccgacatgaaccgtggaattgcactgtattcactgaggtatactgtaagtttgacggggcctgtgcacagtggtcgagagacattgtacagcgacgggtccctgtggatcaaaaatgtcacccaggaggacacaggattttatacctttcgaatcataaataaacatggaaaaattcaatcaaatacaaccctgttccttcacgtgaaatcctctcttttcgtctgtgggcgcccttctaacattgacgagcccactattgaatcagtgccggtcagcgttagcgaatggggaagcgttcttctccgtgttcacaatcttccagagaatctacgaacgcttttctggtacaaaggggtgcttgtgttgaagaagcttgagattgcccgatacagaacaaccaagaacacatatgagctgggccctgtgcatagtggtagggaaaccgtgtacagtaatgggtccctgctgctccagaatgtcacctggaaagacaccggattctacaccctaagaactctgagtacagatttgaaagtagaaataacacacatttaccttcaggtgaacacctccctttcctcgtgctgtgaccctgtcacctctgtcccactcatgatagagccagtgccacggcatgcagttgaaggggaaagtgttcttctctatgtccacaatctgcctgaagctctgcaaaccttttcctggtacaaaggagtgtacagccttaaggaatttaaaattgcagaatacagcatagcgacaaagtctgtcttcccgggcccggcacacagaggaagagcgacaggttacaccaacggatctctgctcctccaggacctcactgcaagagatactggcttgtacacactagtaacgttagacagtaattccaaaattaaatcagcccctgtgcaagtcaccgtgcacaagcctgtaacacagcccttcctgagagtcacagagagcacagtgacagtacagagctcagtggtcttcacttgcttgtcggacaacactggagtctccatccgttggctcttcaagaatcagaatctgcaggtcacagagaggatgaccctatccccatcaaattgccaactcaggatacatgatgtcagaagggaggatgctggacagtatcgatgtgaggccttcaacccaatcagctccaagaccagtcgcccagtcagcctggctgtgattaatgagtgacccctcctctcatcctacagcagagtggggacctttctgtattgagatgtccacacttatgcaaccctgccagttacagatttccattcatgctcatggccaactgtccttctgtcccatccctcctcacacctgatcctgaacccccccattatcttctacatcccttcttccacccagttcctttccttcttctttcccctccaactctatttcccccttctaagctgagattcaagcaacctcacggggcctttcttcttgtttaccttctttgtgtcagtggattgtagtgtgtgtatcttgtatttcatggctaatatgcacttataagtgcgacatgtcctggatgccggctttggggttgggctacctcagcaagttccatccatgtgccttcaaaattaatgatgtctgtctcttcaattgctgagtagtagcccatggtgtatatgaaccacattgtctgtatccattctttctagttactggtgccctcctggcagtgctcagcccactattgatgagcaatgtagcccaaaggtaaatgttcaatttgttcttagtggacagagagtttcaagcctatattgacataaagacgggaactgaggttgacagctgtcttagggttttactgctgtgaacagactccatgacctatgcaagtcttataaaggacaacatttattgtggctggcttacagctcagagattcagtccattttcatcaaggagggagcatggaagagtccatgcaagcacagtacagcagatttgattgttctacagcttcatctgaaggatgctagcagaatacccatttccaggcagctagggttagggtattaaagcccacacccacagtgacacacctcctccaacaagactacacctccaacagtgcaattggcccaagaatatacaaaccatcacaacagccatggcctcacagtttgtaatagccaccaatcaaaacttgctgttgtctgaacatagtgtccaaggctcagaacatgccaatggatcactgctccttccgaaaaccatccagatgaagacaatgttttgacccttcaaatctgaaatgctgaagtagaatgtgaataaacatatgtgtattaccacataaacaga

SEQ ID NO: 3426 - DNA, 333 bp, Rattus norvegicus
  Genbank Accession No. NM_019130
atggccctgtggatccgcttcctgcccctgctggccctgctcatcctctgggagccccgccctgcccaggcttttgtcaaacagcacctttgtggttctcacttggtggaagctctctacctggtgtgtggggagcgtggattcttctacacacccatgtcccgccgcgaagtggaggacccacaagtggcacaactggagctgggtggaggcccgggggccggtgaccttcagaccttggcactggaggtggcccggcagaagcgcggcatcgtggatcagtgctgcaccagcatctgctctctctaccaactggagaactactgcaactag

SEQ ID NO: 3427 - DNA, 1004 bp, Rattus norvegicus
  Genbank Accession No. NM_019131
cttagccgcagggggcgccggcgttgcaaagcgggcctgggcgggacgaaccggacctggctccgtaactgcaggagcccagcagtagcagctgcagagcgcggaggcagagcacagcctcagccgccgcctcgccatggcgggtagcagctcgctggaggcggtgcggagaaagatccggagcctgcaggaacaggcagatgccgcggaggagcgtgcgggcagcctgcagcgagagctggaccaggagcggaagctgcgggaaaccgctgaagctgacgtagcatctctgaacagacgcatccagctggttgaggaggagttggatcgcgctcaggagcgtctggccacagctctacagaagctggaggaggctgagaaggctgcagatgagagtgagagaggcatgaaagtcattgaaagccgagcccaaaaagatgaagaaaagatggagattcaggagatccagctgaaagaggccaagcacattgctgaagatgctgaccgaaagtatgaagaggtggcccgtaagctggtcatcatcgagagcgatctggagcgtgcggaggagagggctgagctctcggaaggcaaatgtgccgagcttgaagaagagttgaaaacggtgacgaacaacttgaagtcactggaggctcaggctgagaagtactctcagaaagaagacaagtatgaagaggagatcaaggttctctctgacaagctgaaggaggctgagacccgggctgagtttgcagagagatcagtaaccaaattggagaaaagcattgatgacttagaagataagtttctttgcttctctcctcccaagactccttcatcaagccggatgtcccacctctctgagctctgcatctgtctgctctccagctgacccaggtttctttctagtgcccacccaccctagggccaggcacagaccgtgctttctattgtacagaggtgatcctcccagtgtaaaataaacactgtacgctagtcctgtt

SEQ ID NO: 3428 - DNA, 2400 bp, Rattus norvegicus
  Genbank Accession No. NM_019133
gtcgtcctgagccccttgcgctccgcccccgcggcccaccgacccactgccccttggatcccctgccccaagctgccaccatgaactacctgcggcgccgcctgtcggacagcaacttcatggccaatctgcctaatgggtatatgacagacctgcagcgcccgcaaccacctccgccgccgccctcagccgccagcccaggggccactcccggatccgctgctgcctctgctgagagggcctccacagctgctccagtggcctctccagcagcccctagtcccgggtcctcggggggcggtggcttcttctcctcgctgtctaacgcggtcaaacagaccacagcagctgcagccgccaccttcagtgagcaggtgggcggtggctctgggggcgcaggccgcgggggcgccgccgccagggtgctgctggtcatcgacgagccgcacaccgactgggcaaaatacttcaaagggaagaagatccatggagaaattgacattaaagtagagcaagctgaattctccgatctcaatcttgtggctcatgccaatggtggattctccgtggacatggaagttcttcggaatggggtcaaagttgtgaggtctctgaagccagactttgtgctgatccgccagcatgccttcagcatggcacgtaatggagactaccgcagtttggtcattgggctgcagtatgctgggatccccagtgttaactctttgcattctgtctacaacttttgtgacaaaccctgggtgtttgcccagatggttcgactacacaagaagcttggaacagaggaattccctctgattgatcagactttctatcccaatcataaagagatgctcagcagcacaacataccctgtagttgtgaagatgggccacgcacactctgggatgggcaaggtcaaggtagacaaccaacatgacttccaggatattgcaagtgttgtggcactgactaagacatatgccactgctgagcccttcattgatgctaaatacgatgtgcgtgtccagaagattgggcagaactacaaggcctacatgaggacatcagtgtcagggaactggaagaccaatacaggctctgctatgcttgagcagattgctatgtctgacaggtacaagttgtgggtagacacgtgctcagagatttttgggggacttgacatctgcgcagtggaagcactgcatggcaaggacggaagggatcacattattgaggtggtgggctcctccatgccactcattggggatcaccaggatgaagacaagcagctcatcgtggaacttgtggtcaacaagatgactcaggctctgcctcggcagcgggatgcttcccctggcaggggttcccacagccagactccatccccaggagccctgcccttgggccgccagacctcccagcagcctgcaggacctcctgctcaacaacgacccccaccccagggaggccctccacaaccaggcccaggacctcagcgccagggacccccgctgcaacagcgcccacccccacaaggccagcaacatctttctggccttggacccccagctggcagccctctgccccagcgcctaccaagtcccacagcagcacctcagcagtccgcctctcaggccacaccaatgacccagggtcaaggccgccagtcacggccagtggcaggaggccccggagcacctccagcagcccgcccgccggcctccccatctccacagcgtcaggcagggcccccacaggctacccgtcaggcatctatctctggtccagctccaccgaaggtctcaggagcctcacccggagggcagcagcgccaaggccctccccagaaacccccaggccctgctggtcccattcgtcaggccagccaggcaggtcccggacctcgcactgggccacccaccacacagcagccccggcccagcggcccaggtcctgctggacgtcccaccaaaccacagctggctcagaaacccagccaggatgtgccaccacccatcattgctgctgccgggggacccccgcacccccagctcaacaaatcccagtctctgaccaatgccttcaaccttccagagccagccccgcccaggcccagccttagccaggatgaggtgaaagctgagaccatccgcagcctgaggaagtctttcgccagcctcttctccgactgacacctactctgagaaccctaaacccctagacaacccgtctctgggtcctgagtccatttctcacctttggaatctccaaatcccttgagaacccctctctcctggttctacatcccacttctcattcctcaagatgtcccttgagaaacgtggtcctaaatccagttctcacattgggaatccccaagtccatttagaatcctgg

SEQ ID NO: 3429 - DNA, 2145 bp, Rattus norvegicus
  Genbank Accession No. NM_019137
agcccggttgcactttggagaaaccaggagccgccgcccgaggcaggtgcgggcgagccagggcgccgcggccccccaaccctcgtccccgagccaagcgccgggagcctggagctggggcgcccggattccctgccagccacgcgcgccccagcccagcgaggccccgggcgccccgccgccaccacgccatgctccacctgagcgacttctccggccccgacgcgctcctctccaagcccaccgaaggctgcgcccacaccagccccgagctgccccggctgcctgctagggacgctccctcggccgccgcgtatcctggaggcgacttcttgagctgggctctgagcacctgcggcgccgggggggacttaacagactcctgcttcctggagggccctgcacccacgcccccttcgggcctcagctacagcggcagcttcttcatccaggcggttcccgaacacccgcacgacccggaggccctcttcaacctcatgtctggcatcttgggcttggcacccttccctagccccgaggcggcagcgtctcggtcccccctggatgtccctttccccgcgggtcccgatgccttgttgccggacctttactccccggatctgagttcggccgccttcccggaggcgttttgggaggccgcgccttcggcgggcgctccctcgcagtgcctgttcgagccccagctctccccgcccgacgtcaagcccgggctgagggcgcctcccgcttcgccagcgctggacgctgctgcttcggccttcaaagggccctacgccccctgggagctgctgtcggccggggctccggggaactgtgggtcgcagggaagcttccagaccaccccggaggcacgcttttccgccgtggggaccaaggtcgaggacctgctgtccatcagctgccccgccgagctgcccggtccggctagcagactctacccgccaggggcctacgatgccttctcgctggccccaggtgacttaggggaggggaccgagggcctcccggcgctgctgacccctccgggcggggagggagggagcggcggcgaaggcggagagttcctggccgtccctcaagcgcagctgtccccgctgggcctgcgcggcgccgccacggcagacttctccaaagccctggtggccgacctcccggggggcagcggagtggcggcgccttcatcccccgccacctccttccccgcggccaaagcccggcgcaagggacgccggggcggcaagtgcagcgcgcgctgcttctgcccgcggccgcacgtcaaggccttcgcctgccccgtggagagctgcgtgcggacgttcgcgcgctccgacgagctcaaccgccacctgcgcatccacacgggccacaagcccttccagtgccgcatctgcctgcgcaacttcagccgcagcgaccacctcaccacgcacgtgcgcacccacaccggcgagaagcccttcgcctgcgacgtgtgcggccgccgcttcgcgcgcagcgacgagaagaagcgacacagcaaggtgcacctcaagcagaaggcgcgcgccgaggagcgcctcaagggcctgggcttctactcgctgggcctctctttcgccgcgctgtagccggagctggctccgtaggtcggcgccgccggccgtcggcgcacgcgacacggtcctgccgctccctcgtccctgctgccttccctgcctcttccacgcacgtccggggccacccgcagcccagctccagttcccccgaagcgcccgccgctcacgcccttcagcacgggctccgcggacagcgcccgctgttttcggagccgccttcctctagccacccgctctggggactgtcctctcggtccacccacagagcaggcgataccttaggactgaagagagtttttgtaactggcgtacgccccacgccttcctctttatcccttcccagagtcaagctggggatgtaccgagccggtctctcaagaactttgtacagcaagtccagcaagcctttggatgtgatgtctttgctttggggttatttcctttttgttgtcgttcattttttgtaaagcagacgctactctcaagcatttgacaaaactgtttatttttgcaattaaaattattgtgc

SEQ ID NO: 3430 - DNA, 700 bp, Rattus norvegicus
  Genbank Accession No. NM_019139
ggtctacggagaccggatccgaggtgccgccgccggacgggactctaagatgaagttatgggatgtcgtggctgtctgcctggtgttgctccacaccgcgtctgccttcccgctgcccgccggtaagaggcttctcgaagcgcccgccgaagaccactccctcggccaccgccgcgtgcccttcgcgctgaccagtgactccaatatgcccgaagattatcctgaccagtttgatgacgtcatggattttattcaagccaccatcaaaagactgaaaaggtcaccagataaacaagcggcggcacttcctcgaagagagaggaaccggcaagctgcagctgccagcccagagaattccagagggaaaggtcgcagaggccagaggggcaaaaatcgggggtgcgtcttaactgcaatacacttaaatgtcactgacttgggtttgggctacgaaaccaaggaggaactgatctttcgatattgtagcggttcctgtgaagcggccgagacaatgtacgacaaaatactaaaaaatctgtctcgaagtagaaggctaacaagtgacaaggtaggccaggcatgttgcaggccggtcgccttcgacgacgacctgtcgtttttagacgacagcctggtttaccatatcctaagaaagcattccgctaaacggtgtggatgtatctgaccctggctccagaga

SEQ ID NO: 3431 - DNA, 6469 bp, Rattus norvegicus
  Genbank Accession No. NM_019140
cggcccgccaggcagctccggccgtgcgcgcacgccgagccgccggagcccgggccgacccgtgccggagcagcatgcggagcccgcagccgctgctcctctggacacctcagcctgaggcctctccgtgagttacggggacaccatcccccaccagggcggaggctggaggccactgccaagcatggcgcccacctggagacccagcgtggtgtctgtggtgggtcctgtggggctcttccttgtactgctggccagagggtgcttggctgaagagccacccagatttatcagagagcccaaggatcagattggtgtgtcaggaggcgtggcctccttcgtgtgccaggccacaggtgaccctaagccacgggtgacctggaacaagaagggcaagaaagtgaactcacagcgctttgagaccattgactttgacgagagctcgggggccgtgctgaggatccagccacttcggacaccccgggatgagaacgtgtacgagtgtgtggcccagaactcggtgggggagatcacagttcatgcgaagctcaccgtcctgcgagaggaccagctgcctcctggcttccccaacattgacatgggcccccagttgaaggttgtagagcgcacacgcacagccaccatgctctgtgctgccagcggaaaccctgaccctgagatcacctggttcaaggacttcctgcctgtggaccccagtgccagcaatgggcggatcaagcagcttcggtcaggtgccctgcagattgagagcagcgaggagacagaccagggcaagtacgagtgtgtggccaccaacagcgctggggtgcgctactcatcacctgccaacctctacgtgcgagtccgccgtgtggccccccgcttctccatcctgcccatgagccacgagatcatgcccggtgggaatgtgaatatcacttgtgtggctgtgggctcacccatgccctacgtgaagtggatgcagggggcagaggacctgacgcctgaggatgacatgcccgtgggtcggaatgtcctcgaactcacggatgtcaaagactcagccaactatacttgtgtggccatgtccagcctgggagtgatcgaggccgttgctcagatcactgtaaaatctctccccaaagcccctgggactcccgtggtgacggagaacactgctaccagtatcactgtcacatgggactcaggcaatcctgaccctgtgtcctactacgtaattgagtataaatccaaaagccaggatgggccgtatcagatcaaagaagacatcaccaccacgcgctacagcatcggcggcctgagccccaactctgagtatgagatctgggtgtcagctgtcaactccatcggccagggcccccccagtgagtcggtggtgacccgcacaggcgagcaggcaccagccagtgctcccaggaatgttcaggcgcgcatgctcagtgccaccaccatgattgtgcagtgggaggagcccgtggagcccaatggcctgatccgtggctaccgcgtctactacaccatggagcccgagcatccggtgggcaactggcagaagcacaatgtggacgacagtcttctgaccactgtgggcagcctgctagaggatgagacctacactgtgagagtgctcgccttcacatcggtgggcgatgggccactgtcagaccccatccaggtcaagacccagcagggagtgcccggccagcccatgaacttgcgggctgaggccaagtcagagaccagcattgggctctcgtggagtgcaccacggcaggagagtgtcattaagtatgaactgctcttccgggagggcgaccgaggccgagaggtggggcgaaccttcgacccaaccacagcctttgtggtggaggacctcaagcccaatacggagtacgcgttccggctggcggctcgctcgccgcagggcctgggcgccttcaccgcggttgtgtgccagcgcacactgcaggccaaaccgtcagccccccctcaagacgttaagtgcaccagcttgcgctccacggccatattgatccttctggaagctttggagaaatggacggagtaccgtgtcaccgccgtggcttacacagaggtgggaccagggcccgagagctcgcccgtggtcgtccgcaccgatgaggacgtgcccagcgcgcccccgcggaaggtggaggcggaggcgctcaacgccacggctatccgagtgctgtggcgctcgcccacgcccggcaggcagcacgggcagatccgcggctaccaggtccactatgtgcgcatggagggcaccgaggcccgcgggccaccgcgcatcaaggacatcatgctggcggatgcccaggaaatggtgatcacaaacctccagcctgagactgcttactctatcacagtagccgcgtataccatgaaaggcgatggcgctcgcagcaaaccgaaggtggtggtgaccaagggagcagtgctgggccgccccaccctgtcggtgcagcagacccccgagggcagcctgctggcgcgctgggagccccccgcggacgcggctgaggacccagtgcttggctaccgcctgcagtttgggcgcgaagacgcggccccggccacgttggaactggcggcgtgggagcggcggttcgcggcgcctgcacacaagggcgccacctatgtgtttcggctggcggcgcggggccgcgcggggctgggcgaggaggcctcggcggcgctgagcatccctgaggacgctccgcgtggcttcccgcagatcctgggccccgcgggcaacgtgtccgcgggctccgtaatactgcgctggctgccacccgtgcccgccgagggcaacggcgccatcatcaagtacacggtgtccgtgcgggaggccggcaccccagggcccgcgacagagaccgaactggcggcggcggcccagccgggggccgagacagcgctcacactacaggggctgcggccggagacggcctacgagctgcgcgtgcgcgcgcacacgcgtcggggccccggccccttctcacccccgctgcgatacaggcttgcgcgggacccagtctcccccaagaacttcaaggtgaagatgatcatgaaaacttcagtgctgctaagctgggagttccctgacaactataactcacccacgccctacaagatccagtacaatggactcacactggacgtggatggccgcactaccaagaagctgatcacgcacctcaagccacacaccttctataacttcgtgctcaccaaccgtggcagcagcctgggaggcctgcagcagacggtcaccgccaggaccgccttcaacatgctcagtggcaagcctagtgtcgccccaaagcctgacaacgatggttccattgtggtctacctgcctgatggccagagtcccgtgacagtgcagaactacttcattgtgatggtcccacttcggaagtctcgtggtggccagttccctatcctactaggtagtccagaggacatggatctggaggagctcatccaggacctctcccggctgcagaggcgcagcctgcgccactcaagacagctggaggtgcctcggccttacatcgccgctcggttctccatcctgccagctgtcttccatcctgggaaccagaagcaatatggtggctttgacaacaggggcttggagccaggccaccgttatgtcctctttgtacttgctgtgctgcagaagaatgagcctacatttgcagccagtcccttctcagaccccttccaactggacaacccagacccgcagcccattgtggatggcgaggagggcctcatctgggtgatcgggcccgtgctggccgtggtcttcatcatctgcatcgtaattgccatcctgctgtacaagaacaagcctgacagcaaacgcaaggactcagagccccgcaccaaatgcttattgaacaatgcagacctcgccccccatcaccccaaggaccctgtggaaatgcgacgtatcaacttccagacgccaggtatgctcagccacccgcccattcccatcacagacatggctgaacacatggagagactcaaagccaacgacagcctcaagctctcccaggagtatgagtccatcgaccctggccagcagttcacttgggaacattcgaacctggaggccaacaagccaaagaaccgatacgccaatgtcatcgcctatgaccattcacgagtcatcctgcagcctttagaaggcatcatgggtagtgattacatcaatgccaactatgtggacggctatcggcggcagaacgcatacatcgccacgcaggggcccctgcctgagacctttggggacttctggcggatggtgtgggagcagcggtcagccactgtggtcatgatgacacggctggaggagaaatcacgggtcaaatgtgaccagtactggcctaaccgaggcaccgagacatacggcttcatccaggtcaccctactagatactatggagctggccaccttctgtgtcaggaccttttctctacacaagaatggctctagtgagaagcgtgaggtacgacattttcagttcacagcatggcctgaccacggggtacccgagtaccccacacccttcctggcgtttctgcgcagagtcaagacctgcaacccgcctgacgctggcccagttgtggtccactgcagcgcgggtgtggggcgtactggctgcttcattgtaattgatgccatgttggagcgcatcagaacagagaagacggtggatgtgtacggacacgtgacactcatgcggtcacagcgcaactacatggtgcagacagaggatcagtatagcttcatccacgaggcactgctggaggctgtgggctgtggcaataccgaggtccccgcgcgcagcctctacacctatatccagaagctggcccaggtggagcctggcgagcatgtcacaggaatggagcttgagttcaagaggcttgccagctccaaggcacacacttcgagattcatcactgccagcctgccttgcaacaagtttaagaaccgcctggtgaacatcctgccgtacgagagctcgcgtgtctgcctgcagcccattcgtggtgtcgagggctctgactacatcaatgccagcttcatcgacggctacagacagcagaaagcctacattgcaacgcagggtccactggcagagaccacagaggacttctggcgtgccctgtgggagaacaactccactattgtggtaatgctcaccaagctccgcgagatgggccgggagaagtgccaccagtactggccagctgaacgctctgcccgctaccagtactttgtggttgacccgatggcagagtataacatgccacagtacattctgcgtgagtttaaggtcacagatgcccgggatggccagtcccggaccgtccgacagttccagttcacggactggccagagcagggtgcacccaagtcaggggaaggcttcattgacttcatcggccaagtgcataagaccaaggagcagtttggccaggatggccccatctcggtgcactgtagtgctggagtgggcaggaccggagtattcatcactctgagcatcgtgctggagcgaatgcgctacgagggggtggtggacattttccagacagtgaaggtgcttcggacccagcggcctgccatggtgcagacagaggatgagtaccagttctgcttccaggcggcgttggaatacctgggcagctttgatcattatgcaacataagccatggccccgcccaacacctcgacccagctccaagtgccctgaatgtgagcccagccctcggtgctgggtgggaggcggcccagggaggaaacctcctctccctggagacaggcactgccttctgaagggcacattcctcattcccttctgactccaaaacgaggttccagggtggggggtagggtggagagtagaggagccactgctcccatagctggggtcacaagggacagaactctgctcccacacttccctgcctgcggaattccgaaaacaattctatttccaaagctacagaagagcacacagtctgacttgtaggtgggtgactgatgagaatgctgttatggtatcagacgtgtagtgtattgctaggaataagcctgtgaggatttgtactatgaggcatactcctagtagagaaccgaagtttcatcatgatgagatgtttgatgtggggtggggtgttgagggggttttttttgttcaagccaaaggtaactttattgattcatgaatctggaaagttcaagtacaggttttattccagaaaagaactgattctgagcacagtgtagtcagtgctccatcactctgggttgcccaaaaaaaagacttgcacaatgattccagttgacatgcaacatggacagaaacatttcacaaagccacacccatatatgaaggagg

SEQ ID NO: 3432 - DNA, 1647 bp, Rattus norvegicus
  Genbank Accession No. NM_019142
atggccgagaagcagaagcacgacgggcgggtgaagatcggccactacatcctgggggacacgctgggcgtcggcaccttcgggaaagtgaaggtgggcaagcacgagttgactggacataaagttgctgtgaagatactcaaccggcagaagattcgaagcctggacgtggtcgggaaaatccgcagagagatccagaacctgaagcttttcaggcaccctcatataatcaaactgtaccaggtcatcagtacaccgtctgatattttcatggtcatggaatatgtctcaggaggagagctatttgattatatctgtaaaaatggaaggttggacgaaaaggagagtcgacgtctgttccagcagatcctttctggtgtggactattgtcacaggcatatggtggtccacagagatttgaaacctgaaaacgtcctgcttgatgcacacatgaatgcaaagatagccgacttcggtctttcaaacatgatgtcagatggtgaatttttaagaacgagctgtggctcgcccaattatgctgcaccagaagtaatttcaggaagattgtacgcaggccctgaagtagacatctggagcagcggggtcattctctatgctttgctgtgtggaactctcccttttgatgatgaccacgtgccaactctttttaagaagatatgtgacgggatattttatacccctcagtatttgaatccctctgtaataagccttttgaagcatatgctgcaggtagatcctatgaagagggccacaataaaagatatcagggaacatgaatggtttaagcaggaccttccaaaatatctctttcctgaagacccgtcttatagttcaaccatgattgatgatgaagccttaaaagaagtgtgtgagaagttcgagtgctcagaggaggaggtcctcagctgcctgtacaacagaaaccaccaggacccactggcagttgcctaccacctcataatagacaacaggagaataatgaacgaagccaaagatttctacttggcaacaagcccacccgattctttcctcgatgatcaccatttaactcggcctcaccctgagagagtaccattcttggttgccgaaacaccaagggcccgacacaccctagatgaattaaacccacagaaatccaaacaccaaggcgtacggaaggcaaagtggcatttggggattcgaagtcaaagccgacccaatgacatcatggcagaagtgtgtagagcaatcaagcagttggactatgaatggaaggttgtaaacccctattatttgcgtgtgcgaaggaagaaccctgtgacaagcacattttccaaaatgagtctacagctataccaagtggatagtaggacttacttattggatttccgaagtattgatgatgagattacagaagccaaatcagggactgctactccacagagatcgggatccatcagcaactatcgatcttgccaaaggagcgactccgacgccgaggctcaaggaaagccctcagaagtctctcttacctcatccgtgacctccctcgactcctctcctgttgacgtagctccaagaccaggaagtcacacgatagaattttttgaaatgtgtgcaaatctaattaaaattcttgcacagtaa

SEQ ID NO: 3433 - DNA, 8329 bp, Rattus norvegicus
  Genbank Accession No. NM_019143
ctcgcacccgctgcactgcacaggggaagaaaaggagcccagggtgtgagccggccagcggccacaacttctggtcctctcccgtgtcctccttccatcttcttacaggcgtccccacctcaggacttttcctgcaggctgcgaggggaaccaacttcgtggccactagcctcctggagagggcgactctcctcccatccactcaagatgctcaggggtccgggacccgggcggctgctgctgctagcagtcctgtgcctggggacatcggtgcgctgcaccgaaaccgggaagagcaagaggcaggctcagcaaatcgtgcagcctccgtccccggtggctgtcagtcagagcaagcctggctgttttgacaacgggaagcattatcagataaatcagcagtgggaacggacctacctaggcaacgccctggtttgtacctgctatggaggaagcagaggttttaactgcgagagcaagcctgaacctgaagagacctgttttgacaaatacactggaaacacttacaaagtgggtgacacttatgagcgccctaaagattccatgatctgggactgtacctgcattggggctgggcgaggcaggatcagctgtaccattgcaaatcgctgccatgaagggggtcagtcctacaagattggtgacaagtggaggaggccacatgagactggtggctatatgttggagtgtttgtgtctggggaatggaaaaggggaatggacctgcaagccaatagctgagaaatgttttgatcacgctgctgggacttcctacgtcgtgggggagacctgggaaaagccctaccaaggctggatgatggtggactgtacttgtctgggcgaaggcaatgggcgtatcacctgcacctcccggaacagatgcaatgatcaggacaccaggacgtcctacagaattggagacacatggagcaagaaggacaacagagggaacctgctccagtgtgtctgcacaggcaacggcagaggggagtggaagtgtgagcgacatgttctacagagtgcttcagctggatctggctccttcacagatgtccgaacagctatttaccaaccccagacccacccccagcccgcaccgtacggccactgtgtcacagacagcggtgtggtctactctgtgggaatgcagtggctgaagtctcaaggagacaagcagatgctgtgcacttgcctgggcaatggcgtcagctgccaggagacagctgtgacccagacttacggtggcaactcaaacggggagccctgtgttctcccgtttcactacaacggtaggaccttctactcctgcaccaccgaagggcggcaagacggacatctgtggtgtagcacaacttcaaattatgaacaagaccagaagtattctttctgcacagaccacgcggttttggttcagactcgaggtgggaattccaatggtgccttgtgccacttccccttcctgtacagcaaccggaattacagcgactgtacttctgagggtaggcgggacaacatgaaatggtgcggcaccacccagaactacgatgccgatcagaagtttggattctgcccaatggctgcccatgaggagatctgcacgaccaacgaaggggtcatgtatcgcattggggaccagtgggataagcagcatgacctgggccacatgatgaggtgcacgtgtgttgggaacggccgtggacaatgggcctgcatcccctactcccagctccgagatcagtgcatcgttgatgacattacttacaacgtcaacgacacgttccacaagcgtcacgaggagggacatatgctgaactgtacctgcttcggtcagggccggggcagatggaaatgtgaccccatcgaccgatgccaagattcagagacccggacattttaccagattggtgactcctgggagaagtttgtgcatggtgtcagataccagtgttactgttacggccgtggcattggggagtggcactgccagcctctgcagacctacccaggcacaactggacctgttcaagtaattatcacggagacccccagccagcccaattcccaccccatccagtggaatgccccggagccttcacacatcaccaagtacattctcaggtggagacctaaaacctctacgggtcgctggaaggaagctaccattccaggccaccttaactcctataccatcaaaggcctgaccccaggtgtgatctacgagggacagctcatcagcatccagcagtacgggcaccaagaagtgactcgctttgacttcaccaccagcgccagcacacctgtgaccagcaacacagtgactggagagactgcgcccttttctcctgttgtggccacttccgaatctgtcactgaaatcacagccagcagcttcgtggtctcctgggtctcagcttccgacacggtgtcaggattccgagtggagtacgaactgagcgaggaaggagatgagcctcagtaccttgatcttccaagcacagccacttctgtgaacattcctgacctgctcccgggcagaaagtacatcgtcaacgtctatcagatatctgaagagggaaagcagagcttgatcctgtctacatcacagactacagcacctgatgcgcctccagaccctactgtggaccaggttgatgacacttccattgttgttcgatggagcagaccccaggcacctatcacagggtacaggattgtctattcaccttcagtagaaggcagtagcacagaactcaaccttcctgaaacggccaactccgtcaccctcagcgacctgcagcccggtgttcagtacaacatcactatctatgctgtggaggagaaccaggagagcacacccgttttcatccagcaggagactactggcgtcccacgatccgatgatgttcccgctccaaaggacctacagtttgtggaagtgaccgacgtgaaagtcaccatcatgtggacacctcctaatagcgcagtgactggataccgtgtggatgtcctgcctgtcaacctgccaggggaacatgggcagaggctgcctgtcaacaggaacacctttgctgaagtcaccggactgtccccaggggtcacgtacctcttcaaagtctttgctgtgcatcagggcagggaaagcaagcctctgacagcacaacagaccaccaaactcgatgctcccactaacctccagtttgtcaatgaaacggacagaacagttctggtaacttggactccacctcgagcccggatagcaggctaccgactgacagtgggcctcacccgaggaggccagcccaagcagtacaatgtgggacccatggcttccaagtatcccctgagaaatctgcagcctgggtctgagtacactgtgaccttgatggctgtgaaaggcaaccagcagagtcccaaagccaccggagtctttactaccctgcagcctctgcgctccattccaccttataacaccgaggtgacagagaccacaatcgtgatcacctggacccccgctccaaggattggcttcaagctgggtgtacgaccaagccagggaggtgaagcaccccgagaagtgacttcagactcaggaagcatcgttgtgtctggcttgactccaggcgtggaatacacgtacaccatccaagtcctgagggacggccaggagagagatgcaccaattgtcaaccgagtagtgacaccgctgtctcccccaaccaacttgcacctggaggccaatcctgacactggagtgcttaccgtctcctgggagaggagcaccaccccagatattactggctacagaataaccaccacccccacaaacgggcagcagggaaccgctttggaagaagtggttcatgccgatcagagttcctgcacttttgaaaaccgtaatcctggcctggagtacaatgtcagtgtttacactgtcaaagatgacaaggaaagtgcccctatctctgataccgtcatcccagaggtgccccagctcactgacctaagctttgttgatataactgactcaagcatcggcctgaggtggaccccgctaaactcttccaccattatcgggtaccgaatcacagtagttgcggcaggagaagggatccccatttttgaagattttgtggactcctcagtaggatactacacagttacagggctggaacccggcattgactatgacatcagcgttatcactctcattaatggcggagagagtgcccctactacactgacacagcaaacggccgtccctcctcccacggatctgcgattcaccaatatcggtccggacactatgcgggtcacttgggccccgcctccgtccattgagctaaccaacctcttggtgcgctactcacctgtgaagaacgaggaggatgtggcagagctgtccatttcaccctcagacaacgccgtggtcctaacaaatctcctgcctgggactgagtacctagtcagtgtctccagcgtgtacgaacagcatgagagcatacctctcagaggaagacagaaaacaggtctggactccccaactggttttgattcttctgatgtcaccgccaactcattcaccgtccactgggtggctcctcgggcccccatcaccggctacatcatccgccatcacgccgagcattctgccggaagacccaggcaagaccgagtgccgccctcaaggaattctatcaccctcaccaaccttaatccgggcacggagtacattgtcaccatcattgctgttaatggcagagaggagagccccccactgattggccagcaatccacggtttccgatgtcccgagagatctggaggtcatcgcttccacccccaccagcctgctcatcagttgggaaccccccgccgtctctgtgcgctattacagaatcacctatggagagacaggaggaaatagccctgtccaggaattcactgtgcccggaagcaagtccaccgccaccatcaacaacattaaaccaggagcagactacaccatcaccctgtatgctgtcactggccgtggggacagtccagccagcagcaagccagtttccatcaattatcaaacagaaattgacaagccatcccagatgcaggtgacggatgtccaggacaacagcatcagtgtcaggtggctgccttcaacttctcctgtgacaggttacagagtgaccaccgctcccaaaaatggcctaggaccaacaaaatctcaaactgtcagtccagatcaaacagaaatgaccattgaaggtttgcaacccaccgtggagtatgtggttagtgtctatgctcagaaccggaacggagaaagccagcccctggttcagactgcagtgaccaacattgaccgccctaaaggactggcattcactgatgtggatgtcgattccatcaaaattgcctgggaaagcccacaggggcaagtttccaggtacagggtgacctactcaagccctgaggatggaatccatgagcttttccctgcgcctgatggtgacgaggacacggcagagctgcacggcctcaggccgggttctgagtacacagtcagtgtggttgccttgcacggtggcatggagagccagcccctgattggagtccagtccacagccattcctgcgccaaccaatctgaagttcactcaggtgtcacccaccaccttgactgcccagtggacagcgcccagtgttaagctcactggctaccgagtgcgggtgaccccgaaggagaagacaggaccaatgaaagaaatcaacctttctccagacagcacctccgtgattgtgtcagggctcatggtggccaccaagtatgaagtcagcgtctatgctctcaaggacacattgacaagcagaccagctcagggagtcgtcacgactctggagaatgtcagccctccaagaagggcccgtgtgaccgacgctacagaaactaccatcactattagctggagaacgaagacagagacgatcactggcttccaagtcgatgccattccagccaatggccagaccccggttcagaggaccatcagcccggatgtcagaagctatactattacaggtttacagccaggcactgactacaagatccacctgtacacgctcaacgacaatgcccggagctctcctgtggtcattgatgcctccacggccattgatgccccatccaacctgcggttcctgaccaccacacccaactccttgctggtatcatggcaggcaccccgtgccaggattactggctacattatcaagtatgagaagcctggatcccctcccagagaagtggtccctcggccccgccctggtgtcacggaggccaccatcactggtctggagccaggaaccgagtacaccatctatgtcatcgcactgaagaacaatcagaagagtgagcccctgattgggaggaaaaagacagatgagcttccccaactggttacccttccacaccccaatcttcatggaccagagatcttggatgttccctccacagttcaaaagacccccttcgtcaccaaccctgggtatgacaccgaaaatggtattcagcttcctggcacatcccaccaacaacccagtgttgggcaacaaatgatctttgaggaacatggctttaggcgaaccacgccacccactgcggccacccccgtcaggcttaggccaagaccatacctgccgaatgtagatgaggaggtccaaatcggtcatgttcccaggggagacgtagactaccacctctatcctcatgttccggggctcaatccaaatgcctctacaggacaagaagctctctctcagacaaccatctcttggacgccattccaggagagttctgagtacatcatttcatgccaacctgttggcactgacgaagagcccttacagttccaagttcctggaacttctaccagtgcgactctgactggccttaccagaggggtcacctacaacatcatagtggaggccctgcacaaccagaggaggcacaaggtccgagaagaggttgttactgtaggcaacactgtcaacgaaggcctgaaccagcctacggatgactcatgctttgacccttacacggtttcccattacgccgttggagaggaatgggagcggttatctgactctggctttaagctcacttgccagtgcttgggctttggcagtggtcatttcagatgcgattcatctaaatggtgccatgacaacggtgtcaactacaagatcggagagaagtgggatcgtcagggagaaaatggccagcggatgagctgcacatgtctcgggaatggaaagggagaattcaaatgcgatccccatgaagcaacgtgttatgacgacgggaagacctaccacgtaggagaacagtggcagaaagagtatctcggagccatttgctcctgcacgtgtttcgggggccagcggggctggcgctgtgacaactgccgcagacctggggctgctgaacccagtcccgatggtaccactggccacacctacaaccagtatacacagagataccatcagagaacgaacactaatgtaaattgcccaattgaatgcttcatgccgttggacgtgcaggctgacagagatgattccagagagtaatctttccatccagcccaagccaacaagtgtctctctaccaaggtcaatccacaccccagtgatgttagcagaccctccatttctgagtggtcatttcacccttaagccttctgctctggagtcaagttctcagcttcagctcaacttacagcttctccaagcatcgccccgcgggatgttttgagacttccctcttaaatggtgacagttggtgccctgttctgcttcagggtattcagtactgctcagtattattgtctaagagaatcaaaagttcttgtgatttggtctgggatcaaagggaaacacaggtagccaaccacgatgcaatgaattgaatggtagtacccaagagcgggagcaggaagttaaaccagacagttctgctttcttttgccgtctgatctgcagcactgtcaggaggcctgtcctgtggctgtgtccaaacaccccacaggactcactgtcccaacaatcctaattgcctagaaatatctttctcttacctgttatttatcaatttttcccagtatttttatacggaaaaaattgtattgaagacactttgtatgcagttgataagaggaattcagtataattatggttggtgactatttttataatgtacatgccaacactttactactgtggaaagacaagtgttttaataaaaagatttacattccat

SEQ ID NO: 3434 - DNA, 1381 bp, Rattus norvegicus
  Genbank Accession No. NM_019144
ccccagagaataaagtctcagcgatcaccgcttctgttccaggagcttccttgcctcttgcgtcctctatgaccacctgtgcttcctccagcatggatacgtggatggtgctgctgggcctgcaaatcctgctgctcccactcctggctcactgtacagccccagcttccaccctgagattcgtggctgtgggtgactggggaggggtccccaatgccccattccacacagcccgggaaatggccaatgctaaagaaatcgccagaaccgtgcagattatgggcgctgacttcatcatgtccctgggggacaacttctacttcactggagtgcatgacgccaatgacaagaggttccaggagacctttgaggatgtgttctctgaccgtgccctccgcaacatcccctggtacgtgctggctggaaaccatgatcaccttggcaatgtctcggcacaaattgcctactccaagatctccaagcgctggaacttccccagcccttattaccgtttgcgtttcaaagttccgcggtcgaacatcaccgtggccatctttatgctggacaccgtgatgctgtgtggcaattccgacgactttgtcagccagcagcctgaaatgccccgagacctgggagtggcccgcactcagctgtcctggctcaaaaaacagttggcagcagccaaggaggactatgttttggtggccggtcactaccccatctggtccatcgccgagcacggacccacccgctgcctggtcaagaacttgaggccattgttggctgcatacggggtcaccgcctacctgtgtgggcatgaccacaacctgcagtatcttcaggatgagaacggtgtgggctatgtgctgagtggggccggcaacttcatggacccttctgtgcggcatcaacgaaaggtccccaacggctacctacgctttcactatggatctgaggactctctgggtggcttcacatacgtggagataggctccaaagaaatgagcatcacgtatgtggaagcctctggaaaatcactcttcaagaccagcctccccaggcgacccagaccctgaagacctacaagggtcctgcttatcccctaatgggtctgagggagggagcctctgcaagcctgatgggtgggccctgtgaggacctcacccaccggcagctttttctctgccctggtactctggcagagtgggaagggggaaccacagaggcttacatataggaaagaagtacactcacaccaactggcccccacagccaggcttaccctgtggttttggggtagacctttcttgggagtggggctttcttttaaatcaagcatctcactgtcactgctgttcaataaaaacaatagttgacaagg

SEQ ID NO: 3435 - DNA, 2917 bp, Rattus norvegicus
  Genbank Accession No. NM_019152
cccagggaccgcagcaatctcccaaactccccttccccaggatggcagaggagttaatcacacctgtgtactgcaccggggtgtcagcccaagtgcagaagcaacgggacaaggagttgggcttgggccgccatgaaaatgccatcaagtacctgggccaggattatgaaaatcttcgtgcaagatgcctgcagaacggggtcctcttccaagacgatgccttccctccagtttctcatagcttgggcttcaaggaactgggtcccaattcctctaaaacctatggcatcaagtggaagcgtcctacggaactgctgtcaaacccccagttcatcgtggatggagccacccgaacggacatctgccagggagcactgggggactgttggctcctggctgccattgcctcgctcactctcaacgagactatcctccaccgagtggttccctacggccagagcttccaggagggctatgctggcatctttcatttccagctgtggcagtttggggagtgggtagatgtggttgtggatgatttgctacccaccaaggatggaaagctggtgttcgtgcactctgcccagggcaacgagttctggagcgctctcctggagaaagcctatgcaaaagtgaatggcagctatgaggccctttcgggaggctgcacctcagaggccttcgaggactttaccggtggggtcactgagtggtacgatctgcagaaggcacccagcgacctctaccagatcattctgaaggccctggaacgaggctccttgctgggctgctccattaatatttccgatatccgtgatttggaggctattacttttaagaacctggtgaggggccatgcatactctgtgacggatgccaagcaggtcacttaccagggccagcgggtgaacctaatccggatgcggaacccctggggtgaagtggagtggaaaggaccctggagtgacaactcctatgagtggaacaaagtggacccctatgaacgtgagcagctgagggtcaagatggaggacggggagttctggatgtccttccgggacttcatacgtgagttcaccaaactggaaatctgcaaccttacacctgacgcccttaagagcagaaccctccggaactggaataccacattttacgagggcacctggcgccggggaagcactgctggaggctgcaggaactacccagctaccttctgggtaaacccccagttcaagatccggctggaggaggtggatgacgcagacgactatgacagtcgagagtccggctgcagcttcttgttggccctcatgcagaagcatcgccgcagggagcgtcgctttggccgggacatggagaccattggttttgcagtgtaccaggtccctcgggagttggcgggtcagcctgtgcacttgaagcgtgacttcttcctggccaatgcttctcgggcacaatcagagcactttatcaaccttcgagaggtcagtaaccgcatccgcctgccgccgggggagtatatagtggtgccctccaccttcgagcccaacaaagagggtgactttctgctgcgcttcttttcagagaagaaggctgggacccaggaactagatgaccagatccaggccaacctccccgatgagaaagtgctctctgaagaggagatcgatgacaacttcaaaaccctgttcagcaagttagcaggggatgacatggagatcagtgtcaaggagttacagaccatcttgaacagaatcattagcaaacacaaagacctgcgcactaacggcttcagcctggagtcgtgccgcagcatggtgaacctcatggatcgagacggtaatgggaaactgggcctggtggagttcaacatcctgtggaaccgcatccgaaattacctgaccatcttccgcaagtttgacctggacaagtctggcagcatgagtgcttatgagatgaggatggccatcgaggctgcaggcttcaagcttaacaagaagctgcatgagctcatcatcacccgctactcagagcccgacctggccgtggactttgacaactttgtgtgctgccttgtgcgcctggagaccatgttccggtttttcaaaattctggacacagacctggatggtgttgtgacctttgatctatttaagtggttacagctgactatgtttgcatgaagcgggatggctcctctgcctgtgttcttccttcttcctctgccaagccacacctccccgccatgccgtaccagaccatgtcagctgccagtgccttccctcaaaaaaaggagggcaccttgtcctcctgtccccttgtcctcctgtcctttcacctccccactacctctgttcaattgctctaggcagagtcacagggcccttcctgcccctgtagctaaggcaaccctgacccctgctcatggctaagagcaggaaggcagctccctgcttactccttcctgcctccggggcaggagtaggcatccctgcccctcccactccctgctactgtccagatgtgtgtctcacctaatctgtggaggctctagcccctgtcatcccctagacctgcagacttcgtaaccactagctagttccttgtctgcacctgggtgttgaaggcctcacctcactatgggagccccacagccagttcaccttcctgtgccttcatgtgcagcagccaagatccctctgcaaaccaaagtacacctctcctgcccgtgtgcccaccaggaacttcctggccgggagggcactcaggccctccgtatccccaccccccttcctctattttttaatatttttcaaggaaatgcttgagggactagtgtactggttatggaggaccaggacctggggggtgggttggggaggtcccatgtttcagtgcagtgggaaaataaaatgaa

SEQ ID NO: 3436 - DNA, 1588 bp, Rattus norvegicus
  Genbank Accession No. NM_019156
ccaggcaagacagtgagactccagaagctccgagcccagtttgccaaggccctctgctagaggcctgccatggcatctctgaggccctttttcatactagccctgctggcattggtttctctggctgaccaagagtcatgcaagggccgctgcactcagggtttcatggccagcaagaagtgtcaatgtgatgagctttgcacctactatcagagctgctgtgttgactacatggagcagtgcaagccccaagtgacccggggggatgtgtttaccatgccagaagatgagtattggagctatgactacccggaggaaaccaagaacagtaccaatgctggcgtgcaatccgagaacacctctctacactttaacctaaagcctcgagccgaagagactataaagccaacaactcctgatcctcaggaacagtcaaacacccaagaacctgaagtggggcaacagggagtggccccaaggcctgacaccactgatgaaggaacctctgagtttccagaagaagagctgtgtagtggaaagccctttgatgccttcacagacctcaagaatggttccctttttgccttccgaggtgagtattgctatgagctagatgaaacagcagtgaggcctgggtaccccaaactcatccaagatgtctggggcatcgagggccccatcgacgctgccttcactcgcatcaactgtcagggaaagacctacttgttcaagggtagtcagtactggcgctttgaggatggtgtcctggaccctgattatccccgaaacatctctgaaggcttcagtggcataccagacaacgttgacgcagccttagcccttcctgcccacagttacagtggccgggaaagggtctacttcttcaagggaaaacagtactgggagtatgaatttcagcagcagcccagccaggaggaatgtgaaggaagctctctgtcagccgtgtttgagcactttgccttgcttcagcgggacagctgggagaacatttttgaactcctcttctggggcagatcctctgatggcgccaaaggaccccaattcatcagcagggattggcatggtgtaccagggaaagtggacgctgctatggccggccgcatctacatcactggctccacattccgctctgtccaggccaaaaaacagaagtctgggcgtcgaagtcgaaaacgctaccgttcacgccgagggcgtggccatagccgcagccgcagccgcagcatgagctctcgtcgcccatcgcgttcagtctggttctctttgctctccagcgaagagagtgggctaggaacctacaattacgattatgatatgaactggctgatacctgccacctgcgagcccattcagagcgtctatttcttctctggagacaagtactaccgagttaaccttagaacacggcgagtggactctgtgaatcctccctacccacgctccattgctcagtattggctgggctgcccaacctctgagaagtaggaatcagcacccacacagctgagcttcagaaacctcgtcctccagctttttctcccagcccaataaagtgttggccccaaaa

SEQ ID NO: 3437 - DNA, 1463 bp, Rattus norvegicus
  Genbank Accession No. NM_019158
  misc_feature (1)..(1463): n = a or c or g or t
cgaaagcaatcctttaaaagcgcagagtcagcggaccagtctgagttctggagttaagtgagcacatctccttcagctggtgcagctcctggagctctgactcccaccttccggagcagatatgtctggggagcagacgccgatgtgtagtatggacctacgtgagatcaaggggaaggagaccaacatggctgacagttaccatggcatgtcctggtatgagcagtacatacaaccgtgtgtggtggaacttttgggctccgctctcttcatcttcattgggtgtctatcggtcatcgagaacagtccaaatactgggctcctgcagcctgccctggctcatgggctggccttggggctcatcattgctaccttggggaacatcagcggtggacacttcaaccctgctgtgtcgctcgcagtcacactggttggaggcctcaagaccatgctgctaattccctactgggtctcccagctgtttgggggaatgatcggagctgccctggctaaggtggtgagtccagaggaaaggttctggaatgcgtctggggcagcctttgccatagtccaggagcaggagcaggtggcagaagccctgggggtagagatcgttatgacgatgctcttggtattggctgtgtgtatgggtgccgtcaatgagaagacaatgggtcccctagccccattctccattggtttctctgtcattgtggatatcctggcaggtggtgggatctctggagcctgcatgaaccccgctcgcgcctttggacctgccgtgatggctggctactgggacttccattggatctactggctggggcccctcctggctggcctctttgtgggactgctcattaggctcttcattggagatgagaaaacccgcctgattctaaagtcgaggtgaagaactgctggcagcatccccactgcctggagtcctcagctgtttgtcctgagttgaggacaggacaattccattattttctgcaggacctgagctcagaggagccactctgacagcagcagaccttggcctggcttcccaggcaggcaggcagctgctgctgtcctgagcatgctcctggaacctggaactcctttgtgcccatggactgggcttggggcccagcctaaagacatgtagagaccacatagaaaaggaggacaggtctctgttcttgagaaagggcagggcatgggagagccgagcaggtggagcatgcagttgctaatgcacactgttcatttttccagccctctttcttttttactgtgttgggtttggaacccagtccatgcgtactaggtgagcactttgctacggagcctcctgttctccccaccctctttcctcttggttacactgttacagaagggctttcaggagcccaaagatntccttgcctccccagctgccaatctgactttgtaataaatggcttagtgttcctgcc

SEQ ID NO: 3438 - DNA, 1407 bp, Rattus norvegicus
  Genbank Accession No. NM_019163
atgacagagatacctgcacctttgtcctacttccagaatgcacagatgtctgaggacagccactccagcagcgtccgtagccagaatgacaatcaagaacggcagcagcatcatgacagacagagacttgacaaccctgagtcgatatctaatggccgaccccagagtaactttaccaggcaggtgatagagcaagatgaggaggaagacgaagagctgacattgaaatatggagccaagcacgtcatcatgctctttgttcctgtgaccctctgcatggtcgttgtggtggccactatcaagtcagtcagcttctacacccggaaggatgggcagctaatctataccccattcacagaagacaccgagactgtaggccagagagccctgcactcgatcttgaatgccgccatcatgatcagtgtcatcgtcgttatgaccatcctcctggtggtcctgtataagtacaggtgctacaaggtcatccatgcctggcttattgtttcatctctgttgttgctgttctttttttcattcatttacttaggggaagtattcaagacctacaatgtcgccgtggactatattacggttgcactcctgatctggaattttggtgtggtcgggatgattgccattcactggaaaggcccactccgactgcagcaggcgtatctcattatgatcagtgccctcatgtccctggtatttatcaagtacctccctgaatggaccgcatggctcatcttggctgtgatttcagtatatgatttggtggctgttctgtgccccaaaggtccacttcgtatgctggtcgaaacagctcaggaaagaaatgagactctctttccagctcttatctattcctcaaccatggtgtggttggtgaatatggctgaaggagacccagaagcccaaaggagggtacccaaaaaccccaagtatagcacacaaggaacagagagggaagagacacaggacactggcactgggagcgatgatggtggcttcagtgaggagtgggaggcccaaagagacagtcacctggggcctcatcgctccactcctgagtcaagagctgctgtccaggaactttctgggagcatcctcactagtgaagacccggaggaaagaggagtaaggcttgggctgggagatttcattttctacagtgttctggttggtaaggcctcagcgaccgccagtggggactggaacacaaccatagcctgctttgtagccatattgatcggcctgtgccttacgttactcctgctcgccattttcaagaaagcgttgccggcccttcccatctccatcaccttcgggctcattttctactttgccacggattatctcgtgcagcccttcatggaccaacttgcattccatcaattttatatctag

SEQ ID NO: 3439 - DNA, 879 bp, Rattus norvegicus
  Genbank Accession No. NM_019166
cggcgcgcggtgcagccacgatggaagggggtgcgtacggagcgggcaaagccgggggcgccttcgacccctacaccctggtgcgacagccacataccatcctgcgcgtcgtgtcttgggtcttctccattgtggtcttcggctccattgtgaatgagggctacctgaacaacccggaggaggaggaggagttctgcatctacaaccgcaaccccaatgcctgcagctacggcgtgaccgtgggcgtgttggccttcctcacctgcctggtctacctggcgcttgatgtgtacttcccgcagatcagcagtgtcaaggaccgcaagaaagccgtgctgtctgacatcggtgtctcggccttctgggccttcttctggttcgtgggtttctgcttcctggccaaccagtggcaagtctccaagcccaaggacaaccctctgaacgaagggacagacgcagcccgggctgccatcgccttttcgttcttctccattttcacgtgggcgggtcaggccgtgctagccttccagcggtatcagattggcgccgactcggccctcttctcccaggactacatggatcccagccaggactccagcatgccttatgcaccctacgtggagcccagtgctgggtcggaccctactggcatgggtggcacctaccagcatccagccaacgccttcgatgctgagccccagggctaccagtcgcagggctactgagccccccctgatggtggtgacagtgaccgcctaccctgcccctgcccttacatcctagctcccctcccaagcaccctgctccctcccaggtgaccctgcctcgcacatgctcagcctccaagtgattccactgaggcccagtgcagctggggtg

SEQ ID NO: 3440 - DNA, 1018 bp, Rattus norvegicus
  Genbank Accession No. NM_019169
gtgtggagcaaagatacatctttagccatggatgtgttcatgaaaggactttcaaaggccaaggagggagttgtggctgctgctgagaaaaccaagcagggtgtggcagaggcagctgggaagacaaaagagggcgtcctctatgtaggttccaaaactaaggagggagtcgttcatggagtgacaacagtggctgagaagaccaaagagcaagtgacaaatgttggaggggcagtggtgactggtgtgacagcagtcgctcagaagacagtggagggagctgggaacattgctgctgccactggttttgtcaagaaggaccagatgggcaagggtgaagaagggtacccacaagagggaatcctggaagacatgcctgtggaccctagcagtgaggcttatgaaatgccttcagaggaaggctaccaagactatgagcctgaagcctaagaatgtcgttgcacctactgtcctaagatctgcccaggtgttcttccatggcgtacaagtgctcagttccaacgtgcccagtcatgaccttttctcaaagctgtacagtgtatttcaaagtcttccatcagcagtgatcggagtcctgtacctgcccctcagcatcccggtgctcccctctcactacagtgaatacatggtagcaggctcttgtgtgctgtggatattgttgtggcttcaaacctaaaatgttagaagaaacttaaaacacctaagtgactaccacttatttccaactcttcaccgtttttggttgctgttctcaagaagttgtgatttgctataagacttttagatgtccttaatgattctttctgtctaagaagaatgatgtgctgtgaaatttgttaatatatattttaaaatatgtgagcatgagactacgcacctataaatattaatttatgaattttacagttttgtgacgtgttttattaacttgtgtttgtatataaatggtggaaattaaaataaaataaaaacattatctcattgcaaaaaaaaaaaa

SEQ ID NO: 3441 - DNA, 1018 bp, Rattus norvegicus
  Genbank Accession No. NM_019170
cagctgcagagtttaccccaggttctttggtctccgacggcctttctacgcacacgcagccatgtcttccgacagacccgtggcactggtgactggtgctaacaaaggaatcggattcgcgatcgtacgtgatctctgtcgtaaattcttgggggacgtggtcctcacggcgcgggacgagtcacggggccacgaggcggtgaagcagctgcagaccgagggcctgagcccacgcttccaccagctggacatcgacaacccgcagagcatccgcgcgctgcgtgactttctgcttcaggagtacggaggactgaacgtgctggtcaacaatgcgggcatcgccttcaaagttgttgaccccacccccttccacattcaagcagaggtgacaatgaaaaccaacttttttggtacccaagatgtctgcaaggagctactccctataataaaaccccaaggcagagtggtgaatgtatcaagcagcgtgagtctcagggccctgaaaagctgcagcccggagctgcagcagaagtttcgaagtgagaccatcactgaggaagagctggtggggctcatgaacaagtttatagaggatgcaaagaaaggagtccatgcgaaagaaggctggcccaatagtgcatatggggtcaccaagataggggtgacagtcctgtccagaatctatgccaggaaactcaatgaggagaggagagaggacaagatcctcctgaatgcctgctgccctgggtgggtcagaaccgacatggcaggaccaaaagccaccaaaagcccagaagaaggagcagagacccccgtgtacttggcccttttgcctccaggtgcagaggggcctcacgggcagtttgttcaagataaaaaagttgaaccatggtgaatccaactctcacccccaccccttctatcctgacttggtgaaagccaagggacatttataatataccatcacttctggaaaaataaacataactaagtctttaagcacacaacaggtgtttgc

SEQ ID NO: 3442 - DNA, 1097 bp, Rattus norvegicus
  Genbank Accession No. NM_019180
ggagagaggagccgagacagccaagatgctgaagctgctgctgctgctggcactgtcccccctggctagtctggtgcacgcggccccttgcccagtcaagcagcgagtgggcattgtgggaggacgagaggcttctgaaagtaagtggccctggcaggtgagcctgagatttaaattcagcttctggatgcatttctgtggcggctccctcattcacccacagtgggtgctcactgcggcacactgtgtgggactgcacatcaaaagcccagagctcttccgtgtacagcttcgtgagcagtatctatactatgcggaccagctactgactgtgaaccggaccgttgtgcacccccactactacacagtcgaggatggggcagacattgccctgctggagcttgagatccctgtgaatgtctccacccatatccaccccatatccctgccccctgcctcggagaccttcccctcggggacttcttgctgggtaacaggctggggcgacattgatagtgacgagcctctcctgccaccttatcctctgaagcaagtgaaggtccccattgtggaaaacagcctgtgtgatcggaagtaccacactggcctctacacaggagatgatgttcccattgtccaggatggcatgctgtgtgctggaaataccaggagcgactcctgccagggagactcagggggcccactggtctgcaaagtgaagggtacctggctgcaagcaggagtggtcagctggggtgagggctgcgcagaggccaatcgtcctggcatttacacccgggtgacgtactacctggactggattcaccgctatgtccctcagcgttcctgagacccatccagggtcagggaagaaccaggcacctgctgtctttaactcactgcttcctggccagatggaaccctggccttctttgtactctgtctcccctgtctaccgggtgtccctctgagcccccactttgttccaccttgagtccctcgccactcctgtcccctctgcctcccaccacaacacagctgcactgtgcggctccctcttttctgtggctcattaaagtatgtgaaaattttgctcc

SEQ ID NO: 3443 - DNA, 1856 bp, Rattus norvegicus
  Genbank Accession No. NM_019184
gtctccctgagaaggctgccatggatccagccctagtcctggtgctcactctctcctctctgcttctcctctcactctggagacagagctttgggagagggaagctccctcctggtccaacacctctcccaatcattggaaacacccttcagatatatatgaaggacatcggccaatcaataaaaaagttttcaaaagtctacggccctatatttactctgtatttgggcatgaagccctttgtggtgttgcatgggtatgaagctgtgaaggaagctcttgttgatctaggagaggaattttctggaagaggcagttttccagtatctgaaagagttaacaagggccttggagtcatttttagcagtgggatgcaatggaaggagatccggcgtttctccatcatgaccctgaggacttttgggatgggcaagaggaccattgaggaccgtattcaagaggaggctcagtgccttgtggaggaactgaggaagagcaaaggtgccccttttgatcccacctttatcctgggctgtgctccctgcaatgtgatatgctccattattttccagaatcgccttgattataaagatccgacttttcttaacttgatgcacagatttaatgaaaacttcaggcttttcagctccccatggctacaggtctgcaatactttccctgccattattgattacttccctggaagtcataaccaagtacttaagaatttcttctatataaaaaactatgttttggagaaagtaaaagaacaccaagagtccttggacaaggacaatcctcgggacttcattgattgtttcttgaacaaaatggaacaggaaaagcacaatccgcagtctgagtttacccttgaaagcttggtggctactgtaactgacatgtttggagctggcacagaaacaacaagtaccactctgaggtatggactcctgctgctgctgaaacacgtggatgtcacagctaaagtccaggaagagatagaacgtgtaattggcagaaaccggagcccctgcatgaaagacaggagccagatgccctacacggatgctgtagtgcatgagatccagagatatattgaccttgtccccacaaacctgcctcatttagtgacacgtgatataaaattcagaaactacttcattcccaagggtaccaatgtgatagtatcgctgtcatccatactgcatgatgacaaagaatttcctaatccagagaagtttgaccctggtcactttctagatgagagaggtaactttaagaagagtgactactttatgccattctcagcaggaaagaggatatgtgcaggagaagccctggctcgcacggagctgtttttgttcttcaccaccattttacagaattttaacctgaagtctctggttgatgtaaaagacattgacacaacaccagctatcagtggatttggccatttgccccctttttacgaggcttgttttattcctgtgcaaagggcagactctctaagctctcatctgtaatgtctcttctgagggtcctgtctacttcattcttggtactatagtagctttaactcacatatccccatttccttcggatccagtgaacatcaaacctcattgagttgagttccctgagtcaatatatagttctattcctgttccctatatcttgtgacgttccctatatcttgtgacattcccatgcagtacttacatagttagtgctaatacttgtatgacttcattactgttaatactgttttcactatataaaagcaaaatattttagaatatgagaattcagagtcatctgttcccttcatgtgctaaataaatactaatttttggacc

SEQ ID NO: 3444 - DNA, 1067 bp, Rattus norvegicus
  Genbank Accession No. NM_019186
acggaggaccgtcagccagcaatcgcgtagctcgatcgatcacccaggaagagaaattgtaagcagataagaagaacgcgttcggtttgggacaccatttgcagctggaaatggggaatggactgtcagaccagacttccatcctatccagcctgccgtcctttcagtcctttcacattgttattctgggtttggactgtgctggaaagacaacagttttatacaggctgcagttcaacgaatttgtaaatactgtacctaccaaaggatttaacactgagaaaattaaggtaaccttgggcaattccaaaacagtcacttttcacttctgggatgtaggtggtcaagagaaattaagaccactgtggaagtcatatacccgatgcacagatggcattgtgtttgtggtggactctgttgatgttgagagaatggaagaagccaaaactgaacttcataaaataactaggatatcagaaaatcagggagtccctgtgcttattgttgctaacaaacaagacctgaggaactcactctctctctcagagatcgagaagttgttagcaatgggtgaactgagctcatcgactccttggcatttacagcccacctgtgcaatcataggagatgggctaaaggaaggacttgagaaactacatgatatgataattaaaagaagaaaaatgttgcggcaacagaaaaagaagagatgaatggcagtacttttatatcggtgtggaataggttttacttggtctgatttctgacaagctgaagagtgtctacagcctggtttgcctgtctgccctcacggatgctattaaagctttgttttgttgaacagtcagatacccaactctgttgccttgtggaagatgagtaaatgcaatgcttcttaaaggggtctcttctccgtgacccacaaatcttttggtactaccattttgggaagccaaaaaaggctagtaattgaccagaaaacaattttgtggaaatttgacctgaagttagtgaaataaaactttgaagagtgtaaaaaaaaaaaaaaaaaaaaaaaaaaaaaaaaa

SEQ ID NO: 3445 - DNA, 1058 bp, Rattus norvegicus
  Genbank Accession No. NM_019187
cattaaaatgtggcttagatcttacaggataacgttttcctgtttgaccagactaaaaacttacaggtcctcttggaagaaattatacagtacttcacaaacagttgacagcaaggaggtcaaaaccttccaggccctggctcactcatggtgggatgagcaagggaagtttgcgcctcttcattctatgaatgacctacgggtgccgttcattagagacaatcttttgaaaacaagtactaatcatgatccaggaaagcctttatctgggatgaagattctcgacgttggctgtggcggtgggttattaactgaacctctagggagactgggagcttcagttgttggaatcgatcctgtggctgaaaacattaagatagcacagcaccataaatcatttgatccagtcctggataagaggatacagtaccgagtgtgctccctggaggagaccttgaatgagaatgcagagtgttttgatgctgtcgtggcttctgaagtggtcgagcatgtgaacaaccttgaaatgttcatacagtgctgctatcaagtattgaaacctggtggctctttattcattactacagtgaacaaaacacagctgtcctatgtcttgggaattgttttctcagagcaaattgcaggcattgttccaaaaggcactcatacgtgggagaagtttgtttcacctgaaaagctagaaagcatcttggaaccaaatggtctgtcagttgaaactgtggcaggaatggtctataaccctttctcaggttactggcattggactgaaaataccagccttaactatgcagcccatgctgtgagagccagggctcaggaacacctggagcctgctgagtctgcttgaaagggggaagcagaagcaccccatgccaaagtctccggcagcccaagtgtgcacgaggggcagagaaaatgagaaagctctgaggacagcagtaaatatgcttgaagttgtgttgtttacaaatccaaacatcttactccttttcgggagggattctgaagaacaaaaggtcaataaaaatatctaaatc

SEQ ID NO: 3446 - DNA, 2113 bp, Rattus norvegicus
  Genbank Accession No. NM_019191
gggcagcgcggagcccgtcggaagaggaaggaacaaaaggtccggggcccggctcggacgggccgggaccaggcgctgggtgcagggtagatttaccaggctgtttctgagtgtggattgttacccttggtaagaaaatgtcgtccatcttgccattcactccgccagtggtgaagagacttctgggatggaaaaaatcagccggtgggtctggaggagcaggtggtggagaacagaatggacaggaagaaaagtggtgtgaaaaagcagtgaaaagtctggtgaaaaagctaaagaaaacaggacgattagatgagcttgagaaagccatcaccactcagaattgcaatactaagtgtgtcaccataccaagcacttgctctgaaatttggggactgagtacagcaaatacggtagatcagtgggacacaacaggcctttacagcttctctgaacaaaccaggtctcttgatggtcgtcttcaggtgtctcatcggaaagggctgccacatgttatatattgccggctgtggcgctggccagaccttcacagccatcatgagctcaaggcgatcgagaactgcgaatacgctttcagtctgaaaaaagatgaagtgtgtgtgaacccttaccactaccagagggtggagacaccagtcttgcctccagtcttggtgcctcggcacacagagattctaacagaactgccgcctctggatgactatacccactccattccagaaaacacaaatttcccagcaggaattgagccacagagtaattacatcccagaaacaccaccacctggatatatcagtgaagatggagaaactagtgaccaacagttgaaccaaagtatggacacaggctctccggctgaactgtctcctaccactctctcccctgtcaatcacagcttggatttgcagccagttacttattcagaacctgcattttggtgttcaatcgcatattatgaactaaaccagagggttggagagaccttccatgcgtcacagccctcactcactgtagacggctttacagatccatcgaactcggagaggttctgcttaggtttgctctccaacgttaacagaaacgctactgtagaaatgaccagaaggcatataggaaggggagtgcgcttgtattacataggtggggaagtgtttgccgagtgcctaagtgatagtgcgatctttgtgcagagccccaactgtaaccagagatacggctggcaccccgcgacagtgtgcaaaatcccaccaggctgtaacctgaagatcttcaacaaccaagaatttgctgctcttctggctcagtctgttaaccagggttttgaggccgtttatcagctgactcgaatgtgcaccataagaatgagcttcgtgaaggggtggggagcagaataccggaggcagacagtaacaagtactccttgctggattgaacttcatctgaatggccccctgcagtggttggacaaagtattaactcagatgggatccccgtcagtgcgatgctcaagcatgtcctaaagtccgtcagcagtggagctcattggaagacttaacgtaccaactcctccgccacagtactcgtgtgtgatcccgtggactgtgctagtcaaaacccagagcgaaaacagcacttgaggtctcatcagttaaagcaccttgtggagtctgtttcctacatttgaattttagatgggaaattagtgtctagaaatgccctcccagaggggacaaagaagacttaaagacttaatgatgtctcgttgggcataagacagtgtcccaaaggttattaataccagtagtagttgtgtacagtaacgtgtccagacccagtattgcagtgctctgctgtttgtataccttcttagtgtgcataaatgaggtgtgtgctgctgcttggtctaggcaagcctttataaaattacagtacctaatctgttattcccacttctccgttatttttgtgtcttttttaatatataatatatatatcgagattttcaaattatcatttagaagcagattttccttgtagaaactaatttttctgccttttaccaaaaataaactcgtgggggaagactcgtgcc

SEQ ID NO: 3447 - DNA, 1053 bp, Rattus norvegicus
  Genbank Accession No. NM_019195
gcggcgaccccccggcggcgcggagatgtggcccttggcggcggcgctgttgctgggctcctgctgctgcggttcagctcaactcctgcttagtaaagtcaaatctgtagagttcacgtcatgcaatgacactgtggtcatcccttgcaaagtccttaatgtggaggcccaaagcaccgatgaaatgtttgtgaagtggaagttgaacaaatcgtatattttcatctatgatggaaataaaaatagcactactagagaacaaaactttaccagtgcaaaaatctcggtctcagacttgctcaaaggcattgcctctttgacaatggatacccatgaggctgtggtgggaaactacacctgtgaagtgactgagctttccagagaaggcaaaacagttatagagctgaaaaaccgcccagtttcgtggttttctacaaatgaaaagatcctcattgttattttcccaattttggctatactcctgttctggggaaagtttggtatattaacactcaaatacaagtccagccatacgaataagagaatcattctgctgctggttgccgggctggcactcacactcatcgtggttgttggcgccatccttttcatcccgggagagaagcccgtgaagaacgcttctggtcttggcctcattgtaatctccacaggaatattaatactgcttcagtacaatgtgtttatgacagcttttggaatgacctctttcaccattgccatattgatcactcaagtgctgggctatgtccttgctgtggtcgggatgtgtctctgcatcatggcttgtgaaccagtgcacggcccccttttgatttcaggtttgggaatcatagctctagcagaattacttggactagtttatatgaagtttgtcgcttccaaccagcgaactatacaacctcctaggaataactgaagggaagtgacggactgtaacttgaaagtcagaaatggaagaatacagttgtctgagcaccatggccttcacaactcacagctggaaggaacacacaacagtgactgactttcatc

SEQ ID NO: 3448 - DNA, 2430 bp, Rattus norvegicus
  Genbank Accession No. NM_019201
acgaggcgcggctggcggcgcggtggcggctcggcacggcggtggccggtcgcaggcggccgggcggaatagcagactgcgccgaagccgccccaggcgcagggctcgcggcggcggagagcgccggactcatcggggcccgcggccacccgcgcctttcaatgggcagctcgcacttgctcaacaagggcctgccgctggtaagactttgaacccgacgcaggcttcagtggctgctgtggagcagaagcctgagagctttggttggagacaataagacgtgggatgaggctccgtgacagaacgcggttcggcctggggattctgaagacaaaaagctttggacaggcgaattcatggtcgtggaaaccccgccccaattaagcaatgtcaggcgtccgacctcccatcatgaacgggcccatgcacccccggcccctggtggcgctgctggatggccgggactgcacagtggagatgcctatcctgaaggatgtggccacagtagccttctgtgatgcgcagtccacacaggagatccatgagaaggtactgaatgaggcagtgggcgccctgatgtaccataccatcacactgaccagagaagatctggagaagtttaaagctctcagaatcatcgtccgaattggcagcgggtttgacaacatagacatcaagtcagctggtgatctaggcatcgcagtgtgcaatgtaccagcagcatctgtggaagaaacagcagactccaccctgtgccacattctgaacctataccgacgaactacctggctacaccaggcacttcgggaaggcactcgggtccagagtgtagagcagatccgagaggtggcttcaggagctgccaggatccgtggagagaccttgggcatcattggactaggtcgtgtgggccaggcggtggcacttcgggcaaaggcttttggcttcaacgtcctcttctatgacccatacctatctgatggaatcgagcgggccctggggctgcagcgtgtgagcacactgcaggacctgctcttccacagtgactgcgttaccctgcattgcggcctcaatgagcacaaccaccacctcatcaatgacttcacagtcaagcagatgagacaaggagccttcctggtgaacacagcccgtggtggcctggtggatgagaaggcactagcccaggccctgaaggaagggcggatccgtggcgcagcgctggacgtgcatgagtcagagcctttcagctttagccagggacccttaaaggatgcacccaacctcatctgcaccccccatgctgcatggtacagtgagcaggcgtccattgagatgcgagaggaggcagcccgggaaatccgacgagccatcacaggccggatcccagatagcttgaaaaactgtgtcaacaaggaccacctgacagctgccacccactgggccagcatggaccctgctgtggtgcaccctgagctcaatggggctgcctacagcaggtaccctccaggtgtggtgagtgtggcccccactggcatcccagctgctgtggaaggtattgttcccagcgccatgtccctgtcccatggcctgccccctgtggcccacccaccccacgctccttctcctggccagactgtcaagcctgaggcggatagagaccatacgactgaccagttgtagcctgtgaggagctctccagccttgacacctggtggagggagctgcacacccttggacccaagtgtgcagaggtgacatccagtgtggccctagcactccagagactggcccgggcgtgcaccaggcggggcaagaggaagcacgtccccaagttgattgtagttgtcccgtcctgtgggctggctcactgtcctgtgtcctttgcgttcctcgtttaagcaaaagaagttagtagctaattctatcacgaatgttcttgtctgtgtacagtttttagaacattaccaaggatttgtttgcttagctgtcaacaaaaagaaaacctgagggagcattcagcaagtcagtttgagattatttttccttttctacgttggaacgtgccccggaatgtggccgtcggcacacttctcaggacaatgaatccttcctgtttttctttttatgccacacagtgcattgtttttctatctgcttgtcttatttttagaataatttagaaaaacaacaaaggctgtttttcctaattttggcatgaaccccttgttccaaatgaagacggcatcgcgagtggctctgaggtgtgtctgcagtgcccagtgtgctcaggaccatcggggtctgtcctggggaaggcaggggttggcagacccttgcctacgtggtgccgtcctgctgatgtggtaggctagcaatattttggttaaaatcatgtttgtgactgtaaccatttgtatgaattattctcgt

SEQ ID NO: 3449 - DNA, 2158 bp, Rattus norvegicus
  Genbank Accession No. NM_019204
ccccagcctgcctaggtgctgggagccgggagctggattatggtggcctgagcagccgacgcagccgcaggagctgggagtccctcacgctgcaaagtccgcctggaagaccctgaaagctgcaggctccgatagccatgcccgcccctcccagccccacaaggggcccgatccccccgctgaggctggcggtcgccgtccagatgtagctgggtcccccggatcgccatcgtcctcttctctcgtgcgctacagatttctcctgcccactctccaccgccgggagcaggaactgagcgaggggcctgcagactctgcagtcctgatgcccccgaggccgctctcctgagagaagccaccaccacccagacttaggggcaggcaagagggacagtcgccaaccggagccacaaggcccgggctcaccatggccccggcgctgcgctggctcctgctatgggtgggctcgggaatgctgcctgcccagggaacccatctcggtatccgactgccccttcgcagcggcctggcagggccacccctgggcctgaggctgccccgggagacggacgaggaacctgaggagcctggccggagaggcagctttgtggagatggtggacaacctgaggggaaagtccggccagggctactatgtggagatgaccgtgggcagccccccacagacgctcaacatcctggtggacacgggcagtagtaattttgcagtgggggctgccccacaccctttcctgcatcgatactaccaaaggcagctgtccagtacataccgagacctccgaaagtctgtgtatgtgccctacacccagggcaagtgggagggggaactgggcactgacctggtgagcatccctcatggccccaacgtcactgtgcgtgccaacattgctgccatcactgaatcggacaagttcttcatcaatggttccaactgggagggcatcctagggctggcctatgctgagattgccaggcctgacgactccttggagcccttttttgactccctggtgaagcagacccacattccgaacatcttttccctgcagctctgtggcgctggcttccccctcaaccagactgaggcactggcctcggtgggagggagcatgatcattggtggtatcgaccattccctatacactggcagtctctggtacacacccatccggcgggagtggtattatgaagtgatcattgtacgtgtagaaatcaatggtcaagatctgaaaatggactgcaaggagtacaactatgacaagagcatcgtggacagtggcaccaccaaccttcgtttgcccaagaaagtatttgaagctgcagtcaagtccatcaaggcagcctcctcgacggagaagttcccggatggcttttggctaggggagcagctggtgtgctggcaagcaggcacgaccccttggaacattttcccagtcatttcactttacctcatgggtgaagtcaccaatcagtccttccgcatcaccatccttcctcagcaatacctacggccagtggaagatgtggccacgtcccaagacgactgttacaagttcgccgtctcacagtcatccacaggcaccgttatgggagcggtcatcatggaaggcttctatgtggtctttgatcgagcccgaaagcgaattggctttgctgtcagcgcttgccatgtgcacgatgagttcaggacggcggcagtggaaggtccgtttgtcacggcagacatggaagactgtggctacaacattccacagacagatgagtcaacacttatgaccatagcctatgtcatggctgccatctgcgccctcttcatgttgccactctgcctcatggtatgtcagtggcgctgcctacgctgcctgcgccatcagcatgatgactttgctgatgacatctccctgctgaaataaggaggccagtgggcagatgacagagatccccctggaccacatctgggtggttccctttggtcacgtgagttggagatatggatggtacctgtggccagagcacctcaggaccctcaccaacctgccgaatgcttctgccttgacagaaaagagacacttggcaagctggattacagggcttgcaagggctgtttgaaacaggagggagaaagcagcattctggtg

SEQ ID NO: 3450 - DNA, 4301 bp, Rattus norvegicus
  Genbank Accession No. NM_019206
ggcacgagaagtcggaccctcccaccctgctcacaccctccaagtggtccacggagttccgagactttctgaagatagccttggataagaacccagaaacccggcccagtgctgcgcagctgctgcagcatcccttcgtcagtacagtcaccagtaataaggcccttcgggagctggtggctgaggcgaaggctgaggtgatggaggagatcgaggacggcaaggaggacggcagggaggacggcagggaggatgggaaagaggaggattgagacgagaaggatgctgtgagtgctgttccgcccccagtcaaccacactcaggactcctctgccaatggaactcagccaagcctcaactctgacaagcttctccaggattcttctacccccctgcctcccagccagcctcaggagcctgtgaacgggccctgtaaccaaccctcaggggatggatccccccagaacaccagccctgcagatgaggtctccaagaatgacaatggcttaaaggtacctgttcccctccggaagtcccggccattgtccgtggatgccagaattcaggtgaccgaagagaaacaaatcactgaccaggctgagaaccccagttctgcagccagcaaacccccgaaggtcaaccagagccgacctaacagcagcgccctggagactttgggtgtcgagactctggccaatggaggcctggagctccctggctctgtaactccaaaccattctaagagggcgtcggactgtagcaacctgtctacctcagagagcatggactacggcacctccttgtctgctgacctgtcattgaacaaagagacgggctcattgtctctcaagggctcaaaactgcacaacaagaccctgaagaggacccgccggtttgtggtggacggtgtggaggtgagcatcaccacctccaagatcatcagcgaagacgagaagaaagacgaggagatgaggtttctcaggcgccaggaactccgagagcttcggctcctgcagaaagaagagcatcggaaccagacgcagctgagcaccaagcacgagctgcagctggagcagatgcacagacgatttgaacaagaaatcaacgccaagaagaaattctatgacgtggagctagagaacctggagcggcagcagaagcagcaggtggagaagatggagcaggaccacagcgtgcgtcgcagagaggaggccaagcggatccgcctggagcaggatcgagactacgccaggttccaagagcagctcaagcagatgaagaaggaggtgaagaatgaggttgagaaactgccccggcaacagcggaaggagagcatgaagcagaagatggaggagcacgcacagaagaaacaactgctggaccgagactttgtagccaagcagaaggaagacctggagctggccatgaagaagctcacggcagaaaacaggcgtgagatctgtgacaaggaacgtgattgccttaacaagaagcaggagctcctccgagaccgagaggcagccctgtgggagatggaggagcaccagttacaggagagacatcagctggtgaagcagcagcttaaggaccagtacttcctgcagcggcatgacctgctgcgcaagcacgagaaggagcgggagcagatgcagcgctacaaccagcgtatgatggagcagctgaaggtcagacagcagcaggagaaggcgcggctacccaagatccagaggagtgacggcaagacccgcatggccatgtacaagaagagcctgcacatcaatggtgcgggcagtgcctccgagcagcgggagaaggtcaagcagttctcccagcaggaagagaagaggcagaaggcggagaggctgcagcagcagcagaaacacgagaaccagatgcgagacatggtggcacagtgcgagagcaacatgaacgagctgcagcagctgcagaatgaaaagtgtcatctgttagtggagcatgaaacccagaagctgaaggccctggacgagagccataaccagagcctgaaggaatggcgagacaagcttcggccacgcaaaaaggccctggaagaggatttgaaccagaagaagcgggaacaggaaatgttcttcagactaagtgaggaggcagagaccagacccaccacacccaacagagccagcaagttcttcccctacagctctggggatgcttcctaacacacacatgcctgggctgcggtgcggcagtacagccaccagggccaccaaccctctacaaacaagtgactcaggacctcttcctcttgcttctgtgccagctccaactacccagcaccccagttgcccacagcaccaccccagtgcttctgatggatgacctcatcccaactcagattcccatcacctggaagtgacctgggctgttggggtccgggaccgagcgggatgggcgtacccctcctgtttgccaaaacaccagctctactgtctgtgggcacaagcgctactgatgacatcaccacgaacccatccttattgtgatccttgtggttttttcttctccttcagtaattcctcacagtgttggaaaacatccctcagagccattttgcttctcagcagccagctctcaggggtgtccccattaccctgcttcgcacagctgactttgtgctcgatgagacgctgtgtatgtgggggtagggagtggggaaagggaggccagaaatgttcattctgctggtttctgacattttatgccatctcattttgcctctccctgtcacacacacacacacacacacacacacacacacacacacacacacacacacaatgcaaacacacaacttggccctcctgaacctgatcgtaggacacggagtacagagcatgtcaggtggagcagctgctggggcatgctgagtgctggccccaaagcccagagaaggcacaggctgtactgcagcctgcctgccactcgtttggctgcacacaggatcctgtgttcaggggtaaactcccctccacacttgtcttctgctgcctagcgcatgccaatctcgcccttgcccagttgttggcaagtactggggaaggctcctgacctttgacctttgccccagtcctgcactggagtcccactgtacatttccactaagccggacagtcctttggacttctctgtttaggaagagatgcttcccacccctgggaacagccgaagctcaggaaaatgccaagcctcgtgcctgggcctttgggttgctcaggtagcctcccaagatgctgcgccccataggctaccatgcccagaaaagcagctggtcggcccagccggcgttcgctgatagcgccttagggctcagttaaagcacaggtaaatggctggctgctttgtataccctccttttagacagcatcaccccagggattaggatgggatgggtgggggcggggcacccaggcagtggagtctgggagtggctgagacctcagcagtatttccccatcactgccccatgctgagacaaccttctaggacgtttcctcagatgctgactgggtgcttgggaggggagtgggctagtaaaacaaaataggaaaacaggtcttgggactcccagatcttgtgtgcagtaaggaagttcacagagccccaggaaggcgatagttctcagggtagcgagcgtcagcttgctttcaggccgcacaccgaggagtcttgaggaacagttgacttctttcttactggtgcatgggggctgggaaacacaagttgtcagagtgcagctgtgggactcagagatgggaagtgggcaaggccacgccctgcagggctctaccattgtttacaatgtacttggctgcattcgggggtggggggaacttgacagtggctattaggcaaaatgccggttttgtggttcaggtaacagtctttgaccactccctgacgtcattcgtactgtcctcctccttgttgcttccacacttagtcccacctgagctctggtacctctgctgtgccttttttgagtggggtctagccttgtcttccagcctcataatttaacctaagtgcaatgcctgccaccgacaaaggcccgtgaagtattcctcatgtcctgtgctaacgttttctgtataggaacaggcagaaatgtctttagcaccgcggatataactaacttatatttcccttcacgaaggatagaagtaacgggtgtgtcatttccaacggtcatgtataatttttgtaaactgttctctgcaaacaaaaaaaatgtaaatatgcttctaataaaataataaggt

SEQ ID NO: 3451 - DNA, 897 bp, Rattus norvegicus
  Genbank Accession No. NM_019213
cggcacgaggacgagagcacccgggaagagtcggcgccgctagtgccgggaccaggagcctccgcgagcaagatggccgctcccgagaccgaggccagggggcaggggtactaagtccggacccgcgtgcccttctcccggccgcctgcgccctcatcaagacctcgcgcttctagccaagacatctacatggattattctcgccgtggtcacgaggccgttccaatagagctctagttggcccagattgagaactctggcatttggctgctctgagctggaacctccgggaggtctgctgcaacaggtgcgaccctgaccgctccatgctcgtgggcgcggggaggcgtggcctcccccggggcggccacctctgttggttgctgtgcgctttcaccttaaagctctgcgaagcagaggccccggtgcgcgaggagaagctatcagtgagcacatcaacttcaccatgttggttggtagaagagtttgtggtgaccgaagagtgtactccgtgttctaacttccagattaaaacgacacctgagtgtggttctacagggtatgtggagaaaatcacatgcagctcatctaagaggaatgaattcaaaagctgccgttcagctcttctggaacaacacttattttggaagtttgaaggcatcgtggtgggggtagctttagtcttcgcttgccttgtcatcattcgtcagcgacagctggacagaaaggctcttgaaaaagtccggaagcaaattgaatccatatagctgaatctgctgtgtatggtgggtcccacggatgcatctcagatggagaaagttcagggctaatgtgccctcataagccttgtggtagtgcatcttcaatgactcctcttccaggccattaatgagcaca

SEQ ID NO: 3452 - DNA, 1356 bp, Rattus norvegicus
  Genbank Accession No. NM_019220
cccggagctgtcgatcggggacaaagcgcggccgcccgcgccccccgagccgcccgagccggggccagccccccgcgactgacatgatgtttccgcaaagccggcactcgggctcctcccacctcccccagcagctcaagttcaccacctccgactcctgcgaccgcatcaaggatgagttccagctgctacaagcgcagtaccacagcctgaagctggagtgtgacaagctggccagcgagaagtcagagatgcaaaggcattacgtcatgtactatgagatgtcttacggattgaacatcgagatgcacaaacaggctgaaattgtgaagaggctgaatgggatttgcgcccaggttctaccctatttgtcccaggagcatcagcagcaggtcctgggagctatcgagagagccaagcaggtcacggctcccgagctgaactccatcatccgacagcagctccaggctcaccagctgtcccagctccaggcgctggccctgcccctgacaccgctgcctgtcgggctccagccgccatccctccctgcggtcagcgcaggcacaggcctgctgtcactctctgctctgggctctcagacccacctctccaaggaggacaagaacggacacgatggggacacccaccaggaggatgatggagagaagtccgattagctcctggggagagggagggggaggggggataccaggggagacaggcacagagagcacagtgttctgagggccacactgcacacagctcggtccctacccaagcttccacctccagtcctggttccagctgtgcaccctgggcctaggagacgccagagggacagcccaggctacagggaaaattccccaccttcaacatttccccgggctacagccaccaatctcggcccagaatgtacacaacgctagccgcccctttccaccctgtgcaccccgaatttgccccctttccccttctctgcttcctgcactgcacacctgctaggcccagacccctccccccagctcacccagctctggttccctcaaccgcggaaagaaagcattggctcgggactgcagtgggggtgggcaccccacaaacttccctctccccttccccaaataaacgtgagggttaaaagtcggtttgtttattatttctttttcgtcccagtactctatagctaccatctaagagagaaaaagaaggaagccctggagcgagcgagggtctgtctgtgcatatagttagatttttctggtcgcctcgctttgcaccgagaggtggagggccgctgtactgagggtggggtctagctgtgccttcaaaataaaaacatgaaaaggtcaaaaaaaa

SEQ ID NO: 3453 - DNA, 1800 bp, Rattus norvegicus
  Genbank Accession No. NM_019222
  misc_feature (1)..(1800): n = a or c or g or t
ggagcggagagcggtgagcgacatgtccttccgaaaagttgtgcggcagagcaaattccggcatgtatttggtcagccagtcaagaatgaccagtgctatgaggacattcgagtctcccgagttacctgggacagtaccttctgcgcagtcaaccccaagttcctggcagtgattgtggaagccagtggtgggggtgcctttatggtgctccctctaaacaagacaggccgcattgacaaggcctacccaacagtatgtgggcacacaggacctgttctggatattgactggtgcccccacaatgacgaagtcattgccagtggatcagaggactgcactgtcatggtgtggcagattccagagaatgggctgacctcccctctgacagagccagtagtggtgcttgaggggcataccaagcgtgtgggcatcatcacctggcaccccacagcccgaaatgtgcttctcagtgcaggttgtgacaatgtggtgcttatctggaatgtgggcactgcagaggagctgtaccgcctagacagcttgcaccctgacctcatctacaatgtgagctggaaccacaacggcagcctcttttgcacagcttgcaaggacaagagtgtccgaatcatcgatcccaggcggggcaccctggtggcagaacgggagaaggctcatgagggggctcggcccatgcgggccatctttctggctgatgggaaggtgttcaccgctggtttcagccgcatgagtgaacggcaactggcactctgggacccagaaaactttgaggagcccatggccctgcaggagctggattcaagcaatggggctctactgcctttctatgacccggacaccagtgtggtctacgtctgtggcaagggtgattccagcatccggtactttgagatcacagatgaacctccctacatccactttctgaatacctttaccagcaaagaaccccagaggggtatgggcagcatgcctaagaggggcttggaggtcagcaagtgtgaaattgccaggttctacaaactgcatgaacgcaagtgtgagcccatagtaatgactgtgccaagaaagtctgacctctttcaggatgatctgtaccctgacacagccggacccgatgctgctcttgaggcagaggattgggttagtggtcaggatgctgatccaatcctcatctcactacgggaagcctatgtgcccagtaaacaacgggacctgaaggtcagccggcgcaacgtgctatcggacagcaagcctgccggttacagccgctccggagtctccacagctactgcaattactgacattcccagtggcaaccttgctgggtctggtgaagctgggaagctggaagaggtgatgcacggacttcgggcacttcgggtgctggtcaaggaacaaggggagcgtatcagccgcctggaggagcatctgggccgcatggagaatggggatacataggaccaccagggacctgctcccgatactgcctccttctcctccaacccttcccacctagcttctgtggccaggtcacaccaggcagtttgctgctcagtgcctctgtggcaggtcatggccagtttgcacctctccacagcctggggcncaggttggaagcaccacctggcttttggaagatttttgtaccaaggcaaattccaagtactctaagggaccatctcctcgacttgcccaacccactgccccctcactagaaaaagcagcagagatgggttctatattttcattccaaataaaagctctttctaaagccaaaaaaa

SEQ ID NO: 3454 - DNA, 351 bp, Rattus norvegicus
  Genbank Accession No. NM_019223
atggcggcggcgctgaccttccgccgtctgttggctctccctagggctgcccggggtttcggggtgcgagtgtcgctgagcggggagaagatcacgcataccggccaggtgtctgatggaaaagactacagggggattcgttttgtagatcgtcagaaagaggtgaatgagaactttgccattgatttgatagcacaacaacctgtgaatgaggtggaccgtcgtatcatagcctgtgatggagggggtggagccttgggccaccccaaggtgtatataaacctggacaaagaaacaaaaacgggtacgtgtgcctactgcggcctgcagttcaagcagcagcatcactag

SEQ ID NO: 3455 - DNA, 14279 bp, Rattus norvegicus
  Genbank Accession No. NM_019226
gcggacacagcgtcttctgtcgccggtttctttcgctcactgctccctcgttccggaggtagctcttctcggctctctctctctctcttctctatctctctcccttccgcggatccgccatgtcggagaccggcggcggtgaggacggctcggccggcctggaggtgtccgcggtgcagaatgtggcggacgtgtcggtgctgcagaagcaccttcgtaagctggttccgctgctgctggaggacggcggcgacgcgccggctgcgctggaggcggcgctggaggagaagagcgccctggagcagatgcgcaagttcctgtcagacccgcaggtccacacggtcctggtggagcgctccaccctcaaagaggacgttggtgatgaaggagaagaggagaaagaattcatttcctataacatcaacatagacattcattacggggtgaagtccaatagcttggcgttcatcaagcgagcccctgtgattgatgcagacaagccggtgtcttcccagctccgagtcctcacgctgagcgaagactcgccctacgagaccctgcactccttcatcagcaatgcagtggctcctttctttaagtcctacatcagagagtctggcaaagcagacagggatggagataagatggctccttcggttgagaaaaagattgcagagcttgagatggggctccttcacctgcagcagaacattgagatcccggagatcagcttgccaatccaccccattatcaccaacgtcgctaagcagtgctacgagcgtggagaaaagcccaaagttacagatttcggtgataaggttgaagacccaacctttcttaaccagttacagtctggagttaatcggtggatccgagaaattcaaaaggtgaccaagcttgaccgagatccagcatcaggaactgccttgcaggaaatcagcttttggctaaacttggagcgtgcattgtaccgcatccaggagaagcgggagagcccagaggtgctcctgactctggacatcttgaagcatggcaaacgtttccatgccactgtcagttttgacacagacacaggtcttaagcaggcgttggaaacggtgaatgactacaatcctctgatgaaagacttccccctgaatgacttgctgtctgccactgagctggacaagataaggcaggcacttgttgcaattttcacacatctgagaaagatccgaaacacaaaataccccattcagcgggccctgcgacttgtggaggcaatttccagagacttgagttctcagttgctcaaagtcttgggcacgaggaagttgatgcatgtagcgtatgaagagtttgaaaaggtcatggtggcttgcttcgaagtcttccagacgtgggatgatgagtatgagaaactccaagtgctgctgagggacatcgtcaagaggaagagggaggagaacctgaagatggtgtggcgcatcaaccctgctcacaggaagctgcaggcccgcctggaccagatgaggaagttccgccgccagcacgagcagctgagagctgtcattgtcagagtcctgcgcccacaggtcacagcagttgcacagcagaaccaaggagaggcacctgaaccccaagacatgaaagtggccgaggtcctctttgatgctgcagatgccaacgccatcgaggaggtgaacctggcctatgagaacgtcaaggaagtagatgggctggatgtttccaaagaagggacggaggcttgggaggctgcaatgaagagatacgatgagaggatcgaccgcgtggagacccgcatcactgcccgcctccgagatcagctcggcacagccaagaatgccaatgagatgttcaggattttctccaggttcaacgcactgttcgtccgcccacacatccgaggggccattcgtgaataccagacccagctgatccagcgtgtaaaagatgacattgagtctctgcacgacaagtttaaggtccagtacccacaaagccaagcttgtaaaatgagtcatgtccgcgacttgccccctgtgtcagggtctatcatctgggctaaacagattgaccgacagctcactgcctacatgaagcgagtggaagacgtcctgggcaagggttgggagaaccacgtggaagggcagaagctgaagcaggatggtgacagctttcgaatgaagctcaacacccaggaaatcttcgatgactgggcgaggaaggttcagcaacgcaaccttggtgtttccgggcgcatcttcaccattgagagcgctcgcgtgcggggccgctctggaaacgtcctcaagctaaaggtgaacttccttccagagatcataacactctccaaagaagtccggaacctcaagtggcttggcttccgcgtgccacttgcaattgtgaacaaggctcaccaagccaaccagctctacccatttgccatctcgctgattgaaagcgtccgcacttacgaacgtacctgtgagaaggtggaggagcgcaataccatttcactgctagtggccggcctgaagaaggaggtgcaagccttgatcgcagaaggcatcgcgttggtgtgggagtcctacaaactcgacccctatgtgcagcgcctggcagagacggttttcaacttccaagagaaggtggacgacctcctgattatcgaggagaagatagacctggaagtccgttccttggaaacctgcatgtatgatcacaagacattctctgaaatcttgaacagagtgcagaaagcagtggacgacctcaacctgcactcctactccaacctgcccatctgggtcaacaagctggacatggagattgaaaggatactgggtgtccgcctgcaagctggccttcgagcttggacccaggttctcctcggacaagctgaagataaagcagaggtagacatggacaccgatgctccacaagttagtcacaagcctggtggagagcccaagatcaaaaacgttgttcatgagctaagaataacaaatcaggtaatctatttgaatccacccatcgaagagtgcaggtacaagctataccaggagatgtttgcttggaagatgattgtgctgtccctgcccaggatccagagtcagaggtaccaggtgggagtgcattatgagttgaccgaggaagagaagttctatcggaatgccttgacacgcatgcctgacggccctgtcgcactggaagagtcctactcggcggtcatgggcattgtgactgaagtcgagcagtatgttaaggtttggcttcagtaccagtgtctgtgggacatgcaggcagagaacatttacaacaggctgggggaggacctcagcaagtggcaagcgctcctggtgcagatcaggagagcccgagggaccttcgacaatgccgagaccaagaaggagtttggaccagtggtgatagattacggcaaggtccagtccaaggtgaacttgaagtatgactcctggcataaggaggttctcagcaaatttgggcagatgctgggctcaaacatgacagaattccattcccagatctcaaagtctcgccaagagctggagcagcactccgttgacacagccagcacctctgacgcggtgaccttcatcacctatgtgcagtctctgaaacggaagatcaagcagttcgagaagcaagttgaactctaccgcaatggtcagcgtctgctggaaaaacaaaggttccagttcccaccttcttggctttacattgacaacatcgagggtgagtggggggccttcaatgacatcatgcgtcggaaggactctgccattcagcaacaggttgcaaacctgcaaatgaagatcgtgcaggaggaccgagctgtggaaagccggactaccgatctgttgacagactgggagaagaccaaacctgtcacaggcaacctacgtcctgaggaggctcttcaggccctcaccatctatgaagggaagttcggccgactgaaggatgacagggagaagtgtgccaaggccaaggaggcactggagctcacagacacggggctcctcagcggcagtgaagaacgagtccaggtggccttggaggagttacaagacctcaagggggtgtggtcagagctttctaaggtctgggaacaaattgatcaaatgaaggagcagccatgggtctcagttcagcctcgtaagcttcgacaaaacctagacggcctcctgaaccagctgaagaacttccctgcaaggcttcggcagtacgcctcctatgagtttgttcagaggctgctgaaaggctacatgaagataaacatgttggtaattgaattgaaatcggaagcacttaaagaccggcactggaagcagctgatgaagaggcttcacgttaattgggtggtttctgagctgaccctgggccagatctgggatgttgaccttcagaagaacgaagccattgtcaaggatgtgctgctagtggcacaaggagagatggctttggaagaatttttgaagcagatacgggaagtgtggaacacatacgaactagacttggtcaactatcagaacaagtgccgtctgatccgaggctgggatgacctcttcaacaaggtcaaggagcacatcaacagcgtctctgccatgaagctctctccgtattacaaggtgtttgaagaagatgccctgagctgggaggacaagctgaaccgaatcatggctctctttgacgtgtggattgatgtgcagaggcgctgggtctacttggaaggcatcttcacaggcagtgcagacatcaaacatctgctgcctgtggaaacccagcgctttcagagtatcagcacggagtttttggctctgatgaaaaaggtctccaagtctccacttgtgatggatgttctgaacatacagggagtccagaggtctctggaaaggttggccgacctgcttggaaagatccagaaagcattaggggagtacctggaacgagagcgctcatctttccccaggttctactttgtgggtgatgaggatttgcttgaaatcattggaaatagcaagaatgtggctaagttgcagaagcacttcaagaaaatgttcgctggcgtttccagcatcatcttaaatgaggacagctctgtggtcctcggcatttcctcccgagaaggggaggaggttatgtttaaaactccagtgtccatcactgaacaccccaaaatcaacgagtggctcactctggtggaaaaggagatgagagtcaccttggccaaacttctggcagaatctgtaacagaagtggagatttttggaaaagcaacttctattgacccaaatacctacattacttggattgataaataccaggcccagctagtggttttgtcggcccagatagcctggtctgagaacgtggagaatgcactaagcaacgtcggaggaggcggagacgtggggcccttgcagtctgtgctcagcaacgtggaggtcacactcaacgtcttagcagattctgtcctcatggagcagccccctctccggagaaggaaactggagcacttgatcacagagttggttcaccaaagagatgttaccaggtccttgatcaaaagcaagattgacaacgccaaatctttcgaatggctcagccagatgcgattttactttgaccctaagcaaacggacgtgttacagcagctgtccatccagatggcaaatgccaagtttaactacggctttgagtacctgggcgttcaagacaagctggttcagacgcccctcacggaccgctgctacttgacaatgacacaggctctggaggccaggctcgggggctccccgttcggaccggctggaacaggaaagacggagtctgtcaaagccctcggccatcagctggggcgattcgtcttagttttcaactgtgacgaaacctttgatttccaggcgatgggacggatcttcgtggggctttgccaagtgggcgcgtggggctgcttcgatgagtttaaccggctggaggagcggatgctgtccgctgtgtcccagcaggtgcagtgcatacaagaggcactgcgggagcactccaaccccaactacgacaagacctcagcccccattacttgtgagctgctgaacaaacaagtcaaggttagcccagatatggctatcttcatcaccatgaatccaggctacgcaggccgctcaaacctccctgacaacctcaagaagctcttccggagcctggcgatgaccaagcctgaccggcagctgatcgcccaggtcatgctgtactcacagggcttccggactgctgaggtccttgccaacaaaatcgtcccgttctttaaactgtgtgacgagcagctgtcttctcaaagccattatgactttggtctgcgggctttgaagagcgtgctcgtgagtgcaggcaacgtgaagagggagaggatccagaagataaagagggagaaagaagagcgaggggaagccgtcgatgaaggagagatcgctgagaacctgcctgagcaggagattctgatccagagtgtctgcgagacgatggtgcccaagctcgtggcggaagacatcccgctgctcttcagtctcctgtcagacgtgttccctggggtgcagtaccaccgtggggagatgacagcccttcgagaagagctgaagaaagtgtgtcaggagatgtacttgacgtatggtgatggagaagaagttggcgggatgtgggttgaaaaggttctccagctctatcagatcacccagattaaccatggcctgatgatggttgggccttcaggaagcgggaagagcatggcctggcgtgtgctgctgaaagctcttgagaggctcgagggtgtggagggtgtggcccacataattgaccccaaggccatcagcaaagaccacctctacggaaccttggatcccaacaccagggagtggacagacggactcttcacacatgtgctgagaaagatcatagacaatgtgagaggcgagctgcagaagcgccagtggattgtcttcgatggtgatgtggaccccgagtgggtggagaacctcaactccgtgctcgacgacaacaagctcttgacattgcccaatggagagcgtcttagcctgccacccaatgtgcgaataatgtttgaggtgcaggacttgaagtatgcaaccctggccaccgtgtctcgctgcggcatggtgtggttcagtgaggacgtgctgagcacggacatgatcttcaacaacttcctggccaggctgcgcagcattcccctggatgagggggaggatgaggcacagcgaaggcgcaaaggcaaagaagacgagggtgaagaggccgcctctccaatgctgcagattcaaagagatgcagcaacgatcatgcagccatacttcacgtccaatggcctggtcaccaaggcgctggagcatgccttcaagctggagcacatcatggacctgacccgcctgcgctgcctgggctcactcttctccatgctgcaccaggcctgccgcaatgtggcccagtacaatgccaaccatcctgatttccccatgcagattgagcagctggagcgctacattcagcgctatctggtgtatgccatcctctggtccttatctggagacagccggctgaaaatgagagcagagctgggcgagtacatcagaaggatcaccactgtgcctctgcccaccgcgcccaacatccccatcattgactatgaggtgtccatcagtggagaatggtcaccgtggcaggccaaggtgcctcagattgaagtggagacacacaaggtagcagccccagatgtcgtcgtgccaaccctagatacagtccgccatgaagctctcttgtacacctggctggctgagcacaaacccctggtcttatgcggccctcctgggtctggcaagaccatgacactcttcagcgccctccgagccttgcctgacatggaggttgtgggcctgaacttctcaagtgccactacaccagagctgttgctgaagacgtttgaccactactgcgaataccggcgcacccctaacggtgttgtcttggctcctgttcagcttggaaagtggctagtcctgttttgtgatgaaatcaacttgccagatatggataagtacggtacccagagagtcatctccttcatcagacagatggtggagcatggaggcttctatcgtacctcagaccaaacatgggtgaagctagagagaatccagtttgttggagcttgcaatccgcccactgaccctgggagaaagcccctctcacataggttcttgcgccacgtgcctgttgtgtatgtggattacccaggaccagcctccctgacgcagatctatggcaccttcaaccgcgccatgctgagactcattccctcgctccgcacctatgcagaacccctcaccgcagccatggtggagttctataccatgtcccaggagagatttactcaggacacacagccacactatatctattcaccccgtgagatgactcggtgggtaagaggaatctttgaagcactgagacccctggagacattgcctgttgaaggtctcattcgcatttgggcacatgaagccctccgtctcttccaagacaggcttgtggaggatgaagagcggcgctggactgatgagaacatcgacatggttgccttgaagcatttccctaacatagacaaagagaaagccatgagccggcctatcctgtacagcaactggctgtcaaaggactatatcccagttgaccaagaggagctaagggattatgtcaaggctaggctgaaggtcttctatgaagaagagcttgacgttcccctggtcttgttcaatgaagtgctggaccatgtgctcaggattgacaggatattccgacaacctcaaggccacttgcttctcattggtgttagtggagctggaaagaccaccctgtctcggtttgtcgcctggatgaatggcttgagtgtctatcagattaaggtccacaggaaatacactggggaagactttgatgaagacctcaggacagtgctgcgacgctcgggctgcaaaaatgagaagatagcattcataatggatgaatccaatgtcttagactctgggttcctggaacgaatgaatactctgctggccaacggcgaggttcctgggctctttgaaggggacgagtatgccacgttgatgactcagtgcaaagagggagcacagaaggagggcctcatgctggactcacatgaggagctctacaagtggttcaccagccaggtgatccgcaacctgcacgtggtgttcaccatgaacccgtcctcagaggggctcaaggacagggcggccacgtcaccagcccttttcaacaggtgtgtgctgaactggtttggtgactggtccacagaagcactctatcaagttggcaaagaattcaccagtaaaatggacctggagaagccaaactatatagtgcctgactacatgccagttgtgtacgataaacttccacagcccccaacacaccgggaagccattgtgaacagctgtgtgtttgttcatcagactcttcaccaggctaacgcacgcctggcaaagcgaggcggcagaacaatggccatcacacctcggcactacctggacttcatcaaccactacgccaacctcttccatgagaagcgcagcgagttggaggagcagcagatgcacctgaacgttgggctccgaaaaatcaaagagactgtggaccaggtggaagaactgcgccgtgacctgaggatcaagagccaagagctggaggtcaagaacgcagcagccaatgacaagctgaagaaaatggtgaaagaccagcaagaggctgagaagaaaaaggtcatgagccaagaaattcaggagcagctgcacaagcagcaggaagtgattgcagataagcagatgagtgtcaaggaggatctggataaagtagagcctgctgtcatcgaggcccagaatgctgtgaagtccatcaagaagcagcacctggtggaggtaaggtccatggccaaccctccagctgccgtgaagctggctctggagtccatctgcctgctgcttggtgagagcaccacggactggaagcagatccgctccatcatcatgagagagaacttcatccccaccatcgtcaacttctcagccgaggagatcagtgacgccataagagagaagatgaagaaaaactacatgtccaaccccagttacaactacgaaatcgtcaaccgggcttctctggcttgcggccctatggtgaagtgggcaattgcacagctcaattatgcagacatgttaaagcgagtggagcccctgcggaatgagctgcagaagctggaagatgatgccaaggacaaccagcagaaagccaatgaggtggagcagatgatccgggatctggaagccagcatcgcccgctacaaggaggagtatgctgtcctcatctcggaggcccaggccatcaaggcagacctggcagctgtcgaagcgaaagtaaaccgaagcactgcacttctaaagagtttatctgctgaaagggaacgttgggaaaagacaagtgaaacgttcaaaaaccagatgtctaccattgctggggactgcctcctgtcggcggccttcattgcttatgcaggctactttgaccagcagatgcgccagaacttgttcaccacctggtctcatcacttacagcaagccaacatccagttccgcacagacattgccaggacggagtacctctccaatgctgacgagcgcctccgctggcaggccagctccctgcctgctgacgacctgtgcacagaaaacgccatcatgctaaagcggttcaataggtacccgttgatcattgacccctccggacaggccacagaattcatcatgaatgagtataaggaccggaagatcacaaggaccagcttcttagacgatgccttccggaagaatttggagagtgctctgagatttggcaatccccttctcgtccaggatgtggagagctacgatccagttttgaatccagtactgaaccgtgaagtccggcgaacaggagggagagtgctgattaccctcggtgaccaagacattgacctgtcaccatcctttgtcatctttctgtctacccgagacccaactgtggagttcccaccagatctctgttcccgggtgaccttcgtgaacttcacggtcacccgcagcagtttacagagccagtgtctcaatgaagttcttaaagcagaaaggcccgatgtggatgagaagcgttctgacctcttgaagctgcaaggggagttccagctccgtttacggcaactggaaaagtctctgctccaagctctgaacgaggtaaaaggccgcattctggatgacgacaccatcattacaaccctggaaaatctgaagcgggaagccgccgaggtcaccagaaaggtggaggagacggacattgtcatgcaggaggtagagaccgtgtcccagcagtacctgccgctgtccactgcatgcagcagcatctacttcactatggagtccctgaagcaggttcacttcctgtatcagtactcactgcagttcttcctggacatctaccacaatgtgctctatgagaaccccaacctgaagggcgccaccgatcacacacagcgcctctctgtcatcaccaaggacctcttccaggtggcctttaaccgggtggcccgaggcatgctgcaccaggaccacatcaccttcgccatgctgctggcgaggatcaagctgaaaggcaccatgggggagcccacctatgacgcagagttccagcacttcctccgagggaaggagatcgtgctgagtgctggctccacccccaaagtccagggcctgactgtggagcaggcggaagctgtggcaaggttgagctgtctgcctgcctttaaagatctcattgccaaggttcaggcagatgagcagtttggcatttggctggagagcagttcaccagagcagacagtgccatacctctggactgaggagacgcctgcaactcccatcgggcaggccatccaccgcctactcctgattcaagctttccgacccgaccgcctgctggccatggcccacatgtttgtttccacaaacctcggagagtccttcatgtccatcatggagcagccacttgacctcacccacattgtgggcacagaggtgaagccaaacacacctgtcctgatgtgctctgtgcctgggtatgatgccagcggacatgtcgaggacctcgccgcagagcagaacacacagatcacttctattgccattggctcagcagaaggctttaaccaagcagataaggcgatcaacaccgcggtgaagtcaggcaggtgggtgatgctgaagaatgtgcacctggcccccgggtggctgatgcagctggaaaagaagcttcactccctgcagccacacgcctgcttccgactcttcctcaccatggagatcaaccccaaggtgcccgtgaacctgctccgtgcaggtcggatctttgtgtttgagccgccacctggcgtgaaggccaacatgctgaggaccttcagcagcatccccgtctccaggatgtgcaagtctccaaatgagcgagcccgcttgtacttcctgctggcctggttccatgctgtcatccaagagcgcctgcgctatgctccactcgggtggtccaagaaatacgaatttggagaatctgaccttcgatcggcttgtgacacggtggacacatggttggatgacacagccaagggccgacagaacatctcaccagataagatcccatggtctgccctgaagacattgatggcccagtccatctatggtgggcgggtggacaatgagtttgaccagcgtctgctcaataccttcctggagcgcctgtttaccacccggagtttcgatagtgaattcaagctggcgtgcaaggtcgatgggcacaaggacattcagatgcctgacggtatcaggcgagaggagtttgtgcagtgggtggagctgctgcctgacgcccagacaccctcatggctgggcctccccaacaatgctgaaagggtcctgcttaccacccaaggcgtggacatgatcagcaagatgctgaagatgcagatgctggaggacgaggacgacctggcctacgcagagacggagaagaagacaaggacggactccacctcagacggccgtccagcctggatgagaacactgcacacgacggcctcaaactggctgcacctcatcccacagacactgagcccactgaagcgcacggtggagaacatcaaggaccctttgtttaggttcttcgagagagaggtgaagatgggggccaagttactgcaagatgtgcgccaagaccttgctgacgtcgtccaagtgtgcgaggggaaaaagaagcagacaaactacctgcgcacgctcatcaatgagctggtgaaagggatcttgccccggagctggtcccattacacagtacctgcaggcatgacggtgatccagtgggtgtcagatttcagcgagaggatcaaacagctgcagaatatctcacaggctgctgcagccgggggtgccaaggaactgaagaacatccacgtgtgcctgggtggcctgtttgtgcctgaggcctacatcactgccaccagacagtatgtggcacaagccaacagctggtccctggaggagctctgcctcgaagtcaatgtcaccgcctcccagagtaccacccttgatgcgtgcagctttggggtcacaggtctgaagctccaaggggccacgtgcagcaacaacaaactctcgctgtccaatgcgatctccacagtcctccccctcacacagctacgctgggggaagcaaactagtgctgagaagaaggccagtgtggtgactttacctgtctatctgaacttcacgcgggcagacctcatcttcactgtagactttgaaattgctacaaaggaagatcctcgaagcttctatgagcgtggagttgcagttctgtgcactgagtaaagctaagcttttcccgaatcctctttctggaatagtagaacccaatatttaactctcattcatccttacacatttggagggtttgatggacccgtgaaaagcaagtggtcggttagcgttggtggtgaaaggtgctgcagttggaaatgggctgggaagggtgaagtgtgcggtttccaagggctgaccaaatggctggttttattaaataaaacactaagcatg

SEQ ID NO: 3456 - DNA, 2435 bp, Rattus norvegicus
  Genbank Accession No. NM_019232
actgttggctaagccggtctcactgctcctttagtctctttggacactttccaaatatcggggcgatgaccgtcaaaaccgaggctgctcgaagtaccctcacctactccagaatgaggggaatggtagcaatcctcatcgctttcatgaaacagagaaggatgggcctgaacgattttattcagaagcttgccaacaactcctatgcatgcaaacaccctgaagttcaatcctatttgaaaatctcccaacctcaggagcccgaacttatgaacgccaacccctcacctcctccaagtccctctcaacaaatcaacctgggtccatcctcaaatccccacgccaaaccctctgacttccacttcttgaaagtgatcggaaaaggcagttttggaaaggttcttctagcaaggcacaaggcagaagaagcattctatgccgtcaaagttttgcagaagaaagccatcttgaagaagaaggaggagaagcatattatgtcagagcgcaatgttctgttgaagaatgtgaagcaccctttcctggtgggccttcacttctctttccagactgctgacaaactctacttcgtcctagactacattaatggcggagagctgttctaccatctccagagggagcgctgcttcctggaaccccgtgctcgcttctacgcagctgaaatagccagtgccttgggttatctgcactccctaaacatcgtttatcgagacttaaaaccagagaatattctcctagactcacagggacacatcgtcctcactgactttgggctctgcaaggagaacatcgagcacaatgggacaacgtccaccttctgtggcacgcctgagtatctcgctcctgaggttctccataagcagccgtacgaccggacagtggactggtggtgcctcggggctgtcttgtatgagatgctctatggcctgcctccgttctacagccggaacacagccgagatgtatgacaatattctgaacaagcctctccagctgaaaaatatcaccaactcagcaaggcacctgctggagggcctcctgcagaaggaccggaccaagaggctgggtgccaaggatgactttatggagattaagagtcatattttcttctctttgattaactgggatgatctcattaataagaagatcacgcccccatttaacccaaatgtgagcgggcccagtgaccttcggcactttgatcccgagtttactgaggagccggtccccagctccatcgggcgatcccctgacagcatccttgtcacagccagtgtgaaagaagccgcggaagccttccttggcttctcctatgcccctcctatggactccttcctctgaaagctcccaggatggttccgaaggatttcctcagcgtttttctaaagtgttttagttagcctttggtggagttaccagctgacagaacatcttagaagagaaatttgcacaccaggaagcttggcagtcccgcctgccggggcctgcacgcggcttgttgacgcggaagctttccggaagctttccgaagagcacatcctcctctcagtgagctagtgaggtcttcatttcttttcttccttccaacgtggtgctagctctaaaggagcttgagagtgccgcctgagacgcaccttggtctcagtgagaaggaagatgcaggtctaagagggatctccgcaggtctgagctgtgatcaagaatattctgcaatgtgccttttctgagattgtgttagctccaaagcttttcctatcgcagagtgtccagtttttgtttgtttttttttttttgttttgttttttgtttcttttttttcccaacccttgcgtatttcccatgtgtgcagttagtgtgagtgctatgcctgatcacagacagttttgttgtaagcatcaatgtgacacttgcaggacactacaatgtgggacattgtttgtttcttccacatttggaagataaatttatgcgcagactgtttttttttgtaagatataataactaaaacctattgaaacggtcttgcagtgacgagcatccagatgcttgagggaagcattgctgctacaaatatttctatttttagaaagggtttttatggaccaatgccccagttgtcagtcagagccgttggtgttcatgttaaaatgtcacctgcaaaatgggcattatttatggttccccccaacctttgttcattttcttttgcattcctgattattgtgtgtaaagaaagtctgtacattgggttataacactagatatttaaacttacaggcttatttgtaaaccatcattttaatgtcctgtaattaacatggttataacatgtacactcccccctactcaccacacaactttttttgtgtgcggtgaaaccaattttggtttgcaataaaatcttgaaaactatttgcg

SEQ ID NO: 3457 - DNA, 1547 bp, Rattus norvegicus
  Genbank Accession No. NM_019237
ctgctgctgctgctgctgctgctgttgctgctgctgctgtttccagcactccccctacacaatgctgcctgctgccctaacctccctgctggggccattccttctagcctgggtgctgcctcttgcccgaggccagacccccaactacacgagaccagtgttcctgtgtggaggggatgtgaccggggagtcgggttacgtggcaagtgagggtttccccaacctctaccccccaaacaagaagtgcatctggacaataacggtgcctgagggccagactgtgtccctgtccttccgagtctttgatatggaactccacccttcctgccgctatgatgctctggaggtctttgctggatccgggacctcaggccagcgacttggacgcttctgtggcaccttcaggcctgcgcctgtagttgcacctggcaaccaagtgactttaaggatgacaactgacgagggcactgggggacgaggattcctgctctggtacagcggtcgggccacctcaggcactgagcaccagttttgcggggggcggatggagaaggcgcagggaaccctgaccacgcccaactggcctgagtcggattaccccccaggcatcagctgttcctggcacatcattgcaccctcaaaccaggtgatcatgctaaccttcgggaagtttgatgtggagcctgacacatactgccgatatgactctgtcagtgtgttcaatggagctgtgagtgacgactcaaagaggctggggaaattttgcggagacaaggcccctagccccatctcttccgaagggaatgagctcctggtccagtttgtatcagatctcagtgtcactgccgatggcttctcagcctcctacaggaccctgccacgggatgccgtggaaaaggagtcagccccaagtccaggggaggatgcacagcatggtccccagtcccgctctgaccctaagacaggaactgggcccaaagtcaaaccacccagtaagcctaaagtccagcctgtagagaaacctgagggctctcctgctacccaggcaactccagttgctccagatgcccccagcatcacttgcccaaagcagtacaagcggtcaggcaccttgcagagcaacttttgctccagtagcctggtggtgacaggaacagtgaaggccatggtccggggcccaggggagggcctcactgtcaccgtcagtctcctgggtgtctacaaaaccggagacctggacctgccctctccagctagtggcacctctctgaagttctatgtgccctgcaagcagatgccccccatgaagaaaggagccagttacctgctgatgggtcaggtggaagagaacagaggccccatccttcctccggagagcttcgtggtgctctacaggcccaaccaggaccagatcctgagtaacctaagcaagagaaagtgcccctcccagcctaggccagatgcctgatgtcctcgccagatcagagtgtggtgcttttatccaaataaatgtttcttgactcaggaaggaaaaaaaaaaaaaaaaa

SEQ ID NO: 3458 - DNA, 1662 bp, Rattus norvegicus
  Genbank Accession No. NM_019238
ggccccgctcctcgccctgcctaccgccggcatctaaacacaggtgggagtgggagatcccgacaggtgagccccgcgccccgcagccacaaggatggagttcgtgaagtgtctaggccacccggaggagttctacaacctgctgcgattccgcatgggaggccggcggaatttcatacccaagatggaccggaactcgctcagcaacagcttgaagacttgctataagtatcttgatcagaccagtcgcagcttcgccgcggttatccaggcgctggatggggacatacgtcatgcggtgtgtgtgttttacctgatcctccgagccatggacacagtggaggatgacatggccatcagtgtggagaagaagatcccactgctgcgaaactttcacactttcctctatgagccggagtggcggttcaccgagagcaaggagaagcaccgagtagtgctggaggacttccccacgatctccctggagtttagaaatttggctgagaaatatcaaacagtgatcgctgacatctgtcacaggatgggatgtgggatggcagaatttctaaacaaggatgtaacctccaaacaggactgggacaagtactgtcactatgttgctggactggtgggaatcggcctttctcgcctattctctgcctcagagtttgaagatcccatagttggtgaagacacagagtgtgccaattctatgggtctgtttctgcagaaaacaaatatcattcgtgattatctggaagaccaacaagaaggaagacagttttggcctcaagaggtatggggcaaatatgttaagaagctggaagactttgttaagccagagaacgtagatgtggccgtgaagtgcttgaatgaactcataaccaacgccctacaacacatccctgacgtcatcacctacctgtcaaggctccggaaccaaagtgtgtttaacttctgtgccattccacaggtaatggccattgctacgctggctgcctgttacaataaccatcaggtattcaagggagtagtgaagattcggaaggggcaagcagttaccctcatgatggatgccaccaacatgccagctgtcaaagctatcatataccagtacatagaagagatttatcaccgggtccccaactcagacccgtcagctagcaaggccaagcagctcatctccaacatcaggacgcagagccttcccaattgccagctcatctcccgaagccactactcccccatttacctgtccttcatcatgctcttggctgccctgagctggcagtacttgagcactctgtcccaggtcacagaagactatgtccagagagaacactgactttgtttagctggaagcggaagtccacgtgaagtgggtttttcttcttcccccagctggattttgacttcccttggtttttccttctactctaatctttcggagaactgagtgtgggacctttaggaactctgaagaggaaaggacgccttgccctcagcagcctggtgcttcctggatgtggtccctgcctcttgtagccactggcatcatgttgaccgaagcactggaaaggccacatgtgatcctagtgaacctggctagaatgctgattgaatctatttaatttgaaacagcctttgaatacctatcacagt

SEQ ID NO: 3459 - DNA, 816 bp, Rattus norvegicus
  Genbank Accession No. NM_019241
atgaactggagcgtctttgaggggctcctaagtggggtcaacaagtactccacagcctttggtcgcatctggctgtctctggtctttgtcttccgtgtgctggtgtacctggtgacagccgagcgtgtgtggggtgacgaccagaaggactttgactgcaacactaggcaacccggctgtaccaacgtctgctatgatgagttcttccctgtgtcccacgtgcgcctctgggccctgcagctcatcctggtcacatgcccctccttgcttgtcgtcatgcatgtggcctatagaaaggctcgagagaagaagtaccagcaagaagttggcaaagggtacctctacccaaaccccggcaagaagcgaggcggactctggtggacatacgtctgcagcctgttgttcaaggccaccatagatattattttcctctaccttttccatgcattctaccccagatataccctcccgtctatggtcaagtgccattcggcaccatgtcccaacacagtggactgcttcatcgccaagccctcagagaagaacatcttcattgtcttcatgttggtcacggccatcgtctgcatcctgcttaaccttgtggagctgctctacttggtgatcaagcggtgttctgagtgtgcaccagcgaagagaccgcccactgcacacgcaaagaatgacccaaactgggccaacccttccagcaaagagaaggacttcctctcaagcgacctcatctttctgggctcggacactcacccacctctgttacctgatcgccctcgagcccacgtgaagaaaaccattctgtga

SEQ ID NO: 3460 - DNA, 1736 bp, Rattus norvegicus
  Genbank Accession No. NM_019242
tctcacccgcgccgctcctcgcctctcttgttagccggagactcgcctctcagccgcccgccgcacagacgcacgagtatacagtgcagctccatcggctgatccttgctgagctccaagtgtaggcggcaccgggcggcccacgatgccgaagaacaagaagcggaacgctccccaccgcggtggcgggggtggcggcggctccggggcagcgacgtcggcggccacgacaggtggcccgcatcggactgttcaacctttcagtgatgaagacgcatccattgaaacaatgagccactgcagtggctatagcgatccttccagtttcgcggaggatggaccagaagttcttgatgaggaaggaactcaggaagacttagagtacaagttgaagggattaattgacctaacccttgataagagtgcgaagacaagacaggcagctcttgaaggtgttaaaaatgcgctgtcttcaaaagtgctgtatgagtttgttctcgagagaagaatgactttaactgatagcattgagcgctgtctgaaaaaaggaaagagtgatgggcagcgcgcagctgcagcgctcgcgtccgttctttgtattcagttgggccctggattggaaagtgaagagattttaaagactcttggaccaatcctaaaaaaaataatttgtgatggaacagcgagtatccaggctaggcagacttgtgcaacttgctttggtgtttgctgttttattgccacagatgacatcactgagctgtattcaactctggagtgcttggaaggtatcttcaccaagtcctaccttaaagagaaagacacgaacgttccttgcagcactcctaatacagtgcttcacatcagctcgcttctcgcatggacgctactgctgaccatatgcccaatcagtgaagtgaagaaaaagctggagctgcatttccataaacttccaagcctcctttcttgtgatgatgtaaacatgagaattgctgctggcgaatctttggcacttctgtttgaattggccagaggaatggagagtgactttttttatgaagatatggattctttgacccagatgctccgggctctggctacagatggaaataaacaccgtgccaaagtggacaagagaaagcagcgctctgtcttcagagacgtcctgagggctgtggaggaacgggattttccaacagaaactgttaaattcggtcctgagcgcatgtatattgatagctgggtcaaaaagcacacctatgacacgtttaaagaggctcttggatcagggatgcagtaccacttgcagacaaatgaattccttcgcaatgtatttgagctggggccccctgtgatgctcgatgctgcaacacttaaaaccatgaagattcctcgttttgaaaggcatttatataactctgcagctttcaaagctcgaacaaaagcccgaagcaaatgccgagataagagagcagatgttggagaattcttctagatgtctgtctttgatgtctgttttctaatttcttcctttattattatttttgctacttctaatgtacataagcttttagagacttttttatcttggtcaacttagataatttttgatgtagggatgggttatattttaatttaatgtacagtgttacaaattaatgagttctttattctgtaaaaataactgataaccacaaataaaagtgtttgtgatgcttggtcaaaaaaaaaaaaaa

SEQ ID NO: 3461 - DNA, 5825 bp, Rattus norvegicus
  Genbank Accession No. NM_019243
cagcgcccaggaggaggaggcggagagtcgctcccgccggccgagcatggggcgcccggcgccgaggccgctgctgctggcgctcctatcgctggctgtctgccgcgggcgtgtggtgagagtccctgcgggcaccctggttcgagtggtgggcactgagctggtgatcccctgcaatgtcagtgactatgatggccccagtgagcaaaactttgactggagcttctcgtcttcgggaagcagctttgtggagctcgccagcacctgggaggtgggcttcccggcgcagcagtaccgtgagcggctgcagcggggcgacatcctgttgaggaggacagccaatgatgctgtggagctgcacataaagaatgtccagccctcggaccaaggccactacaagtgttcaactccaagcacagacgccaccgtccagggcaactatgaggacacaatgcaggttaaagtgctggcagatgccctggtggtgggccccagctcccggcctcctccaggcctgagcctgcgcgagggggagccctttgaacttcgatgtatcgcatctactacgtcaccgttgcacacacacctggcacttcggtgggaactgcaccgtggcccagtgcaccgaagcatcctagccctaagccacgagggcaggtttcacccaggacctggctatgaacagcgctaccacagtggggatgtacgcctggacacggtgggcagcgatgcctaccgcctctccgtagcccgggcactctctgcagaccagggttcctacagatgtgtggtcagtgagtggatcacagagcaaggcagctggcaagaaatccaagaaaaagctgtggaagtggccactgtggtgatccagccaacagctctgcaactggccgtgcccaggacagtgtctgtgaccgaaggaaaggacctggacctttcttgcaacatcacaacagaccgtgtggatgatgtccggcctgaggtgacatggtacttcaaaaagacacccgatacctctttgcttgcctcccatatgctggctcggctggaccgtgattccctggtacacagctcaccacacgttgctctcagccacgtggatacccgctcttaccatctactggtgcgagatgttagcaaagaaaactccggttactatctatgcctcgtggccctctgggctcctggacacaaccggagctggcacaaggtggcagaggccatgtctgccccatctggtgtaagcgtgacctggctagaaccagaataccaggtctacctgaatgcttctaaggtccccgggttttccgacgaccccacagaactgcaatgccgggtgatagacacgaagcgtgtggatgccggtgtccgacttactgtgtcgtggtactatagaatgaaccgtcgcaatgatgacgtggtggccagcgagcttctcgccgtcatggacggggactggactctgagatacggggagagaagcaaacagcgggcccaggacggcgagtttatcttttctaaggagcacacagacacattcagtttccggatccaaaggactacggaggaagacaggggcagttattactgtgttgtgtctgcctggaccaggcagaggaacagcagctgggtgaagagcaaagatgtcttctccaagcccgtcaacatattctgggcctcggaagattctgtgctcgtggtgaaggcacggcagccaaagcctttctttgctgcagggaatacatttgagatgacttgcaaagtgtcttccaagaatattaagtctccacgatactctgttctcatcacggctgagaagcctgttggggacctctccagtcccaatgaaaccaagtacatcatctccctggaccaggattccgtggtgaagctggagaactggaccgacgcatctcgggtggacggcgtcgtgttagagaaggttcaagaggatgagttccgataccgaatgtaccagactcaggtctccgatgcgggcctgtaccgctgcatggtgacagcctggtctcctatcgggggcagcttgtggcgagaggcagcgaccagtctttccaatcctattgagattgacttccaaacctcaggtcccatatttaacgcctctgtgcattcagacactctgtccgtcacccggggagatctcatcaagttgttctgtatcgtcactgtggacggagcagtgctggacccagatgacatggccttcgatgtatcctggtttgcagtacactcttttggcttggacaaggctcccatcctcctatcctccttggaccggaagggagtcgtgactacaggccagagggactggaagagtaccgtcagcctggagcgagtgagcgtgctggaatttttgctgcaagtgcatagctctgaggaccaggactttggcaactactattgttctgtgactccctgggtgaggtcaccaactggttcctggcagagggaagccgagatccactccaggcccatctttataactgtgaagatggatgtgctgaacgccttcaagtacccgctgctgatcggcgtgggcctgtccacagtcatcgggctcctgtcctgcctcattgggtactgcagttcccattggtgctgtaagaaggaggtgcgggagacgcgtcgggagcgccgcaggctcatgtccatggagatggattaagcagttggagggacagaggaacgttgtaggagcagtggggtggggggtgagaagaggactctgagattttacaaccgagtgtgttacactaaaaccggtcctctctaatctcaggtgggactcagcgctctctcttttctgcatgtcaagttccgagcgcggacatgtttaccagcacacggctcttcttcccacggcactttctgatatgtaacaatcgagtgtgtgtctccccccccccgctgaagctgtttaatggttaacccccgtctaattagttttctcctagcagcttatcgatcctctgattcacgtgtgttgatcacttttgatttaagggatcgcagtgaggaagggcgaaagcattcagagttggtcatcatgagtaagagggtacctgcccacccgaaagccagcatccacaagcagccatctggagagctgctacctgctgctctctaccctggcccagaactgatagagacctgtgccaaggcaagctgtggctatgactaccctgcccatcccccattgtcaggagtttaaactatattggaacctaaactctataacttcttgaccccataagccttttgtttccctttctcctctaccctcttctgttttcgggtttgtttctgtgagagtgaggatatggcagccctggagtctagaatttggctttccaccaagcaccttatctcgccaccttagccttaagaatgagtatgaagaaaaatccaccaccacctctgtccagggcaggtctgtgaggagaggacactggggaaggaaaggcacagatgcttgcttacttgctcactctgtagttctgaggccgctgtgcctgctccaggaatcccagggtgagtgggagcagagggcatctgagttgtgccgctgagccaggtgccctgtcccttcatgagaggcactgtcccttgtacccccaggaccagcatgggagccacaaatgtgccacattgagctccttcccaggaaggcagattgctgcctgccagactgactgacttcaaggaatcagaaattgcctggagcaagcgtgtgttctctgtgacctttttcagtccttgaagtctttttaagatccccgcagggggtggtgaagaggggtatactttgtggacggtttgctttcctattagaaacacaaagggaacccagcaatttagtgttatgtgaatggcctgtaaaataggattgaaggcagccggctctgcctgactgggcccagcaggaataggacagagggcaggcacaccttccaggtcaccagtgcctgctccatcagggcctcagccatgcaaagtctctcgccctagcatagccttccaggagcctccgataggtactgaggctcatcagccacccggtaccctcaccctaccctctacctctgaaggatttaacattgttgtcttccaaaggggagtgggggaggagagctcctttctcttaagcaataaagtaataagaaaagatggccattcacgggcagctctagtcaccatgggaccggatgcgctgagctcccccctccccaccttctctccatgtggcccatggtggcttttgtatttgccacccagtttcctctgcttgtttcgagcccaccttggagactgctcttatgatgagattctgagccggtggctctagcccaggtggggggtacaggtttagagtcggtagcaagaagagggacagcaggtgcaccccacacaagcaagagaggccagagaaagaggggaggcttcggaagacatggctgttctacatgtcgctctcttattgctagctcagacgtgaggcacaggtgactgtacaaacaggaattaggggagtagaaccaagtattaggaacttcaagcctgtgccattactggagaagattcagggcctttgcagtgcagccctccttaggaggacaagagagatttagccttggatgagttgaggtgagccctagctgtacatgaacccacagaggtccaagcgggtaactgatggtgagagatgagtgatcggtcctaccttcccctttcccttttgtctgatgttgagatttgaacctgagttgtggaggtcatgcccaaacccctccatgttgcttagggctggaagagggaccagaaaccccaggacctagttccttttgggaatattggcattctggggtatgtgtctttttaagtgtggtcaaacactcttgatgtaccaaatagtgttccccgtgaagcgctcttcctgaggctcccacccagcaacactggtctgagggaaggaaaggccaaaccaggcctgggcacatgaaattgcacttcttaaagagaaactttttagaaggttgggtatttttcttaatcacaaaaatctcccactgaaagaacctaagctacattcagatcgaagcctctaaattaaattgtttactttacaatgtttacacacatgactcacttttttagaaaaataagaaaactgcaaactccggctttttaacaacttttcagctttttcatgcatgggatagatatgctggcaacctgactcaccagctggatcaaatcctcatttagaaatgtcccgatatgtggatatatgtgtcttcccccctcccaaccacacagctccctcctgcccagacctctgtctgtttctctggtggcttttgcctcctgctttgcagaccgcctgcagccatgattttgttacggcatccacgagccaaagactgcgccttgggagcaggaacaataagcaatactacaccactcgctactgtcgggggtctttttctctttcttttcttttttagcttcactgatggcaacagaggaagaaaggaattgaggtttaggcaagttctcttcccctgtgtgaccagattctcggtgacacacagttgtgcagatcactaggagaacaaggttgggttttcttttctagtgtgtaacacaaggatctgcaggattttccgtagacaaagaggtctcgtgtatttttgtccctatccaaggttatacaaactaattgtgttgttttatactgtggccacaaatattatgcaatgcaccatttgtttttgtttttattttattaaaggaaatttaattta

SEQ ID NO: 3462 - DNA, 3485 bp, Rattus norvegicus
  Genbank Accession No. NM_019246
gaagtgaagttgctgtcagtggcgcctccggctcccggggaagctgagagtttccgcaggtggcggctgcggcggcggcggcagcggtagcaactgcaacagtagcaacgaaggctgtgggtctgcagctgtgttcccagtcgacattgctcacggtgaaggtgacatctccctccagtttcacaaaatgagtgtggtatggttacgaagaccaggacctaaacttcacagagagcccagcctgctgttctgatgccgaaagggagacagaaagtcccacgcttggatgcccgcctgggcctgcctatctgcctctgtctggaattagccatcttctttctggttccccaggtcatgggcctaacagaggcaggtggtcttgacaccttgggtgcaggggggctaagctgggctgtacatctggacagcctagaaggtgagaggaaggaagagagtctgatacaacaggcaaatgctgtggcccaggcagcggggctggtgaatgctgggcgcattggagagctccaggggcactacctctttgtccagccagctgggcacgggcaagccatggaggcggaggccatgcggcaacaggcagaggctgtgttagccaagcatgaagctgtgcgctggcactcagagcagaggctgctgaagagggccaagcgcagcatccacttcaatgatcccaagtatcctcaacagtggcacctgaataatcggcggagcccaggaagagacatcaatgtgacaggtgtgtgggagagaaatgtaactgggcgaggggtgacggtggtagtggtggacgacggagtggagcacaccgtccaggacattgcacccaactatagcccagagggaagctatgacctcaactctaatgacccagatcctatgccccaccctgatgaggagaacggtaaccaccatgggacccggtgtgcaggagaaattgcagctgtgcccaacaacagcttctgtgcagtaggtgtggcctatgggagccgaatagcaggtatccgggtgctggatggaccactcacagacagtatggaagctgtggcattcaacaaacactatcagatcaatgacatctacagctgcagctggggccccgatgatgatgggaagacagtggatggtcctcatcagcttgggaaggctgccttacaacatggagtgatggctggtcgccaaggctttggaagtatctttgtggttgccagtggtaatggtggccagcacaatgacaactgcaactatgatggctatgccaactccatctacactgtcaccataggagctgtggatgaggagggacggatgcctttttatgcagaggagtgtgcctccatgctggcagtcaccttcagtggaggagacaagatgctgcggagcattgtgactactgactgggaccttcagaagggcactggctgcactgaaggccacacaggaacctcagctgcagcccctctagcagctggcatgatagctctcatgctgcaggtgcggccctgcctcacgtggcgggatgtccagcacatcattgtcttcacagccactcagtatgaagatcatcgtgcagactggctcactaatgaggctggattcagccacagccatcagcatggtttcggcctgctcaacgcctggagacttgtcaatgcagccaagatctggacgtctgtcccttacttagcttcctatgtcagccccatgctgaaagaaaataaggctgttccacggtccccccactctctggaggtcctatggaatgtcagcaggacggacctggagatgtcggggctgaagaccctggaacatgtggcggtgacagtctccatcactcacccacgacgtggcagcttagaactgaaactgttttgtcccagtggcatgatgtctttgatcggcgcgccccgcagcatggactcggaccctaacggcttcaatgactggacattttccactgtgcggtgctggggggaaagagcaagaggagtctacagactggttatcagggatgtaggagatgagccgctccaggtgggcatcctccagcagtggcagctgacgctgtatggctccacgtggagtccagtagacatcaaggacagacaaagtctcttagaaagtgctatgagtggaaaatacctgcatgatgacttcactctgccttgcccacctggactgaaaattcctgaggaggatggttacagcattacccctaacacactcaagacccttgtgctggttggctgcttcagtgtcttctggaccatttactacatgctagaagtgtgcctgagccagaggagcaaggcttccacccatggctgcaggagaggatgctgcccctggcccccacaaagccaaaactccaaggaagtggggacagcactagaatcaatgccactgtgcagcagcaaggacctggatggagtggattcagagcacggggactgcacaactgcctctagcttgctggccccagagctgctgggggaagctgactggagtctgtcccagaacagtaagagtgacctggattgtcctccccaccaacccccagacctgaaggatggacagatctgctgaccccagagcccagcttcttccatgtacaacaggctcttcctaaacttggttatgaggctttcaatcatggatgctcaggagagaatggtcctgatagtgacatctgccacccaaggcctctgaagcattctcagccttctcaagagggtgagggccatcttaattaagcgcagtggtaagggactggtgttcatggctcctctagctgagctttgctgagagcctttcgacaaggggttggcgcccaggccaggcagcccttgatttcatctctctcgggctagtcactgtcctcggccatcaggacctccaccccttcacaagttatgcagcaggtgcctgtatacctaggaacactctcaacagaagtgccgctgtaccgagggcccagagagaggctggcaagagcctagacatgcctaccctgaaagcagctgccttcattaccctttcctgtgtgcctgttctgaagcccgtaccttcactaccactcacccttcctgctgaaggaatggtggcgtgtcccaggaaaactgggaggcacaggattcccagccagcacccttgctgcctcactggggaagttgtcctgctgggctgcagagagctgagacacagtgttgtctaagatagcatgggagcccctgcctatgaccacctgtcttcctctgcaaagtgctcagggaaatggccttcattccagaggccagctgtccgcctgacttttcctccattcttggccttctccccttcccatctttggagctaattgttaatatgaattttttaatgcttaagatttgatttttacttttcaaagcaacattttgttgaatttttttctgcacagctttccaaaataaaaagcagaagtaaaaaaa

SEQ ID NO: 3463 - DNA, 2682 bp, Rattus norvegicus
  Genbank Accession No. NM_019248
acccccctctcctctcctcctcctcctcttttttagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctctttcccctcctggaagggcaggattcagggaacagcaatgggaacgccagcatcaacatcacggacatctcaaggaatatcacttccatacacatagagaactggcggggcctgcacacactcaatgctgtggatatggagctctacacgggactccagaagctgaccatcaagaattctggactccggaatattcagcccagagcctttgctaagaatccccacttgcgttatataaacttgtcaagtaaccggctcaccacactctcctggcagctcttccagacgctgagtcttcgggaattgagactggagcagaacttcttcaactgcagctgtgacatccgctggatgcagctgtggcaggaacagggggaggcacggctggacagccagagcctctactgcatcagtgctgatggctcccaactccccctcttccgcatgaacatcagtcagtgtgatctccctgagatcagtgtgagtcacgtgaacctgactgtccgagaaggagacaatgctgtaatcacttgtaatggctctggctctcctttgcctgatgtggactggatagtcaccggactgcagtccatcaatactcatcagaccaatctgaactggaccaatgtacatgccatcaacttgaccctggtgaatgtgacgagcgaagacaatggtttcaccctgacgtgcattgcagagaacgtggtgggcatgagcaatgccagcgttgctctcactgtctactaccctccacgtgtggtgagcttggtggagcctgaggtacgcctggaacattgcattgagtttgtggtgcgtggcaacccgacacccacgctgcattggctgtacaatggacagccactgagggaatccaagatcattcatatggactactaccaggagggtgaagtctcagagggctgcctgctcttcaacaagcccacccactacaacaatggcaactacaccctcattgctaagaatgccctgggcacagccaaccagaccatcaacggccacttccttaaggagccctttccagagagcacagatttctttgactttgagtctgatgcgagccctacacctcctatcactgtgacccacaaaccagaggaagacacttttggggtgtccatagcagttggacttgctgcttttgcctgcgtccttctggtggtcctctttatcatgatcaacaagtacggtcgacggtccaaatttggaatgaagggtcctgtggctgttatcagtggggaggaggactcagccagcccactgcaccatatcaaccatggcatcactacaccttcatcgctggatgctgggccggatacagtggtcattggcatgactcgaattccagtcattgagaacccccaatatttccgtcagggacacaattgccacaagccagacacatatgttcaacacatcaagaggagagacatcgtgttgaagagagaactgggtgagggagcctttggaaaggtcttcctggctgagtgctacaatctaagccccaccaaagacaagatgcttgtggcagtgaaggccctgaaggatcccaccttggctgccaggaaggatttccagagggaggccgagctgctcactaacctgcagcatgagcatattgtcaaattctatggggtctgtggtgatggggatccactcatcatggtctttgaatacatgaagcatggagacctgaacaagttcctcagggcccatgggccagatgcgatgatccttgtggatggacagccacgccaggccaagggggagctaggactctcccagatgctccacatcgccagtcagatagcctccggcatggtgtacttggcctcccagcactttgtgcaccgggacctggccaccaggaactgcctagttggagccaaccttctagtgaagattggagattttggcatgtccagggacgtctacagtactgattactacagggtgggaggacacaccatgctccccatccgctggatgccacctgaaagcatcatgtaccggaagtttaccacagagagtgatgtgtggagctttggggttattctttgggagatctttacctatgggaagcaaccatggttccagctctctaacacagaggtcattgaatgcatcacccaaggccgtgtcttggagagaccccgagtctgcccaaaagaagtatatgatgtcatgctggggtgctggcagagggaaccacaacagcgactgaatattaaggagatctacaaaatcctccatgctttggggaaggccaccccaatctacctggacattcttggctagtggtgactggtggccaagcgtttatactctgttgcctcctctctccctgcctcatctcctctttttcctcacctcaactcctttcgtccatctttgaccgaaacgaacatcttcatataaactcaagtgcctgctacacatacaacactgaat

SEQ ID NO: 3464 - DNA, 6545 bp, Rattus norvegicus
  Genbank Accession No. NM_019249
ctgtggagctagaaccctggatggcccccgagccagcgccagggaggaggatggtgccccttgtgcctgccctcgtgatgctgggtttgatggcaggtgctcatggcgacagcaaacctgtctttgttaaggtccccgaggaccagatcgggctgtcgggaggggtggcctccttcgtgtgccaagccacaggggaacccaagcctcgaatcacatggatgaagaagggaaagaaagtcagctcccagcgctttgaggtaattgagtttgacgacggagcagggtcagtgctgcggatccagccattacgagtacagcgagacgaagccatctatgagtgcacggccacgaacagtctcggcgagatcaacacaagtgccaagctgtcagtacttgaagaggaccagctgccgtctgggttcccgactatcgacatgggacctcaactgaaggtggtggagaaggctcgcactgccaccatgctgtgtgcagctggtggaaatccagaccctgagatctcttggttcaaagacttccttcctgtggaccctgcttcaagcaacggtcgtatcaagcagctgcgttcaggtgcattgcagattgagagcagcgaggagtctgaccaaggcaagtacgagtgtgtggcaaccaactcggcaggcacacgctactcggcccccgccaacctgtatgtgcgagtgcgccgcgtggctcctcgtttctccatccctcccagcagccaagaggtaatgccgggcggcaacgtgaacctcacgtgtgtggcagtgggagcacccatgccgtatgtgaagtggatgatgggcgccgaggaacttaccaaagaggacgagatgccagttggccgcaatgtgctggagctcagcaatgtcatgcggtctgccaactatacctgtgtggccatctcttcactgggcatgatagaggccacagcccaggtcacagtaaaagctctgccaaagcctccaattgatcttgtggtgacagagacaactgccaccagtgttaccctgacatgggactctggaaataccgagcctgtgtctttctacggcatccagtaccgtgcagctggcacagacggccccttccaggaagtggatggtgtggccagcacccgatacagcattggtggcctcagccctttttcagaatatgccttccgtgtgttggctgttaacagcattgggcgaggaccacccagtgaggcagtgcgagcgcgaacgggtgagcaggcaccctccagccctccacgccgtgtgcaggcccgaatgctgagcgccagcaccatgctggtacagtgggaaccccctgaagagcccaatggcctggtacggggatatcgagtctactacaccccagactctcgacgccccttgagcgcctggcacaagcataacaccgacgcaggactccttaccaccgtgggcagcctgctacctggcatcacctacagcctccgcgttctggcctttactgccgtgggcgacggccctcccagccccaccatccaagtcaagacacagcagggagtgcctgcacagcctgcagacttccaggccaaagccgagtcggacaccaggatccagctatcatggctgctgcccccgcaggagcggatcatcaagtatgagctggtgtactgggcagcagaggatgaaggccagcagcacaaggtgaccttcgaccccacctcctcctacactctggaggacctgaagcctgacacactgtaccacttccagctggctgctcgctcagatttgggggtgggcgtcttcactcccaccgtagaggcctgtacagcacagtccaccccatccgcccctccccagaaggtgacatgtgtgagcacgggctccaccacggtccgggtaagttgggttccaccgccggctgacagccgcaacggcattatcacccagtactccgtggcctatgaggcagtggacggcgaggaccgtaaacggcatgtggtggatggcatcagccgtgagcattccagctgggacctgttgggcctggagaagtggacggagtaccgggtgtgggtgcgggcacacacagatgtgggccctggccctgagagcagcccggtactggtgcgcaccgacgaggacgtgcctagcgggccaccacggaaggtggaggttgagcctctgaactccactgctgtgcatgtctcctggaagctgcccgtccccaacaagcagcacggacagattcgtggctaccaggtcacctatgtgcggctggagaatggggagccccgaggccagcccatcatccaggatgtcatgctggctgaggctcaggaaaccaccatcagcggcctcacccccgagaccacctactccattactgttgctgcctacaccactaagggggatggtgcccgaagcaagcccaaagtggttactaccacaggggcagtcccaggacggcccaccatgatggtcagcaccacggccatgcacaccgcgctgctgcagtggcacccacccaaggagctgcctggagagctgctgggctaccggctacaataccgtagggccgacgaggcgaggcccaacaccatagattttggcaaggatgaccagcattttacagtcaccggtctgcacaaaggggccacctacatcttccggctggctgccaagaaccgggctggcccaggtgaagagtttgagaaagagatcacgacccccgaggatgcgcccagtggctttcctcaaaacctccgagtgacaggactgaccacgtctaccacggaattggcctgggacccgccggtgctggcagagaggaatggtcgcatcaccaactataccgtggtctaccgtgacatcaacagccagcatgaactccagaatgtcactggtgatgtacaccttacactcttgggcctcaaaccggacaccacttatgacatcaaggtccgtgcacataccagcaaaggcgccggcccactcagccccagcatccagtcccggaccatgcccatggagcaagtgtttgccaagaatttccgtgtggccgctgcaatgaagacatctgtgctgctcagttgggaggtccccgactcttacaagtcagctgtacccttcaagatcctgtacaatgggcagagcgtggaggtggatgggcactccatgcggaagctgattgcagacctgcaacccaacacagagtactccttcgtcctgatgaaccgcggcacgagcgctgggggcctacagcacctggtgtccatccgcactgccccagacctcctgcctcagaagccactgcctgcctctgcctttatagaggatggccgcttctccctctccatgcctcaagtgcaggacccctcgctagtcaggtggttctacattgtggtggtgcccattgaccgtgtgggcgggaacctgctggcaccaagatggagcacaccagaggagctggagctggacgagcttctggaggccatcgagcagggtgaggagaaacagcggaggcgtcggcgccaagcagagcggctgaagccttacgtggcagctcaagtggacgagctccctgagaccttcaccctgggggacaagaagaactaccgtggcttctacaaccggcccctgtctccggatctgagttaccagtgctttgtgctcgcctccctcaaggaacccatggaccagaagcgctatgcctccagcccctactcggacgagatcgtagtccaggtgacaccagcccagcagcaggaggagcccgagatgctgtgggtgacaggccctgtcctggcagtcattctcatcatactcattgtcatcgctatcctcctattcaagaggaagagaacacattccccatcgtcaaaggatgagcagtcaatcgggctgaaggactccctgttggcccactcttctgaccctgtggaaatgcgaaggcttaactaccagaccccaggtatgcgagaccacccgcccatccccatcactgacctggcagacaatattgaacgtctcaaagccaatgatgggctcaagttctcccaggagtatgagtccattgaccctggacagcagttcacgtgggagaattccaactcagaggtgaacaagcccaagaaccgctatgcaaacgtcattgcctatgaccactctcgagtcctcctcacctccattgatggtgttcctgggagtgactacatcaatgccaactacattgatggctaccgaaagcagaatgcctacatcgccacacagggtccgctgcctgagaccatgggtgatttctggaggatggtgtgggaacagcgtatagccacagtggtcatgatgaccaggctagaggagaaatcccgggtgaagtgtgatcagtattggccagcccgtggcactgagacctatggcctcattcaggtgaccctggtggacactgtggagttggccacgtacaccatgcgcaccttcgcactccataagagcggctccagtgagaagcgtgagctgcgtcagttccagttcatggcctggccagaccatggggttcctgagtaccccactcccatcttggccttcctgagacgggtcaaggcctgtaacccgctagatgcaggacccatggtggtgcattgcagtgctggtgtgggccgcacgggctgcttcattgtcatcgacgcaatgctggagcgtatgaagcacgagaagacagttgacatctatggccacgtgacgtgcatgcgctcacaaaggaactacatggtgcagacagaggaccagtatgtgttcatccacgaggcactgttagaggctgccatgtgcggacacactgaggtgcttgctcgaaacctctatgcccacatccagaagctaggccaagtgcctcccggggagagtgtcactgccatggagcttgagttcaagttgctggccggctccaaggcccgcgcgtctcgcttcattagtgccaacctgccctgcaacaagttcaagaaccgcctggtgaacatcatgccctatgagctgactcgagtgtgcctgcaacccatccgtggtgtggagggctctgactacatcaatgccagctttctagatggctacagacagcagaaggcctacatagctacacaggggcctctggcggagagcaccgaggacttctggcgcatgttatgggagcacaattccaccatcatcgtcatgctgacgaagcttcgggagatgggcagggagaaatgtcaccagtactggccagcagagcgctctgctcgctatcaatactttgtcgttgacccgatggctgagtacaacatgccccagtatatcctgcgtgaattcaaagtcacagatgcccgggatgggcagtcaaggacaatccgacagttccagtttacagactggccagagcaaggagtacccaagacgggggaaggcttcatcgacttcatcgggcaggtgcacaagacaaaggagcagtttggacaggatgggcccatcacagtacactgcagtgctggtgtgggccgcacaggggtgtttatcaccctgagcattgtcctggagcgcatgcggtacgagggcgtggttgacatgttccagaccgtgaagaccctccgcacacagcgccctgcaatggtgcagacagaggaccaataccagctgtgctaccgtgcggccctggaatacctcggcagctttgatcactatgcaacgtaactactgctcccctctcctccgccgctcccctgagggctccggaggggacccagctcctctgagccataccgaccatcgtccagccctcctgcacggatgctgttgccggcagagcacagcccactgggatcacagcatttcgggaacattgccacaccagtcagagagcccagaacacctgggcaagtaggcggactggcagcctggctctggccctcgtccaccgggcccaagtggagccctgcttcaagctctctgttcactgccgcaattctcatgcttctcatggggtgggaagcgaagggagccccccacgtttatacattaggcggggtagactgcggggtcctagcctcttcctccgactttccttttgcaggtctttcactacagattgggctgctgtgggagtagggacttacttgttttcctttttgagttcacgttggatccttgtacaacttctgcggaaggacacagtacacgctttccttcctcgagcagagctagggccctacctgagcaagtcggctgtggcccgggaggcagctgagactcctgctgtcctccagcctttcagaggagatcctattccagccaaatgcagggaaacactttattttgttttaggttttgtttttccttgagagcctttttttaggccccacagacagtggtgggcggggaggcgataggaaacacatccccagtgtgcatttaacattcatagcctacaaccacagacgtgtctggggggagcctggcaaggcgttcctcgtcaccatcgtgtttgcaaaggttcaaaaaagcaaaaatttaaaaaaaaag

SEQ ID NO: 3465 - DNA, 559 bp, Rattus norvegicus
  Genbank Accession No. NM_019251
gatgtcgtggcgctctgaggcaaaaagttgtttctctgaggagccttaggactgaagccgaggttgggtgaccctggccctttcctacccactcttccttgccctccttcccctctcgtggcaggatgaggcgtgcaggcctgggtgatggagcacctcctggcggctatgggaactatggttatgccaatagtggatataatgcttgtgaagaagagaatgacagactcactgaaagtctcagaagcaaagtaacagctataaaatctctttccattgagataggccatgaagtcaaaaatcaaaataaactgttagctgaaatggattcacaatttgattctacaactggatttctaggtaaaaccatgggaagactgaagattttgtccagagggagccaaacgaaattgctatgctatatgatgctgttttcattgtttgtcttttttgtcatttattggattattaaactgaggtgatgcaagttagtgtgggctttgaatttattgcagttaatgtcttggggaaccactttgataaccagcatctcaacatt

SEQ ID NO: 3466 - DNA, 822 bp, Rattus norvegicus
  Genbank Accession No. NM_019252
gaaatggccaccgggacagaccaagcggtgggatttggccttgtcgccgttagcttgatcatcttcacctactacaccacttgggtgattcttttgccattcattgacagccagcatgtcatccacaagtacttcctgccccgtgcctacgctgtcctcctcccattggccgcaggcctcctgctgctcctgtttgtggggttgttcatcacctatgtgctgctgaagagccagaaggtgaccaagaaggctcagtgaaggtccagcggggatgaggctgcagaggccgcctccacatctcctccagggaagggaccaagggtcacagcctacaagacaggctggctgcactgcagccctctttgggacatggggctgcttacgactcagtttgacaaactggaaccctctctctctctctcggtcatccttttagaagccgagaagaaggtggggtgggaaacctcttgctcactcccttggggctcagaggctgagcagtgctggtcctgtccaccccacagtcaaagctccctgtcccttctacggagttgtgttctctcacctccgttctcctgctgtgctgataggccgagcaggctccaggatgtgtgcagccttctcgcctctctgtacaaatcctgtcccttcacaaggcagctcttccgagtctgacacttccaggctccatgaggacttctggacccacaaagcctggggaaagaccgataaaccccagaagcacaggggtgcgtccaggcagccgcattagaccccagctggcctgtttgggaaaacttagaaataaatgttaatcatgtg

SEQ ID NO: 3467 - DNA, 822 bp, Rattus norvegicus
  Genbank Accession No. NM_019255
aacaaacgccatgtcacagaccaaaacagcgaaggttcgcgtgaccctcttcttcatcctggcgggtggagtgctcgccatggtggccgtggtgaccgaccactgggccgtgctgagtccacacctggagcaccacaatgagacgtgcgtggcagcccacttcggcctttggaggatctgcaccacttgggttgccatgcacaaccaagacaagaactgtgacggcaccataccagcgggggaaaagaattgctcctacttcaggcacttcaacccaggagagagctcggaaatctttgaattcaccactcagaaggagtacagcatctcggcagcggccatcgctatcttcagccttggcttcatcatcataggctccatctgtgcctttctgtccttcgggaataagcgtgattacctgctaaggccggcatccatgttttatgcctttgcagggctctgcctcatcgtgtcggtggaggtcatgaggcagtcggtgaagcgtatgattgacagcgaggacacggtctggattgagtactattattcgtggtctttcgcctgcgcgtgtgccggcttcactttgctcttcctcggtgggctgtttctcctgctgttctccctgcctcggatgccccagaacccctgggaatcctgcatggacactgagtcagagcactagatcaaagcagagtctttcggaggtgaggagggagtctcacatctgccctgacttcttgtctatcgtgtgtctctccctctgagctcctctacaaacagtgcacatggacacaacccagacctgcccaggtcagaggaagc

SEQ ID NO: 3468 - DNA, 707 bp, Rattus norvegicus
  Genbank Accession No. NM_019258
ataaatgtgaactgagagtgctggagacccagaagaaccacaagctggggtggccagagtgaggaacgagcccagcaggaagagcaagttggacagtcacagaaagtttgacagacctacagtggctgcttcattgcagctcaagccccaaggagacgtggaggacatcacttgtaccttttgactgagggaccatgacaaaacccttgttgctctccttgatcttcttcatcattccagcggccctggcagttgatgtggatcagtctaagaatgaagtgaaggcacagaggtactttggatccattagtatctccaatgccaatgtgaagcaatgtgtttggtttgccatgaaagaatacaacaaaggaagtgaggacaaatacctcttccttctggacaagacactccatgccacacttcagatcacagaccgcatggaataccacattgatgttcagatctcccgcagcaattgcagaaaacctttaaacaatactgaaaactgcatccctcaaaaaaatcccaaactggaaaagaaattaagttgcagctttctggtaggagcacttccctggaatggtgagttcgacctgttgagcaaagaatgcaaagatgtctaagggtgtcttggtgtgcgcctcccccttctgggtctgcttttctctgtaataaagagcaacatctggttcaagtctgtcaccaac

SEQ ID NO: 3469 - DNA, 1124 bp, Rattus norvegicus
  Genbank Accession No. NM_019259
cggcacgagccggtcgtccttccctttgcacgtgtccaccccgcgatgctccctctgctgcgctgcgtgccccgcgccctgggtgccgccgccacgggcctccgagcctccatcccggccccgccgcttcggcatttactgcagcccgcgccccggccatgcctccggcccttcggtttgctcagcgtacgagccggctccgctcggcgctctggcctcctgcagcccccaggttcctgcgcgtgcgctgcggctctgcacacggaaggagacaaggcctttgttgaatttttgactgatgaaattaaggaagaaaagaagatccagaagcataagtcccttcccaaaatgtctggagatggggagctggaagtgaacggcacggaggctaaattattgcgcaaagttgccggagaaaagatcactgtcactttcaacattaacaatagcatccctccaacctttgatggtgaagaggagccctcacaggggcagaaggccgaagagcaggagccagaactgacatcaactcccaattttgtggtggaagtgacaaagactgatggcaagaagacccttgtactggactgccactatcctgaggacgagatcggacaccaagatgaggccgagagtgacattttctctattaaggaagtgagctttcagaccactggtgactctgagtggagggatacaaactacacactcaacacagactccctggactgggccttgtatgaccacctaatggatttccttgcggaccgaggggtggataacacttttgcagatgagttggtggagctcagcacagccctggagcaccaggaatatatcacctttcttgaggacctcaaaagctttgtcaagagtcagtagaactgtgagactgagggctctaatataaacggccagctctcctgggcgagcaaaagctgccttgacctcacaactatgctttgccctggctgtcatcctaatatatgggggaaagcaagtttaaattatcgccgttacacctccatttacgattcctttgggctcttttcctgtacacatctattatttgtagatttttgtagtacatgatgatgaacaataaactgacttcctcgtgccga

SEQ ID NO: 3470 - DNA, 1136 bp, Rattus norvegicus
  Genbank Accession No. NM_019262
gggcttcttggacgtttttgggaggggacagcaagggaaggtccttctgcctctagggacccagacttccgctttctgcagacagcagcaggctctgggctctgggaatccactgctgtctggcctagaagcatcatagaacacgaggattccatacacaggaggcccctgaagctgagctgagctgatgaagacacagtggagtgagatcttgacacccctgttgctgctgctcctgggtttgctccatgtctcctgggcccaaagcagctgtactgggtcccctggcatccctggggtccctggcatccctggggtccctggctctgatggcaaaccaggcactccagggataaaaggagagaaagggctccccggactggctggagaccatggtgagttaggagagaaaggggatgcagggatccctgggatcccaggcaaagttggccccaagggtcccgtcggccctaagggtgctccaggcccccctggaccccgcggtcccaaaggtggctctggagactacaaggctacccagaaagtagccttctctgccctgaggacggtcaacagcgccctgcgaccaaaccaggccattcgcttcgaaaaggtgatcaccaatgttaatgataactacgagccgcgcagtggcaagttcacctgcaaggtacctggcctctactacttcacctaccacgccagttcccgcgggaatctgtgtgtgaacatcgtgcgcggccgcgaccgagaccgcatgcagaaagttctcaccttctgcgactatgcccaaaacaccttccaggtcaccacgggtggggtagtcttgaagctggagcaggaagaggttgttcacctgcaggccacagacaagaactccctgctgggcgtcgagggagccaatagcatcttcactggctttctgcttttccctgacatggatgtatgatcacggggtcaaatcactcctatccaaaacctcctccctgccagtaatcctccctggaccccagacactgccctttgactgcccaaagccctgaccagagccctgtagatgttacagaatgggtaaataaactcttcaaggccaagaaaaaaaaaaaaaaaaaaaaaaaaaaaaaaaaaaaaaaccc

SEQ ID NO: 3471 - DNA, 5905 bp, Rattus norvegicus
  Genbank Accession No. NM_019265
tctggagccatacggtgccctgatcctctgtaccaggaagacagggtgaagatggaggagaggtactacccggtgatcttcccggacgagcggaatttccgccccttcacttccgactctctggctgccatagagaagcggattgctatccaaaaggagaggaagaagtccaaagacaaggcggcagctgagccccagcctcggcctcagcttgacctaaaggcctccaggaagttacctaagctttatggtgacattccccctgagcttgtagcgaagcctctggaagacctggacccattctacaaagaccataagacattcatggtgttgaacaagaagagaacaatttatcgcttcagcgccaagcgggccttgttcattctggggccttttaatcccctcagaagcttaatgattcgtatctctgtccattcagtctttagcatgttcatcatctgcacggtgatcatcaactgtatgttcatggcgaattctatggagagaagtttcgacaacgacattcccgaatacgtcttcattgggatttatattttagaagctgtgattaaaatattggcaagaggcttcattgtggatgagttttccttcctccgagatccgtggaactggctggacttcattgtcattggaacagcgatcgcaacttgttttccgggcagccaagtcaatctttcagctcttcgtaccttccgagtgttcagagctctgaaggcgatttcagttatctcaggtctgaaggtcatcgtaggtgccctgctgcgctcggtgaagaagctggtagacgtgatggtcctcactctcttctgcctcagcatctttgccctggtcggtcagcagctgttcatgggaattctgaaccagaagtgtattaagcacaactgtggccccaaccctgcatccaacaaggattgctttgaaaaggaaaaagatagcgaagacttcataatgtgtggtacctggctcggcagcagaccctgtcccaatggttctacgtgcgataaaaccacattgaacccagacaataattatacaaagtttgacaactttggctggtcctttctcgccatgttccgggttatgactcaagactcctgggagaggctttaccgacagatcctgcggacctctgggatctactttgtcttcttcttcgtggtggtcatcttcctgggctccttctacctgcttaacctaaccctggctgttgtcaccatggcttatgaagaacagaacagaaatgtagctgctgagacagaggccaaggagaaaatgtttcaggaagcccagcagctgttaagggaggagaaggaggctctggttgccatgggaattgacagaagttcccttaattcccttcaagcttcatccttttccccgaagaagaggaagtttttcggtagtaagacaagaaagtccttctttatgagagggtccaagacggcccaagcctcagcgtctgattcagaggacgatgcctctaaaaatccacagctccttgagcagaccaaacgactgtcccagaacttgccagtggatctctttgatgagcacgtggaccccctccacaggcagagagcgctgagcgctgtcagtatcttaaccatcaccatgcaggaacaagaaaaattccaggagccttgtttcccatgtgggaaaaatttggcctctaagtacctggtgtgggactgtagccctcagtggctgtgcataaagaaggtcctgcggaccatcatgacggatccctttactgagctggccatcaccatctgcatcatcatcaataccgttttcttagccgtggagcaccacaacatggatgacaacttaaagaccatactgaaaataggaaactgggttttcacgggaattttcatagcggaaatgtgtctcaagatcatcgcgctcgacccttaccactacttccggcacggctggaatgtttttgacagcatcgtggccctcctgagtctcgctgatgtgctctacaacacactgtctgataacaataggtctttcttggcttccctcagagtgctgagggtcttcaagttagccaaatcctggcccacgttaaacactctcattaagatcatcggccactccgtgggcgcgcttggaaacctgactgtggtcctgactatcgtggtcttcatcttttctgtggtgggcatgcggctcttcggcaccaagtttaacaagaccgcctacgccacccaggagcggcccaggcggcgctggcacatggataatttctaccactccttcctggtggtgttccgcatcctctgtggggaatggatcgagaacatgtggggctgcatgcaggatatggacggctccccgttgtgcatcattgtctttgtcctgataatggtgatcgggaagcttgtggtgcttaacctcttcattgccttgctgctcaattccttcagcaatgaggagaaggatgggagcctggaaggagagaccaggaaaaccaaagtgcagctagccctggatcggttccgccgggccttctccttcatgctgcacgctcttcagagtttttgttgcaagaaatgcaggaggaaaaactcgccaaagccaaaagagacaacagaaagctttgctggtgagaataaagactcaatcctcccggatgcgaggccctggaaggagtatgatacagacatggctttgtacactggacaggccggggctccgctggccccactcgcagaggtagaggacgatgtggaatattgtggtgaaggcggtgccctacccacctcacaacatagtgctggagttcaggccggtgacctccctccagagaccaagcagctcactagcccggatgaccaaggggttgaaatggaagtattttctgaagaagatctgcatttaagcatacagagtcctcgaaagaagtctgacgcagtgagcatgctctcggaatgcagcacaattgacctgaatgatatctttagaaatttacagaaaacagtttcccccaaaaagcagccagatagatgctttcccaagggccttagttgtcactttctatgccacaaaacagacaagagaaagtccccctgggtcctgtggtggaacattcggaaaacctgctaccaaatcgtgaagcacagctggtttgagagtttcataatctttgttattctgctgagcagtggagcgctgatatttgaagatgtcaatctccccagccggccccaagttgagaaattactaaggtgtaccgataatattttcacatttattttcctcctggaaatgatcctgaagtgggtggcctttggattccggaggtatttcaccagtgcctggtgctggcttgatttcctcattgtggtggtgtctgtgctcagtctcatgaatctaccaagcttgaagtccttccggactctgcgggccctgagacctctgcgggcgctgtcccagtttgaaggaatgaaggttgtcgtctacgccctgatcagcgccatacctgccattctcaatgtcttgctggtctgcctcattttctggctcgtattttgtatcttgggagtaaatttattttctgggaagtttggaaggtgcattaacgggacagacataaatatgtatttggattttaccgaagttccgaaccgaagccaatgtaacattagtaattactcgtggaaggtcccgcaggtcaactttgacaacgtggggaatgcctatctcgccctgctgcaagtggcaacctataagggctggctggaaatcatgaatgctgctgtcgattccagagagaaagacgagcagccggactttgaggcgaacctctacgcgtatctctactttgtggtttttatcatcttcggctccttctttaccctgaacctctttatcggtgttattattgacaacttcaatcagcagcagaaaaagttaggtggccaagacatttttatgacagaagaacagaagaaatattacaatgcaatgaaaaagttaggaaccaagaaacctcaaaagcccatcccaaggcccctgaacaaatgtcaagcctttgtgttcgacctggtcacaagccaggtctttgacgtcatcattctgggtcttattgtcttaaatatgattatcatgatggctgaatctgccgaccagcccaaagatgtgaagaaaacctttgatatcctcaacatagccttcgtggtcatctttaccatagagtgtctcatcaaagtctttgctttgaggcaacactacttcaccaatggctggaacttatttgattgtgtggtcgtggttctttctatcattagtaccctggtttcccgcttggaggacagtgacatttctttcccgcccacgctcttcagagtcgtccgcttggctcggattggtcgaatcctcaggctggtccgggctgcccggggaatcaggaccctcctctttgctttgatgatgtctctcccctctctcttcaacatcggtctgctgctcttcctggtgatgttcatttacgccatctttgggatgagctggttttccaaagtgaagaagggctccgggatcgacgacatcttcaacttcgagacctttacgggcagcatgctgtgcctcttccagataaccacttcggctggctgggataccctcctcaaccccatgctggaggcaaaagaacactgcaactcctcctcccaagacagctgtcagcagccgcagatagccgtcgtctacttcgtcagttacatcatcatctccttcctcatcgtggtcaacatgtacatcgctgtgatcctcgagaacttcaacacagccacggaggagagcgaggaccctctgggagaggacgactttgaaatcttctatgaggtctgggagaagtttgaccccgaggcgtcgcagttcatccagtattcggccctctctgactttgcggacgccctgccggagccgttgcgtgtggccaagccgaataagtttcagtttctagtgatggacttgcccatggtgatgggcgaccgcctccattgcatggatgttctctttgctttcactaccagggtcctcggggactccagcggcttggataccatgaaaaccatgatggaggagaagtttatggaggccaacccttttaagaagctctacgagcccatagtcaccaccaccaagaggaaggaggaggagcaaggcgccgccgtcatccagagggcctaccggaaacacatggagaagatggtcaaactgaggctgaaggacaggtcaagttcatcgcaccaggtgttttgcaatggagacttgtccagcttggatgtggccaaggtcaaggttcacaatgactgaaccctcatctccacccctacctcactgcctcacagcttagcctccagcctctggcgagcaggcggcagactcactgaacacaggccgttcgatctgtgtttttggctgaacgaggtgacaggttggcgtccatttttaaatgactcttggaaagatttcatgtagagagatgttagaagggactgcaaaggacaccgaccataacggaaggcctggaggacagtccaacttacataaagatgagaaacaagaaggaaagatcccaggaaaacttcagattgtgttctcagtacattccccaatgtgtctgttcggtgttttgagtatgtgacctgccacatgtagctcttttttgcatgtacgtcaaaaccctgcagtaagttaatagcttgctacgggtgttcctaccagcatcacagaattgggtgtatgactcaaacctaaaagcatgactctgacttgtcagtcagcaccccgactttcagacgctccaatctctgtcccaggtgtctaacgaataaataggtaaaagaaaaaaaaaaaaaaaaaaaaaaaa

SEQ ID NO: 3472 - DNA, 3037 bp, Rattus norvegicus
  Genbank Accession No. NM_019269
gaactcacgagcctcgcacgcagaggccctcagcgccccgtttcccgctctgcggtatccccagatccccggacgggtgctgtgggaggctgaggacggcatgcgggactacgacgaggtgaccgccttcctgggcgagtgggggcccttccagcgcctcattttcttcctgctcagcgccagcatcatccccaatggcttcaatggtatgtctatcgtgttcctggcggggaccccggagcaccgttgccttgtgcctcacaccgtgaacttgagcagcgcgtggcgcaaccacagtatcccgttggagacgaaggacggacgacaggtgcctcagagctgccgccgctaccgactggccaccatcgccaacttctctgcgctggggctggagccgggacgggacgtggacctggagcagctggagcaagagaactgcctggatggctgggagtacaacaaggacgtcttcctgtccaccatcgtgacagagtgggacctggtgtgtaaggatgactggaaagccccactcaccacctccttgtttttcgtgggtgtgctgatgggctccttcatttcgggacagctctcagacaggtttggtcgcaagaatgtgctgtttttgaccatgggcatgcagactggcttcagcttcctgcagctcttctctgtgaacttcgagatgtttacagtgctttttgtccttgttggcatgggtcagatctccaactacgtggcagcatttgtcctgggaacagaaattctttccaagtcaattcgaattatattcgccaccttaggagtttgcatattttatgcatttggcttcatggtgctgcctctgtttgcatacttcatcagagactggaggatgctgctgcttgcgctcactgtaccaggggtgctgtgtggggctctctggtggttcatccctgagtccccccgatggctcatctctcaaggccgagttaaagaggcagaggtgatcatccgcaaagctgccaaattcaatgggattgttgcgccttccactatcttcgatcccagtgagttacaagacttaaattccaagaagcctcagtcgcaccacatttatgatctggtccgaacacgaaatatcaggatcatcaccatcatgtccataatcctgtggctgaccatatcagtgggctacttcggactttctcttgacactcctaacttgcatggggacatctatgtgaactgcttcctactggcagctgttgaagtccccgcctatgtgttggcctggctgttgctacagcacctgccccggcggtattctatctctgctgccctcttcctgggtggcagtgtccttctcttcatacagctggtgccttcagaattgttttacttgtccactgccctggtgatggtgggcaagtttggaatcacctctgcctattccatggtctatgtgtacacggccgagctgtaccccactgtggtcagaaacatgggtgtgggggtcagctccacagcatcccgccttggcagcatcctgtctccctactttgtctaccttggtgcctatgatcgcttcctgccttatatcctcatgggaagtctgaccatcctgacagctatcctcaccttgttcttcccagagagctttggtgcccctctccccgacaccattgaccagatgctcagggtcaaaggaataaaacaatggcaaatccaaagccaaacaaggacgcaaaaagatggtggagaaagcccaacggtcctaaagagcacagccttctaacaccctgtccagaaggtgaaaaactgaaaggaaacctgcgtgtagtcagaaatgctctcaatcactgagggctttctgttctgttgaccttgtgtctcacatgctcacggatggggcatctgtcctgaagagccaccttcctccagggccaccaaggctaaccacacacagcttgcacatcccatcacagtgtggactggggcctcccagagaagttactgagtctcttgaagcagtgggacttggaagactgagaaacatctgctagacatgctttgttatcctgtaagacctgatagtcacagacagaacagcaggtctgtttcccctcctttccctaactgaagaacttacaggaaaggaataaaagtgactcagtggtggtgtgcttgtctaggatgcaccagaaggaaacaaaaatttcttttcagaaaataagtgattccatggggagtttgatttctcatcttacctaagttaaccaaaatcctgtgatcattttaacccacaacagaagaacacaagaccaagggaaccctaaaggaaactgaggtgaggctggtacataaagcagacagtgtgtggactgtggctgctctgcccctcagccagctgtactgtgtgtgtctggtcagggtcctgccttgcccagaccctgtgagaaacctactgttgaggccaggcttggcctccactgctgtgtaaatcagaactcaggctgccagacacttggctgtgtcttgagggaaatgtatggataacagagtgttccttccttcttccagcactgtcatgggagtttgtcatctgctgttgtatctcaagctatttgtcctttagcagaaacttgggaactgcctgtgtttcccagctcagggttaccctggctggtgtgcagttgccaatataaatggccttcacagtcttagccactagagcggctctgagtgccaaaaatactaacaccatgcttcttccttttacgatgtgtaatcatgaggaaaatcacaagaaagaaatgtaaattgtgttcacagtctctcagagtcgctggctgcagtcacatcggtggggatttcgtgttcagtgattgtcttctcttctgattatgttgccatggtgctccgaaagcacacgcttcacgctcttaaaatgcaaaacaaacacagaaacccgtattttgtgaaagctactgaagtgccttgggcaaggatatggttttaataaactgatttttttttttaaataaaaaaaaaaaaaaaa

SEQ ID NO: 3473 - DNA, 1731 bp, Rattus norvegicus
  Genbank Accession No. NM_019271
ctgatggccggagagatgacgatcttaggttccgctgtcttgactctcctgttggctggctacttggcacaacagtatttaccactgccaactccaaaagtgattggcattgacctgggcaccacctactgttccgtcggtgtattttttcctggaacagggaaagtaaaggtgatcccagatgaaaacgggcatattagcatccccagcatggtgtccttcactgatggcgatgtgtatgtgggctatgaaagcctagagctggcagactccaatcctcagaacacaatatatgatgctaaaaggttcataggtaagattttcacccctgaagagctggaggctgaaattggcagatacccatttaaggttttacacaaaaatggaatggctgagttttctgtgacaagtaacgaaaccatcattgtttctccggagtacgtcggctctcgattgttgctgaagctaaaggaaatggcagagaaataccttggaatgccggttgccaatgctgtcatttctgtgccagcagaatttgacctacaacagagaaattcaacaatccaagctgccaaccttgctggactgaagatcttgagggtaataaatgaaccgacagcagcagcgatggcctatggtctccacaaggttgatgtcttctacgtgttagtcatagacctgggtggaggaactcttgatgtgtcattactgaataaacaaggaggaatgtttctaacacgcgcaatgtctggaaacaacaaacttggaggacaagacttcaatcaaaggctgcttcagtatttgtataaagagatctatcaaacatacggctttctcccttctaggaaagaggagatccacagattaagacaagcagtggaaatggtcaagctaaacctgacgcttcatcagtctgcccaggtatcagtattactcactgtagaggaaaacgacagccagaaacctcagaatgctgactctaaacttccagaagaccagcttaccccaggggatggtcaccatgtgaacagggtgtttagacctggcctttctgacagcacgagtgcaaaaagtcaggttttgtttgagacagaagtatcacgcaagctcttcaacaccctcaatgaagatctctttcagaaaatactcgtacccattcagcaagtattaaaagaaggcctcttagacaagactgaaattgatgaggtggttctagttgggggttctacgcgcattcctcggatccgccaagttattcaggagttctttggaaaggacccgaacacgtctgtagaccctgacctggcagtggtgacgggagtggccatccaagctgggattgatggagggtgctggcctctccaagttagtgctttagaaattcccaataagcatttacagaaaaccaacttcaactgaactctgagggagtgctggtaactgattgtgtctagtggtgttaatgatttccatgtgaacctcctccagaaatgaaggccatgaagtcactcatggattcatgagaggacatttatacatgacaactttacatagtattttgttttagaattgaatatgaccagatgagtcttgattgtgtttgtaaaaaaggaaaaaaaaaaaaaaaagaagctcagtatttctaaagtaacattggggggtaaaactcctggattctggaagtaggtagccatttgtacttactagtctggaccttaatagtgtcaacta

SEQ ID NO: 3474 - DNA, 2742 bp, Rattus norvegicus
  Genbank Accession No. NM_019274
  misc_feature (1)..(2742): n = a or c or g or t
cagcagccttgccctctgacttgatatttaccagacccggccagcatggctgtcctgaatccaatgactttgggaatttatctccaactcttcttctgctccatcgtgtcgcagccaactttcatcaacagtgtcctcccaatctcagcagcccttcctggcctggatcagaagaaacgaggcaaccacaaagcatgctgcctactgatgcccccgccacccccactcttcccaccgccattcttcagaggcagccgaagcccgcttctctccccagacatgaagaatcttctggaacttgaggcctccccatcaccctgcatgcaaggctctctaggctctcctggcccccctgggccccagggtccacctgggcttcctggcaaggcaggaccaaagggagaaaagggggatcttggccgcccaggaaggaagggtagacctggacccccaggtgttcctggcgagcccgggcccgttggctggccaggccctgaaggacccaggggcgaaaaaggcgacgtgggtatgatgggtctgccagggtcaagaggaccgatgggctctaagggcttccctggatccagaggggaaaagggatccagaggtgaaagaggggacttgggtcccaaaggagaaaagggtttccctggatttcctggaatgctggggcagaaaggtgaaatgggtccaaagggagaatctgggatagcaggacatcggggccccacaggaagaccagggaaacgaggcaagcagggtcagaagggagacagtggaattatgggcccaccaggcaaacctgggccttctggtcaacctggccgtcaaggtcctcccgggcccccaggacccccatctgcaggacaacttgtaatgggactcaaaggggaaagaggatttccagggcccccgggaagatgcctttgcggaccccctgcgaatgtgaataacccctcctatggggaccccatgtatgggcgcggctcccctcgagttcctgcgatttttgtggtcaacaaccaggaggagcttgagaagctgaacactcaaaatgccattgcctttcgaagagaccagcgatctctgtacttcaaagatagccttggctggctccccatccagctaacccctttctacccagtgggtttacaccataaagcagcatggcacctgtgtggggatggggtcctgcagcctggggaggaatgtgacgatggtaacccggatgtgagtgacggctgcattgactgtcatcgggcctactgtggagacggttatcggcaccggggcgtggaggactgtgacggctctgactttggctacctgaagtgcgagacctatctccctggatcatacggagaacttcggtgcacccagtattgctccatcgactccacaccctgccgatacttcacgtgagaggctgcagggacaggtgggctgtggcccatggacccgttggctgtttctctacccttcacatcaagctggccttgccctctcctgggacagtgccctttgaccttcatgtgacaaaacaaggatatattcttgctgctacgacatgcttttgactccgtatgactggaagttttggaccactgaatcctgtcttaattctaagaaccagaatccttctataccccaccctggaaacttccccatcccctccaatctggctaaacagctggctgtaatgcctgatctcttctggaaagatgctggctgaagcgtggatttggcttagcactgttaagcatacaggcatctacaggcctggcgtggttcgttctggtctaccaggtttaggggtgctcgtgaacaggcttctgcacctccaagcacatctgttccgaccccaaagcgagccagctgctgggtctctcaagatttaagaaccacatcataggaggtgagaaattctcttggtgcagctcccagcttcagacctgctgaggggacccttcagctggctggagcctggatcaacttcatgttgatcagtcaggggtacgagagagccacaaggcccaagcttggtcccaggaagagggtgaaggctcagctgagtcactgccatgtgacccctaccagaacagaaaccttcttccttcccgaagttctctgaggcaccatctgaccttgtgcttctctctgcaccttgacctctgtcttgacagtgccctcttgcaacgtgcctgtgtgaaagtctcacccctcatgccctcccatggcccgtgctgctgtttcctcatgctggcttccctggcttgggctccactgccaagtccttggctgcaggacgcgccggtgactctcttccatgcccatcttgcataccccttgttccctcactgtgtgcccaacctcttcctttatcctgggattctttttcctaagccctgcatttctgagaactgccttcccatatttcatgaatggggtttggctctatttggggaaacatcgctttttgtccccctccccaatgcgcgcacctgccttgccccactacccaggctgcctctgggctgtgcaaagctcttcagtgagcccaagccttgggaattcagcaggtggcaccttctcacccagcaagtccgagctgtgaatggtatttcctgagagaaatcagcctgaggnnnncttcaggggcagacagctatctatttactattctgggacttctgggtgggcaaacaagaaataaaggtgattcttggctgtgaaaaaaaaaaa

SEQ ID NO: 3475 - DNA, 3059 bp, Rattus norvegicus
  Genbank Accession No. NM_019277
ccgcgtcgacccggcacaaacacaccatgcaccctgacagtaaatttataaaaaatttttttcaactatagcacaaaaaatgtgtatcacttaacagggatgacaaatggctgtcacttcagtcactataatgcacaatatatatatgccttctacttatgaagcacgtttactggaaaacaactgttatgcagacggcatcctcatttttcttatgtttggtctcttgtcccttgagagatcatgtccagtaagggatctacaacagttccttgtgtgtgttaacaatgatgaaatcacaattgatgtgttttcctgagtctgtccccacagttaaacaatgcctttctccccggggcgccgcgcccggccggcgcctccgcttccagccaagatggcggagagcggcgaggctctgggtacggtcccggagcacgagcggatcttgcaggagatcgaaagcacggacaccgcctgcgtagggcccacccttcggtctgtgtatgatggtcagccaaatgcacacaagaagttcatggaaaagctagatgcctgcatccgcaaccatgacaaggagattgagaaaatgtgtaacttccatcaccagggctttgtagatgctatcacagagctcctcaaagtaagggcggacgcagaaaagctgaaggtccaggttactgataccaaccgaaggttccaagatgctggaaaagaggtgatagaacaaacagaagatattattcggtgtagaattcagcagagaaatattacaaccgtagtagagaaattgcagttatgcctgccagtgttggagatgtacagtaaactgaaggaacagatgagcatgcagaggtattattctgcacttaaaacaatggaacagttagagaacgtatactttcctcgggttagccagtaccgcttctgtcagctcatgatggacacacttcctaaactccgggaggatatcaaagacatctccatgtctgacctcaaggactttctggaaagcattcgaaagcattctgacaaaataggggaaacagccatgaaacaggcacaacagcagaagagcttcagtattgctgtacagaagcaaaccaatatgaggtttgggaaaaatatgcatgtaaacaatgacaggactctagaggaaaagagtgacatcatactgaagcacacacttgaggaggaggccgagaatgacgaggaggtcttaactgttcaagatctcgttgacttttcccctgtttaccgatgctcacacatttattctgctttgggtgatgaagaaacatttgaaaattattaccggaagcaaaggaagaagcaggcgcgcctggttctgcagccgcagtcgagtgtgcatgaaacagttgatggctatagaagatatttcactcagattgtagggttctttgttgtggaagatcacattttacatgtgacccaaggattagtaaccagggcatacactgatgaactctggaacatggccctctcaaagataattgctgtcctcagagctcactcatcttactgcactgatcctgaccttgttctggagctgaagaatctcatcgtcatttttgcggatactttgcagggttatggcttttctgtcaaccgactctttgaccttctatttgaaataagagatcaatacaacgaaacactgcttaagaaatgggccggtattttcagggacatttttgaagaagataactacagccctattcctattggcagtgaagaagaatataaaatggtcatcagtaaattccccttccaagatccggaccttgaaaagcaatccttcccaaagaagtttcccatgtcccagtcagtgcctcttatttatattcaagttaaagaatttatttatgccagtcttaaattctcagagtcactacaccgaagctctacagaaatagacgatatgcttaggaagtcaacaaatctgctgctgaccaggattctgagtagctgcttactgaacctcattagaaaacctcacataggtttgacagagctggtgcaaattatcataaacacaacacacctggagcaggcttgcaaatacctggaggactttataactaacattacaaatatttctcaagaaaccgttcacaccacaagactttatggactttctacttttaaggatgcacgacatgcagcggaaggagaaatatataccaaactcaatcagaagattgatgagtttgtccagctggccgactacgactggaccatggctgagtcggatgggagagcaagtggttatttaatggatcttattaattttttgagaagcatctttcaagtatttacccacttgcctgggaaagttgcccagacagcttgcatgtcagcctgccaacatctgtccacatccttgatgcagatgctcctggacagcgagttaaagcagatcagcatgggggccgtacagcagtttaacctagacgtcatacagtgcgaattgtttgccagctctgagcctgtgccaggattccaaggggacaccctgcagctggccttcattgacctcagacagctccttgacttgtttatggtttgggactggtctacttacctggctgactatgggcagccagcttccaagtacctccgggtgaacccacacgccgcccttacgcttttggagaagatgaaggacaccagtaagaagaataacatatttgcccagttccggaagaacgaccgggacagacagaagctgatcgagacagtggtgaaacagctcagaggcttggtgaccggtatgtcccagcacatgtagaccagatccatgcccgagtgcttctctgtggccagcaccggtcatgagacaataatttgtttacagaagccaaaaactgtagtagaggaaagatactaatgagggcttaaacaataaggacagcaaacatcatttgtatggacttttaataactgaatactattttatatataaaaatgtaacattaattttttccaattttagaagaaaagtcaaaagtgtaatatataaacccaataaattgtgtatg

SEQ ID NO: 3476 - DNA, 1940 bp, Rattus norvegicus
  Genbank Accession No. NM_019283
cacaaccaccaaatatatccacacgttgacgtgatttcttgcccttactcacactaagcccgcgtgtcgatccatctctatggatcccgaacctactgaacactccaccggcggcggctcggttccccgccagccgcccagcgcgcagacggggcttgatgtccaggttgtcagcgcagctggcgactcaggtaccatgagccaggacaccgaagtggacatgaaagatgtggagctgaacgagctggaaccggagaagcagcctatgaatgcagcggacggggcggcagccggggagaagaacggtctggtgaagattaaggtggccgaagacgaggcggaagccggggtcaagttcacaggcttatccaaggaggagctattgaaggtagctggcagcccgggctgggtgcgcacccgctgggcgctgctgctgctcttctggctcggttggctgggtatgctggcgggcgccgtggttatcatcgttcgggcgccacgctgccgtgagctgccggtacagagatggtggcacaagggcgccctctaccgcatcggcgaccttcaggccttcgtaggcccggaagcgagaggcatagctggtctgaagaaccatctggagtacttgagcaccctgaaggtgaagggcctagttttgggcccaattcacaagaaccagaaggatgaagtcaatgaaaccgacttgaaacagattgatcccgatttaggctcccaggaagattttaaagaccttctacaaagtgccaagaaaaagagcattcacatcattttggacctcactcccaactataagggccagaatgcatggttcctccctcctcaggctgacattgtagccaccaaaatgaaggaggctctgagttcttggttgcaggacggtgtggatgggttccaagttcgggatgtgggaaagctggcgaatgcatccttgtacttggctgagtggcagaatatcaccaagaacttcagtgaggacaggcttttgattgcagggaccgcgtcctctgacctgcaacaaattgtcaacatacttgaatccaccagcgatctgctgctgaccagctcatacctgtcacagcccgttttcactggggagcatgcagaactcctagtgattaagtatttgaatgccactggcagccgctggtgcagctggagtgtgtcgcaggcaggactcctgacatcctttataccggctcagtttctccgactctaccagctgctgctcttcactctgccaggaactcctgttttcagctatggggatgagcttggccttcaggcagttgcccttcctggacagcctatggaggctccattcatgctgtggaatgagtctagcaactcccaaacctcaagtcctgtaagcctcaacatgacagtgaagggccaaaatgaagaccccggctccctcctcacccagttccggcgactgagtgacctccgtggtaaggagcgctctctgttacacggtgactttgatgcactgtcttcctcatctggcctcttctcctacgtccgccactgggaccagaatgagcgttacctggtggtgctcaacttccaggatgtgggcctgtcagccagggtaggagcctccaacctccctgctggcataagcctgccagccagtgctaaccttttgcttagtactgacagcacccggctaagccgtgaggagggcacctccctgagcctggaaaacctgagcctgaatccttatgagggcttgttgttacagttcccttttgtggcctgatccctctacacagaacctgccacccttctttcctctctcaggcctttggaattctggtctttctctccttattttgtttttgtttttaaacttttgcagattacatatgaattcttacactgggtgtttttgtcttcaaaataaaaaaaatcacccctgc

SEQ ID NO: 3477 - DNA, 1131 bp, Rattus norvegicus
  Genbank Accession No. NM_019286
atgagcacagctggaaaagtaatcaaatgcaaagcggccgtgctatgggagcctcacaagcccttcaccatcgaggacatagaagtcgcaccccccaaggcccatgaagttcgcattaagatggtggccaccggagtctgccgctcagacgatcacgcggttagtggatccctgttcacgcctcttcctgcagttctaggccacgagggagctggcattgttgagagcattggagaaggggtgacttgtgtgaaaccaggtgataaagtcatcccgctgttctctccccagtgtggaaaatgcaggatctgcaagcacccggaaagcaacctctgttgccaaactaagaatctgacacagcctaagggagctttgctggacggcaccagcaggttctcctgcaggggaaagcccattcaccacttcatcagcaccagcaccttctcccagtacactgtggtagatgacatagcggtggccaaaatcgatgcggctgcaccgctggacaaagtctgcctcatcggctgtggcttctcgactggctatggctctgccgtccaagtcgccaaggtgaccccaggctccacctgtgccgtgtttggcctgggaggtgttggtctgtctgtcgtcattggctgtaaaacagcaggagcagccaagatcattgccgtggacatcaacaaagacaagtttgcgaaggccaaagagttaggtgccactgactgtatcaaccctcaagactacaccaaacccatccaggaagttctccaggagatgactgatggaggggtggacttttcatttgaagtcattggccgtcttgataccatgacttctgccctgttaagctgccattcagcatgcggtgtaagcgtcattgtcggggtgcctcccagtgcccaaagcctctccgttaaccccatgtcgctgctgctgggacgcacctggaaaggagcaatattcggcgggtttaagagtaaagatgccgtccccaaacttgtcgctgacttcatggctaagaagtttccgttggagccgctgattactcatgttttaccttttgaaaagataaatgaagcatttgacctgctccgtgctggaaagagtatccgtaccgtcctgacgttctga

SEQ ID NO: 3478 - DNA, 1430 bp, Rattus norvegicus
  Genbank Accession No. NM_019289
atggcttaccacagcttcctggtggaacccatcagctgccatgcctggaacaaggaccgtactcagatcgccatctgccccaacaaccacgaggtgcacatctacgagaagagcggtgccaagtggaacaaggtgcacgagctcaaggagcacaacgggcaggtgacaggcatcgactgggcccccgagagtaaccgcattgtgacctgcggcacagaccgcaatgcctatgtgtggacgctgaagggccgcacgtggaagcccacgctggtcatccttcggattaatcgagctgcccgctgcgtgcgctgggcccccaatgagaacaagttcgccgtgggcagtggctcccgtgtcatttccatctgttattttgagcaggagaatgactggtgggtgtgcaaacacatcaaaaagcccatccgctccactgtccttagcctggactggcaccccaacaacgtgctcctggctgcaggctcctgtgacttcaagtgcaggatcttctctgcctatatcaaggaggtggaggaacggccagcccctacaccgtggggctccaagatgccctttggggagctgatgtttgaatcgagcagcagctgtggctgggtgcatggtgtctgcttctcggccggtgggagccgagttgcttgggtcagccatgacagcactgtgtgcctggtagatgctgagaagaagatggccgtggcaaccctggcctctgagacattaccgctcctggccatcaccttcatcacagaaaatagtctcgtggcagcgggccacgactgcttcccggtgctgtttacctatgacaacgctgcggggacattgagctttggtggccggctggatgtgcccaagcagaactcccagcgtggcctgacagcccgagagcgcttccagaacctcgacaagaaggccagctctgaagggggtgcagccacaggggctggcctggattcactgcacaagaacagcgtcagtcaaatctcggtgctcagcgggggcaaggccaagtgctcgcagttctgcaccacaggcatggacggtggcatgagcatctgggatgtgaagagcttggagtcagccttgaaggacctgaagatcagatgagctgtgaggagtgctgtcctcatcccacatgctggggaggagggaaaggggttggggaggctaagggctgctttgctgaatgcttctagggtgtagtacaggtctgcaaaggggatgctctctctccaaagaggggaagaggaaggtggggaactttcctgcctatttaatgaaaatgtgccttttaaagagatgctttcattcattgcaaaccaaaaacaagacaaaaaacccaaagcacaatgctggtcataaactgcttcaaaatgtgggctaataaacataccaaatgtgaaaaaaaaaaaaaaaaa

SEQ ID NO: 3479 - DNA, 1259 bp, Rattus norvegicus
  Genbank Accession No. NM_019290
ggcacgagggcgagggtgcagccccggagcggcggcggggcaaaatgaaaaacgaaattgctgctgttgtcttctttttcacaaggctggttcgaaagcatgataagttgaaaaaagaagcagttgagaggtttgctgagaaattgactcaaatacttcaagagaaatacaaaaatcactggtatccagaaaaaccctcaaaaggacaagcctacagatgcattcgtgtcaataagtttcagagagttgatcccgacgtcctgaaagcctgtgaggacagctgcatcctgtacagtgacctgggcttgccaaaggagcttacactctgggtggatccgtgtgaggtgtgctgccggtatggaaagaaaaacaatgcattcattgttgccagctttgaaaatgaggatgagaacaaggatgagatctccaagaaagttagcagggctcttgataaggtgacctctgattatcattcagggtcctcctcctcagatgaagacacaagcaaggaagtagaagtgaaaccgagtgcagtggctacaacgccaagccccgtgtaccagatttcagaactgatattcccacctcttccaatgtggcaccctttgcccagaaaaaagccaggaatgtaccgagggggtggccatcagagtcactaccctcctcctgttccatttgcttatccaagtccaggaaggaagaataaagcgttccgcccaattccagtgacatgggtacctcctcctggaatgcattgtgatcggaatcactggattaatcctcacatgttagcacctcactagttcatttggattgggcggatgtcattttgatagaaaggaagaaataccttcttagatacttaagagtttcacaacttgtagtgaagtcagatggacaaaaccatcaggcttatttttatagaaaagctattgagataatctttcttaaagtatatatatatatgcactttagatatattgatatagtttgagaaactttattaaagttagtcaagtgcctgagtttttaatattggacttgagtatttatatattgtgcattgactctgttggatacaaaacactgtaggagggcgatatgttttagcacctttgagcatttactttatggagaatatgtaagttatttatacagaaggacatttattttatgtcacatagaagaattgtgtgaaatcatgtagttgcaaataaaaagtagtttgaggcgtgaaaaaaaaaaaaaaaaaaaaaaaa

SEQ ID NO: 3480 - DNA, 1201 bp, Rattus norvegicus
  Genbank Accession No. NM_019293
cgccaccaccccgccatgctcagagccaagatgctcgggagaggcccctacaagcccttagccatcctcaggcacatgggacctctctgtgccacaaggccacagcactggcgcttccagcattcctacgcagagaaacacagcaactgtgcccggcaccctctctggactggcccagtgtcctcaccgggaggcacccagcagtctcccattaatatccagtggacggatagtgtctatgacccgaagctggcaccgctcagggtctcctatgatgctgcgtcctgcagatacctctggaacactggttacttcttccaggtggagtttgacgattcctgtgaggagtcagggatcagtggtgggcctctgggaaaccactacaggctgaagcagtttcacttccactggggagcaacagatgaatggggctctgagcacatggtggacggccatgcctacccggctgagctccatttggttcactggaattccatgaaatatgaaaattacaagaaagccaccacgggggagaatggactggcggtgattggagtgtttctgaagctcggggcccatcacgaggccctgcagaggctggtggacatcttgccggaagtaagacacaaggacacacaggtgaccatggggccctttgacccttcttgcctgctgcctgcctgccgggattactggacctaccctggctccctcaccaccccaccactggctgagtcagtcacctggattgtgcacaagatgcccattgaggtgtccccgagccagctgtccacattccgtacactcttgttctccgggcgaggtgaggacgaggaggtgatggtgaacaacttccgcccgctccaaccactcaggggccgcaacgttcgctcctccttccaggtccccagggtgggaacaaagtcttgatctcaggatgaggtctgtaaggataggcagagcggatggaaaagggggtgcgcatttccagggtgcgacgcctggattaaaaaaaaaatggctgcagagatggctcaggggttaagagcactgactgctcttccagaggtcctgagttcagttcccagtaaccacatggtggctcacaaccatctgtaatgggatccgatgccctcttctggtgtgtctgaagagagcgacactgcactcatatgcattaaattaataaatctttaaaaaa

SEQ ID NO: 3481 - DNA, 6071 bp, Rattus norvegicus
  Genbank Accession No. NM_019299
ccctcccttccccttctcctcctctcccttggagagcccgggcaggcactgccctgcagccccagtgacaggaggagaccatactccccgacagcgccatggcccagattctgccaattcgctttcaggagcatctccagctccagaacctgggtatcaacccagcaaacattggcttcagtaccctgactatggagtcagacaaattcatctgcattagagaaaaagtgggagagcaggctcaggtggtgatcattgacatgaatgatccaagtaatccgattcgaagaccaatctcagcagacagtgccatcatgaatcctgccagcaaagtgattgcactgaaagctggaaaaactctacagatatttaacattgaaatgaaaagtaaaatgaaggcccacaccatgaccgatgatgtcaccttctggaaatggatctctctgaatacggttgctcttgttacggataatgcagtttatcactggagcatggagggggagtctcagccagtgaagatgtttgatcgtcattccagcctcgcagggtgccagatcatcaattaccgtacagatgctaagcagaagtggttgctcctgactggcatatctgcacagcaaaatcgcgtggttggagctatgcagctgtattctgtagacaggaaagtctctcagcccattgaagggcatgcggcgagttttgcacaatttaagatggaaggaaacgcagaagaatcgacgttattttgttttgctgtgcggggtcaggcaggggggaagttacatatcattgaagttggtacaccacccacaggaaaccaaccctttccaaagaaggcagtggatgtcttctttcctccagaagcacaaaatgattttcctgttgcaatgcagatcagtgaaaagcatgacgtggtgttcctgattaccaagtatggttatattcacctctatgaccttgagactggcacgtgcatctacatgaacagaatcagtggagaaaccatctttgttactgctcctcatgaagccacagctggaataataggagtcaacagaaagggacaagtcctatcagtttgtgtggaagaagagaacataattccttacatcaccaatgtcctacaaaatcctgatttggctctgagaatggctgtgcggaacaacctagctggtgcagaagagctcttcgcccggaaatttaatgctctcttcgcccagggaaactactcagaggctgcaaaggtggctgctaatgcaccgaagggaatccttcgtactccagataccatccgtcgattccagagtgtcccagctcagccaggtcaaacttcacctctgcttcagtattttggaatccttttggaccaaggccagctgaacaaatacgagtccttagagttatgtagacctgtccttcagcaagggcggaaacaacttttggagaaatggctgaaagaagataagctggaatgttctgaagaactgggtgatctcgtaaaatctgtggacccaacgttagcactgagtgtatacctcagggccaatgtccctaataaagtcatccagtgctttgcagagacaggtcaagtccagaagattgttttatatgctaaaaaagttggctatactccagactggatctttctcctgagaaatgtcatgcggatcagtccagatcaaggacagcagtttgcccaaatgttagttcaggacgaagaacctcttgctgatatcacacagattgtggatgtctttatggaatacaatctaatccaacaatgtactgccttcttacttgatgctttgaagaataatcgcccttctgaaggtcctttgcagacgcgattgcttgagatgaaccttatgcacgcacctcaagttgcagatgccattctagggaatcagatgttcacccactatgaccgggctcacatcgcccagctgtgtgagaaggcgggcctactgcagcgtgcattagaacatttcaccgacttatatgatataaaacgagcagtcgttcatacccatcttctcaaccccgagtggttagtgaattactttgggtccttatcagttgaagattccctagaatgtctcagagccatgctgtctgctaatattcgtcaaaatctacagatctgggttcaggtcgcttctaaatatcatgaacagctgtcaactcagtccctgattgaactcttcgagtcattcaagagttttgaaggcctcttttattttctggggtccattgttaacttcagtcaagacccagatgtgcactttaaatatattcaggcggcttgcaagactggacaaatcaaagaggtggaaagaatctgcagagagagcaactgctatgatccagagcgcgtcaagaatttcctcaaggaggcgaaactcacagatcagttgccactcatcatcgtctgtgaccgctttgacttcgtccatgacctggtgctgtatttatacagaaacagtcttcagaagtacatagagatatatgtccagaaagtaaatccaagtcgacttcctgtggttattggaggattgctggatgttgactgctctgaagatgtcattaaaaatttgattcttgttgtgagaggtcaattctctactgatgagcttgttgctgaagttgagaaaagaaacagattgaagctgcttcttccttggcttgaggctagaattcatgagggctgtgaggagcctgctacacacaatgcgttagccaaaatatacatcgacagcaataacaacccagagagattccttcgtgaaaacccctactatgacagtcgtgtcgtgggaaagtactgtgagaagagagacccacatctggcctgtgttgcttatgaacgtggccagtgtgatctggaactaatcaacgtttgcaatgagaattccctcttcaaaagtctttctcgctacctggtccgtcgaaaggatccagagttgtggggtagtgtgctactggaaagcaatccatacagaagaccattaattgaccaggtcgtacagacagccttgtctgaaactcaggacccagaagaagtgtcagtaactgtcaaggcttttatgacagcagatcttcctaatgaactcattgagctgctggagaaaattgtccttgataactctgtattcagtgaacacaggaatctgcaaaacctcctcatcctcactgcaattaaggctgaccgaacccgagttatggagtatattaaccgcctggacaattatgatgcgccagatattgccaacattgccatcagcaatgagctcttcgaagaagcatttgctattttccggaagtttgatgtcaatacttcagcagtgcaggtgttaattgaacatattggaaacctggatcgtgcatatgagtttgctgaacgctgcaatgagcctgctgtttggagtcaactcgcaaaagctcagttgcagaaagggatggtgaaggaagccattgattcttacatcaaagcagatgatccttcgtcttacatggaagttgttcaggccgccaatactagtggaaactgggaagaattggtgaagtatttgcagatggcacgcaagaaggcccgagagtcctacgtggagacagaattgatatttgcactggctaaaacaaaccgtcttgcagaattagaagagttcatcaatgggccaaataatgctcatattcagcaagttggtgaccgttgttatgatgagaaaatgtatgatgctgctaagttgttgtacaataatgtttctaactttggacgtttggcgtctaccctagttcaccttggcgagtatcaggcagcagttgatggtgctagaaaagctaatagtactcgaacatggaaagaggtctgctttgcctgtgtagatgggaaagagtttcgccttgctcagatgtgtggactccatattgttgtgcatgcagatgaattagaggagcttatcaactactatcaggatcgtggatattttgaagaactcatcaccatgttggaggcagccttgggactagagcgagctcacatgggaatgttcacagagctagcaattttgtattctaaattcaagccacagaaaatgagggaacacctagagttgttttggtcaagagtgaatattcctaaggtgctgagagccgcagagcaagcccatctttgggcagagctggtgtttctgtatgacaagtatgaagagtatgataatgccatcatcactatgatgaatcaccccaccgacgcatggaaggaagggcagttcaaagacatcatcaccaaggtggctaatgtggaactgtactacaaagcaatccagttctacttagaattcaagcccttgttgttaaatgacttgctcatggtgctgtctccacggttggctcatactcgtgcagtcaattatttcagcaaggttaaacagctaccactggtgaaaccatatttacgctcagttcagaaccacaacaacaagtccgtgaacgaatccctgaacaacctctttatcacagaggaggattaccaggctctgcgaacatcaatagatgcttatgacaactttgacaacatctcacttgctcaacgtttggaaaaacatgaactcattgaattcagaagaattgctgcttatctcttcaaaggaaacaatcgctggaaacagagtgtggagctgtgcaagaaagacagcctttacaaggatgcaatgcagtatgcctctgaatcgaaagacacagaattggctgaagaactcctgcagtggtttctgcaggaagagaagagagaatgctttggagcttgtctcttcacctgctacgatcttttaaggccagatgttgtcctggaaactgcatggagacataatatcatggattttgccatgccctatttcatccaggtcatgaaggagtatttgaccaaggtggataaattagatgcttcggagtcactgagaaaagaagaagaacaagctacagagacacagcccattgtttatggtcagccccagctgatgctaacagccggacccagtgtggcagtccctccccaggcaccttttggttatggttatactgcaccaccatatgggcagccacagcctggctttgggtacagcatgtgagacggaagctgatcccgtagtctcctattttcatactgaagcatcgtccacccacttctcagtttataaacgggaaacaggcaacgtgttcttgtaacctttacttcatgaaggactacctttttgttctaactatagactcggatcgcctaggttaaaactttattttcacattccgcatcattagaccttcttttcaaaggggaatagtactcacgtgggctttttctccccctcattctttgaagaactgattactattcaatctattgtgaagaacctgatttgcactctgtagtgtttaaagaaacaaagaaactctaatattgaatctcttaaatttagtgtatgtaaacagctttcactatgtattctgtaaatgcaccccattctcttttattcaaagaaaagctaacgtgaaaatactgctatgtgaccatgcaagactgtcagagccaacaaagacaacactaatcagcatatcttacattggaatcacagcgctctccaaattatttgaaaatgcatacagacaacttgcctgattttttttttttttaaaacgagtatcacaggccctgtaacctatgcaggtttccccattatgcatatagaaaatgctagtgtgttgctcacttcatgtgtaacaggtgccctcatgttgtgctgtatcctgtgctttttctgtgggaccattccattcaggaacaaagagcaccatgactgcacacgtgtgtatttactaacccttccctgaggtgtgtgtatgttggatattgtggtgttttagatcactgagtgtacagaagagagaattcaaacaagatattgctgttcttcagttttgttcgtggaatttgaaattactccaatttaaaataaattactggactgtggaaataacatgtagaattgcagttttaattaaatacatctcaaaaccag

SEQ ID NO: 3482 - DNA, 1768 bp, Rattus norvegicus
  Genbank Accession No. NM_019303
  misc_feature (1)..(1768): n = a or c or g or t
gctgccttcactatggatggtgtgagcacagccatcttgcttctcctcctggctgtcatctctctgtccctgaccttcacctcatggggcaagggccagctccctccaggacccaagcctctcccaatcctaggaaacctgctgcagcttcgctcccaagacttgctgacctcactcaccaagcttagcaaggactatgggtcagtgttcacggtgtacctggggcccaggcgtgtgattgtcctcagcggatatcaaactgtgaaggaggctcttgtggacaaaggggaggagttcagtggccgaggctcataccccatctttttcaacttcaccaagggcaacggcatcgccttctccgatggagaacgctggaagatcctccgaaggttctctgtccaaatcctgaggaactttggcatgggaaaaagaagcatcgaggagcggatcctggaagaaggcagcttcctgctggacgtgctgcggaaaacggaaggcaagccctttgaccccgtgtttatcctgagccgctcggtctccaacattatttgctctgtcatcttcggcagtcgtttcgattatgacgatgaacggctgctcaccattatccactttatcaatgacaacttccagattatgagcagcccctggggcgagatgtacaacatcttcccgagtctcctggactgggtgcctgggccgcacagacgcgtgttccggaactttgggggcatgaaagatctcatcgcccgcagcgtccgcgagcaccaggactccctggaccccaactctccccgggacttcatcgactgcttcctcacaaaaatggtacaggagaagcaagacccactgagccacttcaatatggacaccctnctgatgaccacacacaacctgctctttggtggaacggagactgtgggcaccactttacgccatgccttcctcattcttatgaagtaccccaaagtgcaagcccgtgtgcaggaagagattgattgtgtggtgggacgttcgcggatgcccacgctggaggaccgtgcatccatgccttacacagacgcggtgatccacgaagtgcagcgctttgcagacgtcatccccatgaacctgccccaccgcgtcattcgggacacacctttcaggggcttcctgatacccaagggcacagatgtcatcacgctccttaacaccgtgcactatgactccgaccaattcaagacccctcaggagttcaatcctgagcattttctggatgccaatcaatccttcaagaagagccccgccttcatgccattttcggcgggacgccgactgtgtctgggagagccactggcacgcatggagctgttcatatacctcacctccattctccagaacttcacgttgcatccgctggtggagcctgaggacatcgacctgaccccgctcagctcagggctgggcaatttgccaaggcctttccagttgtgtatgcgcattcgctgagtactgcaccaggggactgctctggccctcttccaggggtttcactgttgtgggcctccattgacgtctctctcacgttcccttccctaaacccggggcctgccacgtgtcggtactttacccttcctatcttaagcgcatcttcatggaaaaaatgacgtgacaaaggggaaatacccatcttatacgcacagaccctgttctgcgatgcacccttttcctggctgtttgtatcatttcctagtaaataccttactagtaaaaaaaaaaaaaaaaaaaa

SEQ ID NO: 3483 - DNA, 4259 bp, Rattus norvegicus
  Genbank Accession No. NM_019331
aaaaaagaggattccgtggcttaaaaaaaaagtttgaaagcctctgacttaatagtttccaccaccaaggaaactgaggcccagagagaggaaatgacctgggtaagatctccgagggaccagtagttgaacagggactaggagttaaaatttcatgggaggtgcctgtaacaggacctgccttggggtctctgctggaaagagagacctgattgggtttcccagcagtcttcagtggcttgctccgtggctgcctcagccaggtctccagcagccacacctggggatctggcccccgtcctgtcctccagccccacccacctcggctccatgccccccccagtcagcttcgggaccctggcagtgagcaggcacgtggcagccaaggccctgtgaccaggccagggagacggagctctggggtcccagtcacctgcccccccatggagctgagaccctggttgctatgggtggtagcagcagcaggagccttggtcctgctagcagctgaagctcgcggccagaagatcttcaccaacacgtgggctgtgcacatttctggaggcccagctgtggctgatagtgtggcacggaagcatgggttccacaacctgggccagatcttcggtgactattaccacttctggcacagagcagtgacaaagcggtccctgtcgcctcaccgcccgcggcacagccggctacagagggtgcctcaagtgaagtggctggagcagcaggtagccaagcaaagggccaagagggacgtgtatcaggagcccacagaccccaagttccctcagcagtggtacctgtctggggtcactcagcgagacctgaatgtgaaggaagcctgggcccagggcttcacagggcgtggcattgtggtctccatcctggatgacggcattgaaaagaaccatcctgacttggcaggcaattatgacccgggagccagctttgatgtcaatgaccaggaccctgacccacagcctcggtacacgcagatgaatgacaacaggcacggcactcggtgtgccggggaagtggcagcggtggccaacaatggtgtctgtggtgtaggtgtagcttacaatgcccggattggaggggtgcgtatgttggatggcgaggtgactgacgcggtagaggcacgttcgctgggcctgaatcccaaccacatccacatctacagcgccagctggggccccgaggacgacggcaagaccgtggatgggccagcccggctcgccgaggaggccttctttcggggagttagccagggccgcggagggctgggctccatctttgtctgggcctcagggaatgggggccgggaacatgacagctgtaactgtgacggctacaccaacagtatctacacgctgtccatcagcagtgccacacaattcggcaacgtgccctggtacagtgaggcctgctcctccacactggccaccacctacagcagtggcaaccagaatgagaagcagattgtgacaactgacttgaggcagaagtgcactgagtctcacacaggcacctcagcctccgcccctttggcagctggtatcattgctctcaccctggaggccaacaagaacctcacctggcgggacatgcagcacctggtggtgcagacctcaaagccagcacatctcaacgctaacgattgggccaccaatggcgtgggccggaaagtgagccattcctatggctacgggctgttggatgcaggtgccatggtggccctggcccagaactggacaacagtggccccccagcggaagtgcatcattgaaatcctggcagagcccaaggacattggcaaacggctagaggtgcgcaagaccgtgacagcgtgcctgggtgagcccaaccacatctccagactggaacacgttcaggcacggctcaccctgtcttacaatcgccgtggtgacctggctatccacctcatcagccccatgggcacccgttccaccctattagctgccagaccacatgactactctgctgatggatttaatgactgggctttcatgacaactcattcctgggatgaggacccctctggcgagtgggtcctagagattgaaaataccagcgaggccaacaactatgggacgctgaccaagttcactctcgtcctatatggcacagcctctgagggtctctctgcacctccagagagcagcggctgcaagaccctcacatccagccaggcctgcgtggtgtgtgaggaaggtttctcactgcaccagaaaagctgtgtccagcgttgcccaccaggcttcacaccccaagtccttgatacacactacagcactgagaatgatgtggagatcatccgtgccagcgtctgcaccccctgccacgcctcatgtgccacttgccagggcccagctcccacagactgcctcagctgccccagccatgcctccctggaccctgtggagcaaacctgctcccggcaaagccagagcagccgagagtcccgacctcagcagccacctcccgcactgcgcccagaggtggaagtggagccccggttgcgggctgggctggcctctcacctgccggaggtcctggccggcctcagctgccttatcatcgctctcatctttggcatcgtcttcctcttcctgcatcggtgttcaggcttcagcttccggggagtgaaagtgtacaccatggaccgtggcctcatctcctacaaggggctgcctcctgaggcctggcaggaggagtgcccatctgactcagaagaggatgagggccggggcgagaggaccgcctttatcaaagaccagagcgccctttgatgagcccactgcccaccctatcaaatcgatcccttcctcggcactttttaattcaccaaagtatttttttatcttgggactgggtttggaccctagctgggaggtgagaggggcagagacccttgggcctacctgtttgcctgaggtggggtcccgggagcctcaccccccaccaaccctccatgtggaggaaggagtaaatctttagggcagcttcctgcagagtgaagaggggcagcctttctgactccctggccagctgcagccttgcccctcccctgcccctcagaaagcaataatggtccccatccaggcaacagggaggctggccaggaggtacttgaagaaggtggccacctctccaagggcttttgcatcccctgaccctctctggctcaggatgagcctctgaagaagcttgcagtcacaggaagggaccaaagcaaacgaggcactctccagtgtgcctgcactcttgctctcagcctgcctctgcactccaggtctccacctcagctggtagccaggctgagctagacctgcacaggtcaggctctggggccttatgctggtgtcctgaccatcctctatggcaccccccccccaagccagggccttgttttctgagcccggggctgcctgggcagttggcgctcacagtccaggagcccctgggtgggtggtggggagggacggtggctcctcccacctcccacccgatgctgctttcccctgtggggatctcaggagctgtttgaggatatattttcactttgtgattattcactttagatgctgatttttttttttttgtatttttaatgggggtagcagctggaccattcaccttctcctacccatgtccaccctgcctttcccatggctgcccagctctgaggcagagggaatcactaagccccaagtcctgaagaggcaggccagccagctgggctccaggaaagggggtcatggtgggaggggtaggctgacatcatctgtttcaaatggggttgtgccacaggcttttgggttgctggctctccaagtgccaggggtgggcaggtggcaccaccaagcccaaactaacactgtgccctggtggagaaagcattggcctatgatgccccccaaaccccctgttctgatgtgcctttcgcacccctcccattaggacaatcagtcccctcccacttgggcctcctcttttctttttcctagcccttctcggtacccaacctacctgtccagggtgccccttgctctcctgcccacccctagcggccatccaggctggttttgtaagatgctgggttggtgcacagtcatttttttttccttgtaatttaaacaggcctggcattgttggttctatttaatggacacgagataatgttagaggttttaaagtgattaaacgtgcagactatgcaaacc

SEQ ID NO: 3484 - DNA, 3808 bp, Rattus norvegicus
  Genbank Accession No. NM_019335
gaactagcctgacctggacttgcccggcagaagcgacagtggtcggagggcgacgagattttaggggcagcacctgaagcacaattcgagtcctgcgccagggcacgggccattgtccggatccagaaagtcggtcaccggggaagaaaaatggccagtgatacaccaggtttctacgtggacaaacttaacaaatactcccagatacacaaagtaaagattatatataaagaaatttctgttacaggacctccacacgacagaaggtttacatttcaagttataatagaagagagggaatttccagaaggtgaaggtagatcaaagcaggaggcgaaaaataatgctgccaaattagctgtcgaaatacttgataatgaaaacaaggtggatagtcacacggatgcttctgaacaaggtttaatagaggggaactacattggccttgtcaattcttttgcccagaaggaaaatctgcctgtaaattttgaactgtgtgaccccgactcccaattgcctcacagatttatttgtaaatgcaaaatcgggcagactacgtatggtactggtttcggtgctaacaaaaaggaggcaaagcagttggctgccaaaaatgcgtatcagaagctgtcagagaaaagcccatcgaaaactggctttgtcacatctttatccagtgacttttccagcagctcgtctataacaagtaactctgcttctcagtcagcatctggaagggatttcgaggacatatttatgaatggtctcagagaaaaaaggaaatcaggagtaaaagtgccatctgatgacgtgctaagaaataaatataccttggacgacaggtttagcaaagattttgaagacatagaagaaattggctcgggtggatttggccaagttttcaaagcaaaacacagaatcgatggaaagacgtatgctattaagcgcattacatataacaccaagaaggcaaagcgtgaagtacaagcactagcagaactcaatcacgccaacattgttcaataccgagtttgttgggagggagaggactatgactatgatcccgagaacagcacaaacggtgacacaagtcgatacaagacccggtgcctctttatccaaatggaattctgtgataaaggaactctgcagcagtggttggaaaagagaaatcggagtcaagaggacaaggctttggttttggagttatttgaacaaatagtgacaggagtggattatatacactcgaaaggtttaattcatagagaccttaagccaggtaatatatttttagtggatgaaaaacacattaagatcggagactttggccttgcaacagccctggaaaatgatggaaatcctcgaacaaagtatacaggaactcctcaatacatgagtccagaacaaaagtcatcgttagtggaatatggaaaggaagtggacatctttgctttgggccttattctagctgaacttcttcacatatgcaaaactgattcagagaaaatagagtttttccaacttctaagaaatggcatcttctccgatgatattttcgacaacaaggaaaaaagccttctacagaaattactctcaagtaaacccagggaacgacccaatacgtctgaaatcctgaagactttggctgagtggaagaacatctcggagaaaaagaaaagaaacacgtgttagggcttttaactgcagtctgaagtggaatgtcagagaacaatgaacttcttctcttaacactctcccagacaggttttggtaagggtgacccaaagacattgtatttatcggctatgaacaagtatgcccgtttcctcaattgttaattgtcggacctgtggctggctagccaaatatggaaatgtttgtttctttctcgtctgcccgaagagaaagccaagccgcggtggagaaggtcacttaacccccaatgctaactgaaggcctaaggcttttgacatactaaagagctggcagccagagctgggagagaagaacctgcagacaggcaggcagagacacaaagacatggactagaatgaaacaggaaggtagagagattgagagacagagccacatggagagacgaaatggcagagtagtaggcttaagttagatgagctaactgagagactgccccagaaaacaggccaacagccttatacacagatgtctcagtgtctatcattaaactccaagcaggatcaatgaaggccctacaataggtttttttttcttgttacttcaaaaacaatcttacaaagttattttcttgagagttccatatgtgtattgtatcctgatcacactccaaaccttctgctgttcatgccttatcatgtgaactatacctctgaacgtgggagtccaaattgtccatctgctccttaacgttacttctcataggtagtttagtcgttgtgatgagaaaagtaatgaaatggtaccagaaatggggttttgtcgcaataaacctactgtgcggtttcttggactttcaggactggtttgtgggaagaatgtggaaaagtttgaagcagcaggctagagaagtcctcagatggtatacgtcaatcttaattctggtagctcagaagtctttgccaaaaaggaacccattgggaattggactagatgccaggacatttgtgtacaagtcaaaagactggtgagggaaatttcaagacattcagactgtggcatggtggttatctccttctcatagctagaattatagagcaaattaggaaggagtgaggggtaagaagtgagagaacaaagatctgggaatgagtgccttcaaagacgaggtcggtgcaaagctgttaaagcgattagtgcactgagggaagccatgtactttccattgctgccattataggaacaagactacagccacgggcggctgcacagcatggaaagtaaaagccctttaaaggtctttcgtgtcaaaagttccagcaggtgccacagccactccagtggagtctgtgtgacaggaagctcttgtgcttcgtttctatgcagaacagaggcctgtgcctggaatggcttgtcctcctggaggtcctggcagtctccctgcaaaaagatggtgaccagggtctatgctttcagtggaattgccttctgtgttctagccttggtgatcttagcgattttaagcctgtcaacaatatctgattttaggaatatagcagggtgggcagatgatcatgtatctttagatgtctcaggcactgaaataaataaatgtctcacaccatcatggtcctgatgaactcaatggctgcaatgaattcaactgctgtatccattagttcccagaaaataggagagaaattaattgcagttactaagaacatgactgttccagaaaaatctttccccccttttgggaaagttttgtttagcatgattcagaatagtaatgattcttttaaaaaagatcatagacaacttccaacaagttgaacaaacttaacagagttaactatggttacttttgcttccttactattctgaggggccataaatataatagagtttaaactttattaaaacaaaggtaaatgatgaatacatacctggtgcccaccagtctggcagtataactgcagttttctaaactattgttttcagctgagaattgttttctagactgtatgttccgctttcctccttgcaagggacatttggtgaggagatgaataagagctagatgattgccaattatgatgtatctgttctaactgtttaagtctatgccaaaaagtaaagctttttacaacaacac

SEQ ID NO: 3485 - DNA, 3974 bp, Rattus norvegicus
  Genbank Accession No. NM_019347
aaaaagaggaaagacagagccggcctagacagcagacatcaggacacccttctaggccagctctgttttctgccttaatgctcaaggaagactgcaagatcatctgaggtgggctctgtaacagcgtcagctccacaaagtcatcgctgcaaagttcaggagatgggagatctttcctgttttcttactgagtgtttccgggtgtgagtgcatcgcattgacatcttcctacctctgtggacaaacaaggacaaggctcgaatcccctcagtctacttcatcagccggacctgcatgactggctattttgaccacttgaagtcatctaaatagaagttctcaagaccaccaagaccaaggacacttcacatgacagatgagcgaccatcccctgaaggagatgtctgacaacaaccgcagcccccccttgccagagcctctttccagcagatacaagttgtatgagtcagagctaagcagccctacctggccttcaagctcccaggatacacacccagcccttcccctgctggaaatgcctgaagaaaaggatctccgatcatcggatgaagacagccacatagtgaagattgaaaagcccaacgagcggagtaaacggagagaaagcgagttgccccgcagggcttctgcaggccggggagcgttcagcctcttccaagctgtgagctacctcactggtgacatgaaggaatgcaagaactggctgaaagataagcccctggtccttcagttcctagactgggtcctgcggggagcagctcaggtgatgtttgtcaacaacccccttagtgggctcatcatcttcatagggctcctgatccagaatccctggtggacgattgctggggcactggggacagtggtctcaaccttggctgcccttgccttgagccaggacaggtcagccatcgcctctggactccatgggtacaacgggatgctggtgggactcctggtggctgtcttctcagagaagttagactactactggtggcttctgtttcctgtgaccttcgcatccatggcctgcccagttatttctagtgccttgagcaccgtcttcgccaagtgggacctgccagtcttcacactgcccttcaacatcgccttaacactgtacctggcagctacgggccactacaaccttttcttccccacgacgcttgtgaagcctgcgtcttcagcgcccaacatcacctggtcagagattgagatgcctttgctgttacaaaccatccccgttggggtgggccaggtctacggctgtgacaacccctggacaggcggcgtgatcctggtggctctgtttatctcctctcccctcatctgtttgcacgcagccataggatccattgtggggctgctggcagcactgacggtggccactcccttcgagacgatctacacgggcctttggagctacaactgtgtcctctcctgtgtcgccattggaggcatgttctacgtactcacctggcagacacacctgttggcacttgtctgtgccctgttctgtgcgtacacgggagcggccctctccaatatgatggcagtggttggtgtgccaccgggcacctgggccttctgtctctccaccctcaccttccttctcctcacaagcaacaaccctggcatccacaagctcccactcagcaaagtcacctacccagaggccaaccgcatctacttcctgacagcgaaacgcagtgacgagcagaagccccccaatggtggcggtggagaacagtcacacggaggaggccagcggaaggcagaggagggctccgagaccgtgttccccaggcgtaagagcgtgttccatatcgagtggtcatccatccggaggaggagcaaagtgtttggaaaaagtgaacaccaagagagacaaaccaaagagccactcccctacctgtatcggaagcccacagtggaactcttggacctgaacaccatggaggagagctctgagataaaggtagaaaccaacacaaccaggactacctggatccagagctccatgatcgctggggggaagagagtcagcaaagccctcagctacatcacaggagagatgaaggagtgcggcgagggacttaaagacaaatctccagtgttccagtttcttgactgggtgctccgaggcacgtctcaggtgatgtttgtgaacaaccctctcagtggcatcctcatcgttcttggcctcttcgtgcagaatccctggtgggccatctccggttgcttgggcaccatcatgtccaccttgactgccctcatcctgagccaggacaagtcggccattgcagcaggactccatggctacaatggggtgcttgtggggctcctgatggccgtgttctcagacaagggcaattactactggtggctgctgctcccggtcatcgtcatgtccatgacttgccccatcctctccagtgctctgagcaccgtcttcagcaaatgggacctcccagtcttcacactgcccttcaacatcgccgtgaccctgtacctggcagccacgggccactacaatctcttcttccccacgaagctgctgcagcctgcagttaccacacccaacatcacctggtcagatgtccaagtgcctttgcttctgagagccatccccgttggaatcggccaagtgtatggctgtgacaatccctggactggaggcatcttcctcgttgctctgttcgtctcttcacctctcatctgcttgcacgctgccatcggatccacgatagggatgttagcagcactcagcattgccacaccatttgactccatctactttggcctgtgtggcttcaatagcactctggcctgtatcgctattggtggcatgttctacgtcatcacctggcagacgcacctgctcgccattgcctgtgccctgtttgcagcctacctgggtgctgccctggccaacatgctgtctgtgtttggattaccaccctgcacctggcccttctgcctctcagcgctcaccttcctcctcctcacaaccaacaaccctggcatctacaagctcccgctcagcaaagtcacctacccagaggccaaccgcatctacttcctgtcccaggagaaaaacagaagggcatcgatgataacaaagtaccaggcctacgacgtctcctaagctgccctttctaagctcgtctggtaaatgcagcctccagaacccaccctgcaccccaggctaaatctaagtcactcaaccacccttcttcctaatatgcgagtggctgctatttggagccctcaatgagatgtgcagcgctcatcaaagccacgctagtttaaactaaatacccaccgatggctctttgggaactctctgtggggggaacttgctagtcacctctttcagttatttagtggcgcaaatcatgattccaggaaatgttcattagcctgccatgcaagagggctgggttcactaatgagttccaactgtctcaggccagtcttctccctaccccatccccacccctatccacacccaccccacccctcatctcagcctgggtgttttgttgccaaggatttctttaccatgacaaggaaggactccaaagtccttccacctcagaagcatttattcttttccatatcctgtaaactaaccaactcagcatggccagcaagtaattattctgacttgagttacttatggaatggctctcagaggagagaggaaaatgttagtgccctgtggaagtttattcttagatatctgggagatgctctaaggcttgggaccggacacctgaattcattgaaaatgccaatgtatcttctttgcaccatagaaatatttccagaaacatcatctggtaaggagtgaccttttccaacatccaatcatagtgtaagcaaacgtctttgcttgtgtaatattcaaaatcagtagtcattaaacttgaaatttgcaaaaaaaaaaaaaa

SEQ ID NO: 3486 - DNA, 4194 bp, Rattus norvegicus
  Genbank Accession No. NM_019349
tcggcgccccgccttctccggggagcgcccggcgggagcggccggaccccgggctcgcgcgggagacgacgcgccacaaactttgccttttattgttcctagccctttaagtgcaaggggctctgttgggctggaaaaatgtccttcttcaatttccgtaagatcttcaagttggggagcgagaagaagaagaaacagtacgaacacgtgaagagagacctgaaccccgaggagttttgggagattatcggagagctgggcgacggagcctttgggaaagtgtataaggcccagaataaggagaccaatgttttagctgctgcaaaggtgattgacaccaaatctgaagaagaacttgaagattatatggttgagattgacatattagcatcttgtgatcacccaaacatagtcaagcttctagatgccttctattatgagaacaatctttggatcctcattgaattttgtgcagggggagcagtagatgccgtgatgcttgaacttgagagaccattaactgagtcccaaattcaagtagtttgcaagcagacattagaggcgttgaattacctacatgacaataaaatcatccacagagatctaaaagctggcaatattctctttaccttagatggagacattaaattagcggattttggagtgtcagctaagaataccaggacaattcaaaggagggattcatttattggcacaccgtattggatggctcctgaagtcgtcatgtgtgagacatcgaaggacagaccctatgactacaaagcggacgtttggtccctgggaatcactttaatagaaatggctgagatagagccgcctcatcatgagctaaacccaatgcgagtgctgctgaaaatagcaaagtcggagccccccacactagcacagccatccagatggtcttcaaattttaaggactttctaaagaaatgcttggaaaagaatgtggatgcgcggtggaccacatcccagctgttacagcatccctttgttaccgttgattccaacaaaccagtccgagaattgattgctgaggcgaaggctgaagtaacagaagaagttgaagatggcaaagaggaagatgacgatgatgagacagagagtgctctgccaatacctgcgaataaacgcgcctcctctgacctcagcattgccagctctgaggaagataagctttcacaaaatgcttgtattttggaatctgtgtcagaaagaacagaacacaatacttctggggataaatttagcaacaaagttcttagtgagaagcctactcctgagggacctgagaagactgtggatgtggatgggcctgcaaatgatgttaacttagaaactgtggctgaaccaaatgaccaagcggtaggattccatgagaatgggagagagaagaaaagaccccaactggaaagtcaaccagatacagaagaccaacaaactgtggatgttaatttagtcggtgaaggaaatgacagcaatatagtaattttagaaacaaacactgattgtctgaaaccagaggaagacagaaatgaagaaaaccaagagataattgagaataaacttacacaatctgaagaaattaaagatatacatattcaaacaatggacttagtttctcaagaaactggagaaaaagaggcagattttcaggcaattgacaatgaagttgggtttacaaaggaagaaacccaagagaaattgggaaaagatgataaaactcacaaagttgtgatcagtgatataaccagtgaggtgggaacagacgagcctccaggtgatacccagaagtctgctgagcagagccaggatgcagagggtggggctggggaagaagccccggagcctgcccagacactaacagagaaggccactgagggccctgaggctcatggtgctgaggaagagcctcgtagtggagagagagtagaggataagcagctagagcagcagtctgcagtgtgtgaaggtgagggacaggtaaccagcacttcagagagcacacgggcaaccacggaggaaccagagactgacgaagttgaccaagtcagcgagtcaaatagcattgaggaactagagagacttggagttactggtgctgaggaacaggctctagggagcaaaggggaggctgctacggagctagatttggagagagaagaaaatgcacaggaactgccagttaaagcagagccccaagctcctgcagcatcgcaggccagcgaacctccccctgtcttaatacccagtattaatattcattcggaaaacacagaaaataaaggagaaatgggtgctttgccaaaacctgaaaccatactgccaccagagcctgaaaatggaaagggaaatgacacggactcagggactgggtccactgtggagaacagcagcagtgacctgaacttgtccatctctagcttcctgagcaaaaccaaggacagtggctcggtgtctctgcaggagacaagaagacagaagaaaacattgaagaaaacacgtaaatttattgttgatggagtagaagtgagtgtgacaacatcaaagatagttacagacagcgactctaaaaccgaggaattgaggtttctcaggcgtcaggaacttcgagagctaaggcttctccagaaggaagagcagaaagcccagcagcagctcaacgggaaattgcagcagcagcgcgagcagatcttcaggcgctttgagcaggagatgctgagtaagaagcgacaatatgaccaagaaattgagaatctagagaagcagcagaaacagacaattgaacgactagaacaagaacacacaaaccgcctgagagacgaagctaagcgcatcaaaggagagcaggagaaggagctgtccaaattccagaatatgctaagaaaccgaaagaaggaggaacaagaatttgttcagaagcaacagcaagagttagacggcgctctgaaaaagatcatccagcagcagaaggcagagttggccaatattgagagagagtgcttgaataacaagcagcagctcctgagagcccgagaagctgcaatttgggagcttgaagaacgacatttacaagaaaagcaccagctgcttaaacagcaacttaaagatcagtatttcatacagagacatcagctgcttaaacgccatgagaaggaaacagaacaaatgcagcgttacaatcaacgacttattgaagaattgaagaacagacagactcaggaacgagctagactgcccaagattcagagaagtgaagccaagacacgaatggccatgtttaaaaaaagtttgaggattaactcaacagctacaccagaccaggaccgtgaaaaaattaaacagtttgctgcacaggaagaaaagagacagaaaaatgagagaatggctcagcatcaaaaacatgagagtcagatgcgggaccttcagttgcagtgtgaagccaacgtccgagagctgcaccagctgcagaatgaaaaatgccacctgttggttgaacatgagactcagaaactgaaggagttagatgaggagcacagccaagagctcaaggagtggagagagaagctgaggcccaggaagaagacactggaggaagagtttgccaggaaacttcaggaacaggaagtgttctttaaaatgaccggggagtccgaatgcctcaacccctcagcgcagagccggggctgtttacaaacgtctcaccccagcagtaccagggcaccagcgtgggcaggatgaagcacatgagcaggaggccgggcttgtaatacctcctctggaacatcaccagcttctcagctttcaggtcagacatgtccagctttccgcccttctctttgacagccgggtgtttgcgcacaagcagccaacccacgtgagagaagaaaaagccacggcgggagttgtgagggtcggcgtgtgtctctgagaacttgtggtgggcgcggtgatcccggggcccattcgtacacatcgttctggaatgccatggtgttggcgatgatgagaaagagcctcaggggcagccgagccttgtaagtcctgtggctccacaggcgatgagccccggctgtgatgcccagggcgctgattacgtagtacaaatatgcaaagaggcaggtgtagaccttgcaggaggggaccagtgtgatcccgtacagggctccaatgtgc

SEQ ID NO: 3487 - DNA, 1639 bp, Rattus norvegicus
  Genbank Accession No. NM_019350
ggggtcccggcagcccacagcacctccagaagggtcctgtccagccccagccacctagcaggagtggggtgggggatagggtacttgggtacctctgcaggaagcaccgcaggaacccgacgccatgttcccggaacccccgaccccggggtctccagcgcctgagacacctccagactccagccgcatcaggcagggggcagtgcctgcctgggtcctggctaccatcttgctgggctcaggcctcctggtcttcagcagctgtttctgtctctaccggaagcgctgtcggagacggatgggcaaaaagagtcaggcccaagcccaagtccatcttcaggaagtgaaggagctgggccggagttacatagataaggttcagcctgaaatagaggaactggacccctcaccatccatgccaggacagcaggtattggacaagcaccagttaggccgactgcagtattcactggattatgacttccagactggccagctcctggtaggcatcttgcaagctgagggactggcagcgttggacctaggaggttcctcagacccctatgttagtgtctatctgctgccagacaagcggaggcgacatgagaccaaggtgcatcggcagaccctgaatccacactttggagagacctttgccttcaaggtcccatacgtggaactaggaggtagagtgctggtcatggcggtgtatgacttcgatcgcttctcccgcaacgatgccatcggagaggtgcgggtgcctatgagttcagtgaacctggggcggccagtgcaggcctggcgagagctgcaggtggctcccaaagaggagcaggagaaactgggggatatctgcttctctctccggtatgtccccacggccgggaagctcaccgtcattgtcctggaagctaaaaacctgaagaaaatggatgtaggaggactctcagacccttatgtcaaggtgcacctgctccagggaggtaaaaaggttcggaagaagaaaaccaccattaagaagaacaccctgaacccctattacaacgaggccttcagctttgaggtgccctgtgaccaggtgcagaaagtccaggtggagctgaccgttttggactatgacaaactggggaagaatgaggccatcgggagagtggcggtgggcacagcagttggtggggctggcctacggcactgggctgacatgttggccaaccctaggcggcccattgcccagtggcactctctgcggccccctgacagagccaggccaatacctgcaccctgattcccgtcaagcaagcacctgaccccagatcctttggtccctgtcccttacctctctccccacatgactctccctactccccaaacattgcattcattcctacctccacattggaaatgtttccgacttccagtaccactcctatacccagaaaccacagtggtcctgcggggaggtggaaaagttgggaaagtctggcatcccctgccccagagtcctaccctctgctttgacaatcagctgtgaagcctctgatctcctttctcccagtctctgagctcttcccacacagcttgacccctgtgctgctcctggggccaaataaatactcaacagcttggaaaaaaaaaaaaa

SEQ ID NO: 3488 - DNA, 1377 bp, Rattus norvegicus
  Genbank Accession No. NM_019356
gttcgggattcacacatacacttcagaatgccgggtctaagttgtagattttatcaacacaaatttcctgaggtcgaagatgtagtgatggtgaatgtaagatccattgctgaaatgggggcctatgtcagcttgttggaatataataacattgaaggcatgattcttcttagtgaattatccagacgacgtatccgttctataaacaaactgatccgaattggcagaaatgaatgtgtagttgtcattagagtggataaagaaaaaggatatatagatttgtcaaaaagaagagtttctccagaggaagcaatcaaatgtgaagacaaattcacaaaatccaaaactgtttatagcattcttcgccatgttgctgaggtattagagtataccaaggatgagcagctggaaagcctattccagaggactgcctgggtctttgatgacaagtacaagagacctggatatggtgcctatgatgcctttaagcatgcagtctcagacccatctatcttggatagtttagatttgaatgaagatgaaagagaagtactcattaacaatatcaataggcgtttgaccccacaagctgtcaagattcgagcagatattgaggtagcttgctatggttacgaaggcattgatgctgtaaaagaagccctgagagcaggtttgaattgttctacagaaaccatgcccatcaagattaatctaatagctccacccaggtatgtgatgacaacaacgaccctagagaggacagaaggactctctgttctcaatcaggctatggcagtcatcaaagaaaagattgaggagaagaggggagtgttcaatgttcagatggagcccaaagtggttacagatacagatgagactgaacttgcaaggcagctggaacggcttgagagagaaaatgcagaagtggatggagatgatgatgcagaagaaatggaagccaaagctgaagattaaccttttggaaaacagtccaatttaaggagtacgaagcagccctttctggctgtaaaccctagacttgaaagttttccagtattgaaaacttcaaagctgaatatttttatttccaagtatttaagtattcgacaagccagaatctaaatgccctccttcatgtcagctgttttcacatagtggctctaacacctcaagcgtttttaagggagtggcttgatttgaccagagacaaatgttaaaccgcagtcctaaaattgggcttgcggttttcatttctgatgtctctggattggcacccttatggtttagagaattaccaggggctccagacaccaacaatcccaacctttctatataaaatgtactcaagcaaacatcaaataaatttctgggatattt

SEQ ID NO: 3489 - DNA, 1932 bp, Rattus norvegicus
  Genbank Accession No. NM_019359
agcagagcagtcggtcccactccagtgcgacccggagcctctgcgggactcgagtccgagcgaacctcgaagcatcatccgcgtccgtctgccgcgttccggcttctgcgccgcgcagagtagcgagcttgtgcatcacccgcgcggccacagctgggggctaagagcagggacaccgagggtgactgaccccgactccgagcgcagccccttcctgtggtccgaacagccatgacccacttcaacaagggcccttcctacgggctctccgccgaggtcaagaacaagatcgcatccaagtatgaccagcaggccgaggaggatctgcgcaactggatagaagaggtgacaggcatgggcattgggaccaacttccagctgggcctgaaggacggtatcatcctctgcgaactcataaacaagctacagccaggctctgtgaagaaagtcaacgagtcctcactaaactggccgcagttggagaacatcggcaactttattaaagccatccaggcttacggtatgaagccccatgacatatttgaggcaaacgacctttttgagaatggcaacatgacccaggttcagactacgctggtggctctagcaggtctggcgaaaacaaaaggattccatacaaccattgacatcggcgttaagtacgcagaaaaacagacacgacgcttcgatgaaggcaagctaaaggctggccaaagtgtaatcggtttacagatggggaccaacaaatgtgccagccaggcgggtatgacagcctatgggactcggaggcatctttatgatcccaaaatgcagactgacaaaccctttgaccagaccaccatcagtctgcagatgggcaccaacaaaggagccagccaggctggcatgtcggcaccgggtaccagaagagacatctatgaccagaagctaacattacagccggtggacaactcgaccatttctctacagatgggcaccaacaaagttgcttcccagaaaggaatgagcgtgtatgggcttgggcggcaagtgtatgaccccaagtactgtgccgcacccacagaacctgtcattcacaacggaagccagggcacgggaacaaatgggtcagaaatcagtgatagcgattaccaggcagaataccccgatgagtatcatggcgagtacccagatgagtaccctcgagagtaccagtatggtgacgaccagggcatcgattactagagtcacacacaggagtgcagtattttagtccattgtttatccagtgagacccaagctagccttgagtaattcttatctcgtcttcctaaacactattacgcttcctgtacctttaaagaatgccttacgtacattcctttctccctttcctgcctcctccctaaattgccttctagtgctgtagcgagggaagcctacagcctaaccagtaactcgcgttggaagaagtgagaaggaacgctgtgcgagggcagccagctctttcgctggagatctataaaattttttacacttacacgtaaactggtattttcaaacaataggaaactatttttttcttttttacagtttagtatgtatctggcttgtacacggtagactaagaagttgatttgctaagtgtggtctttgccaagtaatctaacatgcagctttagaacctgacacgtggatgcttctgcacagtgttgtctgctaagttttaaataaagtcgtgatcagtgtgattcgtgattacatgtgtactcattctttcccgaagctgacaaggtctctcccgagtggcgctctaaaggcgcgtctacagaaatggccgcagacatgtaggtgtgggtggcgtgcctgcagacttcatttgtgccaatgtattactgtagagtcgctgttcccttcaactgtatttattgctgcatttctcagcataaactt

SEQ ID NO: 3490 - DNA, 418 bp, Rattus norvegicus
  Genbank Accession No. NM_019360
  misc_feature (1)..(418): n = a or c or g or t
gccatggnccttcaccttagggttacccatgatagcagaggcagaggacattggctaccatcagttccggtgctctgttgccgaaaccacagatgcgtggtcttctggccaagcgtctgcgggttcatattgttggcgcattcgctgtggccctaggagttgctgctgcctataagtttggcgtggctgaaccaagaaagaaggcttatgcagatttctacaggaattatgactccatgaaagattttgaagagatgaggcaggctggtgtctttcagagtgcgaagtgatttcagaatgcaaagaattctttggattgtgctccatagaagttcactgctgacctgtgttcctgaactatgaaacgtgaatatgtgggctaaggagtagtttctctcaataaacattaattatatgg

SEQ ID NO: 3491 - DNA, 1660 bp, Rattus norvegicus
  Genbank Accession No. NM_019367
cccgtggattcccgactaggtacaagtaaacagctggcggaacgaagcctccagacacaggccaggtgggagcatgccggggctatggaggcagaggcttccttcggcttgggctttgcttctcctgcctttcctgccgctgctgttgcccgcagcccccgcaccccaccgcgggtcctacaagccagtgatcgtggtgcatgggctctttgacagttcatacagcttccgccacctgctggactacatcaatgagacacaccccgggactgtggtgacagtgcttgatctcttcgatggcagagagagcttgcgacccctgtgggaacaggttcaagggttccgagaggctgtggtccccatcatggaaaaggcccctgagggggtacacctcatctgctactcccagggaggcctggtgtgccgcgcattgctgtctgtcatggatgagcacaatgtggattccttcatctccctttcttctccacagatgggacagtatggagacacggactatttgaagtggctgttccctacgtccatgcggtctaacctctatcggatctgctatagcccctggggccaggaattttccatttgcaactactggcacgaccctcaccacgatgacttgtacctcaacgccagcagctttctggccctcatcaatggggagagagaccatccgaatgccactgcatggcggaagaacttccttcgtgtgggccgtctggtgctgattgggggtccggacgatggagtcatcactccctggcaatctagcttctttggtttctatgatgccaacgagacggtcttggagatggaggaacagccggtgtatcttcgagactcttttgggttgaagactctcttggcccggggggccatagtgagatgccccatggctggggtctctcacaccacctggcactccaatcgcacgctctatgacgcttgcattgagccctggctctcctgaagacgtcctcagggctctccaggaattccccagcccagagatcaagtggtggccttctggcgtgcctgtgaccacctcgtcgctcccacactgccccacctccccaccagggctcccaaaccctcccctctgctcctctgtgaatgacaagtcctggtcccctacctcatgtcctcacttggggacgtctccatgctctccctttctgccatggctgaggttgggaagcaagcaccaggtttttaactgtggcttcaccgctgctgctgttgcttctccgggtctggctgtaccggaggagaacccagcccctgcccacctcaggggtcttccaggccactcaggacatttttagcttgttattcccatgcccctcttttctgtccctgtggccagcctccccaccgagaggggcgcccgtacaagggggttctgaggctcccctatggggacagttccacttttgaagtgtcagtgttggggaatatctgtggcctgcaaggcccatctcaggtttggggatcccccagtccctatgatcagtgttggggtatcccctgggagcctaggttctttgaggccccagcccctcttttaaccacccttgagtgggtggtccccgtatttatagaaataaaagttccatttccacagaaaaaaaaaaaaaaaaaaaaaaaa

SEQ ID NO: 3492 - DNA, 450 bp, Rattus norvegicus
  Genbank Accession No. NM_019368
acctgaggcggaaccggaagacccaggtagtggtgccacgtccgtcgctgtgttgcctactcccggagtgggacctcggaaggcgcgatggcagattggactcgagctcagagttctggtgctgtggaggagattgtagacagagagaacaagcggatggctgacagcctggcctctaaggtcaccaggcttaaatcgctggctttggacatcgacagggacacggaagaccagaaccgatacctagatggcatggactcagatttcacaagtgtgactggcctactcacagggagtgtgaagcgcttttccacggtggcacggtctgggcgagacacccggaagcttctgtgtggtatggctgtggtcttaattgtggccttcttcatcctctcctacctcttttcgaggacaaggacgtgagccagtgggagccaagggagccagact

SEQ ID NO: 3493 - DNA, 2958 bp, Rattus norvegicus
  Genbank Accession No. NM_019369
acgaactggagacaaatgaagagccctgcccctgcccacatgtggaacattgtactggtcttgctctcgctgttggctgtgcttccgatcactactactgagaagaatggcatcgatatctacagtctcacagtggactcccgggtctcttcccgatttgctcatactgttgttaccagccgggtggtcaacagagccgatactgttcaagaagcgaccttccaagtagagctacccaggaaagccttcatcaccaacttctccatgatcattgatggtgtgacctacccagggttgtcaaagagaaggctgaagccagaagcaatacactgctgctgtggccggggagagagcgctggccttgtcaagaccactgggagaaagacagagcagtttgaagtgtcagtcaacgtggcccctggttccaagactaccttcgaactcatataccaagagctgctccaaagacggctgggaatgtatgagctactcctcaaagtgaggcctgagcagctggtcaagcaccttcagatgacatctacatctttgagccctcagggtatcagcaccctggagacagagagtactttcatgacccaggagttggcaaatgcccttaccacttcacagaacaagaccaaggcacatatccagttcaagccgacactctcccagcaacggaagtctcagaatgagcaggacacggtgctagatggggatttcaccgttcgctatgatgtggaccggtcttccactggcggataccttcagattgagaacggctactttgtgcaccactttgccccagaggaccttcctacaatggccaagaatgtgctctttgtcattgataaaagcggatctatggcaggcaagaaaatccaacagacccgagaagccctaatcaagatcttgaaagacctcagcacccaagaccagttcaatatcattgtgttcagtggggaagcaaaccagtgggagcagttgctggtgcaagcaacagaagagaacttgaacagggcggttgactatgcttccaagatcccggctcagggagggaccaacatcaataaagcagtgctatcggctgtggaactgctggataaaagcaaccaggctgagctactgccctccaagagcgtttccctcatcatcctgctcacggatggcgagcccactgtgggggagaccaatcccaagattatccagaagaacacacaggaagccatcaatgggcggtatagcctcttctgcctggggtttggctttgatgtgaactatcctttcctggagaagctggccctggacaacggaggcctggcccggcgcatctacgaggactcagactctgctctgcagcttcaggacttctaccaggaagtggccaatccgctgctgtcatcagtgacctttgaatatcccagcaatgctgtggaggacgtcacgcggtacaacttccaacaccactttaagggctcagagatggtggtggctgggaagctccgggaccagggccctgatgtcctcttagccaaagtcagtgggcagatgcacctgcagaacatcactttccaaacggaggccagcatagcccaacaagagaaagagttccagggtcctaagtacatctttcataactttatggagagactctgggcgttgctgaccatacagcaacagctggagcagaggatttcagcctcaggagctgagttagaggccctcgaggcccaagttctgaacttgtcactcaagtacaattttgtcactcctctcacgcacatggtggtcaccaaacctgaagatcaagaacaattccaagttgctgagaagcctacggaagtcgatggtggagtgtggagtatcctctcagcagttcaacggcatttcaagactcctaccacaggatctaaactgctgacatccaggctgagaggaaataggttccagacattgtccagactcggggatggtctcgttggatctagacaatacatgcctcctcctggacttcctggacctcctggacttcctggacctcctgggcctcccggacatcctcattttgcttctagcattgactacggcaggcagccttccttgggaagggtgctagacctgccatccttatcctcacaagatccagccggcccaagtctagccatgttaccgaaagtggtggaacaagaaggcaccacaccagaggaatccccaaacccagaccacccccgggctcctaccatcatcctgccgcttccgggatctggtgtggaccagctctgtgtggatatcttacattctgagaagcccatgaagctgtttgtagacatcaatcaggggctggaggtggttggcaagtatgagaagaatatcgggttctcatggatcgaagtgaccatcctgaagcctcacctgcaggtccatgcaacgcctgaacgactggtggtgacaaggggccgaaaaaactctgaatacaagtggaagaagacactgttctctgtgttacctggcttaaagatgaccatggataagacgggactgctacagctcagtggcccagacaaagtcaccatcagcctcttgtctctggatgaccctcagagaggactcatgctgcttttgaatgacactcatcacttctccaacgacattacaggggagcttggtcagttttaccaggatatcatctgggatgatacaaaacagacagtcagagttctaggaatcgactacccggctaccagagagctcaagttgagttatcaagacgggttcccgggaacagagatttcctgctggacggtgaagatatagaactgacaggagcattgtttgctacctgccatgttgtcctcgtatgcaggcggatgacactgtgtgccaacagggccgcctgtgaggcctagaccttgatggggaagaggatgctctcttgttacaaataaagaagggtgatgt

SEQ ID NO: 3494 - DNA, 2777 bp, Rattus norvegicus
  Genbank Accession No. NM_019370
gaaagaaagagccttattttctggctaaacaggtttacacagctacaggaacaatggattccaggctagctttagccacggaggagcccattaagaaagacagcctgaagagatataagatcctttgtgcggttcttcttgctttgctggtgatcgtgtcgcttggattgggcctgggcctgggactcaggaaacctgaagagcatataggcagctgcaggaaaaaatgctttgattcgtcacacagaggactggagggttgccgctgtgactccggatgcacagaccggggagactgctgctgggactttgaagatacctgtgtgaaatcaactcaaatctggacgtgtaattcgttccgctgtggggagaccagactagaggcagccctctgttcctgtgcggatgactgtctgcagagggaggactgctgcactgactacaaggctgtgtgccaaggagaagtcccatgggtgacagaagcctgtgcctcatcccaggagccccagtgtccagaagggtttgaccagccgccggttatcttgttctccatggacggctttagagctgagtacttacaaacatggagcaccctgctgccaaacattaacaaactgaaaacatgtggactccattccaaatatatgagagcagtgtatcccaccaaaacctttccaaatcattataccattgtcacgggtttgtatccagagtcgcacggcatcattgacaataacatgtatgatgtgtacctcaacaagaatttttcactttcttcagtggagaaaagtaaccctgcctggtggagtgggcagccgatttggttaacagcaatgtatcaaggcttaaaagctgcttcctactactggccaggatcagatgtggctgtcaatggctccttccctaacatctacaggaattacagcaattccgtcccatatgaaagtaggattgctacactgttgcaatggctggacctgcccaaagctgaacgacccagtttttacaccatatatgtggaagagcccgattctgcggggcacaagagtggaccagtcagtgctggagtcattaaagccttacagttagttgatgatgcctttgggatgttgatggagggtttgaaacagaggaatttacacaactgtgtcaacataatcgttctggctgatcatggaatggaccagacctcttgtgacagagtggaatacatgacagattattttcctgaaataaacttctacatgtaccaaggacctgcccctcgaatcaggactcgtaatatacctcaggacttctttacctttaattccgaagagattgtcagagacctcagctgtcgaaaatccgatcaacacttcaaaccctacttgactccggatttgccgaaacgactgcactatgccaagaacgtcaggattgacaaagttcatctaatggtggatcggcaatggctggcttacaggaacaaagggagttccaactgcgaaggcgggacacacggttacaacaatgaatttaaaagtatggaggcaatctttttggcacatggacccagctttaaagagaagactgttatcgaaccatttgaaaacatcgaagtctataatctactgtgtgatcttctgcacatccaaccggcaccaaacaacggttctcacggtagcctgaatcatcttctgaaggcaccattttaccagccgtcgcatgcagaagaattgtcaaagtctgctggctgtggttttactactccattgcctaaggactcactaaactgctcctgcctcgcactgcagacttctggtcaagaagagcaagtcaaccaaagactaaatctcaatagaggagaggtctcggcaacagagaagacaaatttgccatttgggaggcccagggtgatacagaagaacaaagaccactgtctgctttaccacagggaatacgtcagtgggtttgggaaagctatgaagatgcccatgtggagttcatacactgttcccaagccgggagacacatcatctcttcctcccacagttccagactgtctgcgggctgatgtcagggttgatccttcggagagccaaaaatgttccttctatttagcagaccagaatatcgaccatggcttcctctatcctcctgcaatcaaaggaaataatgagagtcaatatgatgctttaattacaagtaatttggtcccaatgtataaagaattcaaaaaaatgtgggactacttccataaagttctccttataaaatacgctatagaaagaaatggagtgaatgtggttagtggacccatatttgattacaattatgatggccattttgatgcccccgatgaaatcacaaactatgtagctggcaccgatgttcctgtcccgacacactactttgtggtactgacaagctgtaaaaacaaaacccacacacccgacagctgccctgggtggctggatgtcctgccctttgtcgtccctcaccggcccaccaacgtggaaagctgtcctgaaaacaaagcagaagacctttgggttgaagagagatttaaagcacacatcgcccgggtccgtgatgtggagctcctcactggccttgacttttatcaggaaaaaacacagcccgtctctgaaattttgcagctgaagacatatttgcccacattcgaaaccattatttgaatagatgtgtaaagccatttgacaaaatggaaacattttctgtcaagaaattataaaataaaattttctatttttctttaaaaaaaaaaaaaaaaa

SEQ ID NO: 3495 - DNA, 2825 bp, Rattus norvegicus
  Genbank Accession No. NM_019371
ggatccaggttttcaagtttgttaggggatttaatgcaaatcaatatgcaaacagagagcattgtaaaaaaaaaaatccagtcctttctccggtcacacacaggttagctaatgtggagctcgcccagatgctctgcagcaccagctcaaggggaagggccaggaggagggcagtcccgggggcgggaccatgacgttgaggtcaaggcggggcttcctctcgttcctccccgggctgcggccgccgcggcggtggctccgcatctccaaaaggggccctccgacttctcactgggccagtccggcgctgggtggcagaactctacactactcctgccggtctcagagcgggactcccttctcttcagagtttcaagcaactttccccgcctttgcagctaaagtggctcggggaccgtggctgccgcaggtggtagagcccccggcccggctctctgcatctccgctgtgcgttcgctctgggcaagccctcggtgcgtgcaccctgggggtcccccgcctcggctctgtgagcgagatgcctctgggacacatcatgaggctggatctggagaagatcgccctggagtacatcgtgccctgtctgcacgaggtcggtttctgctacctggacaacttcctaggcgaggtggtgggcgactgcgtactggagcgagtcaagcagctgcattacaacggggccctgcgtgacggccagctggcggggccccgcgccggcgtctccaagcggcacctgcgaggcgaccagatcacgtggatcgggggcaacgaggagggctgcgaggccatcaacttcctcctgtccctcatcgacaggctggtcctgtactgcgggagccgcctgggcaaatactatgtcaaggagcggtccaaggcgatggtggcttgctatccaggaaatggaacaggttatgttcgtcatgtggacaaccccaatggtgatggccgctgtatcacctgtatctactacctgaataagaattgggacgccaagttacatggaggggtcctgcggatatttccagaaggaaaatcatttgtagcagacgtggagcccatttttgatagactcctgttctcctggtcagaccgcaggaatccacatgaagttcagccctcctatgccaccaggtacgccatgactgtctggtacttcgatgctgaagaaagggcagaagccaaaaagaaattcaggaatctaactagaaaaactgaatctgctcttgctaaagactgacggtggtgtgaagtccgctgggcgcattcgtttagtgacagttcctgaaatgttaagtgtcaagatccaaagactctgtccaatcccctgcctaccgcctgcatcgtttggctccctaccttgtttgtggtacttcgtgttttcttgctgggaatgcgttgccctccagacactctctttgccggatgaactcatttgctaactccagaaacacctgcagacatcctagctggccagcggtttaacggatagatctgggaatggatagatatgggaatgcagctgttcagcccaggattgcctcgtgttcgcactttatgcatacttcctggtctgataggaggaggtttgcgaagaaataaactggtgacagatgccacaaagaggcacccttgaaaccctaacagcaagaaagagaaagatctgaactatttccagatgttgttaacccgagactggacgattacggacaacctgatgacattatcgcctctagaaagggctgctgtcatagcgatcgatttataagtgtcccacggtggatgctcctttttcctggtcctacaacctgttctttttgaaggtcattgctaaattgatgctctcttgtcgaagacgaccccagcctgtatgctccatttttacttcttacttggggatcctaattatccagagaataaaactcaccaggtagtttgggttgttttttctggtactgaaaatttgaagttaaatgagagggacaggaagcgtcctggtaatttagcttctgctaactctgtgggaagagcaaagcctagcggtatgcgataaccatgcatacggtgagcagttcgagagggagatgtggttggaagtgcagacagccccctttcatcatgttccctttagctgttcttcgttcatggctaagaacagcatgttgtactcttaaaagatatggaaataaaaagacctcaaagctatcgagttctcccacattgtctgctctgccagcctcgctttagccgtcttgatccttgagagcaactggttggaagtgcatccagtggtgtggaatttcctagaactgtgggaggtttctcctgcaggatgcaggtgccgcttcccccagaactctgtacgaaacacccattttacggaagttagccatcctagttttcgctgctacttccccatctttcgaacctctttaatttccttgttagaatcccacaagcagcacagacccgagagtgttttatttcatcgtgttcagccatgcagactttccaagcaaagaagttgatacttctttcttctttcgggaaagtgtccaggaagaactgtcattcctccccccatggctctgttttgttttatttcccaccttctaacttacaacgtcatttccttatttattatgtttattgtcttgtagcctatgatgtctagagtgttaaacacaacgaaggcagggatttgtacgtttttgatccatgcagcatgttcccagcacctaagctaacatacagtaagcaacggcttaccaaacacatgttcaataaactcagtctcctctgtaaaa

SEQ ID NO: 3496 - DNA, 757 bp, Rattus norvegicus
  Genbank Accession No. NM_019373
agaacagttaaggtagaggtccccagaaccgcacagcgccaggtctcctcccaagatgttccaccaagtctgggcagcgctgctctatctctacggccttctctttaactccatgaatcagtgccctgagcacagtcaactaatgacgctgggaatggacgacaaagagaccccagagccccacctgggcctgtggtactttattgctggagcggctcccaccatggaagagttggcaacttttgaccaggtggacaatattgtcttcaacatggccgccggctctgccccaaggcagctccagcttcgcgctaccattcgcacgaaaaacggggtctgcgtgccccggaaatggacgtaccacttgactgaagggaaaggaaacacggaactcagaactgaagggcgcccagacatgaaaacagacctcttctccatctcatgcccaggaggaatcatgctgaaagagacggggcaggggtaccagcgtttcctcctctacaaccgatcgccacaccctccagaggagtgtgtggaggaattccagtctctgacgtcctgcttggacttcaaagcctttttagtgactcccaggaatcaagaggcctgcccactgtccagcaagtgacccgtgactccacttgtgtcctggacaggcacgataggagctgagctctgaggggagaagccggcggctcccgctccttctcatggataataaagatgaattgtcaatccaaaaaaaaaaaaaaaaaaa

SEQ ID NO: 3497 - DNA, 3410 bp, Rattus norvegicus
  Genbank Accession No. NM_019376
cggtccttccgacacacgagctccaagccgctcctctcttttcctaaagcccttcaaggcagtcttcggtttccttctttccagccgaccctcttcagccccgcgaagatggtggaccgcgagcaactagtgcagaaagcccggctggccgagcaggcggagcgctacgacgatatggccgcggccatgaagaacgtgacagagctgaatgaaccactgtccaacgaggaacggaacctcctgtcggtggcctacaagaacgtggttggggctcgccgctcctcctggagggtcatcagcagcatcgagcagaagacgtctgcggatggcaacgagaagaagatagagatggtccgagcctaccgggaaaagattgagaaggagctggaggccgtgtgccaggacgtgctgagcctgctggacaactacctgatcaagaactgcagcgagacccagtacgagagcaaggtgttctacctgaagatgaaaggggactattaccgctacctggctgaagtggccactggggagaaaagggcgaccgtggtggagtcgtccgagaaggcctacagcgaagcccacgagatcagcaaggagcacatgcagcccacccaccccatccggctgggcctggcgctcaactactccgttttctactacgagatccagaacgccccagagcaagcctgccacctggccaagaccgccttcgatgacgccatcgccgagctcgacactctgaacgaggactcctacaaggactccactctgatcatgcagctgctccgagacaacctaacgctctggacgagcgaccagcaagacgacgacggcggcgaaggcaacaactaaggccccaggtggactggcagcgcacgctgatgctactactgcagtctttattttttcccatgagttgggggtcgggtgggggagggaaagggagggctgaccttcccagggagaaacccacgactgtcctgtctttgattgcctctttgacatttttgccaaaataccactagtggaaagtcaggctagctatgctggtatcggagtagcagcctcacaggcgccgggactgttgtgcaggtcgtgcaagtggagctgtctgcctttagtttaacttattgctagacggtagggttctaagcagaaagaccggatggatggccctctcgttcagtgcgttctgtggttccagtaaggattcttctgtccacacgccctcgtcttcagttccgtggctgttttctctctgtggctctgctgttttctttttctcttttctcctttctttccccggggtgtataccagagaagttagagtctaaattacccaagtggacaggcttagagtggaaggcacaacctttattgacgagtcagacgtggccctgtacttagaagtctctgatgggttgacagtattaacactaaattgtagtttacagtatttctacacgacagccatacatgacaccaagccattggttctgagttttcctttgtcagtcggctttacgtctgtgtccaggtcggtctggctgtccatcagctctcgtcatggggagagtcagcttcccggagttttggttgatgggcgcttggcaggtggctgttggggaatacttttttttttttttcttctcggttcttctttactctctaaggcaagcccatcacaaaaatagaaaccgttaagtaccacacacacacagagaaaacagagaaaattcaggtctgtatgtcattatcagagactcctgctctcagcagccagggctccatcctcagtgtcactgccgcttgaatgtttctctgcacttgagtctgcccgtaccccgtgctagcagcacgcaggtatctaggtgtcgggcaagattgcagaggtgggaggttaacgagacttggaacatccggtgccagcagctgagccaacaggaaaccactgggaagaggcagttctggtcctaaaccagttgtccctgccacccctccaacccccagcactccttccccaagtgctcagtggagggtaccgaggttcagcaggaggcgctgctcacccctgtctgacctaagctttcctggttttcctttctgaatgaaatcgtagttgatggagattggcttctcacgagatcactgcacacgtgacattgaaggaagctgtgctgctatgccctacatggtccgtctcagcccttggtccctcattctcactgtggataaatcttcccataaacgtgccctgttgcatgcagagtgtgcagtttgtctcctggagaacccatgctctcatggcttcccaagatggcagcaccctagacttgctttacttgtcttcagaggcccagcagccactttatcttatactgaaaccaagctcccacttaagttgagtcacgcttaacaggatgctggtgacgtggctgtagaagaagtacgcccctctgcacagtcctagcatgccctccctcagaggcccctcctcatgctggtgtgcaaacacccactaaccgaggcccacggaagaccgcagcggaggaagcttggccaccagagccatggacagaggggttgggcttcacccggttggtttgtctccatgtcggcagtgagcatgtctgtcccgcttgtactgtttggaaatgacctactggaattgcaaaacctagtttctctttaaatttcagccttgacctttgctgtgttctagaaaagtcatgtgagggtagaactgaagagggagagcgggagacctgacgtgagcgtggatggttccttctccttcccttactgttgagaagcgcacctgcctctgatgctgtctccgttgccgcggttgccccacctattgatacagtattgtgcatgctggtgttgtatttctatacggtagctgacatttattaccttacactgtaggcgttatgtattcctatgacaacaaaacttaagacttcaaaatctttttaaactttttttttttaatttaattttttcctttcaggggtaaagtttgctttaccaaaaatagtggttgtaacaaattgatctgttttggatgttgctatagtgacatgcagttctctattttgttttcggggggaggggacaaaagaaacaccagtgttagcttactcttaatgtctggtgtttgtcatggtgaaattataactattacagtgttggagaacgccgcggagcttctctgaacgacctctgtgctttcttgtcatgttatgcagtgaaactatttttaaggtctaatcaagtgattttttcccccccaactccgtgtttcgctaaggaattatttcgcacacggaccattcttagcagtttcctcagtgatggaatattcatgaatgtgagtcattatgtagccgtcgtacattgagcaa

SEQ ID NO: 3498 - DNA, 3842 bp, Rattus norvegicus
  Genbank Accession No. NM_019379
gggagagccggctcgggggctaggcccttcgggggcggggggctgtcgtgttttctttggcggaggggctggtgaagccggcggctgagcgacgagatgaatttcctccgcggggtgatggggggtcagagtgccggaccccagcacacagaagctgagacgattcagaagctctgtgaccgcgtagcttcatctactttactggacgaccgaagaaatgctgtccgtgcccttaagtcactgtctaagaaataccgcttggaagtgggaatccaagccatggagcatcttatccacgtcttacagacagatcgttcggattctgaaataatagcgtatgctttggacacactctataatataatatccaatgatgaagaggaagaagtagaagaaaattctacaagacagagtgaggatttgggaagccaatttacagaaattttcattaagcagccagaaaatgtcactctcctgttatctttgttggaggagtttgatttccacgtccgatggcctggtgtgagacttctgacttctcttttaaaacagctagggcctccagtgcagcaaatcatcctagtcagccccatgggtgtttcaaaattaatggacttgctggcagattccagggaaattatacgtaatgatggcgtcttactactgcaggcattaacaaggagcaacggagcgatccagaaaattgttgcttttgaaaatgctttcgagagactactggacattattacagaggaggggaacagcgatggaggtatagtagtggaagattgtttgattttgctccaaaatttgttaaaaaacaacaattccaatcaaaatttttttaaagaaggctcttatattcaacgtatgaaagcttggtttgaagttggagatgaaaatcctggttggtcagcacagaaagtgaccaatcttcatttaatgctccagcttgtgcgggtactggtgtctcccaccaaccctcccggtgctaccagtagctgccagaaggccatgttccagtgtgggttactacaacagctttgcactatcctgatggctaccggaattcctgctgatatcctgactgagaccataaatactgtatcagaagttattcgaggctgccaagtaaatcaagactactttgcttctgtgaatgcgccttcaaatcccccacgaccggcaatcgttgtgctgctcatgtccatggtcaacgagaggcagccatttgtactgcgctgcgccgtgctctactgtttccagtgcttcctctataaaaacgagaaaggacaaggagagattgtggccactctgctaccttccactattgacgcaacaggtaactcggtctcagctggccagctgctctgcggaggtttgttttccacagactccctctcaaactggtgtgctgccgtggccctcgcccatgcactgcaagggaacgccacccagaaggagcagctgctcagggttcagctggccaccagcatcggcaaccccccagtgtcgctcttgcagcagtgcaccaacattctgtcccagggaagcaagatacagacaagagtcgggttgttgatgttgctttgtacctggttaagcaactgtccgattgctgtaacacactttcttcacaactcagccaatgttccatttcttacaggacagattgcagaaaatctcggagaagaagagcagttggtccaaggcttatgtgcccttcttttgggcatttcaatttatttcaacgacaactcactagaaaactacacgaaagagaaactaaagcaactaatagagaagaggattggcaaagagaattacatagagaaacttggatttattagcaagcatgagttatatcccagagcatctcagaaaccccagccaaactttccgagtccagaatacatgatatttgatcatgagtttacaaaactggtgaaagaacttgaaggtgttattaccaaggctatttataagtccagcgaagaagataagaaagaggaagaggtaaagaaaaccttagaacagcatgataatattgtgactcactataagaatgtgatccgtgagcaagacctacaactggaggaactaaaacagcaagtgtccacactgaaatgtcagaacgagcagctgcaaacagcagtcacccagcaggcttctcagattcagcagcacaaggatcagtacaacctcctcaaagttcagctcgggaaagacaatcaccatcaaggttctcacagtgacggggctcaggtaaatggcattcagccagaggaaatcagtcggctgagggaagagatagaagaattaagaagtcatcaggtgctcttacagagccagctagctgaaaaggacactgtgattgaaaatttgagatcttcacaagtgtctggcatgagtgaacaggctttagcaacgtgttcacccagagatgccgagcaagttgcagagttaaaacaggaattgtcagcattaaagtcccagttatgttcacagtctctggagatcactagactccagacagagaaccgtgagctgcaacagagagcagagaccttggcaaagtcagttcctgtagaaggagagagtgagcttgtgacagccgcaaaaactacggatgtagagggaaggctgtctgccctgctgcaggagaccaaagagttaaagaatgagattaaagcattgtctgaggagaggacctccattcaaaagcagctggactcctccaacagcaccatcgccatcctacaaacggagaaagacaagctatacttggaagttacggattctaagaaagaacaagatgatcttttggtgctgttggcagatcaagatcagaaaatcctgtcactgaagagtaaactcaaggatcttggtcatccagttgaagaagaagatgaatctggagaccaagaagatgatgatgatgaacttgacgatggtgacagggaccaggatatctagctttaaaccctaggaacaatagagattatgtcattgtgttgaagaagtcttaagacagtgctttggcttgcctccacaaaaaataaagacagaaccaggtggaaagcattcactaataaaattattgatgtatgtttttaatattgccacccatgtgggaaactctgacttcatgtggaagttttatttatgttcttctgaactctcccaaaatttgcagagggcaccaggttccaaaaacacagcatttgaaggcacgtggtggcagtgcagttccttactggttcactggtcggtcgcttgctttcagacagagtctgggccttcagtactaacatttgattaatgtgtattgaacgggaatcactatttctaaatcagcgtttgcattctcggctgattaatccttgtaaagaaaggactgtacttaaagacagggcagccttgaatcaggggtcctgtgtgtcatcacccccttccccactgtgcctccctggtgagcaggatgggacagttcagagtgcttgccgtccagcaggccacctctgcctactgagcggaaagactgtcccggagtgtgaaagcactctgaggagctggaacagtgtattaacgtggctggttttctctctgttaaagctaaagaaggaaacagtatagtcagcagttcatacagctgggattagaattgtttgattatcacaaaacatgttcttagttttacaaaaacccaaactatgatttatgtaatttattggcatttttgctgaataggtgtaagtcagataatagatttttaaaaagcaaatgaagcaatgtgtcaaagtataatgttttcataataaaaatagatattatgttcactt

SEQ ID NO: 3499 - DNA, 2369 bp, Rattus norvegicus
  Genbank Accession No. NM_019380
  misc_feature (1)..(2369): n = a or c or g or t
gggacgggggaaggacggagctcggccgctgctgcctccctcgttcactccctcgcgctctcgcccgccccctccctccctcccctcccttccccgggcccgggcccggaccattcgctgctcgctctccggctagggaggatgtcgggctcgtcgctccccggcgccctggccctctcgctcttgctggtctctggctcgctcctcccagggccaggcgctgctcagaacgctgggtttgtcaagtcgcccatgtcagaaactaagctcacaggggacgcctttgagctgtactgtgatgtggtcgggagtcccacgccagagatccagtggtggtacgcagaagtcaaccgggcagagtctttcagacagctgtgggacggtgctcggaagcgccgtgtcaccgtaaacaccgcctacgggtcaaacggcgtgagtgtgctgagaataacccggctcaccttggaggactctgggacttacgagtgcagggcaagcaacgaccccaaacggaatgacttgaggcaaaacccttccataacatggattcgagcccaggccaccataagcgtccttcagaaaccaagaattgtcaccagcgaagaggtcattattcgagacagcctccttcctgtcaccctgcagtgtaacctcacttccagctctcacacccttatgtacagctactggacaaagaatggggtagaactcactgccacccgtaagaatgccagcaacatggaatacaggatcaataagccaagagctgaggattcaggcgaataccactgtgtatatcattttgtcagcgctcctaaagcaaatgccaccattgaagtgaaagctgctcctgacatcactggccataaacgcagtgaaaacaaaaatgaagggcaggatgctatgatgtattgcaagtctgttggctacccccacccggaatggatgtggcgcaagaaggagaatggtgtgtttgaggagatttccaatagctctggtcgcttcttcatcatcaacaaggagaattacactgaattgaatattgtgaatctccaaatcacagaagatcctggagagtatgaatgtaatgccaccaactccattggctctgcctccgtttccacagtcctcagggtacggagccaccttgccccactttggcctttcttgggaattctggctgaaatcatcatccttgtggtgatcattgttgtgtatgagaagaggaagaggccagatgaggttcctgatgccgggccaatgaaaaccaactctaccaacaatcacaaagataaaaacttgcgccagagaaacacaaattaagtactgcttttaatctctttaggttcctgaaaaatgatggcaacatgacctgctaagttttctgcttggacctctttggtctctccctttcaagtgagcaacaccacaatgaccgtctaaagcatgccttatttagcctctcctataagggtgacctagccaggtacattttaaacaatgcttcagtgtagaaggtgtaaactattttggggcttgatgtgctgtgaatgttgctttccctccctttgttaaaatatttaaatagaagcgaaaggtcctttgaggatcagatcatgcatgcgccatttttttacttatacagctgttaaattggcaaagctctaaatgcactgctgccatctagtgatcattttgnaaagtacagcaaaacctacagatatatacagtatataaatatatatatattcatatcncngggggtgggagaaatccaaaataaagtcaaagcttgtttcatttttaagctgctgatactcattccttattatttgttgtcagatgaggaagctgcagttctggtacaaaaagatgagagtataaacttaagtctgtcattctaagggcttacttaccctataactttaagaacctggaacagtccactgaacggctagaatgaattgcagtatatatgtatgattgctttttaagtgactatttttccttttgtcaaatcatgtaaattctgaaatcttttgcactgatgtgtcgaaccttattcttgtatattcaatcaaggcaacttttataatttcccatttgttttcaatgaccctgaaatgttaatagcatggtgatattctatgcaactctagttataccttttggtttgacactgtattttcacattgatttcatgactgatgatagattttataacctgactgggttctcatgcggtactaactgtagatgcatgtacttgtgttctgtgtaattattgaagtgcaatggtgtacaaaaaaagtgaattcacctgtttttaacaataaaacattgataaaaaaaaaaaaaaaaaaaaaaaa

SEQ ID NO: 3500 - DNA, 940 bp, Rattus norvegicus
  Genbank Accession No. NM_019381
ccgaggtgagaagccccgagcttggcctggctcccccgccccacggagcagccccactctgatctgattggttacctgtggacagcggaggctgcgctgaacagacttggagccatgaatatatttgatcggaagatcaactttgatgccctcttaaaattttcccacataactccctccacacagcagcacctaaagaaggtctatgccagttttgcactgtgcatgtttgtggcagcagcaggggcctatgtccatgtggtcacacgtttcatccaggctggcctgctctctgccctgggcgccctggccttgatgatttgcctgatggccacacctcacagccatgagacggagcagaagaggctgggactgctcgccgtcgccttccttacaggagttggcctgggacctgccctggagctgtgcattgccatcaaccccagcatcctccccacggccttcatgggcacggccatgatcttcacctgcttcagcctgagtgccctctacgccaggcgccggagttacctctttttgggaggtatcttgatgtcagccatgagcctcatgttcgtgtcctctctggggaaccttttctttggatccatttggctgttccaggcaaacctgtacatggggctgctggtcatgtgcggctttgtcctcttcgacactcagctcattattgaaaaggctgaacacggagacaaggattacatctggcactgcattgacctcttcttggacttcgttacactcttcaggaagctcatgctgatcttggccttcaatgagaaggacaaaaagaaagagaagaagtgacgtggtgatcgatcggcctctcccagctcgccttctctccctcagccccgtttctttgcacacatcacaggtgtcgtgtcccatgaaatgaaaagcatcagaaaaaaaaaaaaaa

SEQ ID NO: 3501 - DNA, 581 bp, Rattus norvegicus
  Genbank Accession No. NM_019383
ttctgctggagacaggctccgccgggggtcggtgaagtatccaagatggctgggcgcaaacttgctctaaaaaccatcgattgggtatcttttgtggagatcatgccccaaaaccagaaggcaattggaaacgctctgaagtcctggaatgagaccttccacaccaggttggctagtctgtctgagaaaccaccagcgattgactgggcttactacagggccaatgtggacaagcctggcttggtggatgattttaaaaacaagtataatgctctgaagatccctgtgcctgaggataaatacacagccctagtggacgccgaggagaaggaggatgtgaagaactgtgcccagttcgtgactggatctcaggctagggtccgggaatatgagaagcagctggagaaaataaagaacatgattccctttgaccagatgacgattgatgacttgaatgaggtcttccctgaaaccaagctggacaagaggaagtacccatactggccccatcagcccatcgagaacctgtgaagcagcccaggagggagccctggctgacttgaataaacatttacatagtc

SEQ ID NO: 3502 - DNA, 3851 bp, Rattus norvegicus
  Genbank Accession No. NM_019384
cctaatgataaagatggctctcggtgttgtggcctacaatggaggcgctgctgtcggagtcctcggtcagagcctcgttcacaggagtcagggggtgctgacatggccactgtactggacacagctgcagatagtttccttgtggaggtggtgagcatcctggatccccccgacacctgggttcccagccacctggaccttcagcctggcgaaagtgaggacgtgctagagctggtagctgaggtccgtatcggtgacagggaccccatgcctctacctgtgcccagcctgttgccccgcctcagggcctggaggacaggaaagacggtttctccacagtcccatgcatctcgacctgcctgttcccgtcacctcctcaccttgggcacaggggatggagggcctgccccaccacctgcaccctcctctggctcatcctcgccttccccttccccatcttcgtcttctccttctcctccccctcctcctccacccccaccccctccagctctgcctgccccacgatttgacatctatgatcccttccaccccaccgacgaggcctactccccaccgccagccccagagcaaaaatatgatccctttgaggccacgggctccaaccccagctcatcaggtgggaccccctcgccagaggaggaggaggaagaagaggaggaagaggaagaggagggtctatcacagagcatcagacgaatctcagagaccctggctggcatctatgatgacaacagcttgagccaggacttcccaggtgatgatagcccccaccgggaacccccacccccgcagacgctgggagccccagggacaccaccacaggctgactccactcgggccgaaggggccccacgccgcagggtctttgtggtgggaccggaggctgaggcatgtcttgagggcaaggtttcggtggaagtcgtgacgacggctggtggaccagcgctgccgctgccaccacttcccccgactgatccagagatagaggaaggcgagattgtgcagcctgaggaggagcccagggtggcagtgtcactgttccgtgctgcacgacctcgtcagcctcctgcctctgtagccaccttggcttcagtggccgcccctgctgcgcccccagcctctgctccacgtgcccctgagggtgatgacttcctgtcactacatgctgactctgatggtgagggcgcacttcaagtggacctaggtgagccacctgcaccaccggctgctgatgcccgctggggcggcctggacctgcgccgcaagatcctaacccagcgacgtgagcgctaccgccagcgctctgcctcgccaggcccaccgcctgctcggaagaaggctcgaagagagcggcagcgcagtggcgaccctgcgccaccggattcgcccacctgggaagctaagaagcaccgttcacgtgagcgcaagcttggctcccactccactgcccggcgtcgatcacgctcccgttcccgccgccgttcacgctcccgcagcgccgaccgaagacgtgggagccaccgctcacgttcccgggagaagcgcaggcgccgacggcgttccgcctctccacctccagcggcatcttcgtcatcttcctcgagacgtgagcggcacaggggcaagaggcgtgagggtggcaagaagaagaagaagcgctcgcgctcccgggcagagaagcgctctggggacttagagaagctgcccgcacctgtgcctccctcgggctctgaccgtgacagccgacgccgcggagccgtgccaccttctatccaggacctcacggaccacgacttgtttgccatcaaacgaaccatcacagtgggtcgcccagacaagacggagccacgcgcaccttcgccagcacctgctgtgtccccaaagggggaggtcctgtatgactctgagggtctgagtgcagatgagcgaggtgccaagggtgacaaagatcgcaggcgttcaggggctgcgtcctcatcctcgtcctcaagggagaaagcgtctcgacggaaggccctggatggggaccgggggcgagacagggacaggtcatccaagaagccacggacacctaaggactctgctcctggctcaggggcgctgcccaaagcacccccaagaagtggctcctcgtcctcgtcgtcctcctgctcctctcgaaaagtaaaactgcagtccaaggtggctgtgctcatccgagagggcgtcagcagcaccacccctgccaaggattcctcgtcttcgggcctgggttccattggggtcaagttcagccgagaccgtgagagccgttcaccattcctcaagccggatgagcggtctcctgcagagggggtcaaggtggccccaggcagcaccaagcctaaaaagaccaaggccaaagccaaggctggggccaagaaagccaaggggaccaagggaaagacgaagccgtcgaagactaggaagaaggttcgcagtggaggcagcagcacggccagtggtgggcctggttcactgaagaaatccaaggccgatagctgcagccaggcagccagcgccaaggggacagaggaaacatcatggtctggggaggaacggaccaccaaggcccccagtacccctccacctaaggtagccccacctccacccgcactcaccccggactcccagactgtggatagcagctgcaagacccctgatgtctccttcctagcagaggaagccagtgaggacactggggtccgagtaggggcagaggaggaggaggaagaggaagaagaggaagaggaggaagaggagcagcagcctgccactaccacagccaccagcaccgctgcagctgccccaagcactgcccccagtgcggggtctacagctggagactccggcgcagaggacgggccagctgctagggcctcccagctgccaacgctacccccacccatgccctggaacctacctgctggtgtggactgtactaccagtggtgttctggccttgactgcactcctgttcaagatggaagaagccaacctggccagccgcgcaaaggcccaggagctgatccaggacaccaaccagatcctcaggcaccggaagccaccctctactctgggggtgaccccagctcccgtgcccacttcctttggtctgcccccagccccctccagctacctgcttcctggcagcctccccatagggggctgtggctctacccctcctacccctacagggctagtccctgcatctgacaagagagagggcagcagcagctcagagggacgtggggacactgacaagtatctgaagaagctgcacacacaggagcgggcggtagaggaggtgaagctgtccatcaagccatactaccagaagaaagacatcaccaaggaggagtataaggacatcctgaggaaggctgtccacaagatctgccacagcaaaagcggggagatcaaccctgtcaaggtgagcaacctggtaagggcctacgtccagcgctaccgctacttccgcaagcacggtcgcaagccgggggaccccccaggacctcctcggccacccaaggagccaggccccccagacaagggtggcccaggcctgcccctgccccctctctaagactccttaccctgtccctgtgcctctgagattctggacatatttatggctccacttccccactatgcccccccacagtgggatgatggggaaggttgctgtgaggaagaggagagcccaccctagccctatccctacccgttgacctagcctgcccccacagtcccagcccttctgtcatgccccctccagtttcattaaagatttcataaaaaaaaaaaaaaaaa

SEQ ID NO: 3503 - DNA, 3393 bp, Rattus norvegicus
  Genbank Accession No. NM_019386
ctggcccatggcagaggagctgaacctggagaggtgcgacttggagatacaggccaatggccgtgatcaccacacggccgacctgtgccaacagaaactggtgctgcggcgaggccagcgcttccggctgacactgtacttcgagggccgtggctatgaggccagcgtggacagacttacatttggtgccgtgaccggcccagatcccagtgaagaggcagggaccaaggcccgattctcactgtctgacgatgtggaggagggatcctggtcagcctctgtgctggaccaacaggacaatgtcctctcgctgcagctctgcaccccagccaatgctcctgttggccagtaccgcctcagcctggagacttctactggctaccaaggctccagcttcatgctgggtcacttcatcctgctcttcaatgcctggtgcccagcggatgacgtgtacctagattcagaggcggagcgccgggaatacgtcctcacacagcagggcttcatctaccagggctctgtcaagttcatcaagagtgtgccttggaactttgggcagtttgaggatgggatcctggatgcctgcctgatgctcttggatgtgaaccccaagttcctgaaggaccgtagccgggactgctcacgacgcagcagtcccatctatgtgggccgcgtggtgagcggcatggtcaactgcaatgatgaccagggtgtgcttctgggtcgctgggacaacaattatggggacggtatcagtcccatggcctggatcggcagcgtggacattctgcggcgctggaaggaacacggctgtcagcaagtgaagtatggccagtgctgggtgtttgcggcggtggcctgcacagtgctgcggtgccttggcatccctaccagagtggtgaccaactacaactccgcccacgaccagaacagcaacctgctcatcgagtacttccgaaacgagtacggggagctggagagcaacaagagcgagatgatctggaatttccactgctgggtggagtcctggatgaccaggccagacctacagccaggctatgaggggtggcaggccattgaccccacaccgcaggagaagagcgaaggaacatactgttgtggcccagtctcagtgcgggccatcaaggagggtgacctgagcaccaagtatgatgcgtccttcgtgtttgccgaggtcaacgctgatgtggtggactggatccggcagtcagatgggtctgtgctcaaatccatcaacaattccctggtcgtggggcagaaaatcagcactaagagcgtgggccgtgatgaccgggaggacatcacctatacctacaagtacccagaggggtccccagaggaaagggaagtcttcaccagagccaaccacctgaacaaactggcagagaaagaggagacaggggtggccatgcggatccgagtgggggatggtatgagcttgggcaatgactttgacgtgtttgcccacatcggcaacgacacctcggagagccgtgagtgccgcctcctgctctgtgcccgcactgtcagctacaacggcgtgctggggcccgagtgtggcactgaggacatcaacctgaccctggatccctactctgagaacagcatcccccttcgcatcctctacgagaagtacagcggttgcctgaccgagtcaaacctcatcaaggtgcggggtctcctcgtcgagccagctgctaacagctacctgctggctgagagagatctctacctggagaatcctgaaatcaagatccggatcctgggggagcccaagcagaaccgcaaactggtggctgaggtgtccctgaagaacccactttctgattccctgtatgactgtgtcttcactgtggagggggctggcctgaccaaggaacagaagtctgtggaggtctcagaccctgtgccagcaggagatgcggtcaaggtgcgggttgacctgttcccgactgatattggcctccacaagttggtggtgaacttccagtgtgacaagctgaagtcggtcaagggttaccggaatatcatcatcggcccggcctaagggacccccttcacccagactcagcccatcacctgccagccctcaactcaacctggttttatccccagataatgagcgacgactgcaccccattcgggctgacatgactgcctcggggcttttcagaagacaatgtacttctggcccatcctgttcctctggatctatttccccatctgtccccttagctgtgaggaatgttctgtgctgatacagccagtaccctggcgagagtaagaggagagccattattaccagcactctgtatctgtgtattgtttgaactgtctctagagcctcagagtgagtgcaaacggatggtgagcccgttggctcaacgaaggaactcagctgcctctccaacagtttcccacccgcctcccctctgaaggggaactgtatgtgctaggcaccttgagttctaacagggacagcaacctgttggatgtccatgagaaacttcagggtgggaactgaggctgcccgtgctgtactgtgtcagtaggacaggccagccatcacttgcagggccagtgggtgagcttagaaacaccacctgtgtcatctggcttggaatttagcactctatctgtgacaccagctttgacccgagggtgtcagagaggccatctcttccggccttctccggaaggacacggttagggtgaggaggtgagggaggagcggggaggcttgagagctgggagtcagagcctgggtttaagccccaaggagggctacactctatcctcctcttctgggcttgatcctcctatatcagagcagagattgacaagccctcctccagggtttcctggtcccatacttctaaagccttccatccaaggctagggcacttctggggtgtcctgcttctcacctgtgcctgggctcctcagatacagttccaggacaacccacaagctactcacatagtgcctagactagatttcacagaaggagccttaaatgtccatgctggtccctacccaccagggccacccctccatgcccctcctccttggtaagcacacctagacacagcatttgtctctagaaaagcacagaagcctatgggtcatcatccgagttagcctactcctacccctctgtggctgggccctcaagctggaaggctgcagtgtggaggggtttctagggggtgaggtcagagactctgggatcccctgaaatcccagagaagaacttgggaagaatcacactgctgcatttaacacgttccgctttatgcagagaatcgcaccgtgagtcttgtatctgccctgtccccacacggttccatttcttttgatctgtgcaagctt

SEQ ID NO: 3504 - DNA, 1940 bp, Rattus norvegicus
  Genbank Accession No. NM_019620
ggaattcggcacgaggtgatttccagcttttggaagccccggtgctttacgaaatcacggtagccggagagccatggagatggaacagttgaccttccgagatgtggctgttgacttctctccggatgagtgggaatgcctggaccctcctcagcagaggctgtacagggacgtgatggtagagaactacagaaacctggtctctgtggctctttctcatcattgtacccagaacttttcaccagaacagatcctaaaatattccttcacaaaaggaactaatggaagttgtggccttaaaagtttatacttaagggaagattgtatatatatagatgagagtaaagcccaccatggtagagatatgcaatgtctaattacaagcaataccaaagatgtcattgacagcagagatcaagaacacaaaaccgctctgacaataactcctgtgaggccagatactttggatgagccaagtatctataactgtaaatatccacaggaaagttttcagcatgacttaactttgaaagaaagtttggaagatctgatagatgggttaatgtttcacccaaacagttccatagataaagaattaagaagcagaggactgatatcaacaagtgatcaaattgagactttctatactgaaagatccttactcttcagtcagcaaatagctatctcctatgacccaaagcacaattctattgattatggattgcctgctattgatccattatcacatagcccaaatggcgatacagatgtgtgggaaagccctttcatgtataaggaaactagcaaagattttagtagtgaatctttactaaataactgcaatgatattatcttagagaaatctagtcagtataacaaaatatgtaacgactttgaccattgctcaagtcccaacaaatatcagtatactcttccaaagaagcctttcaattgtgataatttctttactcaatgttcaaagctttctatccatcaatatgttcaagataattgttacaagagtatcgattgtgacacaatgtttaataaaactttaaatgttattacacataaaattcagcattcccagaaatcctacaaatgtaatgaatgtggcaaagcttttaaatattgctcaagttacagaaaacacagaataattcacacaggagaaaaacccttcaaatgtaaagtatgtggaaaatcctttacccaatgtgcaagccttaaaaaacatcagagaatccacacaggagagaaaccctacaaatgtgaagaatgtggcagaagctttaaccactactcaattcttggtcagcaccagaggattcatacaggagagaaaccctacaagtgtaaacagtgtgggaaatcctttactcaatgttcaagccttcagaaacaccaagtaatccacactggagagaagcccttcagatgtgcagaatgtggcaaatcctttacgcaaaactcaacccttagtcaacaccagagaattcatactggagaaaaaccttacaaatgtgaacagtgtggaaaggcctttacccaatgttcaagccttagaaaacaccagagaattcacactggagagaaaccctacaaatgtgaagaatgtggcagagcctttaactgccgttcatcttttactaaacacacaagagaattcacacaggagagaaaccttacaaatgtaaagactgtgacaaagctttcatccactgcacaaaccttactcaacaccggagaatccatacaggagagaaaccatacaaatgtaatgaatgtggaaagtcctttagtcagtgttccaaccttagaaaacatgagagaattcatacatgagtaaaactaacaaatgtaaagaatttagtaaatcttttatccatatgcaaaaaaaaaaaaaaaaaaaaaaaaaaaaaaaaaaaaaaaaaaaaaaa

SEQ ID NO: 3505 - DNA, 1977 bp, Rattus norvegicus
  Genbank Accession No. NM_019623
gtcctcctctgggacagggaaggatgtcacagctgagcctctcctggctgggactggggcctgaggtggccttcccatggcagaccctgctactgtttggagcctcctggatcctggcccaaattctgacccagatctacgctgcctataggaactttcgtcgcctccgtggcttccctcagccccccaaacggaactggcttatgggtcatgtgggcatggtcactcctacagagcagggcttgaaggaattgactcggttggtgggtacctacccccaaggctttttgatgtggattgggccaatggtccccgttattactctgtgccactctgacatcgtccgatctatcctcaatgcctcagctgccgttgcgctcaaggatgtgatattctacaccatcctcaagccttggctgggggatgggctcctggtgagtgctggtgacaagtggagccgccaccgccgcatgctgacacctgccttccacttcaacatcctgaaaccctatgtgaagattttcaacgacagcaccaacatcatgcacgccaagtggaaacggttgatttcagaaggcagttcccgtctggacatgtttgagcacgtcagcctcatgactctggacagtctgcagaaatgtgtcttcagctttgacagcaactgccaggagaagtccagtgaatatattgctgccatcctggagctcagtgccctagtggccaaaaggcaccagcagcctttgctgttcatggacctgctgtacaatctcacccctgatgggatgcgcttccataaggcctgcaacctggtgcatgaattcactgatgccgtcatccgggagcggcgccgcaccctcccagatcagggtttggatgagtttctcaagtctaaggccaagtccaagactttggatttcattgatgtgctgctcctgaccaaggatgaagatggaaaggagctgtcggatgaggacatcagagcagaggccgacaccttcatgtttgagggccatgacaccacagccagtgggctctcctggattctatacaacctggcgaacgacccagagtaccaggagcgctgccggcaggaagttcaggagcttctgagggaccgagatcctgaggagattgaatgggacgacctggcccagctgcccttcctgaccatgtgcatcaaggagagtctgcggctgcaccccccagtcacggtcatctcccgatgctgcacccaggacattctgctcccagatggcaggaccattcccaaaggtatcatctgccttatcagtatctttggaattcatcacaacccgtctgtgtggccggaccctgaggtctacaaccccttccgctttgaccctgaaaacatcaaagacagctcacctctggcatttattcccttctcggcggggcccaggaactgcataggtcagactttcgccatgagcgagatgaaggtggcgctggcactaacactgctgcgcttccgactcctaccggacgacaaggaaccgcgcaggcagccagagctgatcctgcgtgccgagggcggactgtggctgcgggtggagccgctgacggcgggcgcgcagtgacctcacagttggtctggagcacccccaccatcctacctctgaggatcccagaatgaacagaactgtcacccataccagaatcttacggagggccagcagggggcgctgtgaatccagtgagtgggtgagagaggccagttagtgtctgagccaaagacctttgacttcgtctaactgatcgccagcctttatcataaggtgcattcttctccaaccaacctggactattctctggacaataggaagccaaagaaacgtctgagcaagagaccagaatgaaacgcaaatttgagctcttattctcgcagcaaatcccttattcagctccatttccattattttgacctacattcaaatcatctaataaatacattctctc

SEQ ID NO: 3506 - DNA, 2952 bp, Rattus norvegicus
  Genbank Accession No. NM_019630
atctctccagtcccttcctcaaccttctgagaacaggcaaactccaccatgattggcttataaatcgttatatggacctactaaggatgtaacaactgggagcatgcttacctagcatgtccgaaacccggagttcagtccctagcactgcacaatctcagtccttatgaagtagagggaagatcagaggttcaaggacaacatcaatttgagaccagcctgggctacttaccaaagaaagaaagagagaaataaataaatagatagataaataaataaataagtaaataaatatcttatggctggagagttggttcagtgtttaagagcacttattgtggggttggggatttatctcagtggtagagcgtttgcctaggaagctcaaggccctgggttcggtccccagctccggaaacaaaacaaaacaaaacaaaaacaaacaaacaaacaaaaaaccctgtctggaaaacacctaaataaagatatatatatataatatatatacatataatatatatatgatatatatatatatatatatctttgtggaggaagctatacctttctttcttgagcctccaacacataaatgtgccctgtcatcccattcatattgccccaagtgggaaaccatgtgactataaactctaagttcctagtcactaggaactctcaagacacctacctcaggcagcatcacttccggagtgccaccattatcagttaacatccacatctgggattcagatcccagatcccttctgttccctcagaagtcacctacagctttgtgggggtgccccttccctcagagagtgccacccgagttgaccctcaccaaggcaaccctttgtacccacagaatccaacaggaagtagggggaagaacagccggccctgtgccagaaaaaaagaggggagggagaagggggtgctcagcctaccaccgggcaggtcccagataacactgcagatacccaaatgttaatcacccattagcacaggcccagagcaaaggggaaagtgattaggtgtataatggggttcactgggcaggagcagtgggcttgagcttcaaagataagaggttttcaggttaatcagcaccctgtggtgtgtggatataaggaagctaacacagggtcttgaagcaagatcctgagaaccaacaggtaggaggaagggacctcatcctgccctcctggaagagctaagaagagctgttgggtaagaaagaagatgggataggcccgggctagcccaggaggaagtgggtctcctggctcctcactctctccttgtctccaggggaatccagaagacagtacaaagaaattcttaggagaccaggtttcactgccttgggctagctctggtcgtcaggaatctggagcaaggtttctcactactcgctatctctcctaaatactgtaatgggtccacacccctgaagaagttcagagcaaactttaggaagattttaggaagagtcgagatagttcattgtgagaagggacgtgtgtaacaggatggttttcgggtgtgattttcttttaggggaaggatatgatggctgagtaacacttagttgtaagcaggaaggtgggctgctatgaacttagggcttgatgggataatcttgctaaatcctatccctgtgatgtctggtaaggagccaggaagggcgttcccaccacccagcgctttgcggctttcttcttcccagaccttccatcccaccccactccaaatctacagagcaggatcagctctgggtcaaggctccatgttccttctcttcatttcatggaatgcccaaaactcttgactgttcctgccccaccccagctctcagcacccgctcaagccccagcaccaggggggctcctggatccccccttggtataatactgccccttttccttctcagctcggggacacaatctaggaagatggtggctttgaagacctgctctctgctgctggtgctcctgttcctggctgtcgggctgggagaaaaagaagaggttgagttccggtagagttgcgggggaggtgggggggagggcctggtatctgtctctcacctctcagatcccatgctaaatttgctggcccccgaccacgaggcccaaggtatgcagaggggactttcatcagtgattacagcatcgccatggacaagatccgccaacaagactttgtgaactggcttctggcccagaaggggaagaagaatgagtatgtagctccctagcccaactcattcttgaacggtcttcatttctccagctggaaacacaacctcacccagagagaggcccgggctttggagctggcaggacaatctcagagaaacgaggagaaagaggcacaggggaggtgagtccactgtggggggtggggtggcaaacaaagcattctggctcctgcaatctgtctcctttgcagctctttgcccaagagcctcagtgatgaagatgtgctgagggaccttctgattcaagagctactggcctggatggcggaccaagcagagctctgtcgactgaggtggggagctcggggtcgtgggctgttgttcgcttgttagttcaggctctctgtcttctcacccttctcgtgtctccccctcttcaggtcccagtgaccgacctaccccggagcaggactggactctgaccttagcttgctcagatcctgcttctgccctggtccaaagtctctgagagaaccaaaccaataaagccttgagctgaagtaaaccttggtgtccattgtgaaaactcattcaaatgtcagctgagcactcacagggcatggctctgtgtgtgtgtgtgtgtgtgtgtgtatcttgggtgtccatgccacccaaggaaaagggacacatccagctattcctctatgaatcttacaaccatacgggaaccaacacagaccagaggaatt

SEQ ID NO: 3507 - DNA, 1395 bp, Rattus norvegicus
  Genbank Accession No. NM_019905
aggctctctgcaataggtgcccggcccagcttttttttcaaaatgtctactgtccacgaaatcctgtgcaagctcagcttggagggtgatcattctacacccccaagtgcctatgggtcggtcaaaccctacaccaacttcgacgctgagagggatgctttgaacattgaaacagcaatcaagaccaaaggcgtggacgaggtcaccattgtcaacattctgactaaccgcagcaatgcacagaggcaggacattgccttcgcctaccagaggaggaccaaaaaggaactgccatcggcgatgaagtcggccttgtctggtcacctggagaccgtgatgttaggcctgttgaagacacctgctcagtacgatgcctctgagctcaaagcctccatgaagggcctggggactgatgaggactccctcatcgagatcatctgctcaagaaccaaccaggagctgcaggagattaaccgagtgtataaggaaatgtacaagaccgatctggagaaggacatcatctctgacacatctggagaattccgaaagctgttggtcgcccttgcaaagggtaaacgggcagaggatggttctgttattgactacgagctgattgaccaggatgcccgggagctctatgatgctggggtgaagaggaaaggaaccgatgtccccaagtggatcagcatcatgactgagcgcagtgtgtgccacctccagaaagtgttcgaaaggtacaagagctacagtccttatgacatgctggagagcatcaggaaagaggtcaaaggagacctggagaacgccttcctgaacctggttcagtgcattcagaacaagcccctgtactttgctgaccggctgtatgactccatgaagggcaaggggactcgagacaaggtcctgattagaatcatggtctctcgcagtgaagtggacatgttgaaaatcagatctgaattcaagaggaaatatggcaaatccctgtactacttcatccagcaagacactaagggtgactaccagaaggcgctgctgtacctgtgtggtggggacgactgaagggcttggcatggtggattgcccagaagtggccctacctgtgccccaacctaatgttctagagaatcagcctgccactaatggacccctgaactcctccctgtgaagatgacgacagagctgccgacccatcccccatcttagctgcctttgcctggctttcccctcattctctcctttatgccaaagaaatgaacattccagggagttggacgtaccgtctgtgacatgagacacttcctcatatgtgtcgtgaataaaccatttttactttaaaaaaaaaaaaaaaaaaaaaaaaaaaaaaaaaaaaaaaaaaaaaaaaaaaaaaaaaaa

SEQ ID NO: 3508 - DNA, 1435 bp, Rattus norvegicus
  Genbank Accession No. NM_019907
tgatgtattttggcagctgctcctgctttgcgggttgagggggacaggacgacccgtggaaggatggtgtgtgaaaagtgtgaaaagaaactcggcagggttatcactccagacacatggaaggacggggcccggaacaccacagaaagtggtggaaggaagctgaacgaaaacaaagctctgacttcgaagaaagcaaggtttgatccatatggaaaaaataagttctccacttgcagaatttgtaaaagttctgtacaccagccaggttctcattactgtcaaggctgtgcctacaagaaaggcatctgtgcgatgtgtggcaaaaaggttttggatactaaaaactacaagcagacttccgtctagtctgttgaagattccaactctacggttgtatttgtgcttcagcttttcaagcgtaacacggatgtccatctcacaaaatgacctgtttgaggatgaatgattcagtctgaagcagggacgttgatcagtattgatctgtctgctctcatgaagttgtgaatgaagtttctgccttaggtggttattttccttgtgagcattttactgaactagataagtgacaaaattaatgaacgaggtttcccaacttgtgtacgcactgtctactcgacattatctaattaatgagtacgcactgtctactcgacattatctgtataattaatgagtaaggtgttccctacttctgtacgcactgtctactagacattatccatataattcctatctgacccacgcgttttatttatagatattgcaaatgtgaaatcactgattctttgctctgaacttgacatccagacttgagatttctcactttctcacaaacattgcagttcttagaacaaacagggccttagttactgcattttcatgagctataatgtctgagaccatttttgcagagtggttccttggtgaccagtcctgccacaagtctaagataagttgcatttttatttaaagttgctgttgctgctaaagtgagtttcttttacgtgtgactgagtgccatggggcccgatgtccaggcagacactgaagttcagagacgtgcgttctgtcagcattatcttaaattcaaatgagaatacatttattctgtttgggaatgttctttgaagaaggatacatagctttccttaacaccccccaacccccgctgccacttcctcagaaataaagcaggcctctggcctctgacattgctgcagcctgccagggggctgctgtgaatgaaggtttttcttgttgccttctttgggttgggccttccacctttaaaaccctcagcctacccagagaccaaaagcatattctctgtttttatctgcaggatcttaaatgcatatcactgtgtaatgtgagacctactataaacaatgaaaaaataaaaaaaaaaaaa

SEQ ID NO: 3509 - DNA, 3504 bp, Rattus norvegicus
  Genbank Accession No. NM_020075
ctctgcttttctctttcagagctgttgcgcagccattggtacctgtattggggaaacatagcatacaagcaagaagcttacagcctcagtggcgaaaaatttttcatgtcagagaccgagaactcttgcagtcgtttatgtcatcccttcttctccagacagaagataccaaaaagttgcaatcaaagatctgttcatcttattgataaagtcactaataagccaaaatgtctgtcaacgtcaaccgcagcgtgtcagaccagttctatcgctacaagatgccccgtttgattgctaaggttgagggcaaaggaaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgagtgtgagaatcctgaaacagatctgcatgtcaatccaaagaagcaaacaataggtaattcttgtaaagcctgtgggtaccgaggcatgcttgacacacatcataaactctgtacattcattctcaaaaacccacctgagaatagtgacattggtacaggaaagaaagagaaagaaaagaaaaatagaaagggcaaggacaaggaaaatggctctgtatccaccagtgagacaccaccacctccaccaccaaatgaaattagtcctccacatgctgtggaagaagaggaagatgatgattggggggaggatacaactgaggaagctcaaaggcgcagaatggatgaaatcagtgaccatgcaaaaggtctgacacttagcgatgatttggaaagaactgtagaagagcgtgttaacatcctgtttgattttgttaagaaaaagaaagaagagggcattattgattcatctgataaagacattgtggctgaggcagaaagactggatgtaaaagccatgggccctctcgttttgacagaagttctctttgatgagaagataagagagcaaatcaagaaatacaggcgccattttttaagattttgtcataacaacaaaaaggcccagcggtaccttcttcatggtttggaatgtgtggtagcaatgcatcaagctcagttgatctccaagattccacatatcttgaaggagatgtatgatgcagaccttttagaggaagaggtcattatcagctggtcagaaaaggcctctaagaaatatgtctcaaaagaacttgccaaagagattcgtgtcaaagcagagccatttattaaatggttgaaggaagcggaggaggaatcttctggtggtgaggaagaagacgaagatgaaaatattgaggtggtatattcgaagactgccagtgtaccaaaagttgaaactgtgaagtctgacaacaaggatgacgacattgatattgatgccatttaaaaggatggatgcaacttagcttaacagtgtaatgctgcaaatttttctccattatcagccagaagtgcaacatgtatgtgcaagagctaaagtggcttaacatcatgctacacttgatactaaaaagctattactgtgagtggtctataattaagcccaatgagacatctagggagtccatacatatcagtgagcagttgtagtttgcttatttatagcatgtttctttcggaaaaactagtggtggacacatttggatcacatttatacagttataaaaaataaagatttgattttggtcattcttcagactttgggctatgaatggcttatgctgaagtaattggctacttttaggatgttacaccatttaataacttagacttcttaagtttggtagattgttaggtactgaagacttgaagaatgcaaacaattataatgaccttactcagccattaagaaatgaagtattttgaaagttgtgtctccagtccattgagattggcaactgacaattcttgtcattctaaggaaatttgatgatttaatgacagtgtgacatcctcatgagaagtaaaaatgacctgtgtgtcctatggtttaagagcaaattttgaaacttggagttgtggtttttcagtttgtgtacactcaccccaaattgtagtctattgagtcatgtgcattgcacgttggataagccagggaaatgacaaataagtattttgtgtgtatttagtggttgctttgtactgagagaaaagctttgaggtgtgattaaatcgtaaactctgattctatttgggagaaacaggaaaaaggtgcacttaatctaaaacagcataagttttcaacttttacccttaaattataatttcaagatgtttagacatactgtatcttgtgtttgatgtgttccccctccctaatattatggtttattctttaatgccttttaatttggatataatagcttgtactttagattttggttgctatcttgccaaaataagtgttactgtttttcaagcttgatccccttccctgattgtcttatttaaagagaaagttaaactcatacttctgagtcagagcctgtattttggttaagacttgggatattttttacttcacattgaatatagctggatacctgagaagtctggtgatggcactgggtgggtgcagctagctaaggcctgaccagcccattcagagccttggacttcagacacaaaagtgagtttcttacccacttgctggtgtaaactctatctggggtcctgactatatttgaatacttgtcttcaatattaaaaaacatagcacatttttctttctacaaaagtacattctggagttaagaacccatgtggttgatttgtgtgtggcgtgctagctcatacattatttggatcttattctttgtgtcatccatctcacagattataagactttgattaatgtaaaaagtatgcgttaaaatcataccaaacatttggtaaaattaaaaccttgatgggaggctgggcgtggaacaggagccatatacctggaatggtaacaggggaatgtgctatgtcacaccaaagaagtgggacttggaaagtcacttgtctcctgggtttcagactctttgttgcatgggcagcccatccatatgtcattactttttgagattctcaagtagatcagcacatttcggcctcaggttggcaagattttgtcttagagctgttgctttaaagggaaatggtcaggtcttagacacttaggaaggtcttgggcttctgttcattctggtgccaaaccagtgggattcaaatttcacacaatctgggtttttattcatggaggttaacctggtaagagtaatccttcatggctctattgaggtgtcttaaaaagtttcctgtttcaaacagctacattacttgattaaaacaatgttataaaattaaatttccccctcctttcatattaa

SEQ ID NO: 3510 - DNA, 1254 bp, Rattus norvegicus
  Genbank Accession No. NM_020076
cccgacaggagacagagcacattgtagctctccaactgccggattacctggcgaccacgttgtggtcagaagagtcctgcctgccggccatggagcgctgtgtgagagtgaagtcttgggtagaagagaatcgggcctcctttcagcctccggtttgcaacaagcttatgcaccgggagcagctcaaaatcatgttcgtcggaggccccaacaccaggaaggattatcacattgaagagggagaggaggtgttttaccagctggagggagacatggtgctccgagtcctcgagcaaggagaacaccgggatgtggttatacgacagggagagatattcctcctgcctgccagggtgccccactccccgcagaggtttgccaacaccatgggcctggtgattgagagaaggcgaatggagaccgagctggatgggctgaggtactatgtgggcgacactgaggatgtcctcttcgagaaatggttccactgtaaggaccttgggacgcagttagcccccatcatccaagagttcttccactctgagcagtaccgaacaggaaagcccaaccctgaccaactgctcaaggagccgccattcccgctgagtacacggtccgtaatggagcccatgtcactgaaggcctggctggagagccactccagggagcttcaggcaggcacatccctaagcctgtttggggacagctatgagactcaggtcatcgcccacggacaaggcagcagcaaaggcccgagacaggatgtagatgtgtggctgtggcaactggagggctcctctaaggtgacaatgggaggacagtgtgtggccctggccccagatgacagcctgctggtgcccgctgggttctcgtacatgtgggagcgagcgcaaggctctgtggccttgtctgtgacacaagaccctgcctgtaagaagccactggggtgacccttctgtgtgggcccaaagcagccacagggtgcctgagtgctgtcctgacagctgccctttccagacagctctttcagcctcatgacatctccgtggacattgacagggcccctccgtgatcgtgggctgtcactggcatccaccctgctgtcatgcttagctcaggatgcagaggggattcctaggacaccagtagttcccctctctcctaacagccctacactgtcagcgaggtgcataccgtcctcatgcgcctgtcagcctaacactaagaaatctctcaataaaggcctcctgctgg

SEQ ID NO: 3511 - DNA, 721 bp, Rattus norvegicus
  Genbank Accession No. NM_020080
gaattcggcacgagcgccgttgcagctatggccactgctctaggatttcgctgcctttaccgaacgcgacctgcgacgctcggtcggtacgtcgataggctgtggaggagcccgagtcgggggcaccggctttctccggctgacgatgagttataccagcggacgcgtatctctttgctgcaaaacgagttccctcaggccgtatacatcgacagctacaatagcagaggtttcactatcaacggaaaccgcgtgtttggaccttgtgcgctgctcccacagaccgtggtccagtggaacgtgggatctcatcaggatatcactgaagagagcttctcgattttctggatgctggaacctaggatagagattgttgtggtgggcaccggaaacaagactgagcggctgcactctcaagtcctgcaggccatgaggcagcggggaattgcggtggagatacaggacacgcctaacgcctgtgccaccttcaacttcctgtgccacgaaggtcgagtgacaggagctgccctcatccccccacctggagagactgcacttgcctcttctggtcaaaccacagagtgaaccatccagaacagtcaaggagggcactgagcttcgtgatctccccgtgccttccctactccccctcttggcacactagctgtcaatgctcacccaggataataattttatgatcttcttatcaaaaaaaaaaaaa

SEQ ID NO: 3512 - DNA, 546 bp, Rattus norvegicus
  Genbank Accession No. NM_020082
  misc_feature (1)..(546): n = a or c or g or t
ggaattccgctaatagctagactggtnccagtcagacggaggaaacctggccagcttttgcactttctaggtgacgatggacatacagaggacccaatccttgcttctgctcttgttgctgaccctgctggggttagggcttgtacagccctcctatggccaagatagaatgtaccaacggttccttagacagcatgtggaccctgagggtacaggcggcagcgacaactactgcaacgtgatgatgcagagacggaggatgacttctacccagtgcaaacgcttcaacaccttcatccacgaagacatctggaacattcgcagcatctgtgatactgccaatatcccatgcaagaatggcaatatgaactgtcacgaaggcatagtgagggtcactgactgcagagagacagggagctctgtgccccacaactgtaggtacagggcgagagccagcactaggcgagttgtcattgcctgtgagggtaccccagaggtcccagtgcactttgacagatagatgacatctgtagctgctactgctgg

SEQ ID NO: 3513 - DNA, 447 bp, Rattus norvegicus
  Genbank Accession No. NM_020099
gcttttggagaaagccggaagcagcgacagccccagctccagagacatggcgggcgttaaagctcttgtggcactctccttcagtggggcaattgggctgacctttcttatgctgggatgtgccttggaggactatggcgtttactggcccctgttcgtcttgattttctacgtcatctcccccatcccctacttcattgccaaaagggtcacctatgactcggacgcgactagcagtgcctgtcgggaactggcatatttcttcaccactgggattgttgtttctgcctttggatttcctgttattcttgctcgcgtggctgtgatcaagtggggagcctgtggtcttgtgctggctggcaatgctgttattttcctcacgatccaaggcttcttcctcgtctttgggagaggagatgatttcagttgggaacagtggtagcccct

SEQ ID NO: 3514 - DNA, 4128 bp, Rattus norvegicus
  Genbank Accession No. NM_020306
ggttccggctgtgggcagcagggtggtccgcgactgcggccggaagcaggctgagcggctctcggcgagcgccgcctgtacttccggggacttcagcctagctcttgagttttccctgtaggcggcgcgggagggaaaagtttgcagggccgtgctgggaagatcacctccgcttcccaatgtgagcagtttctcgaacgctctctctagaaggttgcccagagaggtggtggacgggaacatgaggcagcgtctcctcttcctgaccactttggtgcctttcgtcctggcaccccgacctccggaggaaccaggctctggctcccacctgcgacttgagaagcttgattctttgctctcagactacgatatcctctctttatctaatatccagcagcactccataaggaaaagggatctacagtctgcgacacacttagaaacactactaactttttcagctttgaaaaggcattttaaattatacttgacatcaagtacagaacgcttttcacagaacttgcgagtcgtggtggtggatgggaaagaggaaagcgagtacagtgtgaagtggcaggacttcttcagcggacatgtggttggtgagcctgactctagggttctagcgcacataggagatgatgatgtcacagtaagaatcaacacagatggggcagaatataacatagagccactttggaggtttgttaatgatactaaagataaaaggatgctggtgtataagtctgaagatatcaaggatttttcacgtttgcagtctccaaaagtatgtggttatttaaatgcagatagtgaagagttgcttccaaaagggctcatagacagagagccatctgaagagtttgtccgtcgagtgaagaggcgagctgaacctaacccattgaagaatacttgtaaattactggtggtggcagatcatcgattttataagtacatgggccgaggagaagagagcactactacaaattacttaatagagttaattgaccgagttgatgacatataccggaacacctcgtgggacaatgcaggatttaaaggttatggagtacagatagaacagattcgaattctcaagtctccacaagaggtaaaacctggtgaaagacacttcaatatggcaaaaagttttccaaatgaagaaaaggatgcttgggatgtgaagatgctgctggagcaatttagccttgatatagctgaagaggcctctaaagtctgcctggctcatcttttcacctaccaagattttgatatgggaactcttggattagcttacgttggttctcccagagcaaacagtcatggaggggtttgtccaaaagcttattacaacccaggtgtgaagaagaacatctatttgaatagtggtctgacaagtacaaaaaattatggtaaaaccatccttacaaaggaggctgacctggttacaactcatgaattgggacacaattttggagcagaacatgatcctgatgggctggcagagtgtgccccaaatgaggaccaaggaggaaagtatgttatgtaccccatagctgtgagtggtgaccatgagaataataagatgttttcaaactgcagtaaacagtccatctacaagaccatagaaagcaaggctcaagagtgcttccaggagcgcagcaacaaggtgtgcggcaactccagggtggacgaaggagaagagtgtgacccgggcatcatgtacctgaacaacgacacctgctgcaatagtgactgcacactgaagccaggtgtgcagtgcagtgataggaatagtccttgctgtaaaaattgtcagtttgagacggcccagaagaagtgccaggaggctatcaatgctacttgcaaaggagtgtcttactgcacagggaatagcagtgagtgccccccaccaggagatgctgaagatgacactgtgtgcttggacctgggcaagtgcaaggctgggaaatgcatccctttctgcaagagggagcaggagctggagtcctgcgcatgtgctgacaccgacaactcgtgcaaggtatgctgcaggaacctttctggcccatgtgtgccttacgtcgatgcagagcaaaagaacttatttttgaggaaagggaagccctgtacagtagggttttgtgacatgaatggcaaatgtgagaaacgggtacaggacgtaattgagcggttttgggatttcattgaccagctgagcatcaacacttttgggaagtttctggcagacaacatcgttgggtctgttctggttttctccttgatattttggattcctttcagcattcttgtccactgtgtggataagaaactggacaagcagtatgagtccctgtctctgtttcatcacagtaacattgagatgttgagcagcatggactcagcatctgttcgcattatcaagccgttccctgcaccccagactccaggtcgtctgcaggccctgcagccggctgcaatgatgccgccagtgtctgcggctccaaaactggatcaccagaggatggacaccatccaggaagaccccagcacagattcacatgtggatgatgatggctttgagaaggaccccttccccaacagcagtgcagccgccaagtcctttgaggacctcacagaccacccagtcaccaggagtgagaaggccgcctccttcaagctgcagcgtcagagccgagttgatagcaaagagacagagtgttagtgggagcctgggcctgctctgggggacacagacctacagatgttccacagagctgacctgaatcaaaatagactgtaatgatctgagaaacgggagcagcttagcagatgctggtcatgtgacaggaccttcacatgacatcctgtgtatgtaggccctttgaagaggtgaggtaaatctggcttatttaaggctttcaggttttggggttttcttttgtaatctaaaaatctcctttgacctgtggtgcagaagcagaaaataaggctggatcaagttcctggtgacagcactgattaagccttcagtctgtttttctgtatgctgtaaggtcctctcactacggtgaagcacttagcagtgaggataactggaacacagactttttgggggttttggccttcacatgtgcgttgtctccaaatgccgtctgtcttggcactgaactttgtggatacagtcctttccaagatgaagactagctctggaacagtctatacaaacagccacatgaacttcaagatggcctattaactgcttagccccaggttccctggacagtttttccgttttgcaaaaagtgtcttcacgggtctctaaacattgtttgtcttaaaaaatactgggctggagagttggccccacagttaagagcacttggtttcattcccagtacccacacggtggctcttaactccaatcccaggggagatgacatcttctgaactctagaacacaaggcatgcattggtgcagtcaaacatgcaggcaacacacacaaatttagaaagccaagtgctgtaagaagttgcacatcccccaacctacagtgcttcgcggtctgagctggagtggagctctctcctgaacactctggaaggctggcaggtgctgagctggctagggagacgggtggggcccagccctggaagaaccgtcttcagcctcagcaagcagacactcgcgttacctcaggctttggggcttcaggacccaggatgttttgtacttattgtgtgaggataaataccattagcctgaattctcatttctgtaagttttagttataaaagctttttttcttctaagaattgcaatgtgctcaccagcaaacacgtcttaaccagaataacttgtaactctgaggacagttaaccaaacctgtgccttgtctctcctgagggtgtctgttacactaatacttgaacatgtaccttgtggtattggctccttttactagtcatgacagccttatatgttagttacactttgaggatttgctctaaggtgagtggggtgtgtgggtgtatgtatgaatgaaacagttggcagaatataagaaaaccatttttataaaattgtgactttttaaaacaaaaaaaaaaaaaaaaaaaaaaaaaaaa

SEQ ID NO: 3515 - DNA, 539 bp, Rattus norvegicus
  Genbank Accession No. NM_021261
cctcggcctccgggctgcgggaacgcccggactgggaacgccacgtcgagaggcgttcgcggaaggcgcgggatccaggacgtgctggtcacccccaaaccccaggccacccattatcgccttggttcgcccatcagagttgtaagaaaatggcagacaagccggacatgggggaaatcgccagcttcgataaggccaagctgaagaaaaccgagacgcaggagaagaacaccctgccgaccaaagagaccattgaacaggaaaagaggagtgaaatctcctaaaagcctaggaagatttccccaccccaccccttcatctccaagaaccccctcgtgatgtggaggaagagccacctgcaagatggacgcgagccacaagctgcactgtgaacccggcactccgcgccgatgccaccggcccgtgggtctctgaaggggacccccccactaatcggactgccaaatttcaccggtttgcccagggatattatagaaaattatttgtatgattgatgaaaataaaacacacctcgtggc

SEQ ID NO: 3516 - DNA, 348 bp, Rattus norvegicus
  Genbank Accession No. NM_021264
tatgtctggaaggctgtggtgcaaggccatttttgctggctacaagcgaggcctccggaaccaaagagagcacacggctcttcttaaaattgaaggtgtttatgcccgagatgaaactgagttctacttaggcaagaggtgtgcttatgtgtacaaagcaaaaaacaatacagtgactcctggaggcaaaccaaacaaaaccagagtgatctggggaaaagtaactcgggcccatggaaacagtggcatggttcgtgccaaattccgaagcaaccttcctgcaaaggccattggacacagaatccgtgtgatgctgtacccatcccggatttaaactaatggagagta

SEQ ID NO: 3517 - DNA, 1574 bp, Rattus norvegicus
  Genbank Accession No. NM_021577
tgagtggcgcgcttgctgagtgctgccacatcccgcaagctgagcaggtatcccaactctgttcctgcccggtagaccacccgaggtgtgagtgtggtcttgtcttccagattcgtaggacagaagctccaggaggaggacccgcccaacatggcatcggagagcgggaagctatggggtggccgatttgcaggctcggtcgaccccaccatggacaagttcaactcatctatcgcctatgaccggcatctgtggaatgtggacctgcagggaagcaaggcctacagcaggggcctggagaaggcagggcttctcaccaaagctgagatgcagcagatactgcaaggcctggacaaggtggctgaagagtgggcccaaggcatcttcaaattgtaccctaatgatgaagacatccacacggccaacgagcggcgcctgaaggaactcattggtgaagctgcagggaagttacacacaggcagaagtcgcaatgaccaggtggtcacggacctcaggctgtggatgaggcaaacctactcaaaactctccaccttcctcaaggtgctcattgaagccatggtagaccgggcagaggcggagtgtgaagtcctcttccctgggtacacacacttacagagagctcagcccatccgctggagccactggatcctgagtcacgccgttgcgctgacacgagatttagagagactgaaggaggtgcagaagcggatcaatgtcctgccactgggcagtggggccattgcaggcaaccctctgggtgtggaccgggagttcctctgtgcagaactgaactttggagccattacgctcaacagtatggatgccaccagcgagagagacttcgtggctgagttcctgttttgggcttctctgtgcatgacccatctcagcaggatggcagaagacctgattctctacggtaccaaggaattcaactttgtgcagctctccgatgcctacagcaccggaagcagcttgatgccccagaagaaaaacccagacagcttggagctgatccggagcaaggcgcgccgagtgtttggacggtgcgcaggactcctgatgaccctcaagggacttccaagcacctacaacaaggacttacaggaagacaaggaggctgtgtttgaagtgtctgacaccatgacagctgtcctccaagtagccactggagtcatctctacactgcagattcatcgtgagaacatggcacaggcactcagccctgacatgctggctaccgaccttgcctactacctggtccgcaaagggatgccattccgccaggcccacgaggcctcagggaaagctgtggtcgtggcagagatgaaaggggtggctctcaaccagctgtcacttcaggagctgcagaccgtcagtcccctgttctcgagtgacgtgaatctcgtgtgggactacagccacagcgtggagcagtacacagccttgggtggcacagcacagtccagtgttgagtggcagatcagccaggtgcgggccctgctgcagatgtagcagccctagattccacccagtcaaactgcgccccaata

SEQ ID NO: 3518 - DNA, 1659 bp, Rattus norvegicus
  Genbank Accession No. NM_021585
ctaaatcctctcatttcctgcatgtggttgggaagaggaatcttagaagacgagccccactctgtagcagctcaactaaccatgggcgatgatgacacccctgtgtgcctctctgtcgcctcatgcaagggagtgagttgctggctggacaaactcttactctgggctcttactctgtctatcacacttcgaaacaccgccgtggattgtaggagggtggacagaaatggattgctttctccaaatctgaactcaagtatgagtgtggtcaggatgggccaaaatgtatctctgtcttgttccagcaagaacacatccatagacatcacctattcgctctttttgggtaagagatacctagaaagcaagaggagaagagggggagctgtggatttccacctgaggatctccaatgccaacgagtcaggcccctacaagtgcaaagtcaatgattccaactcgtcgaaatacagtcagaatttcaacttcacaatcatccaggatgagagctgctcttcttgtctactgtcgctgttgctcccaggggtgttattggggctaatactcccaggcctggcctttttgatttatttgaaatacaaaaaagggtgcacaggaaagactctgaaagagaatgagtccaagggttctggagatgcgcccacgcaaggggagctgtatgcgaatatctgtgaaactcaaaaagggtcagaacaactccaggagatacactatactactccagtcttcaaagaggtggcacccacagaacaagaaggccttgaggatagaaaagatgactacatctactctgaactcacctactaaagtgcgaagaaactgactgtatcctaatataagagactttccagtaagctgatgcttacgaagaaacaggaaattcacctggcacttcagagtttcatcctaggctggggcagaaggatcctgagttcaaggccagctggcactacatagcaagaccctgtcttaaaacacaaagatcaaaaaagatttaacctggtcaccgaaagtgaatgtatttttcacatctggacactattattcctttggctaacttgggcatctaatcttgtcaccaaagtagccaggcttgataagggttaaaaaatacttcggttttgtggccttcagccgttctcactttccaacccaattttaaatggaattatcctggggctgcagaagtggctcagcagctaagagcagacactgctctcccaaaggatgggagtttgagcccagagtctacatcccataactcacagttgccaataacattgtttccgaaggatccatcgccctcttctggcacctgcaggcactacactcatgtgcacagacacacctaaacgcataattaagtaagttggggctggagagatggctcagtggttaagagcactgactgctcttccagaggtcctgagttcaatacccagcaaccacatggtggctcacaaacatctataatgggatccgatgccctcttctgctgtgtctgaagacagctatagtgtacttatgtacataaaataaataaatctttaaaataaataaataagtctatgggcataccaccctgtacatgcccaagctcatctagaagtaaataataaaataaaaaagttaatctta

SEQ ID NO: 3519 - DNA, 6244 bp, Rattus norvegicus
  Genbank Accession No. NM_021587
gaggtccatgggcgctcacggtcgtcctcgcccaccctcgcggggtcggcgcccatagcacctcagcagcacccggcgacaccccggctgagccaggggaccctcaccttgagcagcccgcgcccctcccctcctctccaccccagctcccgccccctgctcgcctccgctcccggctggggtccgctgccgctcagccgcccgcaaagctccctccctgcggccacccagttggcctccaccccgcggcgcacaggctctccgcggagtcctcggggataccgagggagtgcgccggggcagggcgagtcgcacggccggagactgcccgcgatggcgggagcctggctcaggtggggactcctgctctgggcagggctgctagcgtggtctgcgcacggccgggtgcggaggatcacgtacgtggtgcgcccgggcccgggactgccggccggaaccctgcctctggctgggcccccgcggaccttcaacgtcgcactggacgccaggtacagccggagctcaacagccacctccagccgctccttggccgggcccccagccgagcggacccggcgcaccagccagcctggcggcgcggccctgcccgggctccgatctccgctgccacccgagcccgcgcgtccgggggcgcccagccggcagctccactcaaaggccggtgctcagaccgcggtcactcgcttcgccaaacatggcaggcaagtcgtgcgctccaaagtgcagcaggacacgcagagctccgggggctccagactgcaggttcagcagaagcagcagctgcaggggatcaatgtctgtggagggcagtgctgccatgggtggagtaaggccccgggctcccagaggtgcaccaaaccaagctgtgttccaccatgccagaatggagggatgtgtctccggcctcagttctgtgtgtgtaagccagggacaaagggcaaagcctgcgagatcacagctgcccaggacaccatgtcaccagtgtttggagggcagaaccctggctcctcgtgggtccctcctgagccagcagcaaagcgtacttcaaccaagaaggcagacaccttaccaagggtcagtccagtggcccagatgaccttgaccctcaagccgaagccgtccatgggactctcccagcagatacattctcaagtggcacccttgtcttcccagaatgtgatgattcggcatggccagacccaggagtatgtgctcaagcccaagtacttcccagccccaaaggtggtctctggagagcagtccacagaaggctctttctctttaagatatgggcaggagcaaggcacagcaccctttcaggtgagtaaccacactggtcgcatcaaggtggtctttactccgagcatctgtaaagtgacctgcaccaagggcaactgtcacaacagctgccagaaggggaataccaccactctcattagtgagaacggccatgcagccgacaccctgacagccacgaacttccgagtggtaatttgccatcttccatgtatgaatggtggccagtgcagttcaagggacaaatgtcagtgccctccaaatttcacaggaaagctttgccagatccctgtccttggtgccagtatgcctaaactctaccagcacgcccagcagccaggcaaggcactggggagtcacgtcatccattccacacataccttgcctctaaccatgaccaaccagcaaggggtcaaagtgaaatttccccccaacatagtcaatatccatgtgaagcatcctcctgaggcttctgtgcagatacaccaggtttccagaattgatggcccagtgggccagagggtgaaagaagtgcaaccgggccagtcccaagtctcttaccaagggctgcccgtccagaagacccagacagtccattccacatactcccaccagcaggtcattccgcatgtgtatcccgtggctgctaagacacaacttggacgatgcttccaggaaaccattgggtcacagtgtggcaaagcgctccctggcctttcaaagcaagaggactgctgtgggacagtggggacctcctggggctttaacaaatgccagaaatgccccaagaagcaatcctatcatggatatactcaaatgatggaatgcctacaaggatataaacgggttaacaacaccttttgtcaagatattaatgaatgtcagctccaaggcgtatgccctaatggggagtgtttgaataccatgggcagctacagatgctcctgcaaaatgggatttgggcctgaccctaccttttcaagttgtgtgccggatccccctatgatctcagaagagaaagggccctgctaccgcctcgtcagtcctgggaggcagtgtatgcaccctctctctgttcacctcaccaagcagatctgctgttgtagtgtgggcaaggcctggggcccacagtgtgagaaatgtcccctcccgggcacagctgcttttaaggaaatctgtcctggtggaatgggttatacggtttctggcattcatagacgcaggccaatccatcagcatataggtaaagaagctgtatttgtcaagccaaagaacactcaacctgttgctaaaagtactcatcctccacctctcccagccaaggaagagcctgtggaggccctgacctcctcgcgggaacatgggccgggagtggcagagcctgaagtggtaacagcacctcctgagaaggaaataccctcactggatcaagagaaaacaagacttgaacctgggcaaccccagctctccccaggggtttcaactattcatctgcacccacagttcccagtagtggttgaaaagacatcccctcctgtgcctgtggaggtggctcctgaaggttctacatcaagtgccagccaagtgattgctcctacgcaagtaacagaaatcaacgaatgtactgtgaacccggatatttgcggagcaggacactgcatcaacctgccggtgaggtatacctgcatatgctacgagggctacaagttcagtgagcagcagaggaagtgcattgacattgatgaatgtgctcaggcccagcatctctgctcccagggtcgctgtgagaacacagagggaagtttcctgtgtatttgcccagcagggtttatagccagtgaggagggttctaactgtatagatgtggatgaatgtctgaggcccgatgtgtgtagggacggccgctgcatcaacactgctggggccttccgatgcgaatactgtgacagtgggtaccggatgtcacgacggggccactgtgaggatatcgatgagtgtctgaccccaagtacctgtcccgaggaacaatgcgtgaattccccaggttcttaccagtgtgtgccctgcacagaagggttccgtggctggaatggacaatgcctcgatgtggacgagtgcctgcagccaaaggtctgtaccaatggttcctgcaccaacctggaaggctcctacatgtgttcctgccacaagggctacagccccacaccagaccatagacactgtcaagatattgatgaatgtcagcaagggaacctgtgcatgaacgggcagtgcaaaaacactgacggctccttccggtgtacctgtgggcagggctatcagctgtcagcggctaaagaccaatgtgaagatattgacgaatgcgagcaccgtcacctctgctctcacgggcagtgcaggaacacagagggctccttccagtgtttgtgcaaccagggttacagagcatctgtgcttggagaccactgcgaggatatcaatgaatgcttggaggacagtagtgtctgccagggaggtgactgcatcaatacagcagggtcctatgactgcacgtgcccggatggactccagctgaatgacaataagggctgtcaagacattaatgaatgtgcacagccaggactctgtgcacctcatggggagtgtctaaacacacaaggctcattccactgtgtctgtgaacaagggttctccatctctgcagatggtcgtacttgtgaagatattgatgagtgtgttaacaacactgtgtgtgacagtcacggcttctgtgacaacacagccggctctttccgctgcctctgttatcagggctttcaagccccacaggatgggcaagggtgtgtggatgtgaacgaatgtgaactgctcagtggtgtatgtggggaggctttctgtgaaaatgtggaagggtccttcctgtgcgtgtgtgccgatgagaaccaggagtacagccccatgactgggcagtgtcgctcccgggctactgaagattcaggtgtggatcgtcagcccaaagaagaaaagaaggagtgttattataatctcaatgatgccagtctctgtgataacgtgctggcccccaacgtcaccaaacaagagtgctgctgtacatcgggcgccggctggggagacaattgtgagatcttcccttgcccagtccaggggactgctgagttctcggaaatgtgccctagaggaaaaggttttgtccctgctggagaatcctcttacgaaaccggtggtgagaactacaaagatgctgacgaatgcctgctgtttggagaggaaatctgcaaaaacggttactgtttgaacactcagcctgggtatgaatgctactgcaaggaagggacatactacgatcctgtcaaattacagtgttttgatatggatgaatgccaagaccctaacagttgtatcgatggccagtgtgttaatacagagggctcttacaactgcttttgcacccacccaatggtcctggatgcctctgagaagagatgtgtgcagccaactgaatcaaatgaacaaatagaagaaaccgatgtctatcaagatctgtgctgggagcatctgagtgaggagtacgtgtgtagccgtcctcttgtaggcaagcagacgacatacacagagtgctgctgtttgtacggggaggcatggggcatgcagtgtgctctctgccccatgaaggactcagatgactatgcccagctgtgcaacatccctgtgacaggacggcggcgaccatatggacgggatgcgttggtggacttcagtgaacagtatggcccagaaacagacccttacttcattcaggatcgctttctaaacagctttgaggagctacaggctgaggaatgtggcatcctcaacggctgtgaaaatggccgctgtgtaagggttcaggaaggttatacttgcgattgctttgatggatatcatctggatatggccaagatgacctgtgttgatgtaaatgaatgcagcgagctgaataatcggatgtctctctgcaagaacgccaagtgcattaacacagaaggctcctacaaatgcgtgtgtctaccaggctacgtaccatctgacaagcccaactactgtacaccactgaacaccgctttgaatttagacaaagacagtgacctggagtgaaggagaagctacgtaacctatgcccatatactctgcactgtgtaaaggaaaagggagagaggtatacttgagacactgcacctaatccagaccatggcaaagaaggaaacaacgtggagttgcgtgaacccccaaagaaagtgagcggatggagtagcagcctgagaggtgcgacagaccaaatggacatttcctcaaaaacccagtatatatagtctgttcatatgtaaaattcaatggaaaagaggcaggatgcggctgtcattttaaacagaggttgtattattatcttgttttgatttttttttttactattgcttaaatttggcttttaaatagtggtgacgatgttttatatgagtcttctctgtgctgtgcagatccccagccaccattttttcttcagcgataatctcaagtgcaaacatctttgataacgtattgttaaactgtattataagtatgacacagggttgtgctgtcccttggtccggagactttgaaaaacaaattgtctgtcctgtggagcaggcagtgactgttaaacttttatctacatttagagtgggtgggaaaacacctttattttcaatgtattatcggattgcctgtcaattggatcccttacttgggtggaaatggaggagtttcttagcatttattagcactgtgttgtgtaaagtcaacccagaaaaatttaaaaacctgaaatccccccctcaaaatatttaccattgtatgttataagaaaataaaatcgccatttttgtag

SEQ ID NO: 3520 - DNA, 663 bp, Rattus norvegicus
  Genbank Accession No. NM_021592
ctctccaacatgaacctcgtgggcagctacgcacaccatcaccaccatcaccactcacacccgccgcaccccatgctgcacgaacccttcctctttggtccggcctcgcgttgccaccaggagcgcccttacttccagagctggctgctgagcccggctgatgctgccccagatttccctgccggcgggccaccacctaccaccgcagtagcagcggctgcctatggtcccgatgccaggccgagtcagagcccaggtcggctggaggctcttggaggccgcctgcccaggcgaaaaggttcaggacccaaaaaggagcggaggcgcacagagagcattaacagtgcgttcgcggagctgcgtgagtgcatccccaatgtgcctgcggacaccaagctctccaagatcaagactctgcgcctggccaccagctacatcgcctacttgatggacgtgctggccaaggatgcacaagcaggtgaccccgaggccttcaaggctgaactaaaaaagacggatggcggtcgcgaaagcaagcggaaaagggagtcgcctcagcagcacgaaggccttcctcctgccctggggccaagcgagaagaggattaaaggacgcactggctggcctcagcaagtctgggcgctggagctaaaccagtgagac

SEQ ID NO: 3521 - DNA, 1492 bp, Rattus norvegicus
  Genbank Accession No. NM_021594
cggctcggagagaaaggtcgtgagtccgcagcctccgacgggaccggttctgagccttcgcagagcaagatgagcgcggacgcagcggccggggagcctctgccccggctctgctgcctcgagaagggtccgaacggctacggcttccacctgcacggggagaaaggcaaggtgggccagtttattcggctagtggagcctggctcgccggccgagaagtcggggttgctggccggggaccgattggtggaggtgaacggtgagaatgtggagaaggagacgcatcagcaggtggtgagccgcatccgcgcggcgctgaacgccgtgcgcctgctggtggtcgaccctgagaccgacgagcaactcaagaagctgggcgtcccgatccgggaagagctgctgcgcgcccaggagaagtccgagcacaccgagccgccagcggccgccgacactaagaaggctggggaccagaatgaggccgaaaagagccacttggagcggtgtgagctccgaccccggctctgcaccatgaagaaaggccccaatggttatggcttcaacctgcacagtgacaaatccaagccaggccagttcatccgagcagtggacccggactcaccagcagaggcgtctggcctccgggcccaggaccggattgtggaggtcaatggcgtctgcatggagggcaaacagcacggggacgtcgtgtctgccatcaaggctggaggtgatgaagccaagctgctggtggtagacaaggaaacagatgagttctttaagaagtgcagagtgaccccgtcccaggagcacctggatggccccttgcctgaacccttcagcaatggagagatacagaaggagaacagccgtgaagccctggtagagccagcttcagaaagccccaggccagccctggcaagatctgcctccagcgataccagtgaggagctaaatgcccaagatagtcccaagagacacgattccacagagccctcatctacctcctcctcctctgaccccatcttggacttcaacatctccctggctgtggctaaagagagggcccaccagaagcgcagtagcaagcgggccccgcagatggactggagcaagaaaaatgaactcttcagcaacctctgagcattccgcctccgctgttttgtgctggagggtggggctgcccacccgacctagctccccttttcttctcccaggtgcccaccaatcaacattcaaatcagcatcagcacccaccccacttcccgacaaatctgattttcctacaattctgtccttccctcatcctagggaaggagaatgtcctgactccctgctcttcccctaagggcttcttcctaccaaagtgtcccttcaccagtccgccaaggacaccactgggaccctcactaagcaaggacctttggaccagacaagaagtctcccctcggcaatgtgtgataaccaagtccaaggtttaccaagggctgtctat

SEQ ID NO: 3522 - DNA, 2106 bp, Rattus norvegicus
  Genbank Accession No. NM_021653
gctgagatggggctgtcccagctatggctgtggctgaagcggcttgtgatattcctgcaggtagccttggaggtggctacgggcaaggtgctaatgacactgttcccagagagagtcaagcagaacatcctggccatgggccaaaagaccggaatgaccaggaatccccgattcgcccctgacaactgggtccccaccttcttcagcatccagtacttctggttcgtcctgaaggtccgctggcagagactggaagacagggctgagtatggggggctggcccccaactgcaccgtggtccgcctctcaggacagaagtgcaacgtctgggatttcattcaaggcagcagacccctggtgttgaacttcggcagctgcacctgaccttcatttcttctcaaatttgaccagttcaagagactcgtagacgactttgcctccacagctgacttcctcatcatttacattgaagaagctcacgccacagatggatgggcttttaagaacaacgtggacatcaggcagcaccgaagcctccaggaccgcctgcgggcagcacatctgctgctggccaggagcccccagtgtcctgtggtggtggacacaatgcagaaccagagcagccagctctatgcagctctgcctgagaggctctatgtgatacaggaaggcaggatctgctacaagggtaaacctggcccttggaactacaatcctgaggaagtccgagctgttctggaaaagctttgcatcccacctggacacatgcctcagttctagggggccagcaggaaggtcccccaagcttggtactcctccccaccagtacagatgtcctttagctttgaccttcgttcccagatcaattactagctcagatttttctgatctgaacaaataactacccgggaggcaattcagttcacagcacccaaccagcacaaattgttacaaccagagataaagcaataccgagctgttagcaaaagtaagtgtgcagctttgcaccactcccacaggcggagaccaatccagtgtgtgccccttctggtggaagggtactcatgcttggttggctgacttctgaagtgtagtgactcatgatgatgacgtcaaaagctcaatccatttgcccaagtttgccactcatagaatcagttgtttagtaccaagcgacaggcaggcgtatttctacttgtaggaaccaaagacattggaaacacttttctggccctaagattgaaatccgttaatattgttggtgataggtgtttccatggcaacctataatctaattctgctccctctaccatctttgaatagattgcagagaaatctggctctctggtactgacacaaaagctttataactttaactaaaccaaatcacaggcgccagcaaaagctgccattcccctgctgtaactctgttccactggcgcccagtctcttactggtctttcatgttagatggctttggactgacgggtagccatgggttcatctgtcatgtctgcttctttttatatttgtttatgatggtcacagtgtaaagttcacacagctgtgacttgatttttaaaaatgtcgggaagatgcagcaagctaacgattaaaatccgtcaggctatttttgaatggctccggtgtgatccttacaatttcctttctgacttgtgtatgtgggcctgctctgccgtcttttccgatagcccacgtgtaatgtaatcagctaaggcatcgtttgcctggagggaccccgtcctggaggaagaagctcgtatgtggcacgcatccaacatgttgtcctgtgaagtgttgtggaagggacgtggctgttcacgtcacagcaaagcacctttaggggtgatgcgtgaatggacctggggagcattctccaggcatccaaacagttcctccttgctctgccttagggctacacccaatactgtaacattgcatttatgtatggatttaggtgagtcaggatctagctataaagtcgagagtggctgtgaacttacaatcttcagactcagagtagctgggattccaggtctgtccccctatataaaaaatgcttttgacctcttgaaaaaaaaaaaa

SEQ ID NO: 3523 - DNA, 651 bp, Rattus norvegicus
  Genbank Accession No. NM_021661
atgcccaccccacatgaggctgagaaacagcacacagggccagaagaggcagacaggcctccctcgatgtccagccatgatgcagccccctcaggacctcccagtcgaaatccctgctgcttgtgctggtgctgctgctgtagctgttcctggaaccaagaacggcaacgagcttggcaggtttcccgggaaagcaagctgcaacccctccccagctgtgaagtctgcactccaccaagccctgaggaagtacagagctgggcacagtcctttgacaagttgatgcatagccccacgggccgcagtgtattccgggcattcctgcgcacagaatacagtgaggagaacatgctcttctggctggcttgtgaggagttgaaaacagaggctgaccgacatgtggtggatgagaaggcgcgacttatctatgaggactacgtgtccatcctgtcccccaaggaggtcagcctggactcccgtgttcgagaaggcatcaataggaagatgcaagaaccatcaccacacacattcgacgacgcacagctgcagatctacaccctcatgcaccgggactcctaccctcgcttcctcacctcccccacctaccgctctctgttactccagggggccccacagtcctctgaggcctag

SEQ ID NO: 3524 - DNA, 1265 bp, Rattus norvegicus
  Genbank Accession No. NM_021680
cgtcgccctcagccgggcgccccttgccctgtgcccagaccggcccgccccgggacccgccctgccggacccgcttggccgcccgggaagatgcggctgctcccggaatggctcctcttgctctttggtccttggctccttaggaaggttatcagtggccagatcgtggaatccgggaggccacagtacctggacctgcgtcccgccatggccggagggggcgcccgcggccagcagctcccggtgcccgcttcttccgagggcctgaaccccgtgcgctcctggagctgggcttggccagctaaccacaccggggcgctggccaggccgggggcagccggtggcccgcccgtgccgcgcaccaagagaaagccatccattaaagcggcccgcgccaagaagattttcggctggggggacttttactttcgtgtacataccctcaagttctcgctgctggtgaccggcaagattgtggaccatgtgaacggtaccttcagtgtgtacttccgtcacaattcgtccagcctgggtaacctaagtgtcagtatcgtgccgccttccaagcgtgtggagttcgggggcgtctggctgcctgggcctgccccccaccctctacagtctacgctggcattagaaggggtgcttcccggactggggccccctctggggatggcggggcaggggctggggggtaaccttgggggtgcacttgccggcccactcggaggcgcgctgggagttcctggggccaaagagtcgcgcgcttttaattgccacgtagaatatgagaagacaaaccgcgctcgcaagcaccgcccgtgcctgtacgacccgtcgcaggtgtgcttcaccgagcacacgcagagtcaggccgcttggctctgcgccaagcccttcaaagtcatctgtatcttcgtctccttcctcagttttgactacaaactggtgcagaaggtgtgcccagactataacttccagagtgagcacccctactttggataacgcccccgtcctgggcccagagtttcccaccagatctcagtctcactaggtgggaccctccctgtataccccatgctcctgtgactgcccccacgtcttccactatgggtgaggtggagaacaacagccttcccccgggactatcagccagtgtggccctccatttccttgtggtactgagtgtccctaagactcaaatgtcttcgtggcaggaggagagctcctggctagactcctgcacctgaacatgactggttgtc

SEQ ID NO: 3525 - DNA, 2572 bp, Rattus norvegicus
  Genbank Accession No. NM_021699
ggcacgagcgttccctcccctgagataccggcgccatgtccagcgctcggacccccctacccacgctgaacgaaagggacacggagcagcccaccttgggacaccttgattccaagcccagcagtaagtccaacatgctgcggggccgcaactcagccacctctgctgacgagcagccccatattggcaactacagactccttaagaccattggcaagggtaactttgccaaagtgaagttggcccggcacatcctgacggggaaagaggtagctgtgaagatcattgacaagactcagctgaattcctccagcctgcagaaactcttccgagaagtaagaataatgaaggttttgaatcatcccaacatagttaagttatttgaagtgatcgagactgagaagacgctctaccttgtcatggagtatgccagtggcggagaggtatttgattacctagtggcccatggcaggatgaaagaaaaagaagctcgagccaaatttcgccagatagtgtctgctgtgcagtactgtcaccagaagtttattgttcatagagatctaaaggcagaaaacctgctcctggatgctgatatgaacatcaagattgcagactttggctttagtaacgaattcacctttgggaacaagctggatactttctgtggtagtcctccttatgctgccccagaactcttccagggcaaaaagtatgacggtcctgaagtggatgtctggagcctgggcgtcatcctctatacactggtcagcgggtccctgccttttgatggacagaacctcaaggagctacgggaaagggtactgagggggaaataccgtattccattctacatgtccacggactgtgaaaatctgcttaagaaatttctcatacttaatcctagtaagagaggcactttggagcaaattatgaaagatcggtggatgaatgtgggccatgaggatgacgagctaaagccttacgtggagccactccctgactacaaggatccccggcggacagagttgatggtgtcaatgggttacacacgggaagagatccaggactcgctggtaggccagaggtacaacgaagtgatggctacctatctgctccttggctacaagagctctgagctggaaggtgacaccatcactttaaagccccggccttcagctgatctaaccaacagcagtgccccatctccatcccacaaagttcagcgcagcgtctctgccaaccccaagcagcggcgctccagtgaccaggccgtccccgccattcccacctcgaattcctactctaagaagactcagagtaacaacgcagaaaataagcggcctgaggaagagacagggcggaaagccagcagcaccgccaaagtgcctgccagccctctgcctggcctggacaggaagaagaccactcctaccccctccacaaacagcgtcctctccaccagcacaaacagaagcaggaactccccacttttggacagggccagccttggccaggcctccatccagaatggtaaagacagcacagccccccagcgtgtccctgtcgcctccccctccgcccacaacatcagcagcagtagtggagccccagaccgaactaatttcccacggggtgtgtccagtcgaagcaccttccatgctgggcagctccgacaggtgcgggaccagcagaatctgcccttcggtgtgaccccagcctcaccctctggccatagccagggccggcggggggcctctggcagcatcttcagcaagttcacctccaagtttgtccgcaggaacctgaatgaacctgaaagcaaagaccgagtggagacgctcagacctcacgtggtaggcggtggaggcactgacaaggaaaaggaagaatttcgggaggccaagcctcgttccctgcgcttcacttggagcatgaagaccacgagctctatggagcccaatgagatgatgcgggagatccgcaaggtgctggacgccaacagctgccaaagcgagctgcacgagcgatacatgctgctgtgcgtgcatggcacacccggccacgagaactttgtgcagtgggagatggaggtgtgcaaactgccccggctgtctctcaacggtgttcggtttaagcggatatcgggcacttccatggccttcaaaaacattgcctccaaaatagccaatgagctgaagctttaacaggctgtcaggaggggcggcagaggcccaccagtggacttggctgcttgggccaaacctgcatcccctgggagaaaaactgcaggatgaattggtgtgtctcccctgctggcacttgtccccttccaggcccttctcagttttttcttccatgtttgtgggggatgggaagtggtggttcctcctcccacattcacccctgcccagaagtctctcccttcccctctacccccgtacaggaggcaaaggaaggggaaggggttgggggggcagggctccccctcggtactgcggttgcacagagtatttcgcctaaaccaagaaaatttttattaccaaaaagaaaaaaagaaaaaaaaactcgtgcc

SEQ ID NO: 3526 - DNA, 1182 bp, Rattus norvegicus
  Genbank Accession No. NM_021740
gttcccgggtcgtgctccgcgctcactgcagccaccttcgccgcccaccgtctcctccaacgcggactccggcagctttctcgccagagtcctcgaaactcgactaattccttacgcgtacgaccagaccaccggcgtgccccaccatgtcagacgcggcagtggacaccagctccgagatcaccaccaaggacttgaaggagaagaaggaagttgtggaggaggcagagaatggaagagacgcacctgccaatgggaacgctcaaaatgaggaaaatggggagcaggaggctgacaatgaggtagatgaagaagaggaagaaggtggggaggaagaggaggaggaggaagaaggtgatggtgaggaagaagatggagatgaagatgaggaagctgaggctcctacgggcaagcgggtagctgaggatgatgaggatgatgatgttgagaccaagaagcagaagaagactgatgaggatgactagacagcaaaaggaaaagctaaccttacgcaccgtgacctattcaccctccacttcccgtctcagaatttaaacgtggtcaccttcgagtagagaagcaggcccccgcccgcccactgcgcgagtgccacccaccaatgacatgcgctcttcaccaccccaccaaaaccacaacatgaattggcaacatgggaggagaaaagaaccagaacttcccaggccctgctttttttcttaaaaatactttaaaaggaaaatttgtttgtattttttatttacattttatatttttgtacatattgttaggggtcagccatttttaatgataacgggtgaccaaaccagccttcagagcgttttctgtcctacttcagactttacttgtggtgtgaccatgttcattatactctcaaaggagaaaaaaaaccttgtaaaaaaaacaaaaacaacaacaaaaaaacaatcttattctgagcattccagtaactttttttgtgtatgtacctagctgtactataagtagttggtttgtatgagatggttaaaaaggccaaagataaaaagattttttttcctttttttttgtctatgaagttgctgtttatttttttggcctgtttgatgtatgtgtgaaacaatgtccaacaataaaccggaattttattttgctgagttgttccaaaaaaaaaaaaaggaatcc

SEQ ID NO: 3527 - DNA, 1931 bp, Rattus norvegicus
  Genbank Accession No. NM_021742
cccaggtcacaaaatatgacaggctgcaaccttccccacgttcaatgatttctgcagtaagccaaaggactgccaataatttcgctaagaatgtctgctagttcgattactggggattttcaagactttcttaagcatggacttccagctattgcacctgcaccaggatcagagactccacactcccccaaacttgaggaaaaacaccgggaaaaacgtgctgggcttccggaccgacaccgacggcccattcccgcccgcagccgccttgtcatgctgcccaaagtggagacggaagcctcaggactggtccgatcgcatggggaacaggggcagatgccggaaaacatgcaagtgtctcaatttaaaatggtgaattactcctatgatgaagatctggaagagctgtgtcctgtgtgtggcgataaagtatctgggtatcattacggtctcctcacctgtgaaagctgcaagggtttctttaagcgaacagtccaaaaccagaaaaggtacacgtgcatagagaaccagaactgccaaattgacaagacacagagaaaacgatgtccttactgtcggttcaaaaaatgtatcgacgttggaatgaagctggaggccgtgagagctgaccgcatgcgaggaggcagaaataagttcgggccaatgtacaagagagacagggccttgaaacagcagaagaaagccctcattcgagccaatggacttaagctggaagccatgtctcaggtgatccaagcgatgccctcagacctgacctctgcaattcagaacattcattctgcctccaaaggcctacctctgagccatgtagccttgcctccgacagactatgacagaagtccctttgtcacttctcccattagcatgacaatgccacctcatggcagtctgcatggttaccaaccatatggtcactttcctaatcgggccatcaagtctgagtacccagacccctactccagctcgccagagtcaatgatgggctactcctacatggatggttaccagacaagctccccggcaagcatccctcatctgatattggaacttttgaagtgtgaacccgatgagcctcaagttcaagcgaaaatcatggcttacctacagcaagagcagaataaccggaacaggcaggaaaagctgagcgcgtttgggctcttgtgcaaaatggcggaccagaccctgttctccattgttgagtgggccaggagtagtatcttcttcagggaactgaaggttgatgaccaaatgaagctgcttcagaactgctggagtgagctcttgatcctggatcacatttaccggcaagtagcacatgggaaggaagggacaatcttcctggttaccggagaacacgtggactactccagcatcatctcaaacacagaagtcgcattcaacaacctcctgagcctcgcccaggagctcgtggtgagactccgttcccttcagtttgatcagcgggagtttgtgtgtctgaagttcctggtgctgttcagctcagatgtcaagaatcttgagaacttccagctggtggaaggcgtccaagagcaggtcaatgctgccctgctggactacacactttgcaactacccacaacaaactgagaaatttggacaactgcttcttcgactaccagaaatccgggcaatcagcaaacaggcagaagactacctgtactacaagcacgtgaatggggatgtgccctacaataaccttctcattgaaatgctgcacgccaaaagagcctaagttcccacccctagacccttgctctagggacagagactggagggagaagaagaggaggaggaggaaggaagacaaacaatgctctgaactgctccaagcaatgctaattacaaacttggtttaaagacactgaattttgaaagcataataatgaatag

SEQ ID NO: 3528 - DNA, 1591 bp, Rattus norvegicus
  Genbank Accession No. NM_021744
ggaaagaaactgaagcctttctcggagcctgtctgggctgctcccactctcagaatctaccgaccatgaagcttatgctcggcttgttgctgttgcctttgacactggtgcatgcctctcccgccacaccagaaccctgtgagctggaccaggacgaggaaagtgtccgctgctactgcaacttctcagatccgcagcccaattggtccagcgcttttctatgcgcgggggcggaagacgtggagttctacggcggcggtcgcagcctggagtaccttctaaagcgtgtggacacggaagcaaatctggggcagtacactgatattatcaggtctctgcccttgaagaggcttactgtgcggtccgcgcgggttcctactcagattctattcggaaccctgcgtgtgctcggatattctggcctccgggaactgactcttgaaaacctcgaggtaaccggcaccgcgctttcgccgcttctggatgccaccggacccgatctcaacaccttgagcctccgcaacgtgtcgtgggcaacaacggatacctggctcgcagaactgcagcagtggctaaagcctggactcaaggtactaagtattgcccaagcacactcactcaacttttcttgcaaacaggtcggcgtcttccctgcccttgccaccttagatctgtctgacaaccctgagttgggcgagaaaggactgatctcggccctctgtccgcacaaattcccgaccctccaagttttagcgctgcgcaacgcggggatggagacgaccagcggcgtgtgctctgcgctggccgcagcaagagtgccactgcaggcactggatctcagtcacaattcactgcgggatactgctggcactccgagctgtgactggcccagtcagctaaactcgctcaatctatctttcactgggctggagcacgtacctaaagggctgccagccaagcttagcgtgcttgatctcagttacaacaggctggataggaaacctaggccagaggagctgcctgaagtggggagcctgtcacttacaggaaatccctttttgcactctgaatcccagtcggaggcgtataactctggcgtagtcatagccacagctctttcacccggatcagcgggcttgtcaggaactttggctttgctcctaggacatcgcctctttgtttaaggaacgtttgcatcttcctggtttctgagggtcctggtcaacaaatcctctgctttaaatttattaaaatcttaatccacaatgtaaggaaggacaatcaagatggctcaatgggtaaaagccaccaagcttgactcctgattttgatcctcgggatccacaccaaaggaaagaactctctcctgaaagttgtccatcggtgctcacaaataaatatatttttttttccggagctgaggaccgaacccagggccttgcgctcactaggcaagcgctctaccactgagctaaatccccaaccccacaaataaatatttttaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3529 - DNA, 2070 bp, Rattus norvegicus
  Genbank Accession No. NM_021745
ctgagttctgagcgtctacagcgaaagtgctgggctttggaaaggagacctgggctccgaatcctctcagggccttggacgtctctgacccaaaacaatccaaggttcttatttgaagaccaccatcccagaagcacattctcgagttgaaaagttggagtggtgttcgaaatgaatctgattgggccctcccatttacaagccacggacgagtttgctctttctgaaaacttatttggagtgctaacagagcacgcggcaggtcctctggggcagaatctggacttggaatcgtactccccatacaacaatgtgcagtttcctcaagttcagccacagatctcctcctcgtcctattattccaacctgggtttctacccgcaacaaccggaagactggtactctcctggactctatgaactcaggcgaatgcccactgagagtgtgtaccagggagagactgaggtatccgagatgcctgtgacaaagaagccgcgaatggccgcctcatcggcgggaagaataaaaggggatgagctgtgtgtggtctgcggagacagggcctctgggtaccattacaacgcgctcacctgcgagggctgcaaaggtttcttccgaagaagcatcaccaaaaacgccgtgtacaagtgtaagaacgggggcaactgcgtgatggatatgtacatgcgtcggaagtgccaggattgccggctaaggaagtgcagagagatgggaatgttggctgaatgtttgttaactgaaattcagtgtaaatctaaacggctaaggaaaaatgtgaagcagcatgcggatcagacagtgaatgaggacagcgaagggcgtgacttgcggcaagtgacctccacgaccaagctatgcagggagaaaactgaactcactgtagaccagcagaccctcctggattatattatggactcatacagcaaacagagaatgccacaggagatcacaaataaaatcttaaaagaagaatttagtgcagaagaaaattttctcatattaacagaaatggctaccagtcacgtacagattctcgtagaattcacaaaaagacttccagggtttcagacactggaccacgaagaccagattgctttgctcaaagggtccgcagtcgaggccatgttccttcgttcagcggagattttcaataagaaacttcctgccggacacgcagacctgttggaagaaagaattcgaaagagcggcatctccgatgagtacataaccccgatgtttagtttctataaaagtgtcggggagctgaaaatgacccaggaagagtacgctctgctcacagcaattgtcatcctctctccagacagacaatacataaaggatagagaggcagtggagaagcttcaggagcctctgctcgatgtcctacaaaaactctgcaagatctaccagcccgagaaccctcagcatttcgcctgcctcctgggtcgcctgacagaactccggacattcaaccatcaccacgctgagatgctgatgtcttggagggtgaatgaccacaagttcaccccgctcctctgtgagatctgggatgtgcagtgaaggacacggggagaggctagctccttgtcctcctcagagcagcaacctggtattggacttcccttcttttcatttgtaccaggtctcactcaagaatctcaatgaatatttatgtggcaattatacaattcccacaactgtaaatacaggctccatagaattgcttcccctacactgtattttacaaggcttcgggaaaccccactgacacgccctttttgcctcattaaatcaattgttacttcaattttgtcaactgagctagggaccgcctcgttttatcctccatgcggcaacattatatatatatatattttatcaaatagctgttttctcttccttttttttttttttttttttcggagctggggactgaacccagggccttgcgcttgctaggcaagcgctctaccactgagctaaatccccaacccctattaaatagctgttttcaactgagacaataaactgaacgtaatgccaagagaa

SEQ ID NO: 3530 - DNA, 2413 bp, Rattus norvegicus
  Genbank Accession No. NM_021750
cttccgggctcgggagccgcgacaggagggggcctctgaaaagggtcctgttctgagaagtccattgtgtaccttgtcaccagcgcgtctgaaccctctctgaaccttcctgaagctggaagatttcaccctgatggctgactcaaaaccactcagaaccctggatggggaccctgtggctgtggaggctttgctccgggacgtgtttgggattgtcgtagatgaggccattcggaaggggaccaatgcctctgagaaggtctgcgaatggaaggagcctgaagagctcaagcagctgctggacttggagctgcagagccagggcgagtctagggagcggatcctggagcgctgccgggctgtgattcattacagtgtcaagactggtcacccccggttcttcaaccagctcttctcaggattagatccccatgctctggccgggcgcatcattacggagagcctcaataccagccagtacacatatgagattgcccccgtgtttgtgctcatggaagaggaggtgctgaagaaactccgtgcccttgtgggctggaacactggggatggggtcttctgtcctggtggttccatctctaacatgtacgccataaacctggcccgctttcagcgctacccagactgcaagcagaggggcctccgggccctgccacccttggccctcttcacttcaaaggagtgccactactccatcaccaagggagctgcttttctgggacttggcaccgacagtgtccgagtggtcaaggctgatgagagagggaagatgatccctgaggatctggagaggcagatcagtctggcagaggctgagggctcggtgccatttctggtcagtgccacctctggtaccaccgtgctaggggcctttgaccccctggatgcaattgccgatgtttgccagcgtcacgggctgtggttacacgtggatgccgcctggggtgggagcgtcctgctgtcccggacacacaggcatctcctggatgggatccagagggctgactccgtggcctggaaccctcacaagcttctcgccgcggggctgcagtgctctgctcttcttctccgggacacctcgaacctgctcaagcgctgccacgggtcccaggccagctacctcttccagcaagacaagttctacaacgtggctctggacaccggagacaaggtggtgcagtgtggccgccgcgtggactgtctgaagctgtggctcatgtggaaggcgcagggtgggcaagggctggagtggcgcatcgaccaggcctttgctctcactcggtacttggtggaggagataaaaaagcgggaaggatttgagttggtcatggagcccgagttcgtcaacgtgtgcttctggtttgtgcctcccagcctgcgggggaagaaggagagcccagattacagccagaggctgtctcaggtggcccctgtgctcaaggagcgcatggtgaagaagggaaccatgatgatcggctaccagccccatgggacccgggccaacttcttccgaatggtggtggccaaccccatactggtccaggccgatatagacttccttctgggcgagctggagcgtctgggccaggacctgtgagctgcttcctctctctgccccacccaagctctgcataagctcctgggttcccaaaagcgacctttctaggaaacagtggccttgactgtgtgagcccccacacactaactctcctagctaagtattggctgccaggacggtgtctaagcacactacagtctgttcttacgaaatgtgcttcttttaagtcggtcatagtggtacacaccgttaataccagcactggggaggcagaggcagacacaagcagatctcttgagtttgacgccagcccggtctacagagctggcctacacagaaaaaaaacctgtcccaaaaaaaaagaaaggaaggaagtaagaaaggaaaagaaagaaatatttttcattaagattatgtctataaaaaattgttattaatatgagagatatggtacgatgtattaagaaagctagatatgggggttggggatttagctcagtggtagagcccttgcctaggaagcgcaaggccctgggttcagtccccagctccgaaaaaaagaaccacaaaaaaaaaaaaaaaaaaaaaaaaaagaaagctagatatgagtttatatatcatggtatctgagttagactaaaaaaaaaaaatacataggaaaaggcggtgagtggaactgtgccaaaggtcagcagttttccctggaggaggataacaggctgttcctaagtcagcctctcagaccttccctgcttccccactttattatgtaaccacatcacctacttctgagatataacaataaagctttgtcactataaaaaaaaaaaaaaaaaa

SEQ ID NO: 3531 - DNA, 1980 bp, Rattus norvegicus
  Genbank Accession No. NM_021754
ggcacgagggaacgtctaggcaacgtggtctccccgcccgcgggtaggcaaaggcgtttgcgcttcccagcgtctgaggcctagggagccttcagtagccgaaagttagtcttttgcagtggagtaagggctcgcggttagccgcgtagcgcccggatctggcctcaccatgttggtcctatttgaaacgtccgttggctacgccatctttaaggttctgaatgagaagaaacttcaagaggttgatagtttgtggaaagaatttgaaactccagagaaagcaaataaaatagtaaagctaaaacattttgagaaatttcaggatacagcagaagcattagcagcgttcacagctctgatggaaggcaagatcaataagcagctgaaaaaagttttgaagaaaatagtcaaagaagcccatgaacctctggctgtagctgatgctaagctaggaggggtcataaaggaaaaattgaatctcagctgtatccatagtcctgttgttaatgaacttatgagaggaatacgatcacaaatggatggcttgattcctggggtagaaccacgggagatggcagccatgtgtcttggactagcccacagcctatctcgatacagattgaaattcagtgctgataaagtagacacaatgatcgttcaggcaatttccttgttagatgacttggataaagaactaaacaactacattatgcggtgtagggaatggtatggctggcattttcctgagttagggaaaattatttcagataatttgacatactgcaagtgtttacagaaagttggagacaggaagaactatgcatctgccactctttctgaattcctgtcagaggaagtagaagctgaagtgaaagcagctgcagagatctctatgggaacagaggtttctgaagaagatatttgcaacattctacatctgtgtactcaggtcattgaaatttctgaatatagaactcagctgtatgaatatctgcaaaaccgaatgatggccattgcacccaatgttacagtcatggttggggagttggttggagcgcggcttattgctcatgcaggttctcttttgaatttggccaagcatgcagcttctacagttcagattctgggagcagaaaaggcacttttcagggccctcaaatctagacgagacacacctaaatatgggcttatttatcatgcttctcttgtaggccagacgagtcccaaacacaaaggaaagatttcacgaatgctggcggccaaaactgtgttggctatcagatacgacgcctttggtgaagattccagctctgcaatgggagctgagaacagagccaaattagaggccagattgaggattttggaggacagagggataagaaaaataagtggaacgggaaaggcattagcaaaagcagaaaagtatgaacacaaaagtgaagtgaagacttacgatccctctggtgactccacacttccaacttgttctaaaaaacgcaaaatagaagaggttgataaagaggatgaaattactgaaaagaaagcaaaaaaagccaagattaaaattaaagctgaagtagaggaggagatggaggaggcggaggaagaacaggtagtagaagaggagccgactgtaaagaagaaaaagaagaaggataaaaagaaacacataaaggaagagccactttccgaggaggagccatgcaccagcacagcagttcctagtccagagaaaaagaagaaaaagaaaaaaaagaaagatgctgaagactaatgtaaaggaaccgtaatcctgtcacctgaacacatcatgcttaagattcagttgggagcatatcagacgctctaacataatcaagggaggttgattagctttagcttttcaaacctttttgtgtcttgacatcaactgttaaccttagagtctttgatacacaaataaaaatattttctttgtattataaaaaaaaaaaaaaaaaa

SEQ ID NO: 3532 - DNA, 1545 bp, Rattus norvegicus
  Genbank Accession No. NM_021757
atggtggaggaggtacagaagcattctgtgcacacactagtgttcaggtcattgaagaggacccatgacatgtttgtggctgataatggaaaacctgtgcctttggatgaagagagtcacaagcggaaaatggcaatcaagcttcgtaatgagtatggccctgtgctgcatatgcctacttcaaaagagaatcttaaggagaagggacctcaaaacgcaccagattcatatcctcataagcagtatcctgccaatcaaggacaagatgttgaatatttggtgacaggtacacatccatatccaccaggacctggtgttgccttgactgctgatactaagatccaaagaatgccaagcgagtcagccgcacagtccttagctgtggcgttaccgtctcagaccagagttgatgcaaatcggactgcgcctgctggaagtgaataccgacacccaggggcttctgaccgttcccagcccacagcaatgaattctatgattatggagaccagcaataccaagaactctgcattaatggctaaaaaagcccctacaatgcccaaaccccagtggcacccaccgtggaaactctacagggttatcagtgggcatcttggctgggttcggtgtattgctgtggaacctggaaatcagtggttcgttactggatctgctgacagaactataaagatttgggacttggccagtggcaaattaaagctgtcattgactggccacatcagcacagtacgcggtgtgattgtgagcacgaggagcccttacttgttctcttgtggagaagacaaacaagtgaagtgttgggatcttgaatataacaaggttatacggcactatcatggccatctaagtgcagtgtatggtctggatttgcatccaacaatcgatgtcctggtcacttgtagtcgagattctactgctcggatctgggatgtgagaactaaagccagtgtgcacactttgtctggacacacaaatgcagttgctaccgtgagatgccaagctgcagagccacaaattattactggaagtcacgataccacaatacgattatgggatctggtggctggaaagacacgagtcacattgacgaatcataagaagtcagtcagggctgtggtcttacatccgctacattacacatttgcatctggttctccagataacataaagcagtggaaattccctgacggaggcttcattcagaatctctctgggcacaatgcaattattaacacgctggcagtcaatacggatggagtacttgtatctggagctgacaatggcactatgcacctttgggactggagaactggctataattttcagcgcgttcatgctgctgtacagcctgggtctttggacagtgaatcaggaatattcgcttgtgcttttgatcggtcagaaagtcggttactaacagctgaagctgataaaaccattaaagtttacagagaggatgagactgcgacagaagaaactcacccagtcagctggaaaccagaaattatcaagagaaagagattttag

SEQ ID NO: 3533 - DNA, 3025 bp, Rattus norvegicus
  Genbank Accession No. NM_021765
aggttccactgctccgtgggtctgtgtgttcttgagtaccagtgtcgctcggagcctgtgagaggctggggctcggacaatcggagccatgcctcttcgacttgacatcaagagaaagctaactgctatgtctgatcgggttaagagtgtggatttgcatccgactgagccatggatgctggctagtctttacaatggcagtgtgtgtgtttggaatcatgaaactcagacgctggtgaagacctttgaagtgtgtgatctccctgttcgagctgcgaagtttgtcgcaaggaagaactgggtggtgacaggagcagatgatatgcagattagagtgttcaattataacaccctggagagggtgcacatgtttgaagcacactcggattacatccgttgcattgctgttcatcccacccagccgttcattctcacaagcagtgatgacatgcttattaagctctgggactgggacaaaaaatggtcttgttcacaagtgtttgaaggacacacgcattatgttatgcagattgtgataaaccccaaagataacaatcagtttgccagtgcatctctcgacaggaccatcaaggtgtggcagctgggctcttcatcaccaaactttacgctggagggacatgaaaaaggcgtgaattgcattgattactacagtggtggtgataagccatacctcatttcaggtgcagatgaccggctcgttaaaatatgggattatcagaataaaacttgtgtgcagaccccggagggacatgcccagaatgtgtcatgcgcaacgttccatcctgagctgcccatcatcatcacagggtcggaagacggaacggtgcgaatttggcactccagcacctaccggctggagagcacactgaattacggaatggagcgagtgtggtgtgtggccagtctgagaggctccaacaatgtcgctctgggctacgatgaagggagcatcattgttaagcttggtcgggaggaacctgccatgtccatggatgccaatggaaagataatctgggccaagcattcagaggtccagcaggccaacctgaaagcaatgggtgacaccgaaattaaagatggagaaagactgccactagcagtaaaggatatgggcagctgtgaaatatatccacagaccattcagcacaatcctaatgggaggtttgtcgtggtgtgtggtgatggagaatatatcatctacacagcaatggccttgagaaacaagagctttggatctgcccaggagtttgcatgggcccacgattcttcagagtatgcaataagagaaagcaacagtgttgtaaagatatttaagaactttaaggaaaagaaatcatttaaacctgattttggagctgaaagtatctatgggggcttcttgctgggagtcaggtctgtaaatggcttagcattctatgactgggagaataccgaactcatccgcagaattgaaattcagcccaagcacatcttctggtctgactctggagagctggtctgtattgccaccgaggagtcattttttattcttaaatatctgtcagaaaaagtcttggctgcacaggaaacccacgagggagttactgaggatggcattgaggacgcctttgaggttcttggtgaaattcaggaaattgtgaaaactgggctgtgggtaggtgactgcttcatctacacaagttctgtgaacagattaaactattatgtgggaggcgagattgtcaccattgcccacttggacaggacaatgtaccttctgggctatattccaaaagacaataggctttatctgggagataaagaattgaacatagttagctactccctgttagtttcagtcctggaataccagactgctgtcatgcggagggatttcagcatggctgataaggtgctccctactatcccaaaagaacagaggaccagagttgcacactttttggaaaagcagggcttcaagcagcaagcactcacagtatccacagatcctgaacatcgttttgagcttgctcttcaacttggggagctgaaaattgcttaccagttagcagtggaggcagagtcggagcagaagtggaaacaacttgccgaacttgccattagtaaatgtcagttcagcctagcccaggagtgtttgcaccatgcccaggactacggtggtctgctgctcttggccactgcctctggaaacgctagtatggtgaacaagctggcagaaggtgcggagagagatggcaaaaataacgtggcattcatgagctattttttacagggcaagcttgatgcttgcctagagctcttgatcagaacaggaagactcccagaagccgccttcctggcccgaacttacttacccagccaggtctcaagggtagtgaagttgtggagggagaatctctcaaaagtcaaccagaaagcagcagaatccctcgctgaccccacagagtatgaaaaccttttccctggattaaaagaagcctttgttgttgaagaatgggtgaaggagacacatgcggatctgtggccagccaagcagtaccctcttgtcacgccaaatgaagagagaaatgttatggaagaggcaaaacggtttcagccctcaagagccacagctcagcaggaacctgatgggaaaccagcttctagcccagttatcatggcctcccaaaccactcacaaagaagaaaagagtttccaggaactagaagatgatttagataccatggaattagaggatattgatacaacagacatcaatctggatgaagatattctggatgactaaagtttgccatttactccagtaagagattatgatggcacatacaaatcagtcaccaccctgaccagaactgtggcaatccttgctctgcacacgtaaacaaggaggaacatagccccttcatcttcagggcagagttttaactgaaacagacacttgtgcttttttcatattgtcattaaaccacccctcataaaaaaaaaaaaaaaaaaaaaaaaaaaa

SEQ ID NO: 3534 - DNA, 1885 bp, Rattus norvegicus
  Genbank Accession No. NM_021766
gcaaaattaatttattggccactgttcgcttagagggcggaggaagccgactgtttcggtctctgcataacaggcccaaacctttgctccagagatcatggctgccgaggatgtggtggcgactggcgccgaccccagcgagctggagggcggcgggctgcttcaagagattttcacgtcgcctctcaacctgctgctccttggcctctgcatcttcctgctctacaagatcgttcgcggggaccagcccggtgccagtggggacaacgacgacgacgagccgcccccgctgcctcgcctcaagccgcgtgacttcacccctgccgaactaaggcgatacgatggagtccaggacccgcgcattcttatggccatcaacggcaaggtgttcgacgtgaccaaaggccgcaagttctatgggccggagggaccatacggggtctttgctggaagagatgcatccaggggccttgccacattttgcctggacaaagaagcactgaaggatgagtatgatgacctttctgacctcactcctgcccagcaggagaccctgaatgactgggactctcagttcagttcaccttcaagtaccatcacgtggggaaaactgcttgaaggagcggaggagccgattgtgtactcggatgatgaagaacaaaagatgaggctgctcggaagagtgactgaagcagtcagtggagcatatctatttttgtattttgcaaaatcatttgtaacattccagtctgtctttacaacatggtgatttcaatatttagagaagttttgaacttgtaagttttttaagtaacatcactagtgacaccgataaaatcaactcgtcttagaatgcatgatgtgtttgtacgtcacaaatccagaaagtgaactttagttctctagatccaaatggtaaagctgtttctcttctatctgtagttaaaactgaattacaattttattttcctgagagggaaaacttgggttatttccacaaactggccttttttcaagtgcacacacacacagtggccccaaatggtcaatgtactaagaatgaagagagaaggtcttagccatgctatagtctgaaaacaagcccattttacccaacagacttaactgcatgatttttgttttatctacctctaaagcaaaactgcagtgttccaaagtctgtggtattgattcaaaacagaagtccagtaacaaaatgaaaactcaataatgggtttagttggggcaaacacattgcctgtgttcatggactgatttatcatccctgtccccacgtggacactcccacacacagtaactctcacacacctggtaattggcagttggaactacaacagaaatctgaaaattcaaggtagaactttgcaaaagaaaaatctgttgcttgtagcagggcaatggttatgtggttattggccaaatgtaaaatttgagagcaatatacaggacaggaacaggtgtgcgcttttcaaaagcttccactgacatctctgaagaatgagaaaacactacatggcactagctgggtgattttgaaaggaaaatacattcctaaggtaacagttaatcctctgttgttacaaaactcgtagtcgcttcaaaaatagtagtcaggtgtctaggtcttggataatactcttggttaatactaaacctagcttaagtagactctgcagttgtatacatttgttaaaagtattatctgaacaactagtgaggtttcagactcttgtaattgtagttaaatagtcattgtattttcttgtgagctgtgtttaatggttttacctcaaatcagaaaaaaatgaagtgcttgggtcagttaataaaacggttttgcccagtaaaaaaaaaaaaaaaaaaa

SEQ ID NO: 3535 - DNA, 2573 bp, Rattus norvegicus
  Genbank Accession No. NM_021835
gacgactggtctgcgccgccggagaacctctgtcgctggggctggtccgcgggctccgaggaaccgctgcttcctgagagcgctccgtgagtgaccgcgacttttcaaagctccggatcgcgcgggaccaaccaacgtgagtgcaagcggtgtcttaaccctgcgctccctggagcgaactggggaggagggcgcaggggggagcactgcggtctggagcgcacgctcctaaacaaactttgttactgaagcggggacgcgcgggtatcccccgcttcccggcgcgctgttgcggccccgaaacttctgcgcacagcccaggctaaccccgcgtgaagtgaccgactgttctatgactgcaaagatggaaacgaccttctacgacgatgccctcaacgcctcgttcctccagtccgagagtggcgcctacggctacagtaaccctaagattctgaagcagagcatgaccttgaacctggccgacccggtgggcaatctgaagccgcacctccgagccaagaactcggaccttctcacgtcgcccgacgtcgggctgctcaagctggcgtcgccggagctggagcgcctgatcatccagtccagcaatgggcacatcaccactacaccgacccccactcagttcttgtgccccaagaacgtgaccgacgagcaggagggcttcgccgaaggcttcgtgcgcgccctagctgaactgcatagccagaatacgctgcccagtgtcacctccgcggcacaacctgtcagtggggcgggcatggtcgctcccgctgtggcctcagtagctggcgctggcggcggcggcggctacagcgccagcctgcacagtgagcctccggtctacgccaacctcagcaacttcaacccgggtgcgctgagcagcggcggtggggcgccctcctatggcgcgaccgggctggcctttccatcgcagccccagcagcagcagcagccgcctcagccgccgcaccacttgccccaacagatcccggtgcagcacccgcggctgcaggcgctgaaggaagagccgcagacggtgccggagatgccgggagagacgccgcccttgtcccccatcgacatggagtctcaggagcggatcaaggcggagaggaagcgcatgagaaaccgcatcgctgcctccaagtgccggaaaaggaagctggagcggatcgcccggctagaggaaaaagtgaaaaccttgaaagcgcaaaactccgagctggcgtccacggccaacatgctcagggaacaggtggcacagcttaaacagaaagtcatgaaccacgttaacagtgggtgccaactcatgctaacgcagcagttgcaaacgttttgaggacagactgtcagggctgaggggcagtggaagaaaaaaataacagagataaacttgagaacttgactggttgcgacagagaaaaaaaagtgtccgagtactgaagccaagggtacacaagatggactgggttgcgacctgacggcgcccccaatgtgctggagtgggaaggacgtggcgcgcctggctttggcgaggagccagagagcagcggcctgttcgcgacgctttgcgaacgggctgtgccgcgaccagaacgatggacttttcgttaacattgaccaagaactgcatggacctaacattcgatctcattcagtattaaggggggtgggtgggggcttacaaactgcaatagagactgtagattgcttctctagtgctccgtaagaacacaaagcagggagggctgggaaggggagggaggcttgtgagtaccaggctagattgcggatgaactcccctggcctgcctctctcaactgtgtatgtacatatatttttttttaatttgatgaaagctgattactgtctataataaacagcttcctgcctttgtaagttatttcatgtttgtttgtttgggtgtcctacccagtgtttgtaaataagagatttgaagcattctgagtttaccatttgtaataaagtatataatttttttatgttttgtttctgaaaatttccagaaaggatatttaagaaaacacaataaaccattgagaagtagcccccaacctctctgctgcattatcgatagataatgagagctaggtgaaatgacagctgagtgtctgtatgctggggtgagagcctgtagtccctcccgtctggttgtaggaatagacaccctgcatgctatcattgactcatactctctccccagcaacccacaagtccagactgttgaccagaagatggtgcagtgtttcttaaggctggaagaagagggtgttgcaaggggagagggacagcccactgggaaagcagatgcttgagttgagagccatatcaagtagcatgcgctgtgatcgtttataataataataaagacttcagcaattagatgtttatctcaaagcagggacccatggaaggttttacaaaaggtgtctccttccaacttggattctgacgactcctagaaaaagatgacctttgcttgtgcatatttataatagttcgtatcacaataaatgtattcaaataatggtttt

SEQ ID NO: 3536 - DNA, 1035 bp, Rattus norvegicus
  Genbank Accession No. NM_021836
atgtgcacgaaaatggaacaggctttctatcacgacgactcttacgcagcggcaggatacggtcggagccctggcagtctttctcttcacgactacaaactcctgaaacccaccttagcgctcaacctggcagatccttatcggggtctcaagggtcctggggcgcggggtccaggcccagagggcagtggggcaggcagctacttttcgggtcagggatcagacacaggcgcatctctgaagctagcctccacggaactggagcgcttgatcgtccccaacagcaacggcgtgatcacgacgacgcccacgcctccgggacagtacttttacccccgtgggggcggcagcggcggaggtacagggggcggcgtcaccgaggagcaggagggctttgcggacggttttgtcaaagccctggacgacctgcagaagatgaaccacgtgacgccccccaacgtgtctctgggcgccagcgggggtccccaggccgggccagggggcgtctatgctggtccggagccgcctccggtctacaccaacctcagcagttactccccagcctctgcaccctctggaggttccgggaccgccgtcgggactgggagctcatacccgacggccaccatcagctacctcccacatgcaccaccctttgcgggcggccacccggcacagctgggcttgagccgtggcgcttccgcctttaaagaggaaccgcagaccgtaccggaggcacgcagccgcgacgccacgccgcctgtgtcccccatcaacatggaagaccaggagcgcatcaaagtggagcgaaagcggctgcggaacaggctggcggccaccaaatgccggaagcggaagctggagcgcatcgcgcgcctggaggacaaggtgaagacactcaaggctgagaacgcggggctgtcaagtgctgccggcctcctacgggagcaagtggcgcagctcaagcagaaggtcatgacccacgtcagcaacggctgccagttgctgctaggggtcaagggacacgccttctga

SEQ ID NO: 3537 - DNA, 393 bp, Rattus norvegicus
  Genbank Accession No. NM_021840
atgtctggtcgcggcaagcagggaggcaaggctcgcgccaaggccaagacccgctcctcccgggccggcctgcagttccccgtgggccgcgtgcaccgtctgttgcgcaagggaaactactcggagcgcgtgggcgcgggcgccccggtgtacctggcggccgtactggagtacctgacggccgaaatcctggagcttgcggctaatgcggcgagggacaacaagaagacgcggatcatcccgcgccacctgcagctggccatccgcaacgatgaggagctcaacaagctgctgggccgcgtgaccatcgcgcagggcggcgttctgcccaacatccaggctgtgctgctgcccaagaagaccgagagccaccacaagcctaagggaaagtaa

SEQ ID NO: 3538 - DNA, 582 bp, Rattus norvegicus
  Genbank Accession No. NM_021850
atggcgaccccagcctcaaccccagacacacgggctctagtggctgactttgtaggctataagctgaggcagaagggttatgtctgtggagctggccctggggaaggcccagcagccgacccgctgcaccaagccatgcgggcagctggagacgagtttgagacccgcttccggcgcaccttctctgacctggccgctcagctacacgtgaccccaggctcagcccagcaacgcttcacccaggtttccgacgaacttttccaagggggccccaactggggccgtcttgtggcattctttgtctttggggctgccctgtgtgctgagagtgtcaacaaagaaatggagccattggtgggacaagtgcaggattggatggtgacctacctggagacacgcttggctgactggatccacagcagtgggggctgggcggagttcacagctctatacggggacggggccctggaggaggcacggcgtctgcgggaggggaactgggcatcagtgaggacagtgctgacgggggctgtggcactgggggccctggtaactgtaggggccttttttgctagcaagtga

SEQ ID NO: 3539 - DNA, 1009 bp, Rattus norvegicus
  Genbank Accession No. NM_021989
gaattccggtagaaggcagcggaggagccgagccgggctgcgctcgctcgccgccccctagcctctttcttctccgccgggtgcactgccctgcgctgtcccctcgcctcttcgcccccttgacaaagaggacagaaagtttgcgcgggggagcgggccaggtgaggaggggcgtgccggcgccagcccgcgccccagcagccggacccaggcccctagcgcgcccgccatgggcgccgcggcccgcagcctccggctggcgctcggcctcctgctgctggccacgctgctgcgcccggccgacgcctgcagctgctccccggtgcacccgcaacaggcgttttgcaatgcagacgtagtgatcagggccaaagcagtgagcgagaaggaggtggattccgggaatgacatctatggcaaccccatcaagaggattcaatatgagatcaagcagataaagatgttcaaaggacctgacaaggacatcgaatttatctacacggccccctcctcagcagtgtgcggggtctcgctggacgttggaggaaagaaggaatatctaattgcagggaaggcggaaggagatggcaagatgcacattaccctctgtgactttattgtgccctgggacacgcttagcatcacccagaagaagagcctaaaccacaggtaccagatgggctgcgagtgcaagatcacacgctgccctatgatcccatgctacatctcctccccggatgagtgcctctggatggactgggtcacagagaagagcatcaatgggcaccaggccaagttctttgcctgcatcaagagaagtgatggttcttgcgcgtggtaccgcggggcggcacccccgaagcaggagtttcttgacatcgaggacccgtaagcaggctgacagagccccctgtggccaattgaaaagcctctgagggttcagactggtccagctttgacatcccttcctggaaacagcatgaataaaacatcaatcatcccggaattc

SEQ ID NO: 3540 - DNA, 1711 bp, Rattus norvegicus
  Genbank Accession No. NM_022005
agctcacctagaggagggcgcaggcgacagcacagcggtctgcgaggggacccagaagccagtggacgcgggccacccgggagcccagccagtcagccccctctgggaggcgggaaaactgcaagccgcgcccaccgccctgcccccagcgcgccactcccggctgctgggactctgctcagactcctgggatccgcttggagggaacccaacgcctagacaccatggagacggtgctgatcctctgcagcttgctggcccctgtggtcctggctagtgcagctgagaaggagaaagaaaaggatcctttctattatgactaccagaccctgaggattgggggattggtgtttgctgtggtcctcttctctgttgggatacttctcatcctaagtcgcaggtgcaagtgcagtttcaatcagaaacccagggctccaggtgatgaagaggcccaggtggagaaccttatcaccacaaatgctgcggagccccagaaggcagagaactgaagggcagcctccagcatgaagcctccagaagccaaggccagctacccgacactttagaggctgatgtcgaggcttgagaaagccggctacttcataccagacctttccccaggagatgccgaggactcgtgttccctgtgcctctccccaccccctactaaccctagtcttgtattaatgatgtgacactcacagcccttcttctcactgcagccgggctctggaccctttctgtgccgcgtctgtgccgtgtctgtgtgtgtctgctgactgtggtcgttcgtggtcgtttcattgttcctgtgaactgtgtgcttctctcccatgccaccgtcagcaccttgtgccctcctgtgacctccatctactcttgctctctggagtctccccgtccctgaggagcccttagtcccctctttctggatttaggcttgagggagaagttgtaccgagggcaggaagtccccagtgatcccggggctgagaaagttcgtaccctcttcactgatgttccttgtggactctgagaagaaacttgctccagattccaccagtttagaaggtccgtttgcagttggagattcagattgcctcccttgaggcgtctgccctccaggcctcctttttcttttagggtgcccacttaggagtcccaatccgccccaccctttacagaacacccaggaattcttgcctctgaggaatgagctccttacttaacttctgagcaatatccccataggctttggagcccttctgccttcatccaccttccctgcttctgagacttccatctctagcccaattcatctgacagaggactccttccttctctgaagctggtctgtggcaggagatagcccaggggacaggcagcaggcagggtgccggtggctctgtctctctgccacatggtgtggaatctggcagactacagtttctttcccctgcctgtcaggggtcggagtggagagggctggaagggttcaggggcagcgggagagagcaacagggtatgcacacccgtggatgcaaacgcctacgggagtcaaaggtcaccagagtggaaactcacaccagagcctgccccacctgcccattgtgttcccttggaaacgaaccaagccacactgtgtactgggactgctgatctctgtcttgtgatctattatcctctgacaacagaaaagtaaataaatata

SEQ ID NO: 3541 - DNA, 636 bp, Rattus norvegicus
  Genbank Accession No. NM_022175
atggaggctcaaggctctagccatgatatcagccgcttactctgcctgggagtcaaggaagactcggaagaacagcatggtcagtacctgggtgatgtgaaagcagaggctttctttcaggctggagaggggagagacgagaaaggtgcacagggtcagcctggagagggagcagtgggaacagaaggcgaaggagaagaattaaatggaggagaaggccactttggtcctggtgttccaggtcctgtgggtgagggggacaaggatggtggcaccagagctagtggcatggaggaggagcaacatgagcccgttgccgagggcactgagagtgtcaagtctgaggataagcagatgccactccgccgccctgggtccacccagcggcggctggcggaattggagcgcattttgctaagcagtggttcctccagtggcgggaggagcttgatagatggatggatatcagtgtgtccagagtgcaggaattggtttaagattaggagggctgcatacagaagaaataggaggcggagaacaccaatccctgaacattttagagcaacatctgggtgccctgcttgtcttggagcaagatggggagtaagatgtccttttgcaacaccgagattttga

SEQ ID NO: 3542 - DNA, 3692 bp, Rattus norvegicus
  Genbank Accession No. NM_022179
gtcgtcttatttgggagctgagacttgaggaaggtgataacttctgaatccccccaggtagtcaataccattgtggaaacatggccgccattgagccttctggtctgcacccgggagaaagagactcaagctgcccccaggagggcattccaaggccctcaggtagcttagaactggcacaggaatacttgcaacaattcaaggtgaccatgacacagctgcagcagatccaagccagtcttctgtgttccatggagcaggcgctgaagggacaggacagtcccgctccttctgtccggatgttgcccacatacgtgaggtccacaccacatggcaccgagcaaggagacttcctggtgctggagctgggggccacaggagcctcactacgtgtgttgtgggtaacactgacgggcaccaaggaacacagcgtggagaccaggagccaggagtttgtgatccctcaagaggtgatcctaggtgctggccagcagctctttgactttgctgcccgctgcctctctgaattcctggatgcataccccgtggagaatcagggtctgaagcttgggtttaatttctcttttccttgtcaccagacaggcttggacaagagcaccctcatttcctggacaaaaggttttaggtgcagtggtgtggaaggccaggatgtggtccagttgctaagggatgccattcagaggcaggggacctacaatattgatgtggtagccatggtgaatgacacagtgggtaccatgatgggctgtgagctgggcaccaggccatgtgaagtcgggcttattgtagacactggtaccaatgcctgttatatggaggaagcgaggcacgtggcagctctggatgaggaccgcggccgtacctgtgtcagcatcgagtggggctccttctatgacgaagaggccctagggccagtactgaccaccttcgacgatgccctggaccacgagtccctggttcctggtgctcagaggtttgagaagatgattggtggcctttacttgggtgagctggtaaggctggtgctggtccacttgtcccagcatggggtcctctttggtggctgcgcctctcctgcgttgctgagtcaaaacagcatcctcctggaacatgtggccaaaatggaggaccctgccactgggatagcccacgtccacacagtcctgcagggcttgggtctgagccctcaggcctcagatgctgagctcgtgcagcgcgtgtgcatggctgtgtgcacgcgagctgcccagctctgtgcctctgccctggctgcagtcctatcccgcctccagcacagcagggagcagcagacactgcacgtggccgtggccactggagggcgagtgttcgaatggcaccccaggttcctctgcatcctaaaggagacggtaatgctcttggccccagagtgtgatgtctccttcatcccctctgtggatggtggtggccggggtgtggcaatggtgactgctgtggcagcccgcctggctacccacaggcgcatcctggaagagaccctggcaccatttcagctgagcttggagcagctgacagcggtgcaggcacaaatgcgggaagccatgatcagggggcttcaaggagagagctcctccctccgcatgctgcccacttacgtccgagcaacgcccgatggcagcgaacgaggtgacttcctggctttggacctagggggcaccaacttccgtgtcctgttggtacgcgtggccgagggcagtgttcagatcaccaaccaggtctactctattcctgagtatgtagcccagggctctggacagaagctctttgatcatattgtggactgcatcgtggacttccagaagaggcaaggccttagcggacagagcctacccctgggtttcaccttctcttttccttgcaagcagcttggcctggaccagggcatcctcctcaactggactaaggggttcaatgcatcaggctgcgagggccaagatgttgtgtatttattacgggaagccattaggcgcagacaggcagtggagctgaatgtggttgccattgtcaatgacacggtggggaccatgatgtcctgtggctatgatgatccctgttgtgagatgggcctcattgtcggaaccggtaccaacgcctgctatatggaagaactccggaatgtggcgagtgtgcccggggactcaggccacatgtgtatcaacatggagtggggtgcctttggggatgacggctcactgagcatgctcggcacctgctttgatgctagcgtggaccaggcatccatcaacccaggcaaacagaggtttgagaaaatgatcagcggaatgtacctgggggagatcgtccgccatatcctcctgcacttaaccagtcttggagttctcttccggggccagaagacgcaatgccttcagaccagggacatctttaagaccaagtttctctccgagattgagagcgacagcctggccctgcgtcaggtccgagccatcctggaggacctggggctgactctgacgtctgatgatgccttgatggtcctagaggtgtgccaggctgtgtcccgcagggccgcccaactctgcggggcaggtgtggctgcagtggtggaaaagatacgggagaaccggggcctgcaggagctgacagtgtctgtgggagtggatgggacgctctacaagctacatccccacttctccaggctggtgtcagtgacagttcggaagctagcccctcagtgcacagtcacctttttgcaatcggaggatgggtctgggaaaggggcagcgttggtcactcgtgtcgcttgccgcctgacccagatggcctgcgtttgaggaaaatctccaaagagcaattgggatctccctggactaaggattcagcccacacggaccctctggcgggcccagccacccacaactcccaaagaaacccacgggtggtgccctcataactgtccgcccacacccaatggctttctgagagaagcaccactctggttagcaaggaattccccgaagatggcggaggggcaggttctagtattggatggccggggccatcttctgggccgcctggccgattgtggccaactgctgggcaggtagccgaaaggtggtggttgtacgctgtgagggcatcaacatttctggaaatttctacagaaacaagttaaagtatctggccttctccgaaagcggatgaacaccaacccgtctcgaggcccctaccacttccgagccccaagccgcattttttggcgcactgtgcgaggcatgctgccgcacaagaccaaaagaggccaggctgccctggaacgcctcaaggtgttggatgggatccctccaccctatgacaagaaaaagcggatggtggtccctgctgccctcaaggttgtgcggctgaagctaccagaaagtttgcttacctggggcgtctggctcatgaggtcgggtggaagtaccaggcagtgacagctactctggaggagaaacggaaggaaaaggcaaagatccattaccggaagaagaagcagctcttgaggctaaggaaacaggcagaaaagaatgtggagaagaaaatctgcaagttcacagaggtcctcaagaccaatggactcttggtgtgaaccaataaagactgtttgtgcctcaaaaaaaaaaaaaaaaaaa

SEQ ID NO: 3543 - DNA, 1446 bp, Rattus norvegicus
  Genbank Accession No. NM_022180
ggatccgtagaggagaatgcgactctctaaaaccctcgccgacatggacatggctgactacagtgctgccttggacccagcctacaccaccctggagtttgaaaatgtgcaggtgttgaccatgggcaatgacacatccccatctgaaggtgccaacctcaactcatccaacagcctgggtgtcagtgccctgtgtgccatctgtggcgatcgggccactggcaaacactacggagcctcaagctgtgacggctgcaagggattcttcaggaggagcgtgaggaagaaccacatgtactcctgcaggtttagcaggcagtgcgtggtagacaaagataagaggaaccagtgtcgttactgcaggctcaagaagtgcttccgggctggcatgaagaaagaagccgtccaaaatgagcgggatcggatcagcacgcggaggtcaagctacgaggacagcagcctaccctccattaatgcgctcctgcaggcagaggtcctgtctcagcagatcacctcccccatctctgggatcaatggcgacattcgggccaagaagattgccaacatcacggatgtgtgtgagtctatgaaggagcagctgctggttctggtcgaatgggccaagtacatcccggccttctgtgaacttcttctggatgaccaggtggcgctgctcagagcccacgctggtgagcacctgctgcttggagccaccaagaggtccatggtgttcaaggatgtgctgctcctaggcaatgactacatcgtccctcggcactgtccagagctagcagagatgagccgtgtgtccattcgcatcctcgatgagctggtcttgcccttccaagagctgcagatcgatgataatgaatacgcctgcctcaaagccatcatcttctttgacccagatgccaaggggctgagtgacccaggcaagatcaagcggctgcggtcacaggtgcaggtgagcctggaggattacatcaacgaccggcagtatgactctcggggtcgttttggagagctgctgctgctcctgcccactctgcagagcattacctggcagatgatcgagcagatccagttcatcaagctctttggcatggccaagattgacaacctgctgcaggagatgctgcttggagggtctgccagtgacgcgccccacgcccaccaccccctgcaccctcacctgatgcaagaacacatgggcaccaatgtcatagttgccaacacgatgccctctcacctcagcaatggacagatgtgtgagtggccccggcccagggggcaggcagccacccctgagactccacagccatcaccaccaagtggctctggatctgaatcctacaagctcctgccaggagccatcaccaccatcgtcaagcctccctctgccatcccccagccaacgatcaccaagcaggaagccatctagaattc

SEQ ID NO: 3544 - DNA, 6052 bp, Rattus norvegicus
  Genbank Accession No. NM_022183
aaatgaaactagggaagctctcctaaccgacgcacgtctgtggagaagcgtccaagtcgccggtcgcctagcgtttctcactgattttgtcgcttttaggattctcgagccccttcaggacggtcaccatggagttgtcaccgctgcagcctgtaaatgaaaatatgctactcaacaaaaagaagaatgaagatggcaagaaaagactgtccgttgaaagaatctatcagaaaaaaacccaactggaacatatactgctccgcccagatacctacatcggctctgtggagttagtgacccagcaaatgtgggtttacgatgaagatgttggtattaactacagggaagtcacttttgttcctggtttgtataaaatctttgatgaaattctagttaatgctgctgataacaaacaaagggacccaaaaatgtcttgcattagagtcacaatgatgcgaaataatttaattagtatatggaataatggaaagggaattcctgttgttgaacacaaagtggagaaaatgtatgtcccagctctcatatttggacagctcctgacctccagtaactacgatgatgatgagaagaaagtgacaggtggtcgaaatggctatggagctaaactgtgtaacatattcagcaccaaatttactgtggaaacagccagtagggaatacaagaaaatgttcaaacagacatggatggataacatggggagagctggtgacatggagctcaagccctttagcggagaggattacacgtgtattaccttccagcctgacttatctaagtttaaaatgcaaagcctggacaaagatattgtcgcactgatggtcagaagagcatacgatattgctggttccaccaaagatgtaaaagtctttcttaatggaaacaggctgccagtcaaagggttccgtagttacgtggatatgtatttgaaggataaggttgatgaaactgggaacgctctgaaggtggtgcatgaacaagtaaatccccggtgggaagtgtgcttaacaatgagcgagaaaggctttcagcagattagcttcgtcaacagcatcgctacttctaagggtggcagacatgtcgattatgtagccgatcagattgtgagtaaactcgttgatgtggtgaaaaagaagaacaagggaggtgttgcagtgaaggccgatcaggtgaagaatcacatgtggatttttggaaatgcggtaattgaaaacccaacctttgattctcaaacaaaagaaaacatgactttacaagccaagagctttggatcaacttgtcaattaagtgaaaaattcatcaaagctgcaattggttgtggtattgtcgaaagcatactaaactgggtgaagtttaaggcccaaatccaattaaacaagaagtgttcagctgtaaaacataacaggatcaagggaatccccaaacttgacgacgccaatgacgcagggagccgaaactctgctgaatgcacacttatcctgactgaaggggactcagccaaaactctggcagtctcaggacttggagtggttggaagagacaaatatggggtgttccctctcagaggaaaaatactcaatgtgcgagaagcttctcataaacagatcatggaaaatgctgaaattaacaatatcatcaagattgtggggcttcagtacaagaaaaactatgaggatgaagattcattgaaaactcttcgttatgggaagatcatgattatgacagatcaggaccaagatggttcccacatcaaaggcttgctgatcaattttatccatcacaattggccatctcttctgcgacatcgttttctagaagaatttatcactcctattgtaaaggtatctaaaaacaagcaagaaatagcattctacagtcttcccgagtttgaagaatggaagagtacaaatccaaatcacaaaaaatggaaagtcaagtactacaaaggtttgggcacgagcacatcaaaggaagctaaggagtattttgcaaatatgaaacgacatcgtattcagttcaaatactctggccctgaagacgatgctgcgatcagcctggcctttagtaaaaaacaggtcgatgatcgaaaggaatggttaactaatttcatggaagatagaagacagcggaagttacttggccttcctgaggattatttgtatggacaaaccactatgtacctgacctataatgatttcattaacaaggaacttatcctcttttcaaactctgataatgaaagatctatcccatctatggtagatggtttgaaaccaggtcagagaaaggttttgtttacttgtttcaaacggaatgacaagcgagaggtgaaagttgcccagttagctgggtcagtggcagaaatgtcctcttatcaccatggtgagatgtcgctgatgatgaccattatcaatttggctcagaattttgtgggtagcaataatttgaaccttctacagcctattggtcagtttggtaccaggctgcatggtggcaaggactcagccagccctaggtacatctttacaatgctcagccctttggctcggttgttatttccatcaaaagatgatcacacgttacggtttctgtatgacgacaaccagcgtgttgagcctgaatggtacatccctattatacccatggtgctgataaatggtgctgagggaattggtactgggtggtcctgcaaaatccccaactttgatgttcgtgaagtcgtaaataatatcaggcggctgttggatggagaagagcctctgcccatgctcccaagttataagaattacaaaggtactattgaagaactggcttcaaatcagtatgtgattaatggagaagtagctattctgaattccacaaccattgagatcactgagcttcccatcagaacatggacccagacatataaggaacaggttctagaacctatgttgaatggcaccgagaagacaccccctctaataacagactatagggaataccacacagataccactgtgaagtttgtcataaagatgactgaagaaaaattggcagaggcagagagagtgggactacacaaagtcttcaaactccagactagtctcacttgcaactctatggtactttttgaccatgttggttgtttaaagaaatatgacactgtgttggatattctaagagacttctttgagctcaggcttaaatattatggattaagaaaagaatggcttctaggaatgcttggtgcagaatcttctaaactgaataatcaagctcgctttatattagagaaaatagatggcaaaatagtcattgaaaataaacctaagaaagaattaattaaagttctgattcagagaggctatgactccgaccctgtgaaagcctggaaagaagctcagcagaaggtcccagaagaagaggaaaatgaagagaatgaagagagcgagagtgaaagcacgagccctgcagcggagtctggaccgaccttcaactaccttcttgatatgcccctgtggtatctaaccaaggagaagaaggacgagctgtgcaagcaaagggacgagaaggaacaagagctcaacacgttaaagaaaaagactccatcggatttgtggaaggaagacctggctgcttttgtggaagaactggaggttgttgaagccaaggaaaaacaggatgaacaagtaggacttcctggaaagggggtgaaagcgaaggggaagaaagcgcagatatctgaagtcctgccttctcctgtggggaaaagggtcatcccgcaggtgactatggagatgagagctgaggcagagaagaaaatcaggaggaaaattaagagcgagaatgttgagggcacccctgctgaggatggtgctgagccaggactccggcagagactagagaagaggcagaagagagagccaggtaccagggcaaagaagcaaactacattgccatttaagcctatcaaaaaagcccaaaagcaaaacccttggtctgattctgaatcagatatgagcagcaacgaaagcaattttgatgtccctccacgagagaaagagccaagaattgctgcaacaaaagccaaattcacggcggatttagactctgatgacgatttctcaggcttggatgagaaggatgaggatgaagatttcttcccattagatgatactccacctaagaccaaaatgcccccaaaaaatactaaaaaagcactgaagccacagaagagctccacatcagttgatcttgaaagtgatgggaaagacagtgtaccagcttctccaggcgcttctgctgctgacgtcccagctgagactgaaccctccaagccgtcctccaaacagacagtgggagtgaagaggacaataaccaaaggtcagtctttaacctccactgctggcaccaaaaagagagctgtaccaaaggagaccaagtcagattcagccttgaatgctcatgtctccaaaaagcctgctcctgccaaagccaagaacagtcgcaagaggatgccatcttcttctgacagctcggactctgagtttgagaaggcgatttctaaaggtgccacaagcaagaaactcaagggagaggagcgggatttccatgtggacttagatgacactgtggctcctcgagcaaaatccggacgagcaaggaagccgattaagtacctggaggagtcggatgacgacctcttctaaggggtgaggggatttcaggaatggttttactgagccacgttagttttaaagttcttccttaaccactctgaatttaattggcaggaagacttttttttaaataagaatatgcaagtgagcaggcccctgtggccttcacctttgttctcaacatactgtcagtagtggccgtctcgtgggcattgtcgtcttctctgattgtctgttttatgtctgttttctttggtctctgaaacctggcttgaatattttttggattccacataattatatgcttactcagcacagtagcatttatcaatttaaactaaagtggaaatggtttcaaaagcattcctgcctcctttcctatcccactaaatatgaggtaagacagcccttgttttcaattttataggtagaattccggccgggatcccccggcctgcctctgacggcggggactcagcttcggagagtcgggaggcatcaggtggcccgcagctctcgtcctctgcgtccttctcgcggtggctgaccgcgactccgaagaggtggctggccgctgcgcttggcggggtggggcgggatggcggcgtctgatggctggaggcggcctggccgggtactcttctacccgactctgctctacacagtgttcctggggagggtaggcagcccgaccaccgcgattggtaccaccgcatcgaccacacagtgctgctgggcgcagtgccgctgaggagcatgacgcgccggctggtactggacgagacgtgcgacggagtgatcactatgaacgaggagtacgagaccagattcctgtgcaacacctcgaaggaatggaagaatgtgggagttgagcagctacggctcagcacagtcgacatgactggagtccccaccttggccaacctccacagaggagtccagtttgctctcaagtaccagtccctgggccagtgtgtctacgtgcattgtaaggctggtcgatccagaagtgccacaatggtcgaggcctatctgattcaggtacacaactggagcccagaggaggctatagaagctatcgccaaaatccggtcacacatctccatcaggcccagccagttggaaattctcaaagagttccagaaggagattcgtgcaagggcagcaaataactaactactggtctcttgtgctgacatgagtatgaagtctgtggatgacaaagaacttggctctccgagatacagtaacatgttaaaggacaaagcgcttaagctaccaccactgcaaatgtgctgagtataatgtccctcctttgccttccttcctgaaataacacttggatggccacagagaaaaaaaaaaaaaaaaaa

SEQ ID NO: 3545 - DNA, 381 bp, Rattus norvegicus
  Genbank Accession No. NM_022192
atggctgatgaaattgctaaagctcaggtcgcccggcctggcggcgacacgatcttcgggaagatcattcgcaaggaaatccccgccaaaatcatttatgaggatgaccagtgtcttgctttccatgacatttcccctcaagcaccaacacattttctggtgatacccaagaaatatatatctcagatttctgcagcagaagatgatgatgaaagtcttcttgggcatttgatgattgttggcaagaaatgtgctgctgatctgggcctgaagaagggctatcgaatggtggtgaatgaaggttcagatgggggccagtctgtctatcatgttcatctccatgttcttggaggtcggcaaatgaactggccccccggataa

SEQ ID NO: 3546 - DNA, 609 bp, Rattus norvegicus
  Genbank Accession No. NM_022196
atgaaggtcttggccgcagggattgtgcccctactgctcattctgcactggaaacacggggcagggagcccccttcccatcacccctgtaaatgccacctgcgccatacgccacccgtgtcacggcaacctcatgaaccagatcaagagtcaactggctcaactcaacggcagtgccaatgccctctttatttcctattacacagctcaaggggaaccatttcccaacaacgtggataagctatgtgcgccaaacatgacggatttcccacctttccatgccaatgggacagagaagaccaagttggtcgagctgtatcggatggtcacgtacctgggagcctccctgaccaacatcacctgggatcagaaaaacctcaaccccactgccgtgagcctccagatcaaactcaatgcgactacagacgtcatgagggggctccttagcagcgtgctttgccgtctgtgcaacaagtaccatgtgggccatgtggatgtgccctgtgtccccgacaactctagcaaagaagccttccaaaggaagaagttgggctgccagctcctggggacatacaagcaagtcataagtgtgttggcccaggccttctag

SEQ ID NO: 3547 - DNA, 1050 bp, Rattus norvegicus
  Genbank Accession No. NM_022205
atggaaatatacacttcggataactactccgaagaagtagggtctggagactatgactccaacaaggaaccctgcttccgggatgaaaacgaaaacttcaacaggatcttcctgcccaccatctattttatcatcttcttgactggcatagtgggcaatgggttggtaatcctggtcatgggttaccagaagaagctgaggagcatgacagacaagtaccggctgcacctgtccgtggctgacctcctctttgtcatcacactccccttctgggcagtggacgccatggctgactggtactttgggaaatttttatgtaaggctgtgcatatcatctacaccgtcaacctttacagcagtgttctcatcctggccttcatcagcctggaccgctaccttgccattgtccacgccaccaacagccagagcgcgaggaagctgctggctgaaaaggccgtctatgtgggtgtctggatccccgccctcctcctgactatccctgacatcatcttcgccgatgtcagccagggggacggcaggtacatctgtgaccgcctttaccccgacagcctgtggatggtggtgttccagttccagcacatcatggtgggtctcatcctgccgggcatcgtcatcctgtcctgttactgcatcatcatctccaagctgtcacactccaagggccaccagaagcgcaaggccctcaagactacggtcatccttatcctggctttctttgcctgctggctaccgtattacgtggggatcagcatcgattccttcatccttttggaggtcatcaagcaaggatgtgagttcgagagcgtcgtgcacaagtggatctccatcacggaggccctcgccttcttccactgttgcctgaaccccatcctctacgccttcctcggggccaaattcaagagctccgcgcagcatgcactcaattccatgagcagaggctccagcctcaagatcctttccaaagggaaacggggtggacactcttccgtctccacagagtcagaatcctcaagttttcactccagctaa

SEQ ID NO: 3548 - DNA, 393 bp, Rattus norvegicus
  Genbank Accession No. NM_022214
atgagcttccagctccgcagctccgcccgcatccctagccggtcctgctcgtcattcaccctgctggcatttctgctgctgttcacactgccacagcatcgagctcaagctgctcctttctcggccatggttgcaacggagctacgctgtgtttgcttaaccttagctccaagaattaaccccaaaatgatcgctaatttggaggtgatccctgcaggtccacattgccccaaggtggaagtcatagctaagttgaagaaccagaaggataatgtttgtcttgacccacaagctccgttgataaagaaagtcattcagaaaatattgggcagtgaaaataagaaaacaaagcggaatgcacttgcactggtcagatcagccagtactcaataa

SEQ ID NO: 3549 - DNA, 1323 bp, Rattus norvegicus
  Genbank Accession No. NM_022220
atggtccatgggtacaaaggggtccagttccaaaattgggcaaagacctatggttgcagtccagaggtgtactaccagcccacctccgtggaggaggtcagagaggtgctggccctggcccgggagcagaagaagaaagtgaaggtggtgggtggtggccactcgccttcagacattgcctgcactgacggtttcatgatccacatgggcaagatgaaccgggttctccaggtggacaaggagaagaagcagataacagtggaagccggtatcctcctggctgacctgcacccacagctggatgagcatggcctggccatgtccaatctgggagcagtgtctgatgtgacagttgctggtgtcattggatccggaacacataacacagggatcaagcacggcatcctggccactcaggtggtggccctgaccctgatgacagctgatggagaagttctggaatgttctgagtcaagaaatgcagatgtgttccaggctgcacgggtgcacctgggttgcctgggcatcatcctcaccgtcaccctgcagtgtgtgcctcagtttcagcttcaggagacatccttcccttcgaccctcaaagaggtccttgacaacctagacagccacctgaagaggtctgagtacttccgcttcctctggtttcctcacactgagaacgtcagcatcatctaccaagaccacaccaacaaggccccctcctctgcatctaactggttttgggactatgccatcgggttctacctactggagttcttgctctggaccagcacctacctgccatgcctcgtgggctggatcaaccgcttcttcttctggatgctgttcaactgcaagaaggagagcagcaacctcagtcacaagatcttcacctacgagtgtcgcttcaagcagcatgtacaagactgggccatccctagggagaagaccaaggaggccctactggagctaaaggccatgctggaggcccaccccaaagtggtagcccactaccccgtagaggtgcgcttcacccgaggcgatgacattctgctgagcccctgcttccagagggacagctgctacatgaacatcattatgtacaggccctatggaaaggacgtgcctcggctagactactggctggcctatgagaccatcatgaagaagtttggaggaagaccccactgggcaaaggcccacaattgcacccagaaggactttgaggaaatgtaccccacctttcacaagttctgtgacatccgtgagaagctggaccccactggaatgttcttgaattcgtacctggagaaagtcttctactaa

SEQ ID NO: 3550 - DNA, 1050 bp, Rattus norvegicus
  Genbank Accession No. NM_022224
atgtcttctttaagtggaaaagtacaaacagttctgggccccgtagaacccagccaactgggacgcaccctgacccatgagcatctgacgatggcctttgacagtttttattgcccacctcctccatgccaggaagctgcctccagggaacctatcatgatgaaaaatttattttggattcagaaaaatccttactcccatcaagagaatcttcagttgaatcaggaggtagaagccgtaagagaagaactgttgtatttcaaggctaagggcggaggagccgtggtggagaacacgaccactggactcagcagggatgtgcgtacgctgaagtggctggcagagcagactggagtccacatcatagctggtgctgggttttacgtagacgcaactcactttgcagcaaccagagccatgtcggtggagcagcttacagatgtcctcattagtgaaattctccatggagctgacggcaccagtatcaagtgtggagttattggagaaattggctgttcctggcctttgactgacagcgagagaaaggtacttcaggctacggctcacgcccaagctcagcttggttgtccggtgatcatccaccctggacggaacccaggtgcaccattccagatcatccgagtactgcaagaagcaggggcggacatctctaaaacggtcatgtcccaccttgacaggtctatatttgataagaaagaactgctggaatttgcccaacttggctgctacttggaatatgatctctttggtacggagctccttaattaccagctaagcccagatattgatttgcctgatgataacaaaggattaggaggggtccgttttctggtgaacgaaggctatgaagatcggattctcatggcacacgacatacacacaaagcatcgactgatgaagtacggagttcacgggtactcacacatcctcaccaacgtcgttcctaagatgctcctcagaggtctgactgagagggtgctggataagatactcagagaaaaccctaaacaatggctgacttttaaatag

SEQ ID NO: 3551 - DNA, 751 bp, Rattus norvegicus
  Genbank Accession No. NM_022245
tccggcccgggacattgcactaccctgcaagctgtgttgcagggcccggaaggctcactgttccgaaatggccgagcagtcagacaaggatgtgaagtactacactctggaggagattcagaagcacaaagacagcaagagcacctgggtgatcctacatcataaggtgtacgatctgaccaagtttctcgaagagcatcctggtggggaagaagtcctaagagagcaagctgggggtgatgctactgagaactttgaggacgtcgggcactctacggatgcacgagaactgtccaaaacatacatcatcggggagctccatccagatgacagatcaaagatagccaagccttcggaaacccttatcactactgtcgagtctaattccagttggtggaccaactgggtgatcccagccatctcagccctggtggtagctctgatgtatcgcctctacatggcagaagattaacctgtctgtccgaagccaaggaaggaaaagactgccccagagaggggagaaaagaagccagtgttaatcacttccactgacagaaaccctccccctgagaatgtaattgtaatatatctgtctccctctcctcctatgctaggagaacaaagatgggactctttgtactcttaaactttcaaatgtgcctttttactcaacttcattttgacatttcttcactacgtaatttacttattgtaaacatgatctttttaaataatatctggcttgtaaagt

SEQ ID NO: 3552 - DNA, 2345 bp, Rattus norvegicus
  Genbank Accession No. NM_022266
cacagctcttctctccaagaagactcagccagacccactccagctccgaccctaggagaccgacctcctccagacggcagcagccccagcccagtggacaaccccaggagccaccacctggagcgtccggacaccaacctccgccccgagaccgagtccaggctccggccgcgcccctcgtcgcctctgcaccccgctgtgcgtcctcctgccgcgccccgaccatgctcgcctccgtcgcgggtcccgttagcctcgccttggtgctcctcctctgcacccggcctgccaccggccaggactgcagcgcgcagtgtcagtgcgcagctgaagcggcgccgcgctgccccgccggcgtgagcctggtgctggacggctgcggctgctgccgcgtctgcgccaagcagctgggagaactgtgcacggagcgtgatccctgcgacccacacaagggtctcttctgcgacttcggctcccccgccaaccgcaagattggcgtgtgcactgccaaagatggtgcaccctgtgtcttcggtgggtccgtgtaccgcagcggcgagtccttccaaagcagttgcaaataccagtgcacttgcctggatggggccgtgggctgtgtgcccctgtgcagcatggacgtgcgcctgcccagccctgactgccccttcccgagaagggtcaagctgcccgggaaatgctgtgaggagtgggtgtgtgatgagcccaaggaccgcacagtggttggccctgccctagctgcctaccgactggaagacacatttggccctgacccaactatgatgcgagccaactgcctggtccagaccacagagtggagcgcctgttctaagacctgtgggatgggcatctccacccgggttaccaatgacaataccttctgcaggctggagaagcagagtcgtctctgcatggtcaggccctgtgaagctgacctagaggaaaacattaagaagggcaaaaagtgcatccggacgcctaaaattgccaagcctgtcaagtttgagctttctggctgcaccagtgtgaagacctaccgggctaagttctgtggggtgtgcacggacggccgctgctgcacaccgcacagaaccaccacactgccggtggagttcaagtgccccgatggcgagatcatgaaaaagaacatgatgttcatcaagacctgtgcctgccattacaactgtcccggggacaatgacatctttgagtccttgtactacaggaagatgtatggagacatggcgtaaagccagggagtaagggacacgaactcatttagactataacttgaactgagttacatctcattttcttctgtaaaaaaacaaaaaggattacagtagcacattaatttaaatctgggttcctaactgctgtgggagaaaacaccccaccgaagtgagaaccgtgtgtcattgtcatgcaaatagcctgtcaatctcagacactggtttcgagacagtttagacttgacagttgttcactagcgcacagtgacagaacgcacactaaggtgagcctcctggaagagtggagatgccaggagaaagacaggtactagctgaggtcattttaaaagcagcgatatgcctactttttggagtgtgacaggggagggacattatagcttgcttgcagacagacctgctctagcaagagctgggtgtgtgtcctccactcggtgaggctgaagccagctattctttcagtaagaacagcagtttcagcgctgacattctgattccagtgacactggtcgggagtcagaaccttgtctattagactggacagcttgtggcaagtgaatttgccggtaacaagccagatttttatggatcttgtaaatattgtggataaatatatatatttgtacagttatctaagttaatttaaagacgtttgtgcctattgttcttgttttaagtgcttttggaatttttaaactgatagcctcaaactccaaacaccatcgataggacataaagcttgtctgtgattcaaaacaaaggagatactgcagtggaaactgtaacctgagtgactgtctgtcagaacatatggtacgtagacggtaaagcaatggatcagaagtcagatttctagtaggaaatgtaaaatcactgttggcgaacaaatggcctttattaagaaatggcttgctcagggtaactggtcagatttccacgaggaagtgtttgctgcttctttgactatgactggtttgggaggcagtttatttgttgagagtgtgaccaaaagttacatgtttgcacctttctagttgaaaataaagtatatatatttttataaaaaaaaaaaaaaaa

SEQ ID NO: 3553 - DNA, 2715 bp, Rattus norvegicus
  Genbank Accession No. NM_022268
ccgccacccgcaaccatggcgaagcccttgaccgaccaggaaaagcgacggcagatcagcatccgcggcatcgtgggcgtggagaacgtagcggagctgaaaaagggcttcaatcgtcacctgcacttcactctggtcaaggaccgcaatgtggccaccccccgcgactactacttcgcccttgcgcacacagtgcgcgaccacctggtggggcgctggatccgcacacagcagcactactatgacaagtgccccaagagggtgtattacctctctctggaattttacatgggccgaacattacagaacaccatgatcaaccttggcttacagaatgcctgcgacgaagctatttaccagctcgggctggacatggaggagttggaagaaattgaagaagatgctgggcttggcaatggtggtcttgggaggcttgctgcctgcttcttggactccatggcaacgctggggcttgcagcctatggatacggcatccgttatgaatatggaatcttcaatcagaagatccgagaagggtggcaggtagaggaggcagatgactggctcaggcatggaaacccttgggagaaggctcgtcctgaattcatgctgcctgtgcatttctacggaagagtagagcacacccaggcaggaacaaagtgggtcgacacccaggtggtgctggctttgccgtacgacacccccgtacctgggtatatgaacaacacggtgaacactatgcgcctctggtcggcccgagcacccaatgactttaaccttcaagactttaatgtcggagactacattcaggctgtgctggaccggaacctggctgagaatatctccagagtgctgtaccccaacgataacttttttgaagggaaggagctgaggctgaagcaggagtactttgtggtggctgcgaccctgcaggatgtcatccgacgtttcaaggcctccaagttcggctccaaggatggtgtaggaaccgtgtttgatgcttttccagatcaggtagccatccagctgaatgacacacatcccgcactcgccatcccggagctgatgaggatctttgtggacattgaaaaattgccctggtccaaggcctgggagatcaccaagaagacctttgcctacaccaaccacacggtgctcccggaggccctggagcgctggccagtggacctggtggagaagctgctgcctcgacacttgcagatcatttatgagatcaatcagaagcatttagatagaatcgtggccctgtttcctaaagacatcgaccgcatgcggcggatgtctctcatcgaagaggaaggaggcaaaaggatcaacatggcccacctctgcatcgtgggctgccacgcggtgaacggggtagcgaagatccactcggacatcgtgaagacccaagtattcaaggacttcagtgagctagaaccagacaagttccagaataaaaccaacgggatcaccccgaggcgctggctcttactctgcaacccagggctggctgacttgatagcagagaaaattggagaagactatgtgaaagacctgagccagctgacgaagctccacagcttcgtgggcgacgacatcttcctccgggaaatagccaaagtgaagcaggaaaataaactgaaattctcccagttcctggaaaaggagtacaaggtgaagatcaacccatcttccatgtttgacgtgcacgtgaagcggatccacgagtacaaacgacagcttctgaactgcctgcatgtgatcaccatgtacaatcgcatcaagaaagaccctaagaagttcttcgtgccaaggacagtcataattggtgggaaagctgccccaggatatcacatggccaaaatgatcataaagctggtcacctccgtggcagaagtggtgaacaacgaccctatggttggcagcaagttgaaagtcatcttcttggagaactacagagtgtctcttgctgaaaaagtcattccagccacggacctgtcagaacagatctccactgctggcacggaagcctcggggacgggcaacatgaagttcatgctgaacggggccctgaccatcgggactatggatggggccaatgtggagatggcggaggaggccggggaggaaaacctgttcatctttggcatgagggtagatgatgtggccgctctggacaagaaagggtatgaggccaaagaatattatgaggcccttccagaactgaagctggtcattgaccaaattgacaatggcttcttttctcccaatcagccagacctcttcaaagacatcatcaacatgttattttatcatgacagatttaaagtctttgcagactacgaagcctatgtcaagtgtcaagaaaaagtcagtcagctgtatatgaatcaaaaagcctggaacacaatggttctcagaaacatagctgcctcggggaagttctccagtgaccgaacaatcagggagtatgccaaggacatctggaacatggagccttccgatctgaagatctccctatctaaggagtccagcaatggggtcaacgccaatgggaagtaaatgctaaaatatattcttattcaataacttcttactggacttgagtactcttagagcttccctgagtctgttttgttattgaatggttagtaaatgtatttctgtattagagctaaaaataaaatgtcaacttcgagttgtcaaaaa

SEQ ID NO: 3554 - DNA, 3711 bp, Rattus norvegicus
  Genbank Accession No. NM_022287
gaagctgctgcacctggagcacccacccctctgtagaggggagttgatcagaggcccacataaccgtaattacttgtgagcctctgattatagtacaacttgctggattagctcaccggattagccgctcaggtaacactcatttgactggggaaacccatgactcagctatcttttgggtaaataatttaacagtgagcccagcggagtattctccacgggtcagcctcagaagtgcctctgtctgttaagagaagccagggtgattggaggatcagcccgccagcaagctgctgcccccagatattgcaaagcctacagagccggcctggtgtcccagattagccaaagagcctggtgtgacaggatggatgcttctcctgagcccccgcagaagggcgggacactggtactggtccgacggcagccccctgtgtcccagggcttgctggaaacactgaaggccaggctgaagaagagctgcacctgcagtatgccatgcgctcaggctctggtgcaaggtctgtttcctgtcatacgctggctgccccagtaccgccttaaggaatacctggcaggtgatgtcatgtcgggattggtcattggcattatcctggtgccacaggccatagcctactcactgctggctgggttgcagcccatctacagtctctacacttccttcttcgccaaccttatctacttcctcatgggtacctcccgccacgttaatgtgggcatcttcagcctgctgtgtctcatggtgggtcaggtggtggaccgagaactccagttggctggctttgacccctcccaggattctctagggcccgggaacaatgacagcaccctcaacaacacagccacactgacagttgggctacaggactgtgggcgggactgccatgccattcgtatcgccactgccctcactctgatggccgggctttatcaggtcctcatggggatcctccggctgggcttcgtgtctacctatctctcgcaacccctgctcgatggctttgctatgggagcttctgtgaccatcttgacttctcaggctaaacacctgctgggcgtgcggatccctcggcaccagggcctaggcatggtgatccacacttggctgagcttgctgcagaacgtgggacaggctaatctgtgtgatgtggtcaccagtgccgtgtgcctggcagtgctgctgacagctaaggaactctcggatcgctatcgacactatctgaaagtgccagtgcccacagagctattagttattgtggtggccacgattgcgtcccattttggacagctccatacacggtttggctcgagtgtggccggcaacattcccactggttttgtggccccacagataccagaccctaagataatgtggagtgtggccctggatgccatgtccctggccctcgtgggctcagccttctccatctccttggcagaaatgtttgcacgtagtcatggctactctgtcagtgccaaccaagagctgctagctgtgggctgttgcaacgtgctgcctgccttcttccactgttttgccactagtgctgctctgtccaaaactctggtgaagatagccactggctgccagacccagttgtccagtgtggtcagtgctgctgtggtgttgctggtgctgctggtgctggcgccattgtttcacgatctgcagcggtgtgtgttagcttgcatcattgtcgtcagcctgaggggggcgctgcgcaaggtgaaggatctcccacaactttggcggctaagccctgcggacgcactggtctgggtggctactgcagcgacctgtgttctagtcagcatcgaggctgggctgttagctggggtgttcttctcactgctcagcctggcaggccgcacgcagcgtccacgggctgcccttctggctcgaattggagactcgaccttctatgaggatgctgctgagtttgagggcctcctgcccccgcccgaggtgcgagtgttccgtttcacaggtccgctctactatgccaacaaggatttcttccttcggtcactctacagtctgacagggctggatgctgggtactcagccaccaggaaggatcggggcacagaggtgggtgtcagtaacagaagtcttgttgaccgcaaggatctgggttcagtgagcagtggggatgggctggttgtacccctggcatttggtttccacacagtggtcattgactgtgcaccactgctgttcctggatgtggctggcatggccacattgaaggacctgcgcaaaaactacagggccctggacatcaccctgcttctggcttgctgcagtccctcagtgagagacacactgagaaaagggggcttccttggggaagaccagggaactgcagaggagctgctgttccccagtgtacacagcgctgtggagacagcatgtgcccgccgtgaggagctgatggctgctgactctgccctctagcagggcccgcttcctcaagagccaagacctgtgtccacgagccagtcctgagctcttttgtaggagtgacatgaatgataaagtcattatagataaatccttggaccgcctttgccctggagaagccagggaactccaagtaggaaaggaaagtgcagtacccttaacacattggaggattccaaacattcagtgattgaggcgctctacctctgagcccactgctgccccctggtgcctattcaaccctagtagttgcacccacacacatgattccctcagccaacacagtgcccagtttgatagtctgtttatgttgtcatctgaaacagagtcctgcaaattatatgacctccatgatgccaaaaggacactttcccattccctgaaccatcgggtaccagatgtgagctggatatgtggccacacctcaagggtctgaatttccgaaaggcctccttaggcctggtgctcatcttgattggacccttgcaaaggcagccacctgctccagagtcacagtccagtgtcactgtctaaccgatgtgactgacataacctcaacctgactttcgggcacaatgtcccaatacagcttatactggtaaccacaacgtggcgtatgtatggtacaaagccaggcacagtagacacttaccccattctgctgtacttctaagaaaacctcaggaggaaaccacctgtgctccatccagggcctgcctttggcacagccaagcagacattcccctcctcctctgcccaacaggatgctctaactggaagcacaccccagccctgtgcactaccatgattctcccccacccacagcccagcattgtgttccacagctggccccaaaaacgtcagctccaccatctcggctctcttaaaacaagctctgaccagcaattcccagggtacccatttcagcgtcacccacctggctgtgatgaggtccagcagccagtgtatccggacctgctcaatgccactgtgaggcacagcacctatgtaggcaaggttcagttgctggtcccaactaaggtcgtactggtcagcctggtcgtgaggcagtggggggctagggataggacaaagaagtgaagtgtttgtcctaagcaggggcctgcatcataccagactttacacatgttatcacctgactacctagacccttgaggatgaactgtgtatctccagaatgtatgataaagtagcccactaaccag

SEQ ID NO: 3555 - DNA, 1773 bp, Rattus norvegicus
  Genbank Accession No. NM_022289
cgcccgggcaagtcgcgggaacctgcctgggtggctgtgccaaggcacagagtggctcgtctccagcggagggtcacatgaggagtccgagtgtccgggcaggacgggaccagccgtagtcgaagaggagccgccttcctccactcggcagcgcggggtcgcggagcgcaccaagatagtgaattcctgagaagaaaacaatgaactgcatcttggttgttctttaagtatttggacttaaaggtatacaagtttgttgccaagaccaaagaagatggcaaccccttatgtcccagttccgatgccaatcggagactctgcttccagctttacaaacaatagaaatcagaggagctcttcctttggcagtgtgtcaacaagctcaaactcttccaaaggccagctagaagactcaagtgtgggcacttgtaggcacacgaatgtccaggatcagatggacagtgcatcatcagtctgcggcagtcctctcattagaactaaatttacaggtacagattcgtccattgaatattctgctagaccaagagacactgaagaacagcaccctgatgcactgaattgggaagatagaccctcaacacctacaattctgggttatgaagttatggaagagcgggccaaatttactgtatataaaatcctagtaaagaaaagtccagaagaaagctgggtagttttcagaagatacactgacttctccaggcttaatgacaaattaaaagagatgtttccaggctttcgattagcacttcctccaaaacgctggtttaaagataattacaatgcagactttctagaagacagacaattaggactacaagcgtttcttcaaaacttagtagctcacaaagacatcgctaactgccttgcagtgagagaatttctttgtctggatgatccaccaggtccatttgatagcctagaagaaagcagggctttctgtgagactttagaagagactaactaccatttacagagagaactacgtgagaagcaaaaagaggtggaatccctgaagaaactgcttggggaaaagcaacttcacatagatgcgttagagaccagaatcagaacattgtccttagaaccgggagcatcactgtatgtgtcgagagcagaaggtggacagatcctaagggtgcagtcctctgtacttcaagtcaatcgggatgtcttggatgaagaatctagagctgatcataagccacacttcaactctagagaagccggaagtgcaatagcagacatagaagtcgcacagttggcatataatgctgaagatgactaacacactggtgactgctccctccatttcatcattttagcagatttcagcagagtggcaaatgccaccctcaaagactgaaacagaagagaacaagaatgcacgtgtataaagtttacataatttgtttttttagttattggataggaactgtattcactgctgctttcgatatcttttatccagcgttgtatttactacattgaaaaaatatacagttagaattgttatcaagacccatgttcttaaaaactttacataaattattacagtgtcttgcctgtatattgctccaaactactgtgttagtgtatatgtgtgtgcttgcttgtcctaaatcaccacttatattaggtgaaaattaattgcatgttagaatctgggtaatttctctatctcagatatgatatagatttaaatcagtgaacaccacaggaaagataaataagaatccagtttgaaatgtt

SEQ ID NO: 3556 - DNA, 3008 bp, Rattus norvegicus
  Genbank Accession No. NM_022297
  misc_feature (1)..(3008): n = a or c or g or t
ccacatgatttattacaatcatctcctcaatagccacactatttattttatttcaattaaaaatttcttcccaaacctttcctgcacctccctcacccaaaactatagccacagaaaaaacgaataacccttgagaatcaaaatgaacgaaaatctatttgcctctttcattacccccacaataataggtctaccaattgttgtgaccattattatgttcccatcaattctattcccatcatcagaacgcctaatcagcaaccgactacactcatttcaacactgactaatcaaacttatcatcaaacaaataatgttaatcggagccgccgggcgctcgcaggctcgcaggctcgcaggttgggcgcgcgctgctctcgggaagacccggccaccgagccaaaccccgccgccgcctctccgcgcgagccatggccggcctcagccacccctcggtcttcggccgggccacccacgccgtggtgcgggctccgcccgagtccctgtgccgccacgcgctgaggcgctcccagggcgaagaggtggatttcgctcgcgctgagcgccagcaccagctctacgtgggcgtgctgggcagcaagctggggctgcaggtggtgcagctgccggccgacgagagcctgcctgactgcgtgttcgtggaggacgtggccgtggtgtgcgaggagaccgccctcatcacccgccccggggcgcctagccgcaggaaggaggttgacatgatgaaagaggctttggaaaaacttcagctcaacatagtagagatgaaagatgaaaatgcaaccttagatggtggggacgtcctattcacaggcagagagttttttgtgggcctttccaaaaggacaaatcaacgaggtgctgagatcttggctgatactttcaaggactacgcagtttccacagtccccgtggccgattctttgcatttaaagagtttctgcagcatggctggccccaacctgatcgcaatagggtccagtgaatctgcgcagaaggccctcaagatcatgcaacagatgagtgaccaccgttatgacaagctcactgtaccggacgacatggccgccaactgtatatatttaaatatccccagcaaagggcatgtcttgctgcaccgaaccccagaagagtacccagaaagcgcaaaggtttatgagaagctcaaggaccatctactgatccctgtgagcaattctgagatggaaaaggtggacggcttgctcacctgctgctccgtttttattaacaagaagacagactcttgagcggaagagtccctcccgagcggccggcgagtggcctaggccaggctgatgatggctctgtacccattcctcctgtttcctttgacaatctactgtgccactaactcttgtttacaaagaattccaatcttaatcgcctcatttccccacacccccctcttcctcacggggccccctaacctgtgcacacatttgctcaatgaactaagcaacctaggaaatacagaactaacgaatcattggaatgtgattgatagcgtggaggcactcactccagcctctgtgtccttagtgtgggaatagtttagatgcagggcatcctgaaggactgacctcctgggcagacagataaacaagcaagggactttctttgcttcatgagttgcgtttggttcctgtgagagtcctgagaacgtggattttttcccattcccctctcttctcacctctaaaacactttcttccaggtcttcctttggccttcctcacttctttcgtaatcaccttgaacctggatttatccaaggtctcgaactctggataccctcctaacgtccaccctgtctacgtgcagtcctctcctcctcacagccacaacttctgccaccaccagcaaatcagagtggctggttggagacgaggaacctcacagaggcacatcctgacagggtttcccattagcacacctaggaaggtaaattcaggtggttgatacaggatgttagatacagaagcctagaaacacccccatgggtacatctcagagagactgagtcactgccatgattttgcctcatgactggtcctataggagcgtggaggaaagtctttctccaccccaccacctccccctttttcagcttccttctgactcaaccttgtatctacccccttagaatcaccatgattttgaaaagtcatttccttcaaaagaggcagaacatctaatgattgttgacggtctggtaagagctagagggaactgcctccacccaaggcctaggagcacaatcaggaaatggttcctaaagtcaacttcaaacaatgtgtgagtctcctttgaaatatccatgactgtttactgtggaattcaaccgaaacttcaaattacacaactttcannagacgcaggtctctcacagggaacaataccacagcaaaggaattcctttcttgaaagctgaaacaggccaaggacatggtaccttacaaggcacggtgacccagccaggcatctcatcaaacttctggtcacttctaccttggctgtatagcctgcagtctgtcattcgatatttaaagttggggagacaaaggctatgtcagctctagctctccttacctctctttgtgatcagtgtttcttctagtgaaggcaagagagactgggcctcatctcgtccccctcagtggccggaagtgagaaaatcaagacttcctttaccgcccttctcttagttggcaacctctctgaagaggtctccatctctcccttgctgtctaactctagactcatatcgcatgccaatatctaactgtacaccctgtgaatgaaccatatcctggtcactgtcacatttcacagcgtatcacaggtgaacagttatgccttctccagggcaagggaatatgagacagttgcctaaattcataaagaaaaattgttctcagccattatggttgccttgaggggttaaagttgaccccacctacactagc

SEQ ID NO: 3557 - DNA, 1617 bp, Rattus norvegicus
  Genbank Accession No. NM_022298
gcgctgtaagaagcaacacctcctcctcgcctccgccatccacccggcagccgcgaagcagcaaccatgcgtgagtgtatctccatccacgtcggccaggctggtgtccagatcggcaatgcctgctgggagctctactgcctggaacatggcatccagcctgatggccagatgccaagcgacaagaccattgggggaggagatgactccttcaacaccttcttcagtgagacaggagctggcaagcacgtgccccgggcggtgttcgtagacctggaacccacagttattgatgaagttcgcactggcacctaccgccagctcttccacccagagcagctcatcacaggcaaggaagatgctgccaataactatgcccgtggccactacaccattggcaaggagatcattgaccttgtcttggacagaattcgcaagctggctgaccagtgcacgggtctccagggcttcttggttttccacagctttggtgggggaactggctctgggttcacctccctgctgatggagaggctctctgtcgactacggaaagaagtccaagctggagttctccatttacccagccccccaggtttccactgctgtggttgagccctacaattccatcctcaccacccacaccaccctggagcactctgattgtgccttcatggtagacaatgaggccatctatgacatctgtcgtagaaacctcgacattgagcgcccaacctacactaacttaaacaggttgataggtcaaattgtgtcttccatcactgcttccctcagatttgatggggccctgaatgttgatctgacagaattccagaccaacctggtgccctaccctcgcatccacttccctctggccacttatgcccctgtcatctctgctgagaaagcctaccatgaacagctttctgtagcagagatcaccaatgcctgctttgagccagccaaccagatggtgaaatgtgaccctcgccatggtaaatacatggcttgctgcctgctgtaccgtggtgatgtggtccccaaagatgtcaatgctgccattgccaccatcaagaccaagcgtaccatccagtttgtggactggtgccccactggcttcaaggttggcattaattaccagcctcccactgtggtccctggtggcgacctggccaaggtccagagagctgtgtgtatgctgagcaacaccacagccattgctgaggcctgggctcgcctggatcacaagtttgatctgatgtatgccaagcgtgcctttgtgcactggtacgtgggtgagggcatggaggagggagagttctctgaggcccgtgaggacatggctgccctagagaaggattatgaggaggttggtgtggattctgtggagggtgagggtgaggaagaaggagaggaatactaaattaaatgtcacaaggtgctgctttcacagggatgtttattctggtccaacatagaaagttgtgggctgatcagttaatttgtatgtggcaatgtgtgctttcatacagttactgactttaagtgtgaatgatttgtcagagacccgagccgtccacttcactgatgggttttaaataaaatactccctgtctta

SEQ ID NO: 3558 - DNA, 2671 bp, Rattus norvegicus
  Genbank Accession No. NM_022380
ccgccggcgctcggtggtcctgcactgggagggagcaagcgggcgcgcgagagagcgtgcggggccggaaagaccgctggctctggtggggcagaacgaggttgtaagccatggcaatgtggatacaggctcagcagctccagggcgatgcccttcatcagatgcaggccttgtacggccagcatttccccatcgaggtgcgacattatttatcccagtggatcgaaagtcaagcctgggactcaatagatcttgataatccacaggagaacattaaggccacccagctcctggagggcctggtgcaggagctgcagaagaaggcagaacaccaggtgggggaagatgggtttttgctgaagatcaagctggggcactatgccacgcagctccagaacacgtatgaccgctgccccatggagctggttcgctgtatccggcacattctatacaatgaacagaggctggtccgagaagccaacaacggaagctctccggctggaagtcttgctgacgccatgtcccagaagcaccttcagatcaaccaaacgtttgaggagctgcgtctgatcacacaggacacggagagcgagctgaagaagctgcagcagacccaagagtacttcatcatccagtaccaggagagcctacggatccaagctcagtttgcccagctggcccaactgaacccccaggagcgcatgagcagggagacagccctccagcagaagcaagtgtccctggagacctggctgcagcgagaggcacagacactgcagcagtaccgcgtggagctggctgaaaagcaccagaagaccctgcagctgctgaggaagcagcagaccatcatcctggacgacgagctgatccagtggaagcggcgacagcaactggccgggaatgggggtcctcctgagggcagcctggatgtgctgcagtcctggtgtgagaagctggccgagatcatctggcagaaccggcagcagatccgcagggctgagcacctgtgccagcagctgcccatcccaggccccgtggaggagatgctggccgaggtcaacgccaccatcacagacatcatctcagccctggtcaccagcacgttcatcatcgagaagcagcctcctcaggtcctgaagacccagaccaagttcgcggccaccgtgcgcctgctggtgggcgggaagctgaacgtgcacatgaaccctccgcaggtgaaggcaaccatcatcagcgagcagcaggccaagtccctgctcaagaacgagaacacccgcaatgattatagcggcgagatcctgaacaactgctgcgtcatggagtaccaccaggccacaggcaccctcagcgcccacttcagaaacatgtccctgaaacgaatcaagaggtctgaccgccgtggtgcagagtcggtcacggaagagaagttcacaatcttgtttgactcacagttcagtgttggtggaaatgagctggtctttcaagtcaagaccttgtcgctcccggtggtggtgatcgttcacggcagccaggacaacaatgcgacggctaccgtcctctgggacaacgcctttgcagagcctggcagggtgccatttgccgtgcctgacaaggtgctgtggccgcagctgtgtgaggcgctcaacatgaagttcaaggctgaggtgcagagcaaccggggcttgaccaaggagaacctcgtgttcctggcacagaaactgttcaacagcagcagcaaccacctcgaggactacaacagcatgtccgtgtcctggtcccagttcaaccgggagaatctgccaggacggaattacactttctggcagtggtttgacggtgtgatggaggtgttaaagaaacatctcaagcctcactggaacgatggggccatcttgggtttcgtgaacaagcagcaggcccacgacctgctcatcaacaagccagatgggaccttcctgctgcgcttcagcgactcggaaatcgggggcatcaccattgcttggaagtttgactcccaggagagaatgttttggaatctgatgccttttaccacaagagacttctctatccggtccctcgctgaccgcctgggggacctgaattacctcatatacgtgtttcctgatcggccaaaggatgaagtatattctaagtactacacaccagtcccgtgtgagcccgccaccgcgaaagcagctgacggatacgtgaagccgcagatcaagcaagtggtccccgagtttgtcaatgcttctgcagatgcagggagcggcgccacctacatggaccaggctccttccccagtggtgtgccctcaggctcactataacatgtacccacagaatcccgactctgtcctcgataccgatggggatttcgatctggaagacacgatggacgtggcacggcgtgtggaagagctcttaggccggcccatggacagtcagtggatccctcacgcgcagtcatgaccagacctcaccgcctgcagcttcactgtcctcctggaggacccttcctgtggatgttttaattccatgaatcgcttctctttggaaacaatattcgtaatgtgaagtgttaatactagtcgtgactttagtgtctctgtgcatagtggcactagtgaagggagtgtgcgtgagtgtgagtgtgtgagtttgcacgttgt

SEQ ID NO: 3559 - DNA, 1160 bp, Rattus norvegicus
  Genbank Accession No. NM_022381
ttgtcagcaagacctcgctccccttacagtaactctcatctagacgtcgcaactccgccaccatgtttgaggcacgcctgatccagggctccatcctgaagaaggtgctggaggccctcaaagacctcatcaatgaggcctgctgggacatcagttcgggcggcgtgaacctacagagcatggattcgtctcacgtctccttagtgcagcttactctgcgctccgaaggcttcgacacataccgctgcgatcgcaacctggccatgggcgtgaacctcaccagcatgtccaaaattctaaaatgtgctggtaatgaagacatcattacattaagggctgaagataatgctgataccttagcactagtatttgaagcaccaaatcaagagaaagtttcagactatgagatgaagttaatggacttagacgttgagcaacttggaatcccagaacaggagtacagctgcgtagtaaagatgccatctggtgaatttgcacgtatatgccgggaccttagccatattggagatgctgtggtgatctcctgtgcaaaggacggggtgaagttttctgcgagtggggagcttggcaatgggaacattaagttgtcccagacaagcaatgttgataaagaagaggaagctgtgtccatagagatgaatgagccagttcagctaacttttgctctgaggtacctgaactttttcacaaaagccactccactgtctcctacagtaacactcagtatgtctgcagatgtaccccttgttgtagagtataaaattgctgacatgggacacttaaagtattatttggctcccaagatcgaagatgaagaaggatcttaggcgttgctagaaattgagaaactaaacctttgacgatcgcttctgagatgccagcgtgttctgaggtcttttctgtcaccaagtttgtacctgagtattcttaaatattaaaataaaatgtagatatcttctgtaaataaccttttttttcctctccataatttgcttacagaataagctccaaagtaaaaactggttttgttaacataaatgtctctgccttacaaatactggtgattttcataaatgatcttgacgctaaatgcagttttaagaaatatttttcaatttaaataaagttaactgaatttg

SEQ ID NO: 3560 - DNA, 1460 bp, Rattus norvegicus
  Genbank Accession No. NM_022383
gtccgaagcaggtggaacattatggctgacatgcaaaatcttgtagaaagattggagagggcagtgggccgcctggaggcggtgtcacatacttctgacatgcactgtggatatggagacagtccttcaaaaggagcagttccatatgtgcaagcatttgactcgctgcttgccaatcccgtggcggagtacttgaagatgagtaaggagattgggggagatgtgcagaaacacgcggagatggtccacacaggcctgaagttggagcgagctctcctggttacagcttctcagtgccagcagccagccggtaataaactctcggatttgttggcccctatctcggagcagatccaggaagttataaccttccgggagaagaaccgaggcagcaagtttttcaatcatctatcagctgtcagtgaaagcatccaggccctgggctgggtggctctggctgcgaaacccggcccctttgtgaaagagatgaatgatgccgccatgttttacacaaaccgagtcctcaaggagtacagagatgtggataaaaagcatgtggactgggttagagcttacttgagtatatggacagaactgcaggcttacatcaaggagttccataccactggcctggcctggagcaagacggggcctgtggcaaaagaactgagtggattgccatctggaccctctgtgggatcaggcccacctcctcccccaccaggccctcctcctcccccagttcctaccagttctggctctgacgactctgcttcacgctcagcactgtttgcacagattaatcagggggaaagcatcacacatgccctgaaacatgtatctgatgacatgaagactcacaagaaccctgccctgaaagctcagagtggtccagttcggagtggccccaaaccattctctgcacctaaaccccaaactagcccctcccccaaaccagccacaaagaaggagccagctctgctggaactggaaggcaagaaatggagagtggaaaaccaggagaatgtttccaacctggtgatcgatgacactgagctgaagcaggtggcttacatctacaagtgtgtcaacacgacattgcaaatcaagggcaaaatcaattccattacagtagataactgtaagaagcttggcctggtgtttgatgacgtggtgggcattggtgagataatcaatagtagggatgtcaaagttcaggtgatgggaaaagtgccaaccatttccattaacaaaacagatggctgccacgcttacctgagtaagaactccctggactgcgagatagtcagtgccaaatcttctgagatgaacgtcctcattcctacagaaggcggtgattttaacgagttcccagtccctgagcagttcaagaccttgtggaacggacagaagttggtcaccacagtgacagaaatcgctggataagtgaattgcatggg

SEQ ID NO: 3561 - DNA, 893 bp, Rattus norvegicus
  Genbank Accession No. NM_022385
cagtggacgtggcggcgccccggctcaattaggagtcgctgccgagtcccggcctgtcactgaggatcggcgagggcgcggcggcggtccatcatgggtggctttttctcaagtatattttccagtctctttggaaccagggaaatgaggattttaattttgggattagatggtgctggaaaaacgacaattttgtacagattgcaggttggagaagttgttactaccattcccactattggatttaatgtagagacggtgacatacaaaaatctcaagttccaagtttgggacttaggcggacagacaagtatcaggccatactggagatgttattattcaaacacagatgcagtcatctatgtcgttgacagttgtgaccgagaccgaattggcatttccaagtcagagttagttgccatgttggaggaagaggagctgaggaaagccattttagtggtgtttgcaaataaacaggacatggagcaggccatgacgccctcagaaatggccaatgcgcttgggttacccgccctgaaggaccggaagtggcagatctttaaaacgtcagcaaccaaaggcaccggcctcgacgaggcaatggaatggttagttgaaacactgaaaagcagacagtgagtccattcacatcagcgcctgtgaaccaaacgctccgtcacagactcactgaaccagtcagatgtacttctcgtgactggtggaagggactgtgtgattctagcatatacagacctgacttcactatttgtaataaatataaaaagcaagtatctggtgagagggttagcttgatcgaatcacccaaatggtttatgtaatgtaaaatatttcttccttgttttcttgtgttaaggtatatattctatttgtat

SEQ ID NO: 3562 - DNA, 1362 bp, Rattus norvegicus
  Genbank Accession No. NM_022388
ctcacctagctcgggtcatctccaggggcactgaaacacagaggcattacctactaagtcacacacctggtaagtggatgtgagggaactgagcccagccagtaggtactggatctgtgatctcattagtagaccagagctaagtacagtagatagtaaccgggacttcagaacggaacctttgacaacagctgccattatacagaaagaagggatagggctttttctaaaactcagctacacaagggctatcacatacaacttgtaaatggggcctggaggaggacctggaggaggagaagggggctatgtctcacacactaatagacctttctagcaggtacctgtgctctgagtagatctgaggctgcttggagcaggcagagttcctggctgtagacatggaggctggaactgcaccctccagacctgttgctaaattctgagataatgtgtgacccaacctggttcctctggggccagatcttttcaagagtcaggacccagacacctggttaggaaagcctagcttaggacaagacctctcactcctagggaggacagacatctcccctggagtgtttgattttacctttgtgagttcccacctctgagaaagagatgatagtatctttataaagctcttcacgaagcccaatgtggtcactacagggtgttctgaacacgtaactagaattaagcaatccacatacccaggtaattaatcactagtgccatctgtagatgttaaagcggaaagcaatccttttcttcagataagcgcttgcccatgtggaattcgcatacctaattttcacaccagttctgcctcctcctagtggcgtgagctgtggcaggtcacagatcccagacccacctctgctctgcagcccacccagcagcctgcagcctcgccctgggttgatatggagggaataacctgtgcctttctcctggtgctagcaggtctgcctgtcttggaagccaatggtccagttgataaaggcagtcccttctactacgactgggagagcctgcaactgggaggaatgatctttggggggctcctgtgcatcgctggaattgccatggccctgagtggcaagtgcaaatgtaggcgcaaccatacgcccagttccttacctgagaaagtcactccactcatcactccaggctctgccagtacctgacgaactgaacacaggaccaagtttggaggcagctttttgatgacttcctgctgtatctcccctctggagatcttcctctccaaaatggcttccctagagcacacttaagtcttcagtgacagggaagggtgttccaaagttgattttatattaaactggtcttgctgctctg

SEQ ID NO: 3563 - DNA, 2427 bp, Rattus norvegicus
  Genbank Accession No. NM_022389
cgcacgcagaacctgcggtgggcgatcaggtactgagaaagctaccaaggttgcctgctctactcagcacttgagccctggtggaggtctatctttctggaaggatctgagcctctcctccttccctcagatcctgatggcttcaaagtcccagcacaacgcttccaaagccaagaatcacaacgtcaaggctgaatctcaaggacaatggggccgtgcctgggaagtggactggttctccctggtcagcgtcattttcctgctgctcttcgcaccgttcattgtgtactacttcatcatggcatgtgaccagtacagctgctcgctgactgcccccatattggacgtagctacaggccgtgcgagtctggcagacatctgggccaagacaccgcctgtgacagctaaggctgcccaactgtatgccttgtgggtcagcttccaggtgctgctttactcctggcttcctgacttctgccacagatttctgccaggttatgtgggaggcgtccaagaaggtgccataactccagcagggattgtaaataagtatgaggtgaatgggctgcaagcctggctcattacccacttcctctggtttgtgaacgcttacctcctatcctggttctcccccaccatcatctttgacaactggatcccgttgctatggtgtgccaacatcctgggctacgctgtgtccacctttgcaatgatcaaggggtacctgttccccaccagcgccgaagactgcaaattcacaggcaatttcttctacaactacatgatggggattgagttcaacccccgcatcggaaagtggtttgacttcaagctgttcttcaatgggcgcccggggattgtggcctggactcttatcaacctgtcctttgctgccaagcagcaggagctttatggccatgtgaccaactccatgattttggtcaatgtcttacaggccatctatgtgttagacttcttctggaacgaaacctggtacctgaagaccattgacatctgccatgaccactttggatggtacctgggctggggagattgcgtgtggctgccctacctctacacactgcagggcctgtacttggtgtaccaccctgtacagctctccacccccaacgccttgggcgtcctgctgctcggcctggtgggttactatatcttccgaatgaccaaccatcagaaggacctgttccgccggacagatggacactgcctcatctggggcaagaaacccaaggccatcgagtgctcctacacgtcagccgacgggctgaagcaccgcagcaagctgttggtttcaggcttctggggtgtggcccgccacttcaactatacgggagacctgatgggcagcctcgcctactgcctggcttgtggcggcggccacctcctcccctacttctacatcatctatatgactatcctgcttacccaccgctgcctccgtgatgagcaccgctgtgccaacaagtatggccgtgactgggagcgctacgtagccgctgtgccctaccgcctgctgcctgggatcttctgagggccaccctggcaagcagaaagaggcgtcattgaatgtgtggagttgggtgcatgggggccagcatccggctttcccctgcaggggcctccttggtttgctcttctggaggatggagagccaggcgccccacagtgtctggctggtggcaactagagctgagttcacactgatgcctcagcagaatgactggttctccctgttcagcatcctgagggcagaggaccttggccctttcatgtctgttggaagcccaccatctatgttgtctagatagcttaggcttaccaggtgtctcccaggattgggccatcctggtaaactggagacaatgtaggatctaaagagttttggcaatgtcaccttcactcccacctgcaatggtgggctggacccctttttctgtctgtagcgtgatcagcagagggttcaggggccattgaaggaggaaggctctttgtttaggttctttactgtttttacccgaggaatgccaagcagcagactggaatatcccactctgcacatccctggctgacttgataaagtctgtctgacatatgagatggggttcccagaactccccaagtaccccagctagcagcttatccatctcccctcttccggaaggtgcttcttgtttacccctgagacttggctcagaggtgaacagacttggctctgacaacccagaatgtatcaccagttagtggcctcagccacaccttccccaacaggagaaccagcgttggggaaggaatccattctcattagtgacactgccccccaaaactcagggttattttgtaaaactagataggctcatgttagccttgcaagcggttctttgtattaaatctgccctgttaaatgag

SEQ ID NO: 3564 - DNA, 1307 bp, Rattus norvegicus
  Genbank Accession No. NM_022390
gtgcttttgggtttggcgatcagttccgcgggagtcttgtcaggagcaggatggcggcttcgggcgaggcgcgccgagtgctggtgtacggcggcaggggtgctctgggctcgcgctgcgtacaggccttccgggcccgcaactggtgggttgccagcattgatgtggtggagaatgaagaggccagtgccagcgtgattgttaagatgacagattcattcacggagcaggctgaccaggtcactgctgaggtcgggaagctcctaggtgaccagaaggtggatgccattctctgtgtggctggaggatgggccgggggcaatgccaaatccaagtcactctttaaaaactgtgacctgatgtggaagcagagtatttggacatccaccatctctagccacttggccacaaagcacctgaaggaaggaggcctcttgaccctggccggggccaaagctgcgttggatgggactcctgggatgattggctacggcatggccaagggagccgtccatcagctctgccagagccttgcagggaagaacagtggcatgccgtctggggctgccgccattgctgtgcttcccgtcaccctggatactccgatgaacaggaaatcaatgcccgaggcagacttcagctcctggacacccttagagttcctggtggagaccttccatgactggatcactgggaacaaacggccaaactcaggaagcctaatccaggtggtaaccacagacgggaagacagagcttactccagcctatttctaagttgcacctcagtgcccaggagaaccctcttgaaactctactaacctgtgtctgtattgccgcacctggccccatgttgtctgtattcctgtttgtggtacgagataactagtcccgtttgtctcttacgtagtgctccttttttgtcctgggctggtgaggtatgtttatggggaatgagtgggggcctgtaagtagcaccatcagtgctgaggcccagggaggtatgtgtgcaggccgtcatcccagcatcccagactgctttggagacccgtttgatagttcattttttagcatttggggcactttgaaatccaacttgtttttaaattccatgttagtgccatagatgtagtttttgctgcctgaaaattaactgccatgaaaattcattggtgatgtaagtaagcaaaacctaatggactctgttggatatcatttgtgttccagcctaggctaagtgtttatgagaactattcgtgagtgttcggagtgttcttcctaataaacacatttcatgtccccgaattc

SEQ ID NO: 3565 - DNA, 2410 bp, Rattus norvegicus
  Genbank Accession No. NM_022392
tacgctgctttggtggcgtgcacctctcacggtgtgcctagccgccgatgcccaggctgcacgatcacgtctggagctacccaagcgcgggcgctgcgaggccgtacagcctcccgcgaggcatgattgcggcggccctctgtccgcagggccccggagcccccgagcccgagcccgcgccccggggccagcgagagggaaccgcaggcttcagcgcacgacccggcagctggcaccacgacctggtgcagcggagcctcgtgctcttctcatttggcgtggtcctggctctggtgctcaacctgctgcagatccagcggaatgtcacgctcttcccggacgaggtgatagccaccatcttctcctccgcctggtgggtgcccccgtgctgtggcacggcagccgctgttgtcggcttattgtatccctgtattgacagtcacctgggagaaccacacaagttcaagagagagtgggccagtgtcatgcgatgtatcgcggtgtttgttggcatcaaccatgccagtgccaaattagatttcgccaataatgtgcagctgtccctgactctggcagccctatccttgggcttgtggtggacgtttgatcgatcccgaagtggcctggggctcgggatcaccatcgccttcctagccacgctgatcactcagtttcttgtttataatggcgtctaccagtacacgtccccagatttcctctatatccgttcttggctcccttgtatatttttctcaggaggtgtcacagtgggaaacataggacgacagttagctatgggtgttccagaaaagcctcacagtgactgagtttgagcacatgattcagggcggaagcagaatgtggagacactggtcctgggtgtggtgaagaggatctttttctcaatgttccatttagactgggctgatgataaatgactcctaaagatgcgttcacgtagtctaaatagcaagtggaggcaaggactacttacctaaagtcttaccttgctcacccaccctcacacctgtctgcactggaacattctatcccaggctgtatgtgagagttgggtaagggggccggtttcccgagtattagatttcactcatcattcaaagcaaaatgccatatttcaaagccttgaatcaaaatgaattaccaactagcagttttatatcagtgcccaaaggagagaggttgatggtgcttaacagagatgaagtatgtgcagtaagaatatttatccagaattaaaatatagggttgtgtaaagaggggctaagggcagcagtaagttggaggaagatcatgctccccggaggacccagtgcagccacatctccaggtctcgctcaggctggcgctcacacgtgggtctcatcagtgtgggaactatgctgtttactgacaggaggcttgtagacaatcttactgacagcccaggacaacacaaagtcaggattctgcattgcgatgctggacttttcatctcaatttaagtgaagttttatccaagatctggagcatctaagagtgaatagctgtctgctgtttcagtcgtaatgagccgaaattgtgtctctgtcactccagagtggagaggacttttccacagccctatggagcttgcaatctgtgattgccttgtaaaaggttgagtgtgcacgtcactgcgttcggtgcgcagtgtcctgtgtgtgttggacagcgtagaacacatgggaccttgcaagtattgggtcttcaacttcaagtgcaatgtgtatgaaaccaatctgagccttgtattctcttaaatatttattatttttttttaaccgcgcgagctgttctggagaagggttctcgggtcatttcagagctgtgtgaggcacactcagcaatactgtgtcagccgtgacgctccccagtcacaccctccactacaccctagtcctttgacatactccaggtttgtaagtttagtgatttttacttacaaatttacccttttttgcattctaaaattgtgtttaaattatatggaagtacttggtgtaggcagtcattggtccccgggcagcagaagctctgcctgtggaatcgggtttgggttcactctgcagggctcctcatagaggctttgcttatttgttttgaggaaaatgtctggagtaaacctttgttttctgaaactactttagctaaaagaaaatgggtgttctagactttggaatggttcttaaagtttcctggaaataaaaataatgattggcacttcaaagacattctttagccaagacttcagtgtctagcagaaaccacaagtgactagaagagcaagtgatcttggtgatgcacttgattgtatacaatgagtattttttctcttaaactggaaataaatctgttagaaataatatagcca

SEQ ID NO: 3566 - DNA, 3113 bp, Rattus norvegicus
  Genbank Accession No. NM_022394
ttcaaaaaaaaaataataacaaatccaaaaaacacacccacgcaagcccactgacccggttctgtgtgaagtgggcgacggaaccagggtccctggaatggcggagactctgtcgggtttaggagactcgggtgcggcaagcgcagcggccgtgagctccgcggcgtcagagaccgggacgcggcggctcagcgacctgcgggtgatcgacctgcgggcggagctgcggaagcgaaacctcactcgagcggcaacaagagcgtgctgatggagcggcttaagaaggccattgaagaggaaggtgggaatcctgatgaaattgaagtcatctcagaaggcaacaagaagatgcctaagaggcccagcaaagggaagaaaccagaagacgagggtgtggaggacaacgggctcgaggagaattctggggatgggcaggaggatgtggaaaccagcctggagaacctgcaagacatggatatgatggacatcagtgtgctggatgaggctgacattgataatggcagcgtggcagactgtgtggaggaagaagaggaggccacactccctgagggcctaggactgctccgaattggccgattgcaatcgaaggggctccccgaacagctgcaggagcttgctatagatgacaaggaagccattaacaatgtagatacatcatcatctgacttcaccatcctgcaggagatggaagaggcatctttggagccagaaaatgagaaaatactcgacattttgggggaaacttgtaaatctgagccagtaaaagaagaaggttcggagctggagcagccctttgcccaggccacgagtagcgtggggccagacaggaagctggcggaggaagaggacctatttgagagctgcggccacccggaagaggaagaagaagaggaggaagaagaggagcaggaagaggagcaggaggaggagggagatttagctttggccagcagcagcaagtctgagtcttcaagcactcgatgtcagtggagcgaggcagacgccctgttagcagtagtgaaaagggagccggcagaggcgcctggcggaggcactgggatggaccgcgagcctgtagggctagaggagccagttgaacagagtagcacggctgcccagctcccggagaccaccagccaggagctggtgcgagcgcccacggcagccccgagccctgagccccgagatagcaaagacgacgtgaagaagtttgcttttgacgcttgtaatgacgtccctgcggctcctaaagagtcctcagccagtgagggcgctgatcagaaaatgagttctgtggaagatgactcggatacaaaaaggctttccagagaggagaagggtcgcagcagctgtggtaggaatttctgggttagtggcctttcatctacgaccagagccacagatctgaagaacctttttagcagatacgggaaggtggtgggagctaaggttgtgacgaacgcccggagtcccggagctcgctgttacggctttgtcactatgtccacagctgaagaggcaacaaagtgcattaaccatttgcataagactgagctgcatggcaagatgatctcggtggaaaaggccaaaagtgagcccgctggcaaaagagtacctgacaggcgagatggcgacagcaagaaagagaagaccagcaccagtgacagatctgcaaaccttaagagggaggagaaaggtgacagaaaagacgatgccaagaagacggatgatgggagcacagagaagagcaaggatgcagatgaccaaaagcctgggccttcagagcgctctcgaacaaccaagtcaggaagccgtggcactgagcgtactgtggtgatggacaagtccaaaggtgtgcctgtcatcagtgtgaagacttctggttctaaagagagagcctccaaaagtcaggaccgaaagtctgtcagccgggagaagcggtctgttgtgtcctttgacaaggttaaagagtctcgaaagtccagagactcggagtcacggagggagcgggagcgggagcgcagtgagcgggagcaaaggctgcaggcccagtgggagcgggaggagcgagagcggctggagattgcccgggagcgcctggctttccaccgacataggctggagcgtgaacgcatggagagggaacggttggagcgggagcgcatgcatgtggaacaggagcggaggcgtgagcaagagcgcattcaccgagagcgagaggagcttcggcgtcagcaggaactgcgctatgaacaggagcggaggcctgctgtgcgcaggccctatgaagtagatggccggcgagatgatgcctattggccagaagctaaacgggctgcgctggatgaccgttaccactcagacttcagtcgccaggaccgctttcatgacttcgaccacagagacagaggccgctatcccaaccactctgtggataggagagaaggttcacggtcgatgatgggagacagagaaggacagcattaccctgagcgccatggaggacctgaacgccatggccgggactctcgagatggctggggctatggctcaaacaagagactgagtgaaggccgggggctgccccttcttcccaggcgtgactggggagagcatgcccggagacttgaagatgaccgggcatggcagggcacagctgatggaggcatgatggagcgtgatcaacagagatggcaaggtggtgagaggagcatgtctggccactcagggcccggtcacatgatgaatcgtggtggcatgtcagggcgaggcagttttgcccccggaggagcttcccgtcgccatgtgatcccacgtggagggatgcaggcaggcttcggcgggacagagccggggcagcagacccagtgatgcccgcttcacccccgtattgagcacctaaaccacccaaccatgacctccaagtctttttaggaaaccctcccgccattgtacaaaggatttttttttttttatttgctgccatattgtagcttgttacgatggaatttgttttcatttttgttcctgtttttttgtaataaagggttttgttcaaaaaaaaaaaaaaaaaaaaaaaaaaaaaaaaaaaa

SEQ ID NO: 3567 - DNA, 1882 bp, Rattus norvegicus
  Genbank Accession No. NM_022399
cgggggccagtgtgccgccgccccctcggcccgccatgctcctttcggtgccgctcctgcttggcctcctcggcctggctgccgcagaccctgccatctatttcaaagagcagttcttggacggagatgcctggaccaaccgctgggtcgaatccaaacataagtctgattttggcaaattcgtcctcagttctggcaaattctacggggaccaggagaaggataaagggttgcagacaagccaagatgcccgattttacgcgctgtccgccagattcgaacccttcagcaacaagggccagacactggtggtacagttcaccgtgaagcatgagcagaatatcgactgtgggggcggctacgtgaagctgtttccgggtggcttggaccagaaggacatgcatggagactcagaatataacatcatgtttggtccggacatctgcggtcctggcaccaagaaggttcatgtcatctttaactacaagggcaagaacgtgctgatcaacaaggatatccggtgtaaggatgatgaattcacacatctatacacgctgattgtgcggccagacaacacctacgaggtgaaaattgacaacagccaggtggagtcgggctccttggaggatgattgggactttctgccgcccaagaagattaaggatcctgacgctgccaagccagaagactgggatgaacgagccaagattgatgaccccacagattccaagcctgaggactgggacaagccagagcacatccctgaccctgatgctaagaagcctgaggactgggacgaagagatggatggagagtgggaaccaccagtgattcaaaatcctgaatacaagggcgaatggaagccacgtcaaattgacaacccagattacaagggtacctggatacacccagagattgacaatcctgaatactcccccgatgcgaatatctatgcctatgatagttttgctgtactgggcttagacctctggcaggtcaagtctggcacaatttttgacaacttcctcatcaccaatgatgaggcctatgcagaggagtttggcaatgagacctggggtgtcaccaaggctgcagagaagcagatgaaggacaagcaggatgaggagcagaggcttaaggaagaagaagaagacaagaagcgtaaagaggaagaggaggccgaggataaagaggatgaggatgacagagatgaagatgaagatgaagaggatgagaaggaagaagatgaggaggatgccactggccaagccaaggatgagctgtagaggccacaccacctgcctccagggctggactgaggcctgaacacccgccacagagctggctgctccaataatgtctctatgagactcaagaacttttcattttttttccaggcaggttcaggtctggggtggattctgatttttgttccccctgcctcccccaatccctcccccaaccccccctttttttttactggtgtttgtctttaattcttcagccctcaacctcctggcctctcatttttgaatcaacattttttctttctgtccctttctccatctcttggtcactatcctccaactctaggaacaggtatggaggaaaagccctaggcttgagatttcatctgctctcctttctgaatctcagaggagggtaggagaagggggtggtatcttccctccccccagcactgaggaagaatggggctcttcccctttctcccttgcccccaggactgggccatttgtggggcagccagttctagcacagctcacactgagagtgtaagaactacaaacaaaatttctattaaattaagttttgtgtcttcaaaaaaaaaaaaaaaaaaaaaaaaaaaaaaaaaaaaaaaaaa

SEQ ID NO: 3568 - DNA, 15231 bp, Rattus norvegicus
  Genbank Accession No. NM_022401
atggtggctggcatgctcatgccactggaccagcttcgggccatctatgaggtgctctttcgtgagggggtgatggttgccaagaaggaccggcgaccccgaagcctgcatccccatgtgcccggcgtcaccaatctacaggtcatgcgtgccatgacctcgctgaaagctcggggcctggtgcgggagacctttgcctggtgccacttctactggtacctgaccaacgagggcatcgaccacctacgccagtacctacacctgccaccggagatcgtacctgcctctctgcagcgtgtgcgccgccctgttgccatggtgatgcctgcacgtcgtcgctccccccatgtgcagaccatgcaaggtcccttaggctgtccaccaaagaggggccctctgccagctgaggaccctgcccgggaggagcggcaggtctatcgcaggaaggagcgtgaggaaggggcacctgaaacccctgtggtgtctgccaccatcgtggggaccctggccaggcccggcccagagcccaccccagccacagatgaacgagaccgtgtgcagaagaaaacttccaccaagtgggtcaataaacaccttatcaaggctcaaaggcacatcagtgacctgtatgaagacctccgtgatggccacaacctcatctccctgctggaagtcctctcaggagacagcctgccccgagagaaggggaggatgcgtttccacaagctgcaaaacgttcagattgccctggactatctccgacatcggcaggtgaagttggtgaacatcagaaatgatgacatcgccgatggcaaccccaagctgaccctgggcctgatctggacaatcatcctgcacttcaagatctcagacattcaggtgagcggccagtccgaggacatgacagccaaggagaagctgctgctgtggtctcagcgtatggtagagggctaccaaggcctgcgctgtgacaacttcaccaccagctggcgcgacggccggctcttcaatgctatcatccacaggcacaagcccatgctcatagacatgaataaagtgtaccgacagaccaacctggagaacctagaccaggccttctccgtggcagagcgggacctgggagttaccaggctcctggacccagaagatgtggatgtccctcagcctgatgagaagtccatcatcacctacgtttcatccctgtatgatgccatgccccgtgtgccgggcgcacaggatggagtgagggccaatgagctgcagcttcgttggcaagagtaccgggagcttgtgctgctgctgctacagtggatccggcaccacaccgctgcttttgaggagcgcaagttcccctccagctttgaggagattgagatcctatggtgccagtttctgaagttcaaggagacagaacttcctgccaaggaggcagacaagaaccggtccaaaggcatctaccagtctttggagggagcagtacaagcaggccagctcaagattccccctggctaccacccgctagacgtggaaaaggagtggggcaagctgcacgtggccatcctggagcgggagaagcaactccggagcgagtttgagaggctggagtgtcttcagcgcattgtgagcaagctacagatggaggctgggctatgtgaggagcagctgtaccaggcggattccctactgcagtcggatattcggctgctggcctcaggcaaggcggcacagcgggctggggaagtggagagagacctggacaaggctgatggtatgatccggctgttgttcaatgatgtgcagacccttaaagatgggcggcatccacagggtgaacagatgtaccggagggtgtatcgtctgcatgagcgcctggtagccatccgcactgaatacaacctccggctgaaggcaggggtgggtgcccctgtgacccaggtgaccctgcagagcacacagaggcgcccagagctagaggactccacactgcgttacctgcacgacctgctggcatgggtggaggagaaccagcgtcgaatagacggtgctgagtggggcgtggacttgcccagtgtagaggcacagctgggcagccaccgaggcatgcatcagtctattgaggaattccgggccaagatcgagcgggctcggaatgatgagagccagctctcccctgccacccgaggtgcctaccgagactgcctgggccgcctggacctgcagtatgcaaagctgctgaactcctccaaggcccgcctccggtccctggagagcttgcatgggtttgtggcggcagctaccaaggagctgatgtggctgaatgagaaggaagaggaagaagtgggctttgattggagtgaccgcaacaccaacatggctgccaagaaagaaagttactcggccctgatgcgtgagctggagatgaaggaaaagaaaattaaggagatccagaacacgggggacaggttgctgcgggaagaccatcctgcccggcccacagtggagtccttccaggctgccctgcagacacagtggagctggatgctgcagctgtgttgctgcattgaagcgcacttgaaagagaacacagcctacttccagttcttctcagatgttcgggaggctgaggaacagttgcagaaactacaggagacgttacgcaggaagtacagctgtgaccgctccatcactgtcacaaggcttgaggacctgctgcaggatgcccaggatgagaaggagcaactgaatgagtacaaagggcacctctcaggcctggccaagcgggccaaggctattgtgcagctgaagccacgcaaccctgcccaccctgtgcggggtcacgtgcccctgctagctgtgtgtgactacaagcaggtggaggtgactgtgcacaagggtgaccaatgccagctggtgggccctgcacagccgttccactggaaggtgctcagtagttccggcagtgaggctgccgtgccttctgtgtgctttcttgtgccgccacccaaccaggaggcccaggaagctgttgctaggctggaggcccagcatcaggccctggttactctgtggcaccagcttcacgtggacatgaagagtcttctggcatggcagagcctcaatcgtgacatacagctcatccggtcctggtccctagtcacgttccgcacgctgaagcccgaggagcagcggcaagctctgcgcaacctggagttgcactaccaggccttccttcgagacagccaggacgctggtggctttgggcccgaggaccggctggtggcagagcgcgaatatggatcttgtagtcgccactaccagcagctgctacaaagcctggagcagggtgagcaggaagagtctcgctgtcagcgatgcatctcggagctcaaggacattcggctgcaactggaggcctgtgagactcggactgtgcaccgtctgcggctgccactggataaagaccccgcacgggagtgtgcccagcgcatcgctgagcaacagaaagcacaggctgaggtggaggggctgggcaagggagttgcccggctgtctgctgaggctgagaaagttctggccttgccagagccgtcacctgctgcaccaactctgcgctcggagttggaattgaccctgggcaagctggaacaggtcagaagcctgtctgccatctacttggagaaactcaagaccatcagcttggtaattcgcagtacccagggggctgaggaggtgcttaaaacacacgaggagcacctgaaggaggcccaggccgtgcctgccacactccaagagctcgaagtcaccaaggcttcactaaagaagctgcgggcccaggcggaggcacagcagcctgtattcaacaccctacgagatgagctgaggggggcacaggaagttggtgaacggctacagcagcggcatggtgagcgggacgtggaagtagagcgctggcgagaacgtgtcactcagttgctggagcgctggcaggctgtgctagcccagactgatgtgcggcagcgggagcttgaacagctgggccgccaacttcgctactaccgtgaaagtgcggatccgctgagctcctggctgcaggatgccaagagccggcaagaacagatccaggctgtgccaatagccaacagtcaggctgcacgagaacagctgcgccaggagaaggccctgctggaggagattgagcgccatggtgagaaggttgaggagtgccagaagtttgctaagcagtacatcaatgcaatcaaggactatgagctccagctgatcacctacaaggctcagcttgaacctgtggcctcccccgccaagaagcccaaggttcagtctggatcggagagcgtcatccaggagtacgtggatctgcgtacacgctacagtgagctgaccacactcacgagtcagtacatcaagttcatcagtgagacactgcgccgcatggaagaggaagagcggctggctgagcaacagcgggcagaggagcgggagcgcctggccgaggtggaggccgcgctggagaagcagcggcagctggctgaggcccatgcccaggccaaggcacaggccgagctggaggcacgagaactgcagcggcgcatgcaggaggaggtgacgcggcgcgaggaggcggcggtggacgcacagcaacagaagcgcagcatccaagaggagctgcagcatctgcggcaaagctcagaggcagagatccaggccaaggcccagcaggtggaggctgcagagcgcagccgcatgcgcattgaggaagagatccgcgtagtccgtctgcagctagagacaactgagcgtcagcgtggaggggcggaggatgagctgcaggctctgcgtgcacgggctgaggaggcagaagcacagaagcggcaggctcaggaggaagccgagcgcttgcggaggcaggtgcaggatgagagccaacgcaaacggcaggcggaggccgagctggccctgcgtgtgaaggcagaagcggaggcagcgcgagagaagcagcgggccctgcaggctctggatgaactgaaactgcaggccgaggaggccgaacggtggctgtgccaagccgaggcagagagggctcgccaagtgcaggtagccctggagacagcgcagcgtagtgcagaagtggagctgcagagcaagcgtccgtcctttgcagagaagaccgcacagttggagcgcacgctgcaggaagagcacgtgacagtgacacagctgcgggaggaggcggaacggcgggcacagcagcaggctgaagccgagcgagcccgtgaggaagccgagcgggagctggagcgctggcagctgaaggccaatgaggcgctgcggctgcggctgcaggcagaggaggtggcacagcagaagagcctggcccaggccgatgcggagaagcagaaggaagaggcagaacgggaagcccggcggcggggcaaggcagaggagcaggccgtgcggcagcgagagctggctgagcaggagctggagaagcagcggcagctgacagagggcaccgcccagcagcgcctggctgccgagcaggagctgattcgcctgcgggcagagacggagcaaggtgagcatcagcggcagctgctggaggaagagctggcccggctacagcacgaagcgacagcagccacacagaagcgccaggagctggaggctgagctggcgaaggttcgggcagagatggaggtactgctggccagcaaggcacgagccgaagaggagtctcgctccaccagtgaaaagtccaagcagaggctggaagctgaggcagggcggtttcgagagctggctgaggaggctgcccgcctgcgtgctctggccgaggaggcaaggcggcaccgggagttggccgaggaggacgcggcacgccagcgggccgaggcggacggagtgcttacggagaagctggctgccatcagtgaggccacaaggctcaagacggaggcagagattgcactcaaagagaaggaggccgagaacgagcgcctgaggcgcctggctgaagatgaggccttccagcggcgccggctggaggagcaggcagcacagcacaaggcagacatagaggagcgcctggcccagctgcgcaaggcatccgagagcgagctggagcgacagaaggggttggtggaggataccctgcggcagcggcggcaggtggaggaggagatcatggctctgaaggcgagcttcgagaaggccgcggctggcaaggcagaactggagctggagcttggccgcatccgcagcaatgccgaggacaccatgcgcagcaaggagctggccgagcaggaggcagcgcggcagcggcagttggcagctgaggaggagcagaggcgccgggaagccgaggagcgggtgcagaggagcctggcagcggaggaggaagccgcacggcagcgcaaggtcgcactggaggaagtcgagcggctcaaggccaaggttgaggaagcgcggcgcctgcgagagcgagctgagcaggagtctgcgaggcagctgcagctggcccaggaggctgcccagaaacggctgcaggcggaggagaaggcgcacgcctttgtggtgcagcagcgagaagaggagctgcagcagactcttcagcaagagcagaacatgctggagcggctgcggagcgaggcagaggcagcgcggcgagctgctgaggaggcggaggaggcccgggagcaggcagaacgtgaggcagcgcagtctaggaagcaagtggaagaggccgagcggctgaagcagtcggcagaggagcaggctcaggcccaggcccaggcgcaggcggctgcagagaaactgcgcaaggaagcggagcaggaggcggcgcgtcgggcccaggcggagcaggctgcgttgaaacagaagcaggcagccgacgcggagatggagaagcacaagaagtttgcagagcagacgctacggcagaaggctcaggtagagcaggagctgaccacgctgaggctgcagctcgaggagaccgaccaccagaagagcatcctggatgaggagctgcagcggctaaaggctgaggtaacagaggcagcccggcagcgtagccaggtagaggaggagctcttctctgtccgcgtgcagatggaggagctgggcaaactcaaggctcgcattgaagctgaaaaccgggcactcatccttcgtgacaaggacaacacacagcgcttcctggaggaggaggccgagaagatgaaacaggtggcagaggaagctgcacggttgagcgtagctgcccaggaggcagcaaggctgcggcagctagccgaggaggacctggcccagcagcgggccctggcggagaagatgctgaaggagaagatgcaggcggtgcaggaagccacaaggctcaaggctgaggctgagctgctgcagcagcagaaggagctggcacaggagcaggcccggcggctgcaggcggacaaggagcaaatggctcagcagttggtagaggagacacagggtttccagcggaccctggaggctgagcggcagcggcagctagaaatgagcgcagaggctgaacgcctcaagttgcgcatggctgagatgagccgggctcaggcccgtgcagaggaggatgcccagcgcttccggaagcaggctgaagagatcggcgaaaagctgcaccgcactgaactcgctacacaggagaaggtgacattggtgcagactctcgagatccagcgacagcagagtgaccaagatgccgagcgtctgagggaggccattgctgagctggagcgtgagaaggagaagctcaagcaggaggcgaagttactgcagctcaagtctgaggagatgcagactgtgcagcaggagcagatactgcaggagacacaggccctgcagaagagctttctctctgagaaggacagcttgctgcaacgcgaacgcttcatcgagcaggagaaggccaagctggagcagcttttccaggacgaggtggcaaaagcaaaacagctgcaggaggagcagcagcggcagcagcagcagatggagcaggaaaagcaggagctggtggccagcatggaggaggcccggaggcggcagcgtgaggcagaggagggtgtgaggcgcaagcaagaggaactgcagcgtctggagcagcagcggcagcagcaggagaaactactggcagaggagaaccagaggctgcgggagcggctgcagcgcctggaggaagagcaccgagctgcgttggcgcactctgaggagatcgccacctcccaggctgctgccacaaaagcactgcccaatggccgcgacgcacttgatggcccctccatggaggccgagcccgagtacacctttgagggattacgtcagaaggtgccagctcagcagctacaggaagcaggcattctgagcatggaggaactgcagcgtttgacacagggtcacaccacggtggctgagctcacgcagcgggaagatgtgcgccactacctgaagggcggcagcagcatcgcaggattgctcctgaagcccaccaatgagaaactgagtgtctacacagccctacagcggcagctgctcagccctggaacagcccttatcttacttgaggcccaggcagcctcgggcttcctgctggaccctgtccggaaccggcggctgacggtcaatgaggctgtgaaggagggtgtggtgggtcccgagctgcaccacaagctgctgtcagctgagcgtgccgtcactggctacaaggacccttacacaggagaacagatctctctcttccaggccatgaagaaggacctcattgtcagggaccatggcatccgcctgctggaagcccagatcgccacaggtggcatcattgaccctgtacacagccaccgtgttcccgtggacgtggcctaccagcgtggctacttcgatgaggagatgaaccgtgtgctggctgacccaagcgatgacaccaagggcttctttgaccccaacactcacgagaacctcacgtacctgcagctgctggagcgctgtgtggaggaccccgagacaggcctgcgcctcctgccactcacagacaaggctgccaagggtggtgagctggtgtacactgacacggaggcccgtgacgtcttcgaaaaggccacagtgtctgcaccattcggcaagttccagggcaagaccgtgaccatctgggagatcatcaactcagagtacttcacagcggagcagcgacgggacctgctccggcagttccgcacgggccgcatcacggtggagaagatcatcaagattgtcatcacggtggtagaggaacacgagcggaagggccagctctgctttgagggcctccgtgcccttgtgcctgctgcagagctgctggacagtggagtcatcagtcatgaagtctaccagcagctgcagcggggtgagcgctctgtgcgggaagtggccgaggcagacgaggtgaggcaggccctgcggggtaccagtgtcattgccggtgtgtggctggaagaagcagggcagaagctgagcatctatgaggccctgaggagagatttgctgcagccagaggtggctgtggccttgctggaggcccaggctggcactgggcacatcattgaccctgccacgagtgccaggctgactgtggatgaggcagtgcgtgctggcctggtgggtcctgagatgcacgagaagctcttgtcagctgagaaggctgtaacaggctatagggatccctactcgggacagagcgtctcgctcttccaggctctgaagaagggtctcatcccccgagaacagggcctgcgcctgctggatgcccagttatccactggtggcattgtagaccccagcaaaagccaccgtgtgcccctggatgttgcctatgcccggggctacctggacaaagagactaacagggccctgacgtcacccagagacgatgccagagtctaccttgaccccagcacccgggagccagtcacctacagccagctccaacagcggtgccggtctgaccagctgactgggttgagcctactgcccctctcagagaaggccgtccgggcccggcaggaagaggtctactctgagctccaggcccgtgagacattggagaaggccaaggtggaggttcctgtgggcggctttaagggcagggcgctgacagtgtgggagctcataagctcggaatacttcactgaggagcagcggcaggagctgctacggcagttccgcacaggcaaggtcactgtagagaaggtcatcaagattcttatcaccattgtggaggaggtggagactcaacggcaggagagactgtccttcagtggcctccgtgcccctgtgccggccagtgagctcctggcctccaagatcctcagcagaactcagtttgagcagctcaaggatggcaagacatcagtcaaagatctgtcagaggtgggctctgtgcggacactgctgcaaggcagcggctgcctggctggcatctatctggaggactcgaaggagaaagtaaccatctatgaggccatgcgccggggcctcctcagagccagcacagccacactcctgctggaggcccaggcggccactggttttctagtggaccctgtgcggaaccaacgtctgtacgtccatgaagctgtcaaggctggagtggtgggcccggagctccatgagaagctgctgtcggctgagaaggcggtcactggttacaaagatccctactctggcagcaccatctcgctgttccaggccatgaagaagggcttggtcctcagggaccatgccatccgcctgctggaggcccagattgccacaggtggcatcattgaccctgtgcacagtcaccgccttcccgtagatgttgcctaccagcgtggctacttcgatgaggagatgaaccgtgtgctggctgacccaagtgatgacaccaagggcttcttcgaccccaacacccacgagaacctcacgtacctgcagctgctggagcgctgcgtggaggaccccgagacaggcctgcgcctcctgccactcagaggggcagagaagacagaggtggtagaaaccacacaggtgtatactgaggaggagactcggagggcgttcgaggagacgcagattgacatcccaggtggtggcagccacggtggctcctccatgtctctatgggaggtgatgcagtcagacatgatcccagaggaccagcgtgcccggctcatggccgactttcaggctggcagagtgaccaaggagcgcatgatcattatcatcatcgaaatcattgagaagacggagatcatccgccagcagaacctcgcctcctatgactacgtacgccgccgcctcaccgccgaagacctgtatgaggcccggatcatctcccttgagacctacaacctcttccgggaaggcaccaagagcctccgtgaggttctggagatggaatctgcctggcgctacctttacggcacaggatcggtggccggtgtctacctgcctggctctaggcagacgctaaccatctaccaggcccttaagaaggggctgctgagtgccgaggtggcccgcttgctgctggaagcacaggcagccacaggctttctgctggacccagtgaaaggcgagaggctgactgtggacgaggccgtgcggaagggtctggtaggccccgagctgcacgatcggctcctctctgccgagcgagctgtaactggctaccgagacccctacaccgaacagcccatctcactcttccaggccatgaagaaggagctgatccctgccgaggaggcactgaggctgctggatgctcagctagccacaggaggcattgtggacccccgcctgggtttccacctccccctggaggtggcttaccaacgaggctacctcaataaggacacgcatgaccagttgtcagagcccagtgaggtgcgcagctatgtggacccctccacggatgagcgtctcagctacacacagctgctcaagcgttgccgccgtgacgacaacagcggccagatgctgctgccgctctctgatgcccgcaagctgaccttccgcggcctgcgcaagcagatcaccgtggaggagctggtacgctctcaggtcatggatgaggccacagcactgcagctgcaagaaggcctgacctccattgaggaggtcactaagaacctgcagaagttccttgagggtaccagctgcattgctggagtctttgttgatgctaccaaggaacggctgtcggtgtaccaggccatgaagaagggcatcatccgtcccgggacagccttcgagctcctggaagcgcaggcagccaccggctacgtcattgaccctatcaaggggctcaagctgactgtggaagaggccgtgcgcatgggtatcgtgggccccgagttcaaggacaagctgctgtctgctgagcgtgccgtcactggctacaaggacccttactctgggaaactcatctctctcttccaggccatgaagaagggcctgatcctgaaggaccatggcatccgcctgctagaggctcagatcgccaccggtggcatcattgaccctgaggagagccaccgcctgcctgtggaagtggcctataagcgtggtctctttgatgaggagatgaacgagatcctgactgacccctcagatgacaccaagggcttcttcgacccaaacaccgaggagaacctcacatacctgcagctgatggagcgctgtatcactgacccccagactggcctgtgtctcctgccgctgaaggaaaagaagcgggagcggaagacgtcctccaagtcctcagtgcgcaagcgccgcgtggtgattgtggaccctgagacgggcaaggagatgtcagtgtatgaggcctaccgcaagggcctcatagaccaccagacatacctggagttgtcagagcaggagtgcgagtgggaagaaatcaccatctcttcctcggacggcgtcgtcaaatctatgatcatcgaccgccgctctggccgccagtatgacattggtgacgccatcaccaagaacctcattgaccgctcagcactggaccagtaccgcgctggcacactttctatcaccgagtttgccgacatgctctcaggcaacgctggtggcttccgctcccgctcctcctctgtgggctcatcttcctcctaccccatcagttctgctgtccctaggacccagctagcctcctggtctgatcctactgaggagactggcccagtggccggcatcctagacacagagactctggagaaggtgtccatcacagaggccatgcaccgcaacctggtagacaacatcactggccagcggttgctggaggcacaggcctgcaccgggggcatcattgaccccagcactggtgagcgcttcccggtcactgaggctgtcaacaagggcctggtggacaagatcatggtagaccgtatcaatctggcccagaaggccttctgtgggtttgaggacccacgcaccaagaccaagatgtcagctgcccaggccctgaagaagggctggctttactacgaggcaggccagcgtttcctcgaggtgcagtacctgacgggtggtctgattgagcctgacacacctggccgtgtgtctcttgatgaagccttgcaacgtggcactgtggatgcccgcacagcccagaagctgcgtgatgtcagtgcctactccaagtacctcacgtgccccaagaccaagctcaagatctcttacaaggacgctctggatcggagcatggtggaggagggcacagggctgaggctgctggaagccgcggcacagtccagcaagggctactacagcccgtacagtgtcagtggctctggctctactgctggttcacgcactggttcacgcaccggctccagggccggctcccgtcgtggcagctttgatgccactggctctggcttctccatgaccttttcttcttcctcctactcttcctcaggctatggccgccgctatgcctcagggccttcagcctctcttgggggccctgagtctgcagtggcctgatcccccagcctgtatcctgccttcccgctctgcatgtcgccaggctccccgtggaggcgctggggtcttttctttcttcttctttttttttttttttttaacatttaaaggtgtcttcctcccaagcggtgcctaaaatctaaccaaaaagaccagaataacacattaatatatatatatatatgcgatgtccagacagcctgtgtcttgggaaacagggctggcccaggcccagtgaccactccactctccttgggcctccctaatcctttctacctgccactcaccacagctaggtgccttggagaatccagagctgggcactcagcccactactcctgtctctcctgggaggattgccatctgggaaaggcccccagacctctaagccaaccccactggatgtctacctgctggtcctagctgctgaggggaactggggacggtcctgtgagcagacagctgttgagtctcttgaggcctctgccctgagccagctgcttctccccagtgtatacctgaatattcagtgggttttgctggcaaaggaaagatcccaggccaaccatctcttccagcctgcccagagaagccccttccccatgggaagataaggcctggtcctggccccagcctcccgcctggctcctgcagctgccattggagctgtgctttgtagctcactaccccatacttattcccttgagacctgagcctctgcttcagccttccagcctcaactccccttgtaagtgccttctgtgtccttgtacccaggccctaaagacccagacccagggcaagagatggacattctggctgggcggggctggagggttctgcagatctgagaattccttctccagaggcccagggtcttcaagcctgtggaacccctctgggtgctgctgcccaccccactcccagggagccctggccagcccagctgtgctaacataagtacttggccagtgacactctcccttccctggccttggtggctcctacccctgcctccaccctctgagtgagctttgcatgttccactaaccttgagctggtgacaggtggagatgccaggcagaacactaacctgaccatgggcgggggccctgcggtgtccgcccctcaataaaagcaattccaaccttaaaaaaaaaaaaaaaa

SEQ ID NO: 3569 - DNA, 1689 bp, Rattus norvegicus
  Genbank Accession No. NM_022403
tcctagcaaacctgtgtgctcctgggacgcatcactaccatgagtgggtgcccattttcaggaaacagtgtaggatatactttgaaaaacttatctatggaagacaatgaagaagacggagctcaaactggtgtaaacagagccagcaaaggaggacttatctatggggactacttgcagttggagaagattttgaatgcacaagaacttcaaagtgaaatcaaagggaataaaatccacgacgagcacctctttattataactcaccaagcttatgaactttggtttaaacaaattctctgggaacttgattctgttcgtgagatttttcaaaatggccatgtcagggatgagaggaacatgctcaaggtgatgactcggatgcaccgtgtggtggtcatcttcaagctcctggtacagcagttctcggttctggaaacaatgactgccttggacttcaatgacttcagagagtacctgtctccagcatcaggcttccagagtcttcagttccggctgctagaaaataagataggtgttcttcagagcttgagagtcccttacaacaggaaacactatcgtgataactttgaaggagactacaatgagctgctgctgaaatcggagcaggagcagacgctattgcagctggtggaggcatggctggaacgcacacctggcttagagccacatggattcaatttctggggaaagtttgaaaaaaatatcttgaagggtctggaagaggagttcctaaagattcaggcgaaaaaggactctgaagaaaaagaggaacagatggcagagttccggaagcagaaagaggtgctgctctgcttgttcgatgagaagcgtcatgactaccttctgagtaaaggtgaacgacgactgtcataccgtgcactccagggagcactgatgatatatttttacagggaggagcctcgattccaggtccctttccagttgctgacctcacttatggacattgacacactcatgaccaaatggagatataatcatgtgtgcatggtgcacaggatgctaggcagcaaggctggcactgggggatcctcaggctattattatctgcgctcaactgtgagcgacaggtacaaggtgttcgtggatttatttaacctctcatcgtacctggttccccgacactggataccaaagatgaatccgatcattcacaagttcctttacacagctgagtacagcgacagctcctacttcagcagcgatgaatcagattgagttcttctgaacatcagtccaggctacaggattcccagtcaacttttattttataaatttttacaaatatgtgattggtgtaacatatttatatttgtagttcagagacgtgatgttgtggtccaatcctggaaaaaattatgatttcgcatatcatgatgatgtatgattaagcagattaagcattatgataaaaataacttggtaaaatgttagcatcatcatacatatgatgtattctggttataactcaatttaccctgacacttacctccatagaaacactttaagtaattagttccttattgcttcatactttataaagcttggtgagcagttcttttatactatagatgcaataaatactattcttctgtacaaaatttattcaaatgaatctttaattaataaatttagtttttgtctgcg

SEQ ID NO: 3570 - DNA, 2012 bp, Rattus norvegicus
  Genbank Accession No. NM_022407
acctgtgttccaggagccaaaccagcaatgtcttcccctgcacagcctgcagttcctgccccactggccaacttgaagattcaacacaccaagatcttcataaacaatgaatggcatgattcagtgagtggcaagaaatttcctgtccttaaccctgcaactgaggaggtcatctgccatgtggaagaaggggacaaggcagatgttgacaaagctgtgaaggccgcaagacaggctttccagattggctccccatggcgcaccatggatgcttcagagagaggacgcttgctgaacaagctggctgacttaatggagagagatcgtctgctgctggctacaatagaggccatcaatggtgggaaagtctttgccaatgcgtacttgtcggatttaggaggcagcataaaagcattaaagtactgtgcaggctgggctgacaagatccatggtcaaacaataccgagtgatggagacattttcacttttacgagacgtgaacctattggggtgtgtggccaaatcatcccttggaattttccactgcttatgttcatttggaagataggccctgccctcagctgtgggaacacagtggtcgtcaagccagcagagcaaactcctctcactgctcttcacatggcatctttaataaaagaggcagggtttcctcctggcgtggtgaacattgtccctggttatgggccaactgcgggggcagcgatctcctctcacatggatgtggacaaggtggccttcacgggatcaacccaggttggcaaattaatcaaggaagctgcaggaaaaagcaatctgaagagggtcacgctggagcttgggggaaagagcccttgcattgtgtttgcagatgccgacttggacattgctgtcgagtttgcacaccatggagtcttctaccatcaaggccaatgctgcgtcgcggcatcccggattttcgttgaggagtcagtttatgatgagtttgtgagaaagagtgttgagcgagccaagaaatatgtccttggaaatcctctgacccaaggaataaatcagggccctcagattgacaaggagcaacatgataaaatccttgatctcattgagagtgggaagaaagaaggagccaaactggagtgtggtggaggacgctgggggaacaaaggcttctttgtccagcccacagtcttctccaatgtgaccgatgagatgcgcattgccaaagaggagatatttggaccagtgcaacaaatcatgaagtttaagtccatagatgatgtgatcaagagagcaaacaatactacctatggtctagcagcaggagtcttcacaaaagacctggacagggccatcactgtgtcttctgctctgcaggccggggtagtgtgggttaactgctatatgatcttgtcagcccagtgccccttcggtggattcaagatgtctggaaatggacgagaactgggtgaacatggtctttatgagtacactgagctcaagacagttgcaatgaaaatatctcagaagaactcctaagaagcagagtgaagagaaactctcagctgtggctacacgtctcctatcgtcaccagcaaagtgttgttttactataattttttcttctgttgatttctttacatgatgaatccatcagtgttactgttactcatagaaaacatgtagcttaatcctacaaaaccactcaccttctaatatgtgactccagtccttatcccagaataaaaggatagatttaggtgcaagctctctgtaactctgtcatgataggtgctttctgtcgtagctccctgtctagagtactcatttggtgaggaggaccagtcgtgatttaagctctgtccctctgtgaccccttgaactgcttctcggcatgcatgataactgcagagtcggctgctctgtttcccaggtgttgtgaaatgttttctagaaagccatgcctgcttatcaaatgaaatgcccagctgtaattagaatgcaaagctaataaaggg

SEQ ID NO: 3571 - DNA, 2193 bp, Rattus norvegicus
  Genbank Accession No. NM_022498
ggggctcgtggcgtgaagaaggaggacgagtgagacccgggcgcgacggggcgcgtgcgggagggtcggcggcgggacggcgatggcggatatcgataaactcaacatcgacagtatcatccaacggctgctggaagtgagagggtccaagccaggcaagaatgtccagctccaggagaatgaaatccggggactgtgcttgaagtctcgggagatcttcctcagtcagcctatccttttagaacttgaagcaccactcaagatatgtggtgacatccacgggcagtactatgatttgctccgtctgtttgaatacggtggctttcctccagaaagcaactatttgtttctcggggactatgtggacaggggcaaacagtcactagagacgatctgcctcttgctggcctacaaaatcaagtatccggagaacttttttcttcttagagggaaccatgagtgtgccagcatcaatagaatctacggattttatgatgagtgtaagagaagatacaacattaagctgtggaaaacgttcacagactgttttaactgcttaccgatagcagccatcgtggacgagaagatattctgctgtcatggaggtttatcaccagatcttcaatctatggagcagattcggcgaattatgagaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgagttttttgcaaagaggcagttagtcactctgttttctgcacccaactactgtggcgagtttgacaatgcgggcgccatgatgagtgtggatgagaccctcatgtgctccttccagattttaaagcctgcagagaaaaagaagcccaatgccacgagacctgtcacaccgccacggggtatgatcacaaagcaagcaaagaaatagatgtcacttgacactgcctagtgggacttgtaacatagcgtacataaccttcctttttaaactgtatgtgtgctggtcagcttgcccaggtagacctgtcgggccctcccttctccattttgattattgctggcacttgctggttatagcagcaagtgaagcatttcattctcaagaaagcgtttgtttttgtttgtttttaacctctgttccctttgtggacagctctgatgatggtgttaagctgtacaccttggcagtttatcctgtcccaagtgaagcatttcattctcaagaaagcgtttgtttttgtttgtttttaacctctgttccctttgtggacagctcggatataaagagagccctagggtgcgtgagtctgtacatgtaattgtcataaatgcattctgttgatacaaaccactgtgaacagtttttccaagtttgtttgacagggactgctttccctcactgtctcatcctgtacaaactagtgtctgcagctgtggcagcaggagcaacctgccaccctgccacccacactgcccaggctgtctgaagcacactccctcccactgcacacttaactgacgattaaagccattcttttcaatgtctgtgattccttcctaaagccaaagtttctgttggactgtattggcacaccctggacatgaggtggccagggcaccaaggctgctggcacaggccgcctccgtggggactcagaaagaagcaggttattttaactagcaatagtgatgtagtgctgggtaagctattaatggtggaagttaatgagacattgtacagtgcccatatagtctattcactgagtaatctttttacagttggatcaggcctgaacccgtccattcagaaagcttcaaattatagaaacaacactgtcctatacgagtgatcgataatgctttctttggctacattctttattctgcggtgacattgaggcttataaatcaaaaggaactaacttgccgtccaccggtttatacagaactcacagtatctatgacttttttaaactacgacctgttaaaatgaatctgtttccacagatgccgtgtacaatgccatgtgctaagaatgatttcagacttattaaatgcgagcttgtt

SEQ ID NO: 3572 - DNA, 961 bp, Rattus norvegicus
  Genbank Accession No. NM_022499
tttcccaacaggatctcccaccagcccagcttttctatataggctctgacctctggtcatccaagttgcaggatgtcgatgacagacttgctcagcgctgaggacatcaagaaggcgataggagcctttactgctgcagactccttcgaccacaaaaagttcttccagatggtgggcctgaagaaaaagagtgcggatgatgtgaagaaggtgttccacattctggacaaagacaaaagtggcttcattgaggaggatgagctggggtccattctgaagggcttctcctcagatgccagagacttgtctgctaaggaaacaaagacgctgatggctgctggagacaaggacggggacggcaagattggggttgaagaattctccactctggtggccgaaagctaagtggcgctgactgcttgggtctcccacctctccaccccccatgccccatctcagcccttctcgcggccctcctgggtttctgttcagtttgtttatgttattttttactcccccatcctttatggccctcgaatgacaccactcttctggaaaatgctggagaaacaataaaggctgtacccatcggacaccacctgtagggaggacccaggcctggtaggtgttggtttggcaagtttttccggacagcagtgggggtatagtagaaaaagtgagagagagcgaaggaccacgccctgatatttcctgcctgcttggtaccgagtggtcacgtgggccaccttgttcagtctttgtgcctttcctacaaggggatgggatggcgcaggggattttaaagatgcagaaactgccttttaaagagcagaacggaaggggctgagtccacaggtgattactttatgtccctgaggaataactaggtcgaaggactcaaatgacactctatcaattgcttttgactttgctgtgataaaattcctgataagagaaactt

SEQ ID NO: 3573 - DNA, 552 bp, Rattus norvegicus
  Genbank Accession No. NM_022500
atgacctctcagattcgtcagaattattccaccgaagtggaagctgccgtgaaccgcctggtcaacttgcacctgcgggcctcttacacctacctctctctgggcttcttttttgatcgggatgacgtggctttggaaggcgtaggccacttcttccgcgaattggccgaggagaagcgcgagggcgccgagcgtctcctcaagttgcagaacgaacgcgggggccgtgcactcttccaggatgtgcagaagccatctcaagatgagtggggtaaaaccctggaggccatggaagctgccttggccctggagaagaacctgaaccaggccctcttggatctgcacgccctgggctctgcccgcacagaccctcacctctgtgacttcttggaaagccacttcctggataaggaggtgaagctcatcaagaagatgggcaaccacctgaccaacctccgtagggtgcagggcccacaaccagcgcagactggcgtggcccaggcatctctgggcgagtatctctttgagcgcctcactctgaagcacgactag

SEQ ID NO: 3574 - DNA, 1154 bp, Rattus norvegicus
  Genbank Accession No. NM_022501
cggcggcgcagagaggagcgcgggtggagggcgcggaccgaccgagcgcaccgaccatggcctccaagtgtcccaagtgtgacaagaccgtgtacttcgccgagaaggtgagctccctgggcaaggactggcacaagttctgcctcaagtgtgagcgctgcaacaagacactgacgcctggcggccatgctgagcatgatgggaaacccttctgccacaagccctgttatgccacactgtttggacccaaaggcgtgaatatcgggggcgctggttcctacatctacgagaagcctccgacggaggcccctcaggtcactggccccatcgaggtccctgtggtacgaactgaagagcggaagaccagcgggccgcccaagggtcccagcaaagcctctagtgtcaccacgttcactggggagcccaacatgtgccctcgatgcaacaagagagtgtacttcgctgagaaggtgacctccctgggcaaggactggcaccgaccctgcctgcgctgtgagcgctgctccaagacactgaccccaggcgggcatgctgagcatgatggccaaccctactgccacaagccctgctatggaatactctttggacccaaaggagtgaatactggtgctgtgggcagctacatctacgacaaggacccggaaggcacagttcagccttagatctgcagatgctgcccctcgcggtcccctatttgaccctgagggagagtgatctgctgcctagtcctgcctcagtgtgtctcgcctgcaattccagcacctaagtgatggaggagaaagcccagctagtcctagaatttcagctcccttggtcaccttggcatgtcctatgttgcccgtggtttactttctgtctgtgtgtctccatagcaccatgggtcctgtgtccccatgtccctgataactctccaaggtggctgtcctatgatatccctttgcccacactcgcccgccagtattatttatgctctgcttgccggtgatgggcatgagctagctcacagcattcccggggtgacggcaccccagcaaggagccctttgctggttcccacactactccctacttaccctcacatggttcacagctatggagatttgctgtcaataaatagtttggtttaaagattgc

SEQ ID NO: 3575 - DNA, 2248 bp, Rattus norvegicus
  Genbank Accession No. NM_022502
atggcgtcgcccggttaccggaggctgctagctgcggctctgcttccttggtgttgcgccgcctgggccctgggacatctggacccaccttctccaccaccgctggtgatctggcatgggatgggggacagctgctgtaaccccatgagcatgggtagcattaaaaagatggttgaaaaggaaataccagggatttacgtcctgtctctggagattgggaagaacatggtggaggatgtggagaacagcttcttcttgaatgtcaacctccaagtcggaatggcatgtcagattctggaaaaggatcctaagttgcaacacggatacaatgctattggcttctcccagggaggccagttcctgagggcagtggctcagagatgcccaacacctcccatgatgaccctgatctcagttgggggacaacatcaaggtgtctttggactccctcgatgcccaggagagagttctcatatctgtgacttcatcaggaagtcacttaacgctggtgcttactccaaagttgtgcaagaacgcctggtgcaagcacagtactggcatgaccccatcaaggaggaagtgtaccgaaactgcagcatcttcttggcagacataaatcaagagaggcatatcaatgagtcctataaggagaacctgatggccctcaagaagtttgtgatggtgaaattctttaacgattccatcgtggaccctgtagactctgagtggtttggattttacagaagtggccaagctaaggaaaccattcccctccaggagaccactctatacacagaggaccgcctggggctaaagaaaatggacaaagcaggaaagctagtgtttctggctaaggaaggagaccaccttcaaatatctaaagagtggtttacagcccacatcataccttttcttaagtgaagcccttgcactttgcagcagagtttatgacaccacagctcttccaaactccagtttgcaaccagtccttctctcgtgttatcatctaacatgccctgcttggaaagatctaagatctgaatcttatcctttgccgcctgctatcaccatatggtgttgaattcaagtttaattagctagtaaccgtgcagactgctttacaaccatgtgatatggtcaagctctcttttacggaaggggagtctgctattgcagatcagcaattgtgcctaagtgaagtgaagtgaagcagagagacaagctctgagggtaaaacccatacaaatttggagcaaataaaagcctcatggtatccagtcctgagatgttcacacaagcaatttctcaacattgctgtgggggccatgcatgtttctacatcatttcttaaagctgttttcctattttagtgttgccctctagtggcacctagcagtcactccacaagcctaccaacatgccccctcagagctcaccttctatccttaatcctcagtcaccaaaagggggatccaccagcagggttgcttaggagaggaaatgtcctttttcttttcttcccttttttgagacagggtttcactcactttttaaccctagctggcctgcaattcactatgtagagcagactggccttgaactcagtcacagaaatcacctgcccctctgccttctgagtgctgggattaaaggcatgcacccccaccccctacagcaatgtgtgtcttagacaccatggatagtgcgggagtggagaagtgaaaactaggtggctggtcttgccactgcactcttggctaactgtccttaatattacaagtagcgtaaatgtcacttacactactgcaaacaatgggaggaacagtctgaaaagatggaccttgacgatcctaccctacgtcctatttgccagcatgcgtccaactgctactgactgggttcaagaaaatgactaaagagtaaaaatcaacacatattaaactgatgatgattctgacagttaaagaaaaacaacactgatccaccatttcctacatttgaacatggactccttagcccccatcctgaaaagatcccagcatgttctagatgattcctatagagactggtttggagaaatgactgttttcgtcaaagtaccattagccctgcagaatccacccactgctggtttttccttttcctttctcaaacctagtgaaataaaaggatgagggttatggggaggaagtgggaggatctgaaaatagctttgaggttgtcttaaaaaaataaagaatagtttctt

SEQ ID NO: 3576 - DNA, 439 bp, Rattus norvegicus
  Genbank Accession No. NM_022506
tcctttccaacttgggcccggcagaatggctcccgcaaagaagggtggcgagaagaagaagggccgttctgccatcaacgaggtggtgacccgagaatacaccatcaacattcacaaacgcatccatggagtgggcttcaagaagcgtgctcctcgggcactcaaagaaattcggaaatttgccatgaaggagatgggaactccagatgtgcgcatagacaccaggctcaataaagccgtctgggccaaaggaataaggaatgttccgtaccgcatccgagtacgtttgtccagaaagcgtaatgaggatgaggattcaccaaacaagctctacacactggtaacttacgtgcctgttaccacattcaaaaatctacagacggtcaatgtggatgagaactaactgctgaatgtcaaataaagttacagaattgcctcc

SEQ ID NO: 3577 - DNA, 2661 bp, Rattus norvegicus
  Genbank Accession No. NM_022507
cgaggcgggtgccgtcggtcccgcgctgcgcgctcccttccgcgttccgccgtctgccccgcctggcaacccggccctgctcgggggccgctagccatggccggagtgccctggacacagcgctgacggcggctggcggagtgcgccatgcccagcaggaccgaccccaagatggaccggagcggcggccgcgtccgtctgaaggcgcactacggcggggacatcctgattaccagcgtggaccccacgacaactttccaggacctctgtgaggaagtgcgagacatgtgtggcctgcaccagcagcacccactcaccctcaagtgggtggacagtgaaggtgacccttgtactgtgtcctcacagatggagctggaggaggccttccgcctggcctgtcagggcagggacgaagtgctcatcatccacgttttcccaagcatcccagaacaaccgggcatgccttgtcctggagaagacaagtccatctaccgccgtggagccagaagatggaggaagctataccgagccaacggccacctcttccaagccaagcgctttaacaggagagcgtactgtggccagtgcagcgaaaggatatggggcctcgcgaggcaggggtacaggtgcatcaactgcaagctgcttgtccataaacgctgccacgtcctcgtcccgctgacctgcaggaggcatatggattctgtcatgccttcccaagagcctccagtagatgacaagaacgatggtgtagaccttccttcagaagaaactgatggaattgcttatatttcttcatctcggaaacatgacaatatcaaagatgattctgaggaccttaagcctgtcatcgatggggtggatgggatcaaaatctctcaggggctggggctgcaagactttgacctcatcagagtcatcgggcgtggaagctatgccaaggtcctcctggtgcggttgaagaaaaacgaccagatttacgccatgaaggtggtgaagaaggagctcgtccacgacgatgaggatatcgactgggtgcagacagagaagcacgtgttcgagcaggcatccagcaaccccttcctggttggcttacactcctgcttccagacaacgagccggttgttcctggtcatcgagtatgtcaacgggggggacctcatgttccacatgcagaggcagaggaagcttccagaggaacacgccaggttctatgctgctgagatctgtatcgctctcaacttcctacatgagagagggatcatctaccgggacctaaaactggacaacgtcctcctcgatgccgatggacacattaagctgacggactacggcatgtgcaaggaaggcctaggccccggcgacacaacaagcactttttgtggaaccccgaactatatcgcccccgaaatcctgcgaggagaagagtacgggttcagcgtggactggtgggcgctgggtgtccttatgtttgagatgatggctgggcgctccccctttgacatcatcacagacaaccctgacatgaatactgaagactaccttttccaagttatcctggaaaagccaattcggattccccgtttcctgtctgtcaaggcctcacacgtcttgaaaggatttttaaataaggatcccaaagagaggcttggctgccggccgcagactgggttttccgacatcaagtcccatgccttcttccgaagcatagactgggacctgcttgaaaagaagcagaccctgcctcccttccagccccagatcacagatgactatggcctggacaacttcgacacgcagttcaccagcgagcccgtacagctgaccccagatgatgaggacgtcataaagaggatcgaccagtccgagttcgaaggcttcgagtacatcaacccgcttctgctgtctgctgaggagtccgtgtgaggccatgagcatctctgttgtggacacgtctgtgaatgaccctgtcactttacccttaactacagcatatgcatgccaggccagacaccgaggctccaagcagccagagagggatgctggccaccaagaccgcagagggggcacccaacaggcacttctagacagagcaatctcttgtgtccaggccccagaggctggctttgtgctggaaggaaccacttcctgtgcccatggcggccctaccagagggtgagacagccacgccgtcttgaaaggcgcacatcttccacagagacagaactcgatgcactgatccgctccaggaaaagttagcgtgtaatgccctgaggaataaagtgtactgatgatgtcgaagcttcctctgatgccttttttctgtggcacccgcctgatgtccccaatgcagccccccacacgaggaggagctgcgctttccaagcaggcagaacgtaggcaggggacgggcacccaagtgcctgcagggatgttgtgctgcaacaagaattgttacagattcggaacgttttctaaatcccggtaagttctgttgttaatatttaacaagtattttcatacctagggcagctaaccgtggtaggctgaagccgaagggacaccccggccaggttggtggcgctgttcccaccagcccagcccgttcggactctgaagggggggaaattggatcacggagattctaaaacattgctcacc

SEQ ID NO: 3578 - DNA, 1243 bp, Rattus norvegicus
  Genbank Accession No. NM_022509
attttgggcgagcccagccccgtccgtggtagcaggccatggcgatgggcagcggcggcggcgcgggctctgagcaggaagacaccgtgctgttccggcgtggcaccggccagagtgatgattctgacatttgggatgatacagcattgataaaagcttacgataaagccgtggcctcctttaagcatgctctaaagaacggtgacatgtgtgaaacttcagataagccaaaaggcacagctagaagaaaacctgctaagaagaataaaaaccaaaagaagaatgccacagctccattgaaacagtggaaagctggtgacaaatgctctgccgtttggtcggaagatggctgcgtttacccagctaccatcacgtcagttgaccttaagagagaaacctgtgtcgtggtttatactggatatggaaacaaagaggagcaaaacctatctgatctgctttccccgacctgtgaagtagctaacaatacagaacagaacactcaggagaatgaaagccaagtttccacagacgacagtgaacactcctccagatcgctcagaagtaaagcacacagcaagtccaaagctgctccatggacctcgtttctccctccacctcccccggtgcccggggcgggattaggaccaggaaagccaggtctaaggttcagtgggccaccgccgccgccacctccccctcccccgttcttgccgtgttggatgcctccgttcccttcaggaccaccaataattcctccaccccctcccatatctcccgactgtctggatgacacggatgctctgggcagtatgctaatctcttggtacatgagtggttaccacactggttactatatgggtttcagacaaaataaaaaggagggaaagaagtgctcacatacaaattaagaagttcagctctctcccaaggagatggtttgttggtgtccctggtcgataagaacagaagtctcctcgtcacctttgtggactcttggctaagtggtgtcatcatcagggtctccctgtcccgggagtccatcctgagtcagcagcagggcatgcatagagcagcagttggaggaaccgatcaatcgatcgatcagtggcagtgtgagtgcatggaagtcagccaaactgtgactgagcacaaacggacaattgcaattttcttagaatgtcaagatttgtattaatgcctttaaaattaaataaaacccttttttgaaaaaaaaaaaaaaaaa

SEQ ID NO: 3579 - DNA, 1387 bp, Rattus norvegicus
  Genbank Accession No. NM_022510
cctgtgggagcagccgggtagagaggagcgtggccttctcctctccccgccatggcttgtgcccgtcccctcatatcggtgtactctgaaaagggggagtcatctggcaagaatgtcactttgccagctgtgttcaaagctcccattcgaccggatattgtgaactttgttcacaccaacttgaggaagaacaatagacagccctatgctgtcagtgaattagcaggtcatcagaccagtgctgagtcctggggtactggtagagctgtggctcgaattccaagagttcgaggtggtggcacccaccgttctggccagggtgcctttggaaacatgtgtcgtggaggccgcatgtttgcaccaaccaaaacctggcgtcgttggcatcgcagagtgaacacaactcagaaacgatatgccatctgttctgccctggctgcctcggccttaccagctttggtgatgtctaaaggtcactgtgttgaggaagttcctgaactgcctttggtggttgaagataaagttgaaagttataagaagaccaaggaggctgttcagctgcttaagaaacttaaagcttggaatgacatcaaaaaggtctatgcctcccagagaatgagagctggcaagggcaaaatgagaaaccgacggcggatccagcgcaggggaccctgcattatctataatgaagataatggaatcatcaaggccttcagaaacatccctggtattactctgcttaatgtaagcaagctgaacattttgaaacttgctcctggtgggcatgtggggcgtttctgcatttggactgaaagtgctttccggaagttggatgagttgtatggcacttggcgtaaggctgcttccctcaagagtaactacaacctccccatgcacaagatgatgaacacagaccttagcagaatcttgaaaagcccagagatccaaagagcccttcgagcaccacgcaagaagattcatcgcagagtcttgaagaagaatccactgaagaatctgaggatcatgttgaagctgaacccttacgcaaagactatgcgtaggaacaccattctccgccaggctaggaatcacaaacttcgagtgaaaaagctggaagccgcagctgctgcactggcagccaaatcggagaagattgttccagagaagggggctggagacaaaaaacctgcagtaggcaaaaaaggaaagaagcctgtggatgccaagaagctgaagaagcctgcagggaaaaaggtggttaccaagaaaccagcagagaagaaacctaccacagaagaaaaaaagtctgctgcataaactattaaaatttgttaaattccagagagcaaaaagatacagcctatttgaataaatcaaagatgcagtg

SEQ ID NO: 3580 - DNA, 1279 bp, Rattus norvegicus
  Genbank Accession No. NM_022513
gaattcctggcccttctgctccttctctttccccatagttttaactggcaaccggtagcttcttcagcatccgtacagcctgctacaaaaatgggtactgcagaagatgtttttagaaaagatctgaagatcattcatggctaccccatggtctatgcttttgcactgggttgggaaaaaatcgaagagttccagagcagaccatgtgacattgtaatacccacttaccctaaatcaggtactacttggcttagtgaaattgtggacatggttctaaatgatggaaatgttggaaaatgtaagcgagatgttattacctctaaagttccaatgttggaacaaaatgttcctggagcaagaagatcaggtgttgaactcttgaagaaaactccatcacctcgaattataaagacacatcttccaattgatctactcccaaaatccttctgggataacaagtgcaagatgatttaccttgctagaaatggcaaggatgttgctgtgtcctattatcattttgatctaatgaataatattcagcctcttcctggcacctgggaagaatatctggagaaattcctcgctggaaatgtggcctatggctcatggttcgatcatgttaagagttggtgggaaaagagggaagggcatcccatacttttcttatactatgaagacttgaaaaagaacccgaagaaagaaatcaagaagattgccaactttctagacaagaccttggatgaacataccttggaaaggatcgtccatcacacctcctttgaagtgatgaaggataaccccctggtcaattacacccatctgcccacagaaataatggatcacagcaagtccccattcatgagaaaaggtgttgttggtgactggaaaaattacttcacaatgacccaaagtgagaaatttgatgccatatataagaagaaattgtctggaacaacacttgagttctgcacagatattcagagtgcctaaacttcaacttgaatatatgatttcttgaaatagtagtttgacagggaaatcagatggatttgtgagggagaaataaatgtgcttttaaaacactgattaaatatgccctgcacatccctcagcaggaattattaataattccgaattatctagggccaaggtcttttgtgatcttagttttcaaagggtatgtcttcagattccaaggtgactactgaattaaataaataagttttgtgagttttgaaaaaaaaaaaaaaaaaaaaaaaaaaaaaaaaaaaaaaaaaaa

SEQ ID NO: 3581 - DNA, 463 bp, Rattus norvegicus
  Genbank Accession No. NM_022514
ctgctcgctgtcgaaatgggcaagtttatgaaacccgggaaagtggtgctggtcctggctggacgctactccggacgcaaagccgtcatcgtaaagaacattgatgatggcacctccgaccgcccttacagccatgccctggtggctggaattgaccgctatcccagaaaagtgacagctgccatgggcaagaagaagatcgccaagcgatccaagatcaagtcctttgtgaaagtttataactacaaccacctcatgcccacaaggtactctgtggatatccccttggacaaaactgttgtcaacaaggatgtgttcagagacccagcactgaaacgcaaggccaggcgggaggccaaggtcaagtttgaggagcgatacaagacagggaagaacaaatggtttttccagaagcttcgcttttagatgtatttttgttttcgtcattaaaaaaataaaaaat

SEQ ID NO: 3582 - DNA, 541 bp, Rattus norvegicus
  Genbank Accession No. NM_022515
ccggccagacatctgtcaccatgaaggtcgagctgtgcagttttagtgggtacaagatctacccgggacacgggcggcgctacgccaggaccgatgggaaggttttccagtttcttaatgccaaatgtgagtccgcattcctttccaaaaggaaccctcggcaaattaactggactgtcctctacagaagaaaacacaagaaaggacagtcggaagaaattcaaaagaaaagaacccgccgtgcagtcaagttccagcgggccatcacaggcgcttctctggctgatataatggccaagaggaatcagaaaccagaagttaggaaagctcagcgagaacaggctatcagggctgccaaggaagcaaaaaaggctaagcaggcatcaaagaagacagcaatggctgctgccaaggctcccacaaaggcagcccctaaacaaaagattgtgaagcctgtgaaggtctctgctcccagagttggtgggaaacgctaatttagtagatgagagtttaaaaataaagatttgtctctaaaaaaaaa

SEQ ID NO: 3583 - DNA, 2723 bp, Rattus norvegicus
  Genbank Accession No. NM_022516
cgtcccctgcggtctcctctgtgtgccatggacggcatcgtcccagacatagcagtcggtacaaagcggggatccgacgagctcttctccacgtgtgtcagcaacggccccttcatcatgagcagctcggcctcagcagccaacggaaatgatagcaagaagttcaaaggtgataacaggagcacaggagttccttccagagtcatccatgtccgaaagctacctagtgatgtcactgagggcgaggtcatctccctggggctgccctttgggaaagttaccaacctccttatgctgaaggggaagaaccaggccttcattgaaatgagcacagaggaggctgccaacactatggttaactactacacatcggtggcgccagtgcttcgtggacagcccatctacatccagttctccaaccacaaggagctcaaaaccgacagctcgcccaaccaggcacgtgcccaggcagccctgcaggctgtgaactccgtacagtcaggaaacctggccttggcagcctctgctgctgccgtggatgcaggaatggcaatggcaggccagagcccagtgctcaggatcattgtggagaaccttttctacccagtgacactggacgtgctgcaccagatcttctcgaagtttggcacagtcctgaagatcatcacgttcaccaagaacaaccagttccaggcgctgctgcagtatgctgaccctgtgagcgcccagcatgccaagctgtccctggatggccagaacatctacaatgcctgctgcacgctgcgcatcgacttctccaagctcaccagtctcaacgtcaaatacaacaacgacaagagccgagactacacacgccctgacctgccctctggagacagccagccatcactggatcagaccatggcagcagcctttggcctctctgttcctaatgtccatggagccctggcacccctggccataccctctgctgctgctgctgctgctgcagccggccgcattgccatcccagggctggcaggcgccgggaattccgtccttttggtcagcaacttgaaccctgagagagtcacaccccaaagcctctttattctcttcggcgtctacggtgatgtgcagcgggtgaagatcctgttcaacaagaaggagaacgcacttgtcgagatggcagacggcagccaggcccagctggccatgagccacctgaacgggcacaagctgcatgggaagtcagtgcgcatcaccctgtcaaagcaccagagtgtgcagctgcctcgtgagggacaggaggaccagggcctgaccaaggactatggcagctcaccgctgcaccgcttcaagaaacctggctccaagaactttcagaacatctttcctccctcagctaccctgcacctctccaacatcccgccctctgtgtcagaggatgacctcaagagcctcttctccagcaatggcggtgtggtcaaaggcttcaagttcttccagaaggaccgcaagatggcactgatccagatgggctctgtggaggaggcagtgcaggcactaattgagctgcacaaccatgacctgggcgagaaccaccacctgcgagtgtccttttccaagtccaccatctaggtgcctgtgggcctgcgaagcttccgccattccagaaaagccactttaaaaagcagctgaagtgaccttacagaccagagatttatttttttaaagagagatcagtttacctgtttttaaaaaaattaaatctagcccactttgccgtggcaggaaatggcttgggccacagaggcccaggcccagcaaccatgccttgaggggcttaggcgtgaggccacagcggtgccccaacacagccgcttctgtgccttacaaaaccagcgtgcctcacggccgcacacccaccctctaaggccaccagttgtctctagacctgcagtgagccaggcggcctatacttaggctccccaatgccgtgtaagagctggggccactcccctacacccattataatcaagtgacatgattctcccatgtccctggccagcccagagggcccaggccgtcctcagcgccgagccttgtgtgaccttgtattctattccgtggggtcacagacacctgtgcctagcaatctttccacttgaccaaatacccgagtcttttccatttatatgcaagagatagagtttttaagtaactttttatagcagtggtacaattgtatgtgtgtactctaagcttctctgtcccctgcactccttccttccagtgaccaacttgcaggtgggcccaggccagggctggagaagaagctctgaggcttgtgggtgtcctaccttcaaattttggaccaaagttttgttctctgcccgcctctgactatgcccagttgaggggctgacctctaggccttaatgtccttcctggacgcccacctccatcctagcctgtttctatgggaggggttccctgcacctcagtttctgtgaaagtcatggaagagtgtaaatatttatgattttatacctgtggggctgaggcggtgcagcattttttatggtgacagatgtatattttggtaacgactacaggctcagtattgtcctgggccagccctagccacatctaccccagcccagatggtgtattggggggagggggactttccattaaagcagtttataacctttgaaaaaaaaaaaaaaaaaaaaaaaaaa

SEQ ID NO: 3584 - DNA, 900 bp, Rattus norvegicus
  Genbank Accession No. NM_022518
gcggctgctaaggaccgagtctggtcgggcggcctgaggtctctggccagtatcgcttccacctgtccacaaacatggggaatatctttgcaaacctcttcaagggcctttttggcaaaaaagaaatgcgcattctcatggtgggcctggatgctgcagggaagacaacaattctatacaaactgaagctgggcgaaattgtgaccaccattcccaccattggtttcaacgtggagactgttgaatacaagaatatcagcttcaccgtgtgggatgtgggtggccaggacaagattcggccgctgtggcgccactacttccagaacacccaaggcttgatcttcgtagtggacagcaatgacagagagcgtgtgaacgaggcccgtgaagagcttatgaggatgctagctgaagatgagctccgagatgccgttctcttggtgtttgccaacaagcaggacctccccaatgccatgaatgcggccgaaatcacagacaagctggggctgcactctctacgccacaggaactggtacattcaggctacctgtgccaccagcggagacgggctctatgaaggactagattggctgtctaatcagctccggaaccagaagtgaaccagacccctccttccccctcacttcctcttctccgccctcagctttcctctcatgtggcaaacgtgcgactctgtggtcctgagtgccagaagctgtctccatgggttggtcacagtgtgcatcgcaccgtgctgtacatgtgcagacgcagcctgcagccaggtttttatttaatgtaaatagtttctgtttccactgaggcagtttctggtactcctatgcaatattacttagctttttttattgtaaaaagagaatcaactcactgtcagtacct

SEQ ID NO: 3585 - DNA, 1380 bp, Rattus norvegicus
  Genbank Accession No. NM_022519
gggctctttctcctcagccttggtcaccaccccagctctgggacaacaagttgaaaatggcaccctccatctcacgggggctcctgcttctggcaggcctgtgttgcctggcccccagcttcctggctgaggatgcccaggaaaccgatacctcccagcaggaccagagtccaacctaccgtaagatttcttcaaacctggcagactttgccttcagcctataccgggagctggtccatcaatccaatacatccaacatcttcttctcccctatgagcatcaccacagccttcgccatgctctccgtggggagcaagggtgacactcgcaaacagattctagagggcctggagttcaacctcacacagatacctgaggctgacatccacaaggccttccatcacctcctccaaactctcaacaggccagacagtgagctgcagctgaacacaggcaatggcctctttgtcaacaagaatctgaagctggtggagaagtttctggaagaggtcaagaacaattaccactcagaagccttctctgtcaactttgccgactcagaagaggctaagaaagtaattaatgattatgtagagaagggaacccaaggaaagatagttgatttgatgaaacagctggacgaagacacggtttttgccctggtgaattacattttctttaaaggcaagtggaagaggccattcaatcctgagcacactagggatgctgactttcacgtagacaagtccaccacagtgaaggtgcccatgatgaaccgcctgggcatgtttgacatgtactattgcagcacactgtccagctgggtgctgatgatggattacctgggcaacgccactgccatcttcctcctgcccgatgatggcaagatgcagcatctggagcaaactctcaccaaggatctcatttcccggttcctgctaaacaggcaaacaaggtcagccattctctacttccccaaactgtccatctctggaacctataacttgaacacactcctgagctcactgggcatcacccgggtcttcaacaatgatgctgatctctctggaatcacagaggatgcccccctgaagcttagccaggctgtgcataaggctgtgctgaccttagatgagaggggaacagaggctgcaggagccactgtggtggaggccgtccccatgtctctgccccctcaagtgaagttcgaccaccctttcattttcatgatagttgaatcagaaactcagagccccctctttgtgggaaaagtgatagatcccacacgttaatcactgtcctcagaagtcacatcccttctggatcgggtccccttcctaataatattaaactcaggctggcctggcctgatgcttctgc

SEQ ID NO: 3586 - DNA, 1938 bp, Rattus norvegicus
  Genbank Accession No. NM_022521
gcggacgtgtcaggtctctctgcacttccattcctgaaggacccacacaatgctttccaaactagcaagtctgcagactgttgccgctctgcgtcgaggactccgcacctcagtcgcctctgccacatctgttgcaacgaagaagacagagcaaggcccaccatcctctgagtacatttttgaacgggaatctaaatatggtgcacacaattaccatcctttacctgtagccctggagagaggaaaaggcatttatatgtgggatgtggaaggcaggcagtacttcgacttcctgagtgcttatggtgctgtcagccaaggacactgccacccaaagatcatagaagccatgaagagtcaggtggacaagctgacattaacatctcgggctttctataacaatgtccttggtgaatatgaggagtacatcaccaagcttttcaactacaacaaagttcttcctatgaatacaggagtggaggccggagagactgcgtgtaagcttgctcgccgttggggctacaccgtgaaaggcatccagaaatacaaagcaaagatcgtttttgctgttggaaacttttggggtcggacgctgtctgcagtctccagttccacagatccgaccagttatgatggctttggacccttcatgccaggctttgaaaccatcccatataacgatctgcctgcgctagagcgtgctcttcaggatcccaatgttgctgctttcatggtggagcccatccagggtgaagcgggtgttatcgttccagatccaggatacctgacgggagttcgagaactttgcacccggcaccaggtcctgtttattgctgatgaaatacagacaggattggctagaactggtcgatggctagctgtggatcatgagaatgtcagacctgacatagttcttcttgggaaggccctttctggtggcttatatcccgtgtctgcagtgctgtgtgatgatgacataatgctgaccattaaaccaggcgagcacggctccacgtatggcggcaacccactaggctgccgaattgctattgcggctcttgaggttttagaagaagagcatcttgctgaaaacgcagacaagatgggtgccatcttgagaaaggagctcatgaagctgccatctgatgttgtgactgctgtgagagggaaagggttgctaaatgccatcgtcatccgagaaaccaaagattgtgacgcttggaaggtgtgcctgcgactccgagataatgggcttctggccaagccaacccatggtgatatcatccggcttgcccctccacttgtgatcaaagaggatgagatccgggagtcagtggagatcatcaacaagaccatcttgtccttctgagagtaggaactctggggagccatcttcagatggggctcttgtgaaactctgcttgggatgggcagattcggcttgtctgtctcctaaaagacaattttttgaatatgtattatatatttcagttgatgcatagtggagtgacacctaggaacctgcaggtggctgcgtgacacaagagtgagagcgagaggcatctctttgttaaagtttgactgtgtgggagctttctaaggagaaacagatctatctgcatacagcctgcagagtcctgccgtaatttacatgtgtctttacatcttccttgctggcatgaatgttttgtatttggaagtttttttctgagatactacataagaaactgttgaatcattataatcaatgaatggtaagatgattgagggttgagcatatgtaaaatactagtttaaagtacactttgcattggccaacagcagaatgtattatatagtttctgagaattcattaccaaattatactttaagtgcttgattgcaatttgtaaaacatttattttcagtatttctttgaataaagcttcgtttttcttt

SEQ ID NO: 3587 - DNA, 3365 bp, Rattus norvegicus
  Genbank Accession No. NM_022522
ctggaaatggcggcgtcgagcgggaggtctcagtcttccctgcacaggaaggggctgatggcggctgacaggaggagcaggattttggcagtgtgtggaatgcatcctgaccatcaggaaactctgaaaaagaatcgagtggtgctggccaaacagctgctgctgagcgaactgttagaacatctcctagaaaaggacattatcactttggaaatgagggagctaatccaggccaaagggggcagtttcagccagaatgtggaactcctcaacctgctgccaaagagaggaccccaggcttttgatgccttctgtgaagccctgcgggagaccaggcagggtcacttggaagacttactgctcacaaccctctctgatatccagcacatactcccaccgttgagctgtgactatgactcaagtctccccttctcggtgtgtgagtcctgccctcctcacaagcagtcccgcctatccacagatactatggaacactccttagataatggtgatggtcctccctgtcttcaggtgaagccatgcactcctgagttttaccaggcacactaccagctggcctataggttgcagtctcagcctcgtggcttggcactggtgatgagtaatgtgcacttcactggagagaaagacctggaatttcgctccggaggggatgtggaccacactactctagtcaccctcttcaagcttttgggctacaatgtccatgtgctgtatgaccagactgcacaggaaatgcaagagaaacttcagaattttgcacagttacctgcacaccgggtcacagactcctgcatagtagcactcctctcacatggtgtggaaggtggcatctacggggtggatggcaaactgcttcagctccaagaggtttttcgactttttgacaatgctaactgtccaagtctacagaacaaaccaaaaatgttcttcatccaagcatgtcgtggagatgagacagatagaggggttgaccagcaagatggaaagaaccatgcacaatcccctggatgtgaggagagtgatgctggcaaggaggaattaatgaagatgagacttcctactcgctcagacatgatatgtggctatgcttgccttaaaggcaatgctgccatgcggaataccaaacggggttcctggtacattgaggccctcactcaggtgttctctgagagagcttgtgacatgcacgtggccgacatgcttgttaaggtgaatgcccttatcaaggagcgtgaaggctatgcccctggtacagaattccaccgatgcaaggagatgtctgagtactgtagtactctgtgccagcagctctacctgttcccaggctacccacccacgtgatgccacctgctagtcatgctgttggaggccactggaccacggggcacaatggagacttctcttcaagatgtttttgttctgtctactccctcagggatatgagattctcccaagcttgtttcctgtcagccatctccgtctttgggggtgaaacttgaggacagctcctctggtgtggtgttctcttcctgtagagccagctatgaatggatctgttgccagaagcattttggctatagccaatgagactagaaaatgacattgtgaacacagtattattgtggggagagggcatacggatttctcaatgtttgtgatatttttgttcccagggctcttagggatactttgattattgcttttttatatcagttaaggactttcagatatcatctcctactttttttttcatatctgcaacctcattttttccatagtgaagatttggaaaatgtcccaatttaatgcagttgttgtcatctgtcatgaagcggcaggtgagaccctgctacttgagcagaagtttcagacctttgagttcaggccttaggtgaaggacagtccctcagcttttccattggtttctttgtgttcattgtacccagcttttgagcagagcctggggtctgcttgctgtgacactggaagttatatacgtttccctggttatgaattgtcactgaaatgaaccttattgggcatatcaacataaaaatgcagtgacaggtgagtgtgctgtgtctcatactgtcacttgtcaccaggatatctctccttccttactgtggtttctgctgtgcagttaaactacttgatggctgacctccaagaaccctcttgctttgcattggttcccctccttgacccattcactgcttctgccacgtctgtgaaatcttcccttgtagaatgtttctggccacttaagcagtactgcttcagcataaggtttcttcggttttctgcggcagtgtctccattctcactgtttctctgttttagtgaggatagtactataggtgatataacctagaagcacttatctctgctcttatgaaactttcttattcttaaaaaccttttgcatttccatttttttcctcttttccagtttattctccacatgacagagtagttttgtttttttttaatatctggtgatgtcactcccttgttaagaacattagcttcctgttacacctcatctaaaattcaaattcttacccagtttatgagatccggcttttacgttccctttggatctcattagatggtgatttctctctgtgttcagcccctcagttcctcagctcagtgttgcaagtgttctgagctcttctttaagatagtctctgattcttgagtctggcggaggcctcttgaccgtgatgttgatgaagtaagtcttctgtacctccttaggatggcatcatgttggtccttgtgcttactgcaggttgtaatggcacgtttcacttgctccctccaaagctgaaggctccaagagagcaggactgtactccttacttattggctattcagtacggcacttactaggtcttcaatgaatgtttcctgagtaaaggaaggagacaagcagctaactttagttagagcctatcttttgcgatttctaaattgctattatagtactcagtttaattagtatttgtactcttgtgggggtttttttccaggtgttttatttttatccactgttttgttgtttttttacattgtttgaagatgtatcacgtgtgagacaacttctttcacatctccatggtgccccgcaaatttgaggcctatggtagttgaggtgctcaattaatgtttgtcgtatgaaccaggtggtttgaagacttgctgccaaattctgcctttgggtcagtataggatgcatgagtggtagactcttcacacttcccactgccaagattttgtattgccatcaggtgccaaataaatgtcgatacttactactgacaaaaaaaaaaaaa

SEQ ID NO: 3588 - DNA, 1668 bp, Rattus norvegicus
  Genbank Accession No. NM_022523
gcgctcctacagtggctgccggggctggtatttcaaagcgtggttgatctggtggctctgagaatcattctgattactgcttcagacaccataggagtggcaagatcccacctgccaggtgaagggcgggcagatcagtgactttgacctgtacctgctggtcctgacttccagaggcccaggatgggggaattcaacgagaagaaggcaacatgtggcacagtctgcctcaagtatctgctgttcacctacaactgctgcttctggctggctggcctggccgtcatggcagtgggcatttggacactggccctcaagagtgactacattagtctgctggcttcaagcacctacctagcaacagcctacatcttagtggtggctggtgttgttgtcatggtgactggagtcctgggctgctgtgccactttcaaggagcgacggaacctgttacgcttgtacttcatcctgctcctcatcatcttccttctggagatcattgctggcatcctggcctatgtctactatcagcagctcaacaccgagctcaaggagaatctgaaggacaccatgatcaagagataccaccagtcaggccatgagggtgtgaccaacgctgtagacaagctgcagcaagagttccactgctgtggcagcaacaactctcgagactggagagacagcgagtggatccgctctggtgaggcagacagccgtgtggtccctgacagctgctgtaagactgtggtaactggctgtggtaagcgggagcacgcctccaacatctataaagtggaaggtggctgcatcactaagctggagtccttcattcaggagcacctgcgggtcatcggggccgtgggcattggcatcgcctgtgtgcaggtcttcggcatgatcttcacctgctgcttgtacagaagcctcaagctggagcactactgaccatggtgccaggccagaaggccagcctcgcgctgtgtcccagccccccactactgaacactactgagttagactgctgactgccagagaggtagctgccctcatgccattaccatgtcccctggtggctccacctccgtggtagcttcaagtgcctttccctgcacaccaaagtcccaaagcttgaggcagcgtacttgccccagcattaacaagagggggcatgtatgccagtgttgggctaggcctggctagtagagtagggtttagattacttgacagaagtgcctcttatgtagactgcttccctttgggtagctgtgatctgcagtaagtctggggagaatccgagcataccactacacggtgggtaagagcaggtgggaaggggcctttctggttgggctaggcacctttcatgcctgctgccaggaaccctcagatagggcaagcttaggggaactggaatcccacactgtatgctgtcctttccacacaggcctcttgctcctaacggcctcagccctgggcttttcctactactgataacactatgtaaatgttccatgttcctgtacactgtctcttttgggaacatctctgaatggagcatggctgttttcattcactgctgtatcccagatgcccacagatgctcctgctgtgtgacaggtgctcaataaatgtataagcagtcaaaaaaaaaaaaaaaaaaaaaaaaaa

SEQ ID NO: 3589 - DNA, 1827 bp, Rattus norvegicus
  Genbank Accession No. NM_022524
atcttggcctcctccagccccttagtgctgcgcagcctgcccggcgggggaagcgccggctcgccatggggagcccgggactccggcccacgctgctgctgcctcaagtactgttgctgttgctggcgctgctgcacgtcccgccgagccagggcttcccaggctctggagactcaccactagaagacgatggagtctggtcttcacactctctctataaagacactccgtggtgctctcccatcaaggtgaaatatggggatgtgtactgcagggctcctcctgggggatattacaaaacagccctggggaccaggtgtgacattcgctgcaggaagggctacgagcttcatggctcttcccagctcgtctgccagtcaaacaggcgctggtcggataaggtcatctgcaaacaaaagcgatgtcctaccctcaccatgccagcaaatggagggtttaagtgtgtcgatggcgcctactttaactctcggtgtgagtactattgctcaccaggatatacattgaaaggggaacggacagtcacatgtatggacaacaaggcctggagtggccgaccagcctcctgtgtagatatggaacctcctagaatcaagtgcccaagtgtgaaagaacggatagctgagcctaataagctgacagtccgcgtgtcctgggaaaccccagagggaagagatacagcagatgggattcttactgatgttattctgagaggtcttcctccaggctcgaattttccagaaggagaccacaagattgagtacactgtctatgacagagccgagaacaagggaacttgcaagttccgagttaaagtaagagtcagacgttgtggcaagctcaatgccccagagaatggttacatgaagtgttccagcgatggtgacaattatggggccacctgtgagttctcctgtatcggtggctatgagcttcagggtagtcctgcccgagtatgccaatccaatctggcttggtctggtacagagcctagctgtgcagcgatgaatgtcaatgttggtgtcagaaccgcagctgcacttttggatcagttttatgagaaaagacgactcctcattgtgtctacacccacagctcgaaacctcctctacagactgcagctgggaatgctacagcaagcacagtgtggtctggatctccgacatatcaccgtggtggagctggtcggagtcttcccaaccctcatcggcaggatcagagcaaagattatgcccccagccctagctctgcagctcaggttgttgcttcgaatcccactctactccttcagcatggttttagtggataagcatggcatggataaagaacgttatgtctccttagtgacacccatggctctcttcaacctcattgacactttccccctgagaaaagaagagatgatccttcaggctgagatgggccagtcttgcaacacctgatgtgctgttccatttcctggtgctttctcacctcttatcatagagtatatcatgtagtatactacagtgcctgtgggaaggccttaaaaatacctttgatgtacagattttcatttgtaatttttaaagtctattttattatgtgcttcctttgctcttaaacattggcacaatgccttttaaactttgaaatgttaaaaaaaaagtacgaatatatctattctaactctccctttaggccattgtggctgatgaaattagaagtgacagccacgcccatgctttcagaatattattcagtgtgaaacacattttccttttctcttattgtttatataagtcttttgttaataaaatattttgaagc

SEQ ID NO: 3590 - DNA, 540 bp, Rattus norvegicus
  Genbank Accession No. NM_022529
ggaggtgcggctgccatggcgcggaatgtgttgtaccccctctaccagctgggcggccctcagctccgtgtgtttcgaactaacttcttcattcagttggtgcggcctggtaccgcacagcctgaagatacagtgcaattccggatccccatggagatgaccagggtggaccttcgaaattaccttgagcagatttacaacgttcctgtggctgctgtgcgcacacgggtacagcatggctccaacaggaggagggaccataagaatgtgaggatcaagaaaccggactacaaagtggcctacgtgcagctggcccacgggcagaccttcactttcccagatcttttcccagaaaaggaacccacttctccagaccctctggaagaggagctaccccagcagaggcaaagcagcgacccacggtgccctggtatcccttcctggtttggcctatgacctctgacagcaggttctgggccacagaccctagtgagcacagtggttctgacaagcccaaataaaaattttttgtggagaaag

SEQ ID NO: 3591 - DNA, 840 bp, Rattus norvegicus
  Genbank Accession No. NM_022536
gctgcgcctctcggagcgcaatatgaaggtgctcttcgccgccgccctcatcgtgggctccgttgtcttccttttgctgcctggaccctccgtggccaacgataagaagaagggacctaaagtcacagtcaaggtatactttgatttccaaattggagacgaacctgtaggacgagtgacctttggactctttggaaagactgttccaaaaacagtggataattttgtagccttagctacaggagagaaaggatttggctataagaacagcaagttccatcgtgtcatcaaggacttcatgatccagggtggagacttcaccaggggagatggcacaggaggaaagagcatctatggtgagcgcttcccagatgagaacttcaagctgaagcactatgggcccggatgggtgagcatggccaatgcaggcaaagacaccaatggctcccagttcttcataactacagtcaagacctcctggctagacggcaagcacgtggttttcggcaaagttctggaaggcatggatgtggtacggaaggtggagaacaccaagacggacagccgggacaagcccctgaaggatgtgatcattgtagactgtggcaagatcgaagtggagaaaccctttgccattgccaaggagtagagagagcctcggggacctcatccctctaaacagctgtctgtgcgggtcctgtcgattccctcacaggtgaaagcagccagtcacaaggctctgtgcggctctggctccagtgcttccatccgacggggtggccacacccctcacattccacaggcctgatttttatataaaactcctaccaatgctgatat

SEQ ID NO: 3592 - DNA, 871 bp, Rattus norvegicus
  Genbank Accession No. NM_022538
agatctgtgaccatgttcgacaagccgcggctgccgtacgtggtcctcgatgtgatttgcgtgttgctggctggattgccttttataattcttacttcaaggcatacccccttccaacgaggagtgttctgtactgatgagtccatcaagtacccttacagagaagacaccatcccttatgcgttattaggtggaatagtcattccattctgtattatcgttatgattactggagaaactctgtctgtttactttaatgtcttgcattcaaattcctttgtcagcaatcactatatagccaccatttacaaagccgttggagcctttttgtttggagcctcagccagtcagtccctgactgacattgctaagtactctataggcagactgcggcctcacttcctggctgtctgtaacccagactggtcaaaaatcaactgcagcgatggctacattgagaacttcgtatgtcaagggaatgaacagaaggtcagggaaggcaggttgtccttctactcggggcactcctcattctctatgtactgcatgctgtttgtcgcactttatcttcaagccaggatgaagggagattgggcaagactcttacgacccatgctacagtttgggcttgttgctttatccatatatgtgggcctgtctcgagtttctgattacaaacaccactggagcgacgtgttaattggcctcattcaaggagctgttgtggcaatattagtggttttgtatgtaactgatttcttcaagaccacagagtctaacaaagaaagaaaagaggactcacatacgactctacacgaaaccaccaacagacagagctacgcaaggaatcacgagccctgaaggggtcgac

SEQ ID NO: 3593 - DNA, 1944 bp, Rattus norvegicus
  Genbank Accession No. NM_022539
ggtgaagaaggagcgggccctcgccgctcgttctcgctccctctttctctctctcttcttctctctctctttccctctcgggcaacatggcgggcgtggaagaggcatcgtctttcgggggccacctgaatcgcgacctggatccagacgacagggaagagggaacctccagcacggccgaggaagccgccaagaagaaaagacggaagaagaagaagggcaaaggggctgtgtcagcagggcaacaagaacttgataaagaatcgggaacctcagtggacgaagtagcaaaacagttggagagacaagcactggaggagaaagagaaagatgatgacgatgaagatggagatggtgatggtgatggtgcagctgggaagaagaagaaaaagaagaagaagaagagaggaccaagagttcaaacagaccctccctcagttccaatatgtgacctgtatcctaatggtgtatttcccaaaggacaagagtgtgaatacccacccacccaagatgggcggacagctgcttggagaaccacaagtgaagagaaaaaggcgctagaccaggctagtgaggagatttggaacgacttccgagaagctgccgaagcacaccggcaagttaggaaatacgtcatgagctggatcaagcctgggatgacaatgatagaaatatgtgagaagttggaagactgttcccgaaagctcataaaggagaatgggttaaatgcaggcctggcctttcccactgggtgttctctcaacaactgtgctgcacattacactcccaatgctggtgacacgacagtcttacagtacgacgacatctgtaagatcgactttggaacgcatataagtggtagaataattgattgtgcttttactgttacttttaatcccaaatatgacatattattaaaagctgtaaaagatgccaccaatactggaataaagtgtgcggggattgacgtccgtctctgtgatgtcggcgaggccattcaagaagttatggagtcctatgaagtggaaatagatgggaagacctaccaagtgaaacccatacgtaacttaaatggacattcaattgggccatatagaattcatgctggaaaaacagtgcccattgtgaaaggaggggaagctacaaggatggaggaaggagaggtgtatgccattgagacctttggtagcacagggaagggcgtggttcatgacgatatggaatgttcacactacatgaaaaattttgatgtgggacacgtgccaataaggcttccaagaacaaaacacttgttgaatgtcatcaatgaaaactttggtacccttgccttctgccgaaggtggctggatcgcttgggagaaagtaaatacttaatggctctgaagaacctgtgtgacttgggcattgtagatccatatccaccactctgtgacattaaaggatcatacacagcacagtttgaacataccatactctgcgcccaacctgtaaagaagttgtcagcagaggagatgactattaaaacttagtccaaagccaactcaacgtctttattttctaagctttgttggaacacattataccacaagtaatttgcaacatgtctgttttaacagtggacctgtgtaatgccgttatccatgtttaaaggagtttgatcaaagccaaactgtctacatgtaattaaccaaggaaaaggctttcaagactttactgttaactgtttctcccgtctaggaaatgctgtactgctcactagttaggaattacttaaacgttttgttttgaagacctaagagatgctttttggatatttatattgccatattcttacttggatgctttgaatgactacatacatccagttctgcacctatgccctctggtattgctttttaaccttcctggaatccattttctaaaaaataaagacattttcagatc

SEQ ID NO: 3594 - DNA, 1514 bp, Rattus norvegicus
  Genbank Accession No. NM_022546
tgaacccgcaggtttgcaccggaggctctcgcgggggcctcgctggccctgggcggggactcgcgggctgaggacgctcctgtgtccccagaatcctgcagaaggacagcgccatgtccacgttcaggcaggaggacgttgaggaccattatgagatgggagaggagcttggcagcggccagttcgccatcgtgcgcaagtgccagcagaagggcaccggcatggagtacgcggccaagttcataaagaagcggcgcctgccgtccagccggcgcggtgtgagccgtgaggagatcgagcgcgaggtgagcatcctgcgcgagatccgccaccccaacatcatcacgctgcacgatgtgttcgagaacaagacagatgtggtgctgatcttggagctggtgtccggcggcgaacttttcgactttctggctgagaaggagtcactgacagaggatgaggccacgcagttcctcaagcagatcctggacggtgtccactacctgcactccaagcgcatcgcgcactttgacctgaagccggagaacatcatgttgctggacaagcatgcagccagcccacgcattaagctcatcgactttggcatcgcgcacaggatcgaggccggtagcgagttcaagaacatctttggcacgccagagttcgtcgcccctgagattgtaaactatgaaccacttggcttggaagctgatatgtggagcatcggcgtcatcacctacatcctcctgagcggggcttccccattcctgggggagaccaagcaggaaacgctgacaaacatctcggctgtgaactatgactttgatgaagagtacttcagcagcaccagtgaactggccaaggacttcatccgaaggctgctggtcaaagatcccaagaggaggatgaccatcgcacagagcctggagcattcctggatcaaggttcgccggcgtgaggacggcgcccggaagccagagcgacgccgactgcgcgcggcgcgcctgcgcgagtacagtctcaagtcgcactcaagcatgccgcgaaacacgagctacgccagcttcgagcgcttctcgcgcgtgctggaggacgtggcggcggcggagcaggggctgcgcgagctgcagcggggccggcggcagtgccgggagcgcgtgtgcgcgctgcgcgtggctgcggaacagcgggaggcgcgctgccgcgacgggagcgccgggctaggccgcgacctgcgacgcctgcgcacggagctgggtcgcaccgaggctctgcgcacgcgcgcgcaggaggaggcacgggcagcgctcttgggcgctggtggcctgaaacgtcgcctgtgtcgccttgagaaccgctacgacgcgctagccgcacaggtggctgctgaggtgcagttcgtgcgcgatctggtacgcgcgctggagcaggagcggctgcaggccgagtgcggcgtgcgctaggctgcgacacccccagatctccggccatccccagaataaagctactttccacgc

SEQ ID NO: 3595 - DNA, 3109 bp, Rattus norvegicus
  Genbank Accession No. NM_022547
cccgtctgggagctcgcggttcctgtgctgactctcaaagggctgactgaccctcgcacctagcaggtacttctggattgcaagtccagggttctgggccggtgaccctgttttctctacttcctgtctttgaccttgggtaccttccaacccactgttgccatgaagattgcagtaatcggacagagcctgtttggccaggaggtttactgccagctgaggaaggagggccacgaggtggtgggtgtgttcacaatcccagacaaggatgggaaagcagaccccctgggcctggaggctgagaaggatggccgtgccgtgttcaagtttcctcggtggcgtgctcggggacaggctctgcccgaggtggtggccaaataccaggctctgggtgcagagctcaatgtgcttcccttctgcagccagttcatacccatggaggtcattaatgcccccaggcacggctccatcatctaccatccatccctgctacccaggcatcgaggggcttcggccatcaactggaccctcattcatggagataagaaaggaggcttcaccatcttctgggctgatgatggcctggacactggtgaccttctgctgcagaaggagtgtgaggtgcttccagatgacaccgtgagcacgctgtacaatcgtttcctcttcccagagggcatcaaagggatggttcaggctgtgcgactgatcgcagagggtacagccccccgctgcccccagtctgaggaaggagccacctatgagggcattcagaagaaggagacagccaagatcaattgggaccagccagcagaggccattcacaactggatccgtgggaatgacaaggtgccaggtgcctggacagaggcttgtgggcagaagctgacatttttcaactcgacactcaacacttcaggactgtcaacccagggagaagctttacccatcccaggagcccatcgtccaggcgtggtcaccaaagcaggactcatcctctttgggaatgagcatagaatgttgctggtgaagaacatccagctggaagatggcaagatgatgccagcctcccagttcttcaaggggtccgctagcagtgacctggagctgacagaggcggagttggccacggcggaggctgtgcggagctcttggatgcgaatcctgccgaacgtcccagaggtggaagactctacagatttcttcaagtcaggagctgcttctgtagatgttgtgaggctggtggaggaagtgaaggagctgtgtgacgggctggagttagaaaatgaagacgtttacatggccaccacctttagggagtttatccagctcctagtgaggaagctgagaggggaggacgacgagagcgagtgtgtcattaactacgtggaaagggcagtgaacaagctgactctccaaatgccctaccagctcttcataggcggcgagttcgtggacgctgagggctctaagacctacaataccatcaacccaacggatggaagtgtcatctgccaggtgtccctggctcaggtgagcgatgttgacaaggcagtggcagcagcaaaggaagccttcgagaacggactgtggggaaagataaatgctcgtgaccggggccggctcctgtacaggttggcggatgtcatggagcagcaccaggaagagctagccaccattgaggccctggatcgaggtgccgtctacacgctggccctgaagacgcacgtgggcatgtccatccagaccttccggtactttgctggctggtgtgataagatccagggtgccaccatccccatcaaccaggctagacccaaccgcaacctgaccttgaccaagaaggaacctgttggggtctgtggcattgtcatcccctggaactatcccttaatgatgctatcctggaagactgcagcctgcctggcggctgggaacaccgtggtgatcaagcctgcccaggtgaccccactcacagccttgaagtttgccgagctgacactgaaggctggcattcccaagggtgtggtcaacatcctcccaggatctggatccctggttggccagagactctcagaccaccctgatgtgaggaaaatagggttcacaggctccacggaggtggggaaacacatcatgaaaagctgtgctctgagcaacgtgaagaaagtctccctggagctgggtggaaagtcaccccttatcatatttgctgactgcgacctcaacaaggccgtgcagatgggcatgagctccgttttcttcaacaaaggggagaactgcattgcggcaggccggctctttgtggaggagtccatccacaaccagtttgtgcagaaagtggtggaggaggtggagaagatgaaaatcggcaatcccctggagagggacaccaatcatggcccgcagaaccatgaggcccacctgaggaagctagtggagtattgccaacgtggtgtgaaggaaggggccacactggtctgtggtgggaaccaagtcccaaggccaggattcttctttcagccaaccgtcttcacagacgtagaggaccacatgtacatcgctaaggaggagtcctttgggcccatcatgatcatctctcggtttgctgatggggatgtggatgctgtgctgtcccgggccaatgccacagaatttggcctggcctctggggtcttcacccgcgatatcaacaaggccctgtatgtcagtgacaaactgcaggcaggcactgtgttcatcaacacgtataacaagactgatgtggccgcaccttttggaggattcaagcaatctggatttggcaaagacctgggagaggcagccctgaatgagtacctgcggatcaagactgtgacttttgagtactgaagccaagtctgtgatatttctcctgtaccctgttgcctcccctcagggagccctggcccctgtctggtgtcttagcaccctcctgtccccaacactgttcccttcagctgctggagctatcagtgtggacccctgctggtgacaggacacctccggacaattggaagtggttccaagtggagtgagcagtcatgtcccggatgaataaaggttgtgagcagaagtcacctgcaaaaaa

SEQ ID NO: 3596 - DNA, 4269 bp, Rattus norvegicus
  Genbank Accession No. NM_022585
tctcggccgcggtgtttccgtttctctccctggttgtcgcctgctctgctcttctcatccttctcgctctgctgctctgcggagtgacgaggctgaatcttctccccacccagttcgcgcttttcttctttttctcgcgccgctccatttctccagtccggctgccgccgccactgctgctcagctggtgtcggtgccgcgcgtttcccccacgtcgtccccgcagcctatggcccaggccgccttgggtatttctgctcaaggtaaccacatccctctttaaaaattccgccgaaaaagagaagacgctttacccgactctttgggccgttatctcacggcgaactttctgaccgagtatacaactacccagaaggcctaggagaagtgctgtatagagagcagttcgattttaacgctgagccaccttgggaacctagctgatgataggggggttccatctcctaacttgtccatggaggtcttcacttcagaaacccaagactcacattcatccagcttggtgtcaagtgggctgttgctgccaggattatcttgtgattatatgaaagatgtatcagtttcttctgaagtgcagtcaactgtagaagcctttgtagcaggtgtgtaacaagtttgttgcatattctaaggacccagacataggcttggtggcccgtctcttgtttttcctggtttatgactttcggctttgtggaatacggctgagatgaaaggatttattgacgatgcaaactactccgttggcctgttggatgaaggaacaaaccttggaaatgttattgataactatgtttatgaacataccctgacaggaaaaaatgcattttttgtgggggatcttgggaagatcgtgaagaagcacagtcagtggcagaacgtggtggctcagataaagccattttacatggtgaagtgcaactccactccagccgtactggagatcttggcagctcttggaactggatttgcttgttccaccaaaaatgaaatggctttagtgcaagaattaggcgtatctccagaaaacatcatttatacaagtccttgtaagcaagcatctcagataaagtacgcagcaaaagttggagtaaatattatgacatgtgacaatgaagttgaattaaagaaaattgcgaggaatcacccaaatgccaaggtcttactacatattgcaacagaagataatattggaggtgaagatggtaatatgaagtttggcactacactgaagaactgtaggcatcttttggaatgtgccaaggaacttgatgtccaaataattggggttaaatttcatatttcaagtgcttgcaaagaatatcaagtctatgtccatgccctgtctgatgctcgatgtgtgtttgacatggctggggagtttggctttacaatgaacatgttagacatcggtggaggcttcacaggaactgaaattcagttggaagaggttaatcatgttatcagtcctctgttggatatttacttccctgaaggatctggcattcagatcatttccgaacctggaagctactatgtatcttctgcatttacgcttgcagtcaatattattgctaagaaagttgttgaaaatgataaattatcctctggagtagaaaaaaatgggagtgacgagccagccttcgtgtactacatgaatgacggtgtttatggttcttttgcaagtaagctttctgaggacttaaatactgttccagaggttcacaagaaatacaaggaagatgagcctctgtttacaagcagcctttggggtccatcctgtgacgagcttgatcaaattgtggaaagttgtcttcttcctgagctgagcgtgggagattggcttatctttgataacatgggagcagattctttgcacggaccgtctgcttttagtgacactcagaggccagctatttatttcatgatgtcactcagtgattggtatgagatgcaagatgctggaattacttcagatgcaatgatgaaaaacttcttctttgcaccctcttgcattcagctgagccaagaagacaacttctccactgaagcttaaacaggcattaacgcttctttagatctgaagtcgcaggttaagcttgtctggtctacattccagtgtggggaaaaattcaatcaatctttattctgttaattttcttggaaacaaattcatagtaatagctgtttgggaccagacaaaatcagctttcatctataattcattgggggtaataggggatttatttagataatgtatccagatttaaacataccagtttgacccaccccttaagcgtttaaaataaaatatgcaacaaaatggatgacttagtggagatggaagcccattaattgggttccccatcaaatcgtttacatacaagtacacagtttttataataaggattcctgttaaaagtcttgtaaagttgatgtctttcacccagatctatcacatgtgagtggaagaccagtgtgacttcattagatacgtttagtgtatttagagtgtgtaaatttgtgctttggactgtagtttaataaatgtaaaattgcatcatagtatttgttgtatttgacctaatgtaaccttgtatgattgcaataaaactttgtgtagattttaccattttttcaggctaaaaatttgggaatggggctagctagcaaaggtagttttgaactagttgtgtgtatggtctgttttgagagttttctttatagtccatttgtttggtttggctcaatatactttttagttatttaattagtaatttaagtaaaaagtgtttggtaatcattgtgaagttcagattcattatggagagtcgatgtgcagtaagcatgatgtttaacaattttaacaccagaaaatgttaatcttgcataaaccaattgtaataataataggtgtttctgtatagataggatgcatagagtaccttagtaaatctttgaatcacaaatcttttggctgatagaaaagattttattaaacactgaaaacttggtcggggatggggagagagactgcagaagactgcagaaccctaaccttaaagaagggctatgtctatttccagcatcctgatgccccttcgcacagacatttaaatcgagagggctttggggtggtgaagcacactcttcaatttctcacttgtaatggtatcaaattgcaatttttttgttgttgctgatcttggtttgaacctagtcccttagtttcttgttaattcccatttgttcaagcttagtaattcttccttccgtactaaagcttggtggggggtggggggaggagttagcttcactaacctgacactgttgccaggaattttggctttgttcactgctagtgtgttagtcctaagtctcagaatcacagaagtaatgagacaacttacaggggtcacttttcctaccttactctatgttcacaagtggaattcctgacctccaagaggaaatgtgacttcactttggtgccaatggacaggaaattctacctgtgctacataggagaagtgtgggatacacttgaatagctggattttacaccttgatttcaaggtggaaagaaattgatcatgaatctctaatttcaaatcaaaccagtaggtgcttaatatttttgatttgaatattgcccacttgaatatcatgggttctattaattataagaacaactaaggaccccagtccactgtcatctagttgcccttggacttttttccaaggtatactatggggtttatgcaaaatttgaagctaccatatgcattgttgtggtccaggaatgccaaaacttaaagcgtggtacaacctgagtccttggcctgactgtacaggcgtggtctctgtggcatcagttttgccttctgcataggagaaaggttgtatgtaacacagcccggaattgctatctcacatgtgaatgataggtaaacataagaatgtctgtattgtttttgaagactgtttgccataaatctaaagtcaaacctatgtatttcaatttggtatgcttaagaataattaatgtaaaatctttttatatgatattgtaatctcagttcaaatttaattgcaaatataaaacccaaatgatttctatatatagtaaattgaactgtcaaggtaacttgtgtgtgattctgaatacacagatacaatgtttttattcctcatgctttactttgatggcttctatcatgaaatagatgtgaaattttatgaaaaaaa

SEQ ID NO: 3597 - DNA, 2098 bp, Rattus norvegicus
  Genbank Accession No. NM_022592
gaattcgggaatgtcatggatccagtgagacagatccagtgcgaccgtgaaggcaaacgctttccgttcctctcagctccaccagcttccacgtcctcgcccgaccgcgccatggagggttaccataagccagatcagcagaagctccaggccctgaaggacacagccaatcgcctgcgcatcagctccatccaggccaccaccgcggcaggctcgggacaccccacatcatgctgcagcgctgccgagatcatggctgtcctgtttttccataccatgcgctacaaggccctggatccccgaaaccctcacaatgatcgctttgtgctctccaagggccatgcagctcccatcttatatgcagtctgggctgaagctggcttcctgcctgaggcagagctgctgaacctgaggaaaatcagctctgacttggatgggcatcctgtcccgaaacaagccttcaccgatgtggccactggctccctgggccaggggctgggagctgcgtgcgggatggcatacacaggcaaatacttcgacaaagccagctaccgagtctattgcatgctgggagacggggaggtgtccgagggctccgtttgggaggccatggccttcgctggaatttacaagctggacaacctcgttgccatttttgacatcaaccgtctgggccagagcgacccagccccgctgcagcaccaagtggacgtctaccagaagcgctgtgaggcctttggctggcacgccatcatcgtggatgggcacagtgtggaggagctgtgcaaggcctttggtcaggccaagcaccaaccaacagccatcattgccaagaccttcaagggccgcgggatcacagggattgaagacaaggaggcgtggcatgggaagcccctccccaaaaacatggctgagcagattatccaggagatttacagccaggttcagagcaaaaagaagatcctcgccacgccccctcaggaggatgccccttccgtggacattgccaacatccgaatgcctaccccacccaactacaaagtgggggacaagatagccacacggaaagcctatggattggcccttgccaagctgggccacgccagtgaccgcatcatcgccctggatggagacaccaaaaattccaccttctcagagctcttcaaaaaggagcacccagaccgtttcatcgagtgctacattgctgagcagaacatggtgagcattgctgtgggctgtgccacacgtgacaggacagtgcccttctgcagcacttttgcggccttcttcacacgcgccttcgaccagatccgcatggccgccatctccgagagcaacatcaacctttgtggctcccactgcggcgtgtccattggggaagacgggccctcgcagatggccctggaagacctggccatgtttcggtcggtccctatgtccaccgtcttttacccaagtgatggagttgccacagagaaggcagtggaattagcagccaatacaaagggcatctgcttcattcggaccagccgcccagaaaatgccattatctatagcaacaacgaggatttccaggttggccaagccaaggtggtcctgaagagcaaggacgaccaagtgacagtgatcggggctggcgtaactctgcacgaggctctggctgctgcagagatgttgaagaaagagaagatcggtgtccgtgtactggaccccttcaccatcaagcccctggacaaaaagctcattctcgactgtgccagagcaaccaaaggcaggatcctcaccgtggaggaccactactatgaaggtggcataggcgaggcagtatctgctgtggtagtgggcgaacctggagtcacagtcactcgcctggcggtcagccaagtaccacgaagtgggaagccagctgagctgctgaagatgtttggtattgacaaagacgccattgtgcaagctgtgaagggccttgtcaccaagggctaggaaggacatgggatgccgggtgggtgaactacacattccagggatgttctggcaaaggtgctcaagggtgtaccgagtggaaaggtaaatatatgttttgagaaaaaccgaattc

SEQ ID NO: 3598 - DNA, 410 bp, Rattus norvegicus
  Genbank Accession No. NM_022593
actagtaacttcctctgggatcaaatagaattttataagaacacaatggatggagaggagaaaacctatggtggctgtgaaggccctgatgccatgtatgtgaaattaatatcttctgatggtcatgaatttattgtaaaaagagaacatgcattaacatcaggaacaataaaggccatgttgagtggtccaggtcagtttgcggagaatgaaaccaatgaggtcaactttagagagatcccttcacatgtgctatcgaaagtgtgcatgtattttacctacaaggtccgctatactaacagctccactgaaattcctgaattcccaattgcacctgaaattgcactggaactgctgatggccgcgaacttcctagattgttaaataaaataaattataataaactgtta

SEQ ID NO: 3599 - DNA, 1097 bp, Rattus norvegicus
  Genbank Accession No. NM_022594
agctccagagatggctaccgcgatgacagtttccagcaaactcctcggcctgctgatgcagcagctgagaggtacccgccagctgtacttcaacgtcagccttcgatctctgagctcctctgcacaagaggcgtccaaaagaatccctgaggaagtctcagaccacaactacgagtctattcaagtaacatctgcccagaagcatgttctgcatgtacaactaaaccggccggagaagaggaatgccatgaacagggctttctggagggagttggtggaatgcttccaaaagatatctaaagactccgactgtcgggctgttgtggtctctggtgcaggaaagatgttcacttcaggtattgacctcatggacatggcatcagacatcctgcagcccccaggagacgatgtggcccgcatagcctggtacctccgagacctcatcagccgataccaaaagactttcactgtcattgagaagtgccccaagccggtgatcaccgcaattcacggaggctgcattggtggaggcgtggatcttatttctgcctgtgacattcgctactgcactcaggatgctttcttccaagtcaaggaggtggatgtgggcctggctgctgatgtaggaacgctgcagcgactgcccaaggtcattgggaaccggagcctggtcaacgagctgaccttcaccgcccgcaagatgatggctgacgaggccctggacagtgggctggtcagccgcgtgttcccagataaggacgtcatgctgaatgcagcctttgccctggcggccgatatttccagcaagagtcctgtggctgtgcaggggtcaaaaatcaatttaatctactcccgagaccattctgtggacgagagccttgactatatggccacttggaacatgagcatgctgcagacccaggacatcatcaagtcagtccaggcagccatggagaagaaggactcaaaaagcatcaccttctccaagctctgagtgccttcctgaccctggtcccctcagtgcctcctcccggtgtataactttatgacttagttcttcagttcccggggccttatctccactgtgaacaataaag

SEQ ID NO: 3600 - DNA, 1904 bp, Rattus norvegicus
  Genbank Accession No. NM_022597
gagcgactgcgggcccaggttgtcgcgctgcgctcggtgagtacaggatccagcttccaggatgtggtggtccttgatccctctctcttgtctgctggcactgaccagtgcccatgacaagccttcctcacacccactgtcggacgacatgattaactatatcaacaaacagaatacaacatggcaggctggacgcaacttctacaatgttgacataagctatctgaagaagctgtgtggaactgtcctgggtggacccaacctgccggaaagggttgggttcagcgaggacataaatctacctgaatcctttgatgcacgggaacagtggtccaattgcccgaccatcgcacagatcagagaccaggggtcctgtggctcttgttgggcatttggggcagtggaagccatgtctgaccgaatctgcattcacaccaatggccgagtcaatgtggaggtgtctgctgaggacctgcttacctgctgtggtatccagtgtggggatggctgtaatggtggctatccctctggagcatggaacttctggactagaaaaggcctggtttctggtggagtatacaattctcatataggctgcttaccctacaccatccctccctgtgaacaccatgtcaatggctcccgtcccccatgcactggagagggagatactcccaagtgcaacaagatgtgtgaggctggctactccacatcctacaaggaagataagcactatgggtacacttcctacagtgtgtctgacagcgagaaggagatcatggcggaaatctacaaaaatggcccagtggagggtgcttttactgtgttttctgacttcttgacttacaaatcaggcgtatacaagcatgaagccggtgatgtgatgggaggccatgccatccgcattctgggctggggaatagagaatggagtaccctactggctggtagcaaactcctggaacgttgactggggtgataatggtttctttaaaatcctcagaggagagaaccactgtggaattgaatcagaaatcgtggctggaatcccacgcactcagcagtactggggaagattctaatctgctgggacttgattgtatagtccttaggagactttttccaaaatttagcaatgcaggcagggagtgaggcagataggagtctttgattctttgagttcacctaacatgcatgaagctttcagcaaggtttgggtgactggaccagagctgccccccatcagagccaccctacctggctcccttctagcctatcccatgacagtgatcacagcctacatcctagcctctccctagactagtgctgtgtgtagcgcctgctgctgtggctctgtctgccatccctcccacccccacctcagcatccccagaccaagggctttggctgcaggatttccaaaggaatgaacaccaactacatgatgagaggacagatgccacccgccagctgcaccttgaagctagtcacttctaggactgtggcaggctttgatggcccaatgcagttctctggagaaaactacctttccccaaggcatctgcacccattgacaatggtaatgtgcccatctctccttggtcctgccctcaaccgatgcttttccagtcagggttttgttttttgttttgttttgtgtacctcaactgagttatgaagatttgtactggttttacagatcatctcatcgtatggaaaagaacaagcttcgtggtcagtttactgggtgaccggcagacaccacaatcaaactagtctggggaaaacctgcttttttgttgtaggtgccacgtaaccctgtcagtttgacaaggaatgaccgtgccaataaaccaattctccctctgcttggaaaaaaaaaaaaaaaaaaaaaaaaaaaaaaaa

SEQ ID NO: 3601 - DNA, 1640 bp, Rattus norvegicus
  Genbank Accession No. NM_022598
agagccgtgcgcagcggcgtgtgtggggccgtgtgcagacccgcgtgtggcgcaggcaaggaccctgaaaataaacagccgctgctttgcgagtctccttcttgggtctacgtccgagtctcctctgctgtgggcagctcagacgccgaagctctaactgcagctatgagcagcaacgaatgcttcaagtgtggacgatctggccactgggccagggaatgccctactggtggaggtcggggtcgtggaatgagaagccgcggcagaggtggttttacctcggatagagggttccagtttgtttcctcgtctcttcctgacatctgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaagccaggccatctggctcgtgactgtgaccacgcggacgagcagaagtgctattcctgtggggaatttggacatattcaaaaagactgcaccaaggtgaagtgctataggtgtggtgaaactggtcatgtagccatcaattgcagcaagacaagtgaagtcaactgttaccgctgtggcgagtcagggcatcttgcacgggaatgcacaattgaggctactgcctaattattttcctttgtcgcccctcctttttctgattgatggttgtattattttctctgaatcctcttcactggccaaaggttggcagatagaggctgttcccaggccagtgagctttacttgcagtgtaaaaggaggaaaggggtggaaaaaaaaccgaatttctgcatttaactacaaaaaaagtttatgtttagtttggtagaggtgttatgtataatgctttgttaaagaaccccctttccgtgccactggtgaatagggattaatgaatgggaagagttcagtcagaccagtaagcccttctgggtttgagtgtgttcccatgtaggaggtaaaaccaattctggatgcatctaagcttccatgaataactttaattcttagcataatgatggccttggattgtctgacctcagtagctattaaataacatcgagtaacatctgcatcaggccctcatagaacattcagttgagttgggagtaaactgaaaagacaaatgtgttgaaggatatgccagggaatctggctaaagcctaatacaggagcatcttcatcccagtgttgatgctggacgtacagaaggtgatggcaaaggtgtagaacacattttttcaaagactaaatctaaaacccagagtaaacatccgatgctcagagttagcataatttggagctattcaggaattgcagagaaatgcattttcacagaaatcaagatgttatttttgtatactatatcacttagacaactgtgtttcatttgctgtaatcagtttttaaagtcagatggaaaaagcaactgaagtcttagaaaatagaaaatgtaattttaaactattccaataaagctggaggaggaaggggagttttgactaaagttccttttgtttgttttaaattttcatcaatgtatatagaacaaaatgccatattaaaga

SEQ ID NO: 3602 - DNA, 5215 bp, Rattus norvegicus
  Genbank Accession No. NM_022599
gagagcccagccttctccctggctcctatttaagcatcaggcaaagaccgtgggtcccagcaacagcagtgaggaggcacttggcacttcgggcaggtggtagccgctgtgcctggcaccttggcatcctgcctgggctgcacgtggcctggcacccatacagctcctgattgctgcggctggaaggagcctgtgattctgcgtgagtgtggggtccttgggtatacagtcagccgaggtagaggtgggctggcctaggactgtacacttctctaggagctgggcttaactaaaacagaagagattgcggttagacatcaagaggaactcagacccgtgggaaagaaccaggacctgaggcaaaggcgagatttgggtggtggacgggggacagggagactcttcacagtcctcacaggacctacacaggggcctatggtctcagacctgggatcatgttcctgagggggtataagagagaggggcaggtcaggaagcataggaagtcagttgcacatgggggagggttgtggggaaactgtaaaagctatgctggggaggcggcacggagcttgattcaccttcacctgcgccgggcacccgctgaccccgggtttccgcccggagagcagtcagatatgaacggacgggtggattatttagtctccgaggaagagatcaacctgaccagaggaccctcggggctgggcttcaacatcgtcggtgggacagatcaacagtatgtctccaatgacagtggcatctacgtcagccgcatcaaagaggatggggctgcggcccgggatgggcggctccaggagggtgataagatcctctcggtaaatggccaagacctgaagaacctgttgcaccaagatgccgtagacctcttccgtaatgcaggatatgccgtgtccctgagagtgcagcacaggttaccagtgcagaatggacctatagttcatcgaggcgacggagagccgagtggagttcctgtagctgtggtgctgctgccagtgtttgcccttaccctggtagcagtttgggccttcgtgagataccgaaagcagctctgagatgcctgttgtcttccagtgtgtccgatgagctaactatctctctcactcaccatctcgacatcctcccctagtcttccttcccacatagccaacacatgatttaaagtgactgcttatcacccgaaaccttgctgttcaaaatctccaagacttcacattctaatggaagagtaaagagattatttgaagaaagctgggggtggggagagccttgcttagaataaatgagaagttacatattttactagaactgccaataaaaattcagctatcagccaaagaggagaagcttgctcttcctgtctccatggacgacaccttttgcttagctggtgtgctttgaaggctagctgtgctatgtgaaaggaggagctgattttttaaatactttttcttgggaagtatttgtggcctttaatttgtaactatatacttagatgcctatattggacataggcgaatgaatttttttcttttcttagaaaagaaaatacatatatacattaacacacacacacacacacacacacacacagcataaaactgatgccttatggagagttaaagaggtgagaaaactactggttcttggatttctagtggacaagttttgggaactagggggtcatattcctttatatataatcaaaactcatattaaagaatgagttctggattgtaaagagaacttactttttccacttgtctgtaagtctttgtccacaagttaaaaacatacacagtcctaagggctgatcataactgaaacacttcaaaaattattggcagagaaggtataacggggatggaaaagttagctttaaaagagaatgctcagtcagtggcattaggaaaataatgactgaagcaattagttgaaaactgtagaacaactagtgttccagggtagctacagtgatgtgggaaattgtggcaaagcagttcttctcaagtcaatttgtttaaaagactttggggtgtaaagatgagtcctgacagtctctgaatgaccttagtgactgttgtactatgtgaaaggatccattggcatggagatgagaagtaggagggccaaataaaccatcaagacaactgaaaaaagatcatacctcagggtggcacttgaaccctcaaagtgctcaccaactttcagtttctagtatcaggcaaagcctaagggaagggactgctttcctggcagggtggaccccaaatcagcctgcttctgatagagttacgatgagaaggcccaaattgatgtaggctttctttttgtgtatttttcccaaagctataagcactagttttggttttaataaggtaatggaccattttttcagaaaaaggggaaggaataaggtttgtttgtttatagagggtgcaaggaagtttagtgagcatttctgaggaaagcctgagcacacagagtagattaactatgccagagaatagccagggatattggggggtggggggtagtggagctgtcctgtttatgtagcatcaaagttggttttagagtactgaggatagttgaaccaagcctaattttttttttcactttaacaaaataatttccgtcttttcaataaattggccagactattttgacctaagattataaagagttttcctgacaacctagcagtcacttaacagatgtcgattgcacattagttttgtcaagacacctttataacaaagggaaatgcacacacttcatccaaaaggacattgtggttacagttaggaagaaaacacttaagatggaattatccatgtaagtgtaagttgtttatattacagacaacaaaagaaaatagctcccaagctttgagcactgaagatctcagaggaaggactccttaggtgccaatcgtctagcaagcatgcatacataggggacaagttaagagtcttaccgggttgagtaagaaaaggaaattattgccatgcgagacagagcacgatgcagcaatgtggaggatgagcagacagctagcatgttgtaaggagctcagaacgggagagccttcctgcagtggcatcgggggagaatgcaaaggaaagtcttgaacagtccagtgagcctttgcctctggataaactgttgatacagggagacatttgctttaaacagtcttcacataaccaagccattcagtacttcttgaaactgacttcataacaggagtcattgtaagttccacagaaagcaagacgtatgtatttcagttcttgtcttgaccagcagcactccggaggcccagtgtccggtgccctccttgtatctgaagcaggggtaacagctctgctgtgggcctgtttccctctagtatttacctcaaggcttggaaatgtattttgaaagaccttcagtcaaacgaagtaaagcaaatgtcaagaaggataaaccactgttgtgtgttgatgtgtggtgtattgtgatgtaaataaaaaatatcgttgaagttttactttgtaaagattctggtaacacttgggtctccttgggaaagaaacaacacttgaccaaagcatttaagttttaggcaaattccataatatttcactcttagttataaaattatcatacatgagatgttgaggatctatatagattattcagattttatattccttatagattgactcaaatattccttaaaagattatatatgatgctcctatggcataaattgtaatgtttaatgttttgaaaattggttataggtattttttaagttcccataaagtgtttcttgtatttgtcattgtgaattatatgtaattctaatagatattgtttgctttagtcatttttgtctccttttcctatagtttcctgtgtgagtgattccatgtaattaattggacagtctatccacaggcaacaaatagaagtagtatttgtaattgcagcctgtgccagggactgtgttagactgattagtaacactatgaatcacccgagatcttaagtattgctataaagagaagactgaagatgagagagtaaagtattttcctgggattatatagttggtaaaaaagaatcatgatttaaactctggactttggataaaagtatcagtaattttcctcattgctagcagtcctcatgcaaggtctctggactaaagcgatgtattacctgcaaatgcttgagtttcatcccatacttatggcgtgaggtgagtgtggcagccagcatctctgtcctcctaggtaactggttagtgctgaacctcgagattcaccactgtcaggagctgtctctgcttagaatcacctggacagctggctgtcaacccacgttaagtaagaacatgtgggactagaattcagtcaacaataaaagctttcatcaggtggctaaaatgtgcagactctgtttgtactggcatgttggccatcactcacagatgcaactctagccagaatcaagaatggggcagatccagagcccagctcgctgagcttctgccccagatttcagaggcagagtaagaagtggaacagtgttttcctcccaggtgctcaggacaggctggtcaacttccagtcacatatgccatttagtaagtgcttcggcctgtgcagccattagtaaccaaatcatgggatagtgaatctaaaatactcttggataaaatttgtattagaattaaaaaaaaatgagggtcagaaaggtgaactaactccaacttagatgcccctcccctttattttggtctcaaatctgttttaatgtgtccacaacattaatcaaaaactgtattttttttttttcggagctggggactgaacccagggccttgcgcttgctaggcaagcgctctaccactgagctaaatccccaacccccaaaactgtattttaaaaatcagttcactttcatctttttttccttgggttttcagtaaagaccagaaggactgacagacagctagagaggttgtgtagacatccagatggggagagtgcattggacaatctgagaaatctattcaggtgctgcctaattccattagctttaagttagatacaagctgtttgtagtattttgggttttattgtgcaaataaacaatagaggcctttagtcccagcgttaggatgcagagatccatttct

SEQ ID NO: 3603 - DNA, 1686 bp, Rattus norvegicus
  Genbank Accession No. NM_022601
cctaagttgcttgtctgggccactggcaaattcttccttcccaggctagacacacaggctgagcaattggttccgaacccagaggaacccaggcgacgctaggtcacgtggccgactgcttacatgacctgcgggctgctgagcgtcactgtgacgttcaggagacctgcgaagtggcccggctacttccgtcacctgtgctgtcggggtgctgtcatggacctgggaccgatgcgcaagagttaccgcggggaccgagaggcatttgaggaggctcatctgacctctctggatcccatgaagcagtttgcttcctggttcgaggaggctgttcaatgtccagatataggagaagccaatgctatgtgtctggctacctgcaccagagacggaaaaccctctgcccgcatgctgctgctgaagggctttggcaaggatggcttccgcttcttcactaactacgagagtcggaaggggaaagagctggactctaacccctttgcctctcttgtcttctattgggagcccctgaaccgtcaggtgcgtgtggaaggcccagtgaagaaactgccggagaaggaggctgagaactacttccattcccggcccaagagcagccagattggggctgtggtcagtcgccagagttctgtgatccccgatcgggagtacctgagaaagaaaaatgaggaactggggcagctctaccgggaacaagaggtgcccaagccagagtactggggtggctacatcctatatccccaagtgatggagttctggcaaggccaaaccaaccgcctgcatgaccgtattgtcttccgtcgaggcctggcaacaggagactcccctctgggacccatgacccaccacggggaggaagactgggtgtatgagagacttgcaccttgacactggactccagaatgttgggggatcatcatagggaagagtgggggaagggaaggaaaaaaatggaagccaggtataccttctgtgtgtgtgtgtgtatgtgagacattgggtttaaacctcgctcacactaggtaacactttaccactgagataaagtcccagcattttttcttactaccttttattttaagactaagttgcttagtctggccctgaactcactgtgtatacatcccagacaagtcttggctttgagttcctcccctcagtcccttgagtagcagtattataggcttgtgccaccaggcccagttctagtcctgtttttaagaagcccattgcctttgttttttttttttttttttttcttcggggctggggactgaacccaggaccttcggcttcctaggcaagcgctctaccactgagccaaatccccaacccgcccattgcctttgcctttgttaacccttctacctgcatttctccaggactcaccctcaagttctctgaactcgggatcggtttagtggctggaacagagcgcagtagtgttgtagagagtcacaagtagcaaagagtctcataattattcccttgattttgctcctggtttggggggacgcccgtcttgggagctgcagctggtctaactctgtttccagtaacagactaatcaggccgcagatatacaagggctcgctggctatggaaaggagccagaccatgtttgctgtgactcagacaaaccattatatgttctggttggccttg

SEQ ID NO: 3604 - DNA, 2133 bp, Rattus norvegicus
  Genbank Accession No. NM_022602
cgctcggccagctgccgtctacgggcttccgcgcggccaccgggcaactgcgccgcgcggctgccccactgagcgctcggcctcggggccgtgggatccgccgcgctgtctgcggtcaggaagaccgccctcccgcgtccgtgccggacgggtcagaggcggcgccgcacgcgaggccacccgcgatgctgctgtccaagttcggctccctggcgcacctctgcgggcctggcggcgtggaccacctcccagtgaagatcctacagccagccaaggcggacaaggagagcttcgagaaggtgtaccaggtgggcgccgtgctcggcagcggcggcttcggcacggtctacgcgggcagccgcatcgccgacggactcccggtggctgtgaagcacgtggtgaaggagcgggtgaccgagtggggcagtctcggcggaatggccgtgcccctggaggtggtgctgctgcgcaaggtgggcgcggcgggcggcgcgcgcggcgtcatccgcctgctggactggttcgagcggcccgacggcttcctgctggtgctggagcgacccgagccggcacaggacctcttcgacttcatcactgaacgcggcgccctggacgagcctctggctcgtcgcttcttcgcgcaggtgctcgccgctgtgcggcactgccacaattgtggggtcgtgcaccgcgacatcaaggacgagaacctgctggtggacttgcgctcgggcgagctgaagctcatcgacttcggctcgggcgcggtgctcaaggacacggtctacactgactttgatggcacccgtgtgtacagccccccagagtggatccggtatcatcgatatcacgggcggtctgccactgtgtggtctctgggtgtactgctctacgacatggtgtgtggggacattccctttgagcaggatgaggagatcttgcgcggcaggctctttttccggaggagggtctccccagagtgccagcagcttattgagtggtgtctctccctgcggccctcagagaggccctcgctggaccaaattgctgcccatccctggatgctggggacagagggcagcgttccagagaactgtgaccttcggctctgtgccctggatactgatgacggagccagtaccacttccagcagtgagagcttgtgaggaggaggaggggcctggactccacactgggggcctgggctcagcctagccagccctctcccagaatgaacattttctgcctgggatgtctcctgcaaaagcagtgacctctgacccctggtgacctttgctctcggcaccgggcctgtttcctttgctttgagtgcctttttgaacgctgctccacagggcctgggttttcttgagctcttctgtccaaagatggctgcgggctaagcaaggtcccgcctgccctgggtggatacttgaacccgagaccctaccctgctgctccatcttgcggcagccttcctgaccaagtgtgtttgacatggagcgccctgtggtgcccacctccaaccctccagtctcctggtcttcgtctgggcatgtctgcacaagcaatgcaacgctgggccactgctgcccgcctgcctccctggcaccgcacgcaacgagcgtgccacggtctcttatttatggtgtgatcaccctggagggcgcccctgccctgctggggctatttattgtttaatttatttgctgaggttacttcctccaagcaaccaccttctccaggcccctggggtgttcaggaaagccaagggtggccgttcagtccacagacggcatcctggttcctgcacctgcagtaggtccctaaccccatgtttgtgggaggaggaatttgtacagtggctaatttaaggggagtgggagaccctgtcaccctgggcactctgcgctggggagggggtttaaattattgaccttgtacagtctgcttgctggctctgaaagctggggtgggggacagagtctcaagcccttaatttattttagcaactgtgttctgtgaccctggtgtgagtaggcatcaggggtggggttgtataagttcaaaagtgtgaaatgtctggagatcatattttttatacaggtatttcaattaaatgttttggtatat

SEQ ID NO: 3605 - DNA, 1318 bp, Rattus norvegicus
  Genbank Accession No. NM_022606
cgccgcccaggctagcgcgagcctccgctccatcgccccgccgccatggacctattcggggacttgccggagcccgagcgcccgccgcggccgtctgccgggaaagaagcacaggaaggacccgtgctcttcgaggacctgcccccgaccagcagtactgactcaggatctgggggacctttactctttgatggtcttccacctgctggcagcggcaattcaggttctcttgccacatcaggctcccaggtggtgaagaacgaaggaaaaggagcaaagaggaaagcccctgaggaagagaagaatggcggtgaagagcttgtggaaaagaaagtttgtaaagcctcttcggtgatctttggtttgaaaggctacgtggcagagcggaagggtgagagggaggagatgcaggacgcccatgtcatcctgaatgatatcactcaggagtgtaatcctccatcatctctcattactcgggtttcatactttgctgtttttgatggacatggaggaattcgagcctcgaaatttgctgcacagaatttgcaccagaacttaatcaggaaatttcctaaaggagatgtaatcagtgtggagaagactgtgaagaggtgcctgctagatacttttaagcacaccgatgaagagttcctgaaacaggcttcaagccagaagcctgcctggaaagacgggtccactgccacgtgtgtcctggctgtggacaacatcctgtatatcgccaaccttggagatagtcgggcaatcctgtgtcgatataacgaggaaagtcaaaagcatgcagccttaagcctcagcaaagagcacaatccaactcagtatgaagagcgcatgaggatacagaaggctggaggcaatgtcagagatggccgtgtcttgggtgtgctggaggtatcccgctccattggagatgggcagtacaagcgttgcggggtcacatccgtgcctgatatcagacgctgccagttgacccccaatgacaggttcattttgctggcttgtgatgggctcttcaaggtctttaccccagaagaagctgtgaacttcatcttgtcctgccttgaggatgagaagatccagacccgagaagggaagcctgctgttgatgcccgctatgaagctgcatgcaacaggctggctaacaaggcagtgcagcggggctcggcagataacgtgacggtgatggtggtgaggataggacactgaggccgcacactgcacgtgtgctcttgacttgcaggttcatcttgtttgtgcacgctgtgtgtactcctgtggggcttctatggttgtaaataaa

SEQ ID NO: 3606 - DNA, 1468 bp, Rattus norvegicus
  Genbank Accession No. NM_022607
cgcccgggcaggtgtaccatggcggtctctctcctgctgcggggaggacgaatccgggcgctgaaggctgcccttctcgaggcaaaggtgttccgaggagaactggcttctacagtgcccctgtctacagagtccgagaataataaaaaggcggcaggaccaactagcaagacggaaagtgtgttcaaagatgtggtgggagcagaggagagggccaagctcctagacactcacacagcagcggcactgtccaaaagctcccctccacccagttcttacccatcagtggagaacacaggtggggctgtcgcaggcctgccgctcacagacttgtcaagaaagactttggtagcgtttcctcagaaagttacgcctccaccgcatgcctgggcttctgactcggaggctcggcggcatgtccagaaagtgacgaaagattcatcttcatcttcctcatccagctcctcagattcagactctgatggggaggaacatggctccgacattggtccccgagtggcaagcaaaagcaaggcagggttttccaaacctgaggcttctcgtccctcgaagaacggagcccctaagatcacagtttttgcaaaagagaaggccaaggtgcagaagccacacacagatgtcacctacccagagaagcccctgcagcctaagaagaaagggactttcaccaagcctgtagaagatagtaaagaaatcaggtccaagctcatgacatccaagccacagtccagtgaggttttggagcaaaaaatgaaggaaaaacagcaccagggaaaacggagaccagacaagacaggaaaggaaagcacagagctgtttgaagctgaaggaattttacccggccacaggaaagccagagtttccacacagcccacaaccggaacacaagaggccagcgcagaactccggccagccgctgcccccgagtcgggagctagacaggaagccaaagggccagagctcgaatggaagaccgcttctcccctggtcagaaaagaaagcctggagaagcaggtgccagaagggagcttccaggcggaggaggagacctcaggagatcagacactagggagatattcgaagacagttcctgttgaggagaaaaatacctttggagagagagctggaccacaactggaggggacgttccaggcgccagccggcgaagccccgcccactgatgcaggcccaccccaggaagccccaggcgacacacaggagcccacactggttcccgagtcgagtgacaccaccacctacaagaacctgcagcatcatgagtacaacgcattcaccttcctagacctgaacctggacctctccaagttcaggctgccacagccgtcttcgggacgagagtcgccccggcactgaactcaactcagggtagacccccgtgtggtcccttgaattcttgcctgtgagaataaaagtcagaggcacaaat

SEQ ID NO: 3607 - DNA, 1980 bp, Rattus norvegicus
  Genbank Accession No. NM_022631
ccgaggcgctccctcggttcttgggcacatttccacgctataccagccccgcagcccgagcccgggtgccagtgctcgcttccgctccgggtcgctgcgcccacccgacgcgcccaggaggactccgcagtcctgctttgaatcgtccccccaggcttaaccccgacgcttcgcttggattcctcggcccccttcgctggggtggcgacttcctctccgcgccccctccccctcgccatgaagaagcccattggaatattaagcccaggagtggctttggggaccgctggaggtgccatgtcttccaagttcttcctaatggctttggccacatttttttccttcgcccaggttgtaataaaagctaattcttggtggtccctaagtatgaataaccctgttcagatgtcagaagtatacatcataggagcacagcctctctgcagccaactggcgggactttctcaaggacagaagaaactctgccacttgtatcaggaccacatgcagtacattggagaaggcgcgaagacgggcatcaaagagtgccagtaccagttccggcatcggagatggaactgcagcacagtggacaacacttctgtctttggcagggtgatgcaaataggcagccgagagacagccttcacgtacgcggtgagcgctgctggagtggtaaatgccatgagccgagcctgtcgggaaggcgagctgtctacctgtggttgcagccgcgcgcgccccaaggacttacctcgggactggctgtggggcggttgcggggacaacatcgactatggctaccgcttcgccaaggaattcgtggacgcacgagaaagggaacgaatccacgccaagggctcctatgagagcgcacgcatcctcatgaacttgcacaacaatgaagcaggtcgcaggacagtatacaacctggcagatgtagcctgtaagtgccatggagtgtctggctcctgtagcctcaagacatgctggctgcagctggcggacttccgcaaggtgggcgatgccctcaaggagaagtatgacagcgcagcggccatgaggttgaacagccggggcaagctggtacaggtcaacagccgcttcaactccccaaccacgcaggacctggtctacatcgacccaagtccggactactgtgtgcgcaacgagagcactggctcactgggcacgcagggacgcctgtgcaacaagacctcagaggggatggacggctgcgagctcatgtgctgtgggcgtggctatgaccagtttaagacggtgcagaccgaacgctgccattgcaagtttcactggtgctgctatgtcaagtgtaaaaagtgcacggagattgtggatcagttcgtgtgcaaatagtggtggcccgcccataatccagtcccactcccaggacccacatatttatagaaagtacagtgcttctggttctttttatttctcccccaagaattgcagctggaaccatgttttttttttcttccttctgttaccatctaagaactctgtggtttattattaatattataattaatgtttggcaatagtgggggaaactaagaaaaatatttattttgaggatctttgcaaagttagtacgaaacttctttcttctgatgctacaggataaaggggaaataacacgtattcgaacttagctgtgcagttggggttcacatctagaaggcataagaactattttcttctcaaacagagtcctatgagatgggtggtatcctggtgaaagaggtggtacagacccatgagtgactcagtcccagtgaccaaatgaattgcaggtgctctggtataagacaaatcaccttaaatatagatatattaaatatacatatatgccaaaatacagaatacgagacactctgtgtttttttctatttttagaacgatcttttagaaggtacgagctagactttcacatcctcataagcaggcatgtcaggg

SEQ ID NO: 3608 - DNA, 470 bp, Rattus norvegicus
  Genbank Accession No. NM_022643
ctgttttgagacgttggagtggacaaacttatttttccacgatgccggaggtgtcggcaaaggggactactatttccaagaaagggttcaagaaagcagtcaccaagacccagaagaaggagggccggaaacgtaagagatgccgcgaagagagttactccatctacatttataaggtgctgaagcaagtgcacccggacaccggcatctcttccaaggccatgagcatcatgaactccttcgtgacagacatcttcgagcgcatcgcgggcgaggcatcgcgcctggcgcattacaacaagcgctcgaccatcacgtcccgggagatccagacggctgtccgcctgctgctgcccggggagctggccaagcacgctgtgtccgagggcaccaaggcggtcaccaagtacaccagctccaagtgagcccacagagctcacaacagacccaaaggctcttttcagagccac

SEQ ID NO: 3609 - DNA, 378 bp, Rattus norvegicus
  Genbank Accession No. NM_022647
atgcctgagcccgccaagtcccgtcccgccccgaagaagggctccaagaaggctgtgaccaaggcccagaagaaggacggcaaggaacgcaagcgcagccgcaaggagagctactcggtgtacgtgtacaaggtgctgaagcaagtgcacccggataccggaatctcttccaaggccatgggcatcatgaactcgttcgtgaacgacatcttcgagcgcatcgcgggagagcgtcgcctggcgcattacaacaagcgctcgaccatcacgtcccgggagatccagacggccgtgcgcctgctgctgcccggggagctggccaagcacgcggtgtccgagggcaccaaggcagtcaccaagtacaccagctccaagtga

SEQ ID NO: 3610 - DNA, 2748 bp, Rattus norvegicus
  Genbank Accession No. NM_022667
ccggaagcccgaagcaccggagtcccgcagaacctgactccggcctgtcaccaccaccaaaggctaggggacgtcgcctcggtcactatggggctcctgctcaagcctggagcgcgccagggcagcggcacctcctcggtcccagacagacgttgtccccgctccgtcttcagcaacattaaggtatttgttctttgccatggcctgctacagctctgccagctgctctacagcgcctacttcaagagcagtctcaccacaatcgagaagcgctttgggctctccagctcttcctctggtctcatctccagtttgaatgagatcagcaacgctaccctcatcatcttcattagctacttcggcagccgggtcaaccgcccacggatgattggcatagggggtctcctcctggctgcaggggcctttgtcctcaccctcccacacttcctgtcagagccctatcaatacacctcgaccacggatggaaacaggagcagctttcagactgacctctgtcagaagcatttcggagccctgccccccagtaagtgccatagcaccgtgccagatacccacaaggagaccagcagcctgtggggcctgatggtggttgctcaactactggccggcattgggacagtgcccatccagccctttgggatctcctacgtggatgactttgccgagcctaccaactcacctctgtatatctccatcctattcgccatcgctgtgttcggaccggctttcgggtacctgctgggctcagtcatgctgagaatcttcgtggactacggcagagtggacactgctaccgtaaacctgagcccaggtgaccctcggtggattggagcctggtggctgggcctgctcatctcctcaggcttcttgattgtcacctctttgcccttctttttctttccccgagcaatgtccagaggagcagagaggtctgttaccgcagaggaaacaatgcagacggaggaggacaagtcaagaggctccctgatggatttcattaaacggttcccccgcatcttcctgaggctgctgatgaacccgctcttcatgctggtggtcctgagccagtgtaccttctcctcagtcatcgctggcctctccacgttcctcaacaagttcctggagaagcagtatggagccacggcagcctatgccaacttcctcatcggtgctgtaaatcttccggctgcagccttggggatgctgtttggaggaatcctcatgaagcgttttgttttccctctgcaaactatcccccgagtggctgccaccatcatcaccatctccatgatcctctgtgtacctctcttctttatgggatgctccacatcagccgtggctgaggtctaccctcccagcacatcaagttctatacatccgcagcagcctcctgcctgccgcagggactgctcgtgcccagattccttcttccacccagtctgtggagacaatggagtcgagtacgtttccccttgccacgccggctgcagcagcaccaacacaagctcagaagcttctaaggaaccgatctacttgaactgcagctgtgtgagtggaggatcggcgtcacaagacaggctcatgccccacgtcctgcgcgcactactgctcccgtccatcttcctcatttcctttgcggcgctcattgcctgcatctcccacaacccgctctacatgatggtccttcgcgtggtgaaccaggatgaaaagtcgtttgccattggggtacagttcttgttgatgcgcttgctggcctggctgccggctccatccctttatggcctcctcatcgactcctcctgtgtccggtggaactacctatgctcagggagacgaggggcctgtgcgtattatgacaacgatgctctccgaaacaggtacctgggcctacagatggtctacaaggccttgggcacactgctgctcttcttcatcagctggaggatgaagaagaacagggaatacagcctgcaggagaacacctcaggcctcatctgaccctcagctgggactactgccccaccccagagactggatcctatcccttccacacctacctgtattaactaatgtcaacatgccttcctcctcctcttcctcctcctcctcctccttcttcttcctctctctctctctctctctctctctctctctctctcacacacacacacacacacacacatgagagagagttcactcaccctttgagatcacctgccttttctcttctgcctaaagtcttaaggcctgaagtacactgagctgaatgagcaccgggcctgagagtttagtttctccaagtccttggaaggtatccccagcgtaggccctacgtcctccagacaagatgcccataatgaggcggcctctgttttcaccagtgtctcaggaatacttaatggagtgaaaagagggagtcttgccttcttgggccaggcagcccggatctcctctgcctctgcccacacccaggagagccagaggagaagcaggtagttggtttcttatctgctccagcggggctaagggagctgggtgtgtccacttttcatctggattccgtctagcatgaaagccgtgccctcgaggctgttttggaaaccaccattttgggaagtatccctctctataaactatgccccggtatctgaggaggaatgaagggaggaacaaggctggatcatggaaaactgttcacaggaaccagaggcctatcctcccgtcggg

SEQ ID NO: 3611 - DNA, 492 bp, Rattus norvegicus
  Genbank Accession No. NM_022672
ctttccggtggaggagtctggagacgacgttcagaaatggcacctcgcaaggggaaggacaagaaggaagaacaggtcatcagccttggacctcaggtggctgaaggagagaatgtatttggtgtctgccacatctttgcatccttcaatgatacctttgtccatgttactgatctttctggcaaggaaaccatttgccgagtaactggtggaatgaaggtgaaggctgaccgagatgagtcctctccgtatgcagccatgttggctgcccaggatgtggcccagaggtgcaaggaactgggcatcactgccctgcatatcaaactccgggccacaggaggaaacaggaccaagacccctggacctggagcccagtcagccctcagagctcttgctcgctctgggatgaagattgggcggattgaggatgtcacccccatcccctctgacagcactcgaaggaagggtggtcgtcggggtcgccgtctgtga

SEQ ID NO: 3612 - DNA, 811 bp, Rattus norvegicus
  Genbank Accession No. NM_022674
gccttttctctgccttgcttgcttgagctccagcacagtccgagatggctggcggtaaggctggaaaggactccggaaaggccaagacaaaggcggtttcccgctcccagcgagcgggcttgcagttccctgtgggccgtattcatcgacacctgaaatctaggacaacaagccacggacgtgtgggcgcgaccgcagctgtgtacagcgcagccatcctggagtacctcaccgcagaggtacttgagttggcaggaaatgcatcaaaagacttgaaggtaaagcgtattacccctcgtcacttgcaacttgctatccgcggagatgaagagttggactctctgatcaaggctacgattgctggtggtggtgtcatcccacacatccacaaatcactgattgggaagaaaggacaacagaagactgtctaaggatgcctggattccttgttatctcaggactctaaatactcttaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgaatctgaagtggtgggttttgattgagttgactgtttttaaaaaactgtttggattttaattgtgatgcagaagttatagtaacaaacatttggttttgtacagacattatttccactctggtggataagctcaataaaggtcagatcccaaactaaaa

SEQ ID NO: 3613 - DNA, 619 bp, Rattus norvegicus
  Genbank Accession No. NM_022676
gcggccatggagcccgacaacagtccacggaagatccagtttacggttccgctgctggagcctcacctggacccggaggcagccgagcagattcggaggcgccgccccacccctgccacacttgtgctgaccagcgaccagtcatccccagaagtagatgaagaccggatccccaacccacttctcaagtccacactgtcaatgtctccacggcaacggaagaagatgacaaggactacacccaccatgaaagagctccagacaatggttgaacatcacctagggcaacagaaacaaggggaagaacctgagggagccactgagagcacagggaaccaggagtcctgcccacctgggatcccagacacaggctcagcgtcaaggccagatacctcggggacagcacaaaagcctgcagaatccaaacccaagactcaggagcagcgtggtgtggagcccagcacagaggacctttcagcccacatgctaccactggattcccaaggagccagcttggtctgacagaagttgacatccggggatcgccagtgagtgtggaagttcatggacactggatgtttcttaatctcttgtttttaaacgtgataaatttggtgtt

SEQ ID NO: 3614 - DNA, 377 bp, Rattus norvegicus
  Genbank Accession No. NM_022686
acttttactcacaaccatgtctggacgtggtaaaggtggtaaagggcttgggaaaggtggcgctaagcgtcatcgcaaagtcctgcgcgacaacatccagggcatcacaaagcccgccatccgccgcctggcccggcgcggaggagtgaagcgcatctccggcctcatctacgaggagacccgcggtgtgctgaaggtgttcctggagaacgtgatccgcgacgccgtcacctacacggagcacgccaagcgcaagacggtcactgccatggacgtggtctacgcgcttaaacgccagggccgcacactctacggcttcggtggttaaactgctaatgcgctttccttagctgttgcaaaaggcccttttcagggcc

SEQ ID NO: 3615 - DNA, 633 bp, Rattus norvegicus
  Genbank Accession No. NM_022689
atggatgatctatcaccagaagaaattcagcttcgggctcaccaagttactgatgagtctctggaaagcacaaggagaatcctgggtttagccattgagtctcaggatgcaggaatcaagactatcactatgctggatgagcaaggggaacaactaaatcgcatagaagaaggcatggaccaaataaataaagacatgagagaggcagagaagactttaacagaactcaacaagtgttgtggcctctgcgtctgcccttgtaataggaccaagaactttgagtctggaaagaactataaggcaacatggggtgatggtggagacagctcacctagcaatgtggtatctaagcaaccaagccggataacaaatggtcagcctcagcagactacaggagcggccagcggtggatacattaaacgcataactaatgatgccagagaagatgagatggaagagaacctgactcaagtgggcagcatcctagggaacctaaagaacatggctctggatatgggcaatgaaattgatgctcaaaaccagcaaatacagaagatcacagaaaaggctgacaccaacaagaatcgcattgacattgccaatacaagagcaaagaaactcattgacagctaa

SEQ ID NO: 3616 - DNA, 3166 bp, Rattus norvegicus
  Genbank Accession No. NM_022694
ccgtgcaacggggcatcgtcaagatggtcctctctgggtgtgccatgattgtccgagggctgccccgtggtaccgctccagagaggcagatcaacctcagcaacattcgagctggaaatctcgacacacgtcgtcgagctgctacacaaccagatgggaaagataccccagatgagccctgggcatttcctgctagagagttccttcgcaagaagctgattgggaaggaagtctgtttcacgatagaaaacaagactccccaaggacgagagtatggaatgatctaccttggaaaagatactaatggggaaaacattgcagagtcgctagtcgcagaaggcttggctcccggagagagcatgagagccaataatccagagcagaaccggctttcagaatgcgaggaacaagcaaaggcatcgaagaaagggatgtggagtgaggggacgggtcacacacatccggacctcaagtacaccattgagaacccaaggcactttgtggactcacaccaccagaagcctgtcaatgctatcattgagcatgttcgagacggcagtgtggtccgggccctgctccttccggatcactaccttgttaccgtcatgctgtcagggattaagtgcccaacctttcgtcgagaaacagatggtagtgaaacaccagagcccttcgctgcagaagccaagtttttcacggagtctcgactgcttcagagagatgttcagatcattctggagagctgccataatcagaacattctgggcaccatccttcatccaaatggtaacatcactgaactcctcctgaaggaaggttttgcccgctgtgtggactggtcaattgcagtttacacccggggtgcagaaaagctgagggcagctgagaggtttgccaaggagcgtaggctgagaatatggagagactatgtgcctcctactgctaatttggaccaaaaggacaagcagtttgttgccaaggtaatgcaggttttgaatgctgatgccattgttgtgaagctgagttctggagactacaagaccatccacctgtcaagcatccgaccaccaaggttggagggagacaacatacaggataagaataagaagctgcgtcccctgtatgacatcccctacatgtttgaggcccgggaattccttcgcaaaaagctgattgggaagaaggtcagtgtgactgtggactacattagaccagccagcccagccacagaaacagtgcctgccttttctgagcgtacctgtgccacagtcaccattggaggaataaacattactgaggcccttgtcagcaaaggcctagccacagtgatcagataccggcaggatgatgaccagagatcttcacactatgatgagctgctggctgcagaggccagagcgattaagaatggcaaaggattgcacagcaagaaggaagtgcccatccaccgagttgcagacatttctggggacacccagaaagcaaagcagttcctgccctttcttcagcgcgcaggccgttctgaggctgtggtggagtatgtcttcagtggctctcgcctcaagctctacttacctaaggagacctgtctcatcaccttcctgctggcaggcattgaatgtcccagaggagcacgaaatctcccaggcttggtgcaggaaggagagccattcagtgaggaagccacacttttcaccaaggaactagtgctgcagcgagaggtggaggtggaggtagagagcatggataaggctggcaacttcattggctggctacacatggatggggctaacctgtctgtcttgctggtggagcacgcgctctccaaggtccacttcactgctgagcgcagcggctactataagcctctcctgtctgctgaggaagctgccaagcagaggaaagagaaggtctgggcccactatgaggagcagcctgtggaggaggtaatgcctgtactggaagagaaggagcgctcggccagctacaagccagtgtttgtgaccgagatcacagatgacctgcatttctatgtgcaagatgtggagactggcacccagctggaaaaactgatggagaacatgcgcagtgacatctccagccaccctcctgttgagggtctacgcccacgccggggagagttctgcattgccaaatttgtagatggagaatggtaccgcgcccgggtagaaaaagaggagtcccctgccaaagtgcatgtcttctacatcgactatggcaatagagagatcctgccatccacccgcctggccctaccacctgccttcagcactcgcgtgttgccagctcaagccacagagtatgccttcgccttcatccagtggccccaagatgaggacgctcgcacagatgctgtgacagtgtgtgcggacatccaaaacactcagtgcctgctcaacgtggagcacctgagtgccagctgcccccatgtcactctgcagtttgcggattccaaaggtgatgtggggctgggcctggtgaaggaaggactcgtcatggtagaagttcggaaggagaagcagttccagaaagtgatcacagagtacctgaatgcccaggaatcagccaagagtgccaggctgaacctgtggcgctatggcgacttccgagctgacgatgctgatgagtttggctacagtcgctaaggagaacttgcctggctcccagcaccgatgatgccagaccttctccctctgccaggaagccgttttcaactccagacctggtcgggggagtatagattgggtccagcttgcttcagacagaaacctcctctgtcgcgggtagcattggagctggggtggagagcccaaggcttgctggggcagacccctcagtggtactgccgtccagtctctcccagatgattttgtatttttatttaattgtcttcaaatcaggaaagaaccatgaaagactgtgtgttagtgaagggtataatcgtgacacagaggcagctgtcagctggcacccacctctcccccagaccacccttcttcccaagctctgtccaagtgttgattatgtgacttctgatacatccgttctcaaattccagtgtgcccatatctgcccccacaccagcctgttctgtatttaaagcttttgagacccaataaaatagtacctgctgtctgcaaaaaaa

SEQ ID NO: 3617 - DNA, 466 bp, Rattus norvegicus
  Genbank Accession No. NM_022697
ctttccgtctccggccgccgcaggagaggagtcgccgccatgtccgcgcatctgcaatggatggtcgttcggaactgctccagtttcttgatcaagaggaataagcagacgtacagcacggagcccaataatctgaaggcccgaaactccttccgctacaacgggctaattcaccgcaagacggtcggagtggaggcctggcctgatggcaaaggggtcgtggtggttatgaaacgcagatccggtcagcgaaaacctgccacttcctacgtgaggaccaccatcaacaagaatgctcgggctaccctcagcagcatcaggcacatgatccgaaagaacaagtaccgccctgatctgcgtatggcggccatccgcagagccagtgccatccttcgaagccagaagcctgtggtggtgaagaggaaacggacccgccccaccaagagctcctgagccccacaccccg

SEQ ID NO: 3618 - DNA, 1015 bp, Rattus norvegicus
  Genbank Accession No. NM_022698
atgggaaccccaaagcagccctcgctggctcctgcacacgccctaggcttgaggaagtccgatcccggaatccggagcctggggagcgacgcgggaggaaggcggtggagaccagcagcccagagtatgttccagatcccagagtttgagccgagtgagcaggaagacgctagtactacagataggggcctgggccctagcctcactgaggaccagccaggtccctacctggccccaggtctcctggggagcatcgttcagcagcagccgggacaggcagccaataacagtcatcatggaggcgctgggactatggagacccggagtcgccacagttcgtacccagcggggactgaggaagatgaagggatggaggaggagcttagcccttttcgaggacgctcgcgctcggctccccccaatctctgggcagcgcagcgctatggccgtgagctccgaagaatgagcgatgaatttgagggttccttcaagggacttcctcgcccaaagagcgcaggcactgcaacacagatgcgacaaagcgccagttggacgcgcattatccagtcctggtgggatcgaaatttggggaaaggaggctccactccctcccagtgatctgctccacattcccggaattctacccgctcccatcgcccgccatattgggtgtgggcggaagtctttcgaggccttaggaaaaaaggatcgctgtgtccctttaacagggagaagagctgacgtacagcgttgagttccttccggtgcgtgcaatagccatggaggggtggcccttgctttggagttttcaaagttttccacacaccctaccccctacgcctccggaagtggctatgttccctctccgttactggacagccctcaggcgcctgtgctaagttgcgagtcctggtaaaccgagactgggtgctgtcctatcatcctagctggaggccccaggtcaagaaacgtgctttataataaagcccgcgcatgtgtaaaaaaaaaaaaaaaa

SEQ ID NO: 3619 - DNA, 392 bp, Rattus norvegicus
  Genbank Accession No. NM_022699
atggtggctgcaaagaagacgaaaaagtctctggagtcaatcaactctaggctccaacttgttatgaaaagtggaaagtacgtgctggggtacaaacagactctgaagatgatcagacaaggcaaagcgaaattggttatcctcgccaacaactgtccagctttgaggaaatctgaaatagaatactatgccatgttggctaaaactggtgtccatcactacagtggcaataacattgaattgggcacagcgtgtggaaaatactacagagtatgcacactggctatcattgacccaggtgattccgatattattagaagcatgccagaacagactggtgagaagtaaacaagaaagttctcctttaataaaactttgccagagctcctttt

SEQ ID NO: 3620 - DNA, 943 bp, Rattus norvegicus
  Genbank Accession No. NM_022700
gaaccccgccccatcccgctgctccgttcctccgctgtgcatgcgagggacgtcaggggcggcgccgcagcagttacccctggtaacgggggaggcaggaggaggaggcggaggaggaggaggagggactcggcttgaggatgggcttgctctctattttgcgcaaattgaaaagtgcaccagaccaggaggtgcgaatcctcctcctgggcttggacaacgctggcaagacgaccctgctgaagcagcttgcatctgaagacatcagccacatcacacctacacagggatttaacatcaaaagtgtacagtcacaaggttttaaactgaatgtatgggacattggcggacagaggaaaatcagaccatactggagaagctattttgaaaacactgatattcttatatacgtaattgacagtgcagacagaaaaagatttgaagagacgggtcaggagctaacggaattgctggaggaagaaaagctgagctgtgtgccagtgctcgtctttgctaacaagcaggatctgctcacggcggccccagccgcagagatcgcagaagggctaaacctacacaccattcgggaccgcgtctggcagatccagtcctgctcagcgctcacaggcgagggcgtccaggacggcatgaactgggtctgcaagaatgtcaacgcaaagaagaagtaagatgccgagggaggcgcggagctgcgggagctggtcccgccctgagaaagaaacactggcttgcgctttctgaccaaaggctttcccatctgcacggccacagctgtgtggtgggaggggacagcagcttaagaggaacccccattccagcagtagattttaactgatctcagaggttcagtatcgtttttcaaataaaggaattatattgtttcctctgcaaaaaaaaaaaaaaaaaaaaaaaaaaaaaaaaa

SEQ ID NO: 3621 - DNA, 2157 bp, Rattus norvegicus
  Genbank Accession No. NM_022701
gaatctgttggcacggaggaagaagtccctggggaatcttaggactgtcacaggggcgctcaagggactgggcggtggcagaggcagttctcctgataggagggggaagaggtgccacagggccccttcccctctgcaaaggcttcttctctctcccctccagttgcagcctcaactatgtttttcacttgtggcccaaatgaggccatggtggtctccgggttctgcaggagccccccagtcatggtggccggaggccgagtgtttgtcctaccctgcattcaacaaatccaaaggatctctctcaacacactgaccctcaatgtcaagagtgagaaggtttatacccgccacggggtccccatctcagtcacgggcattgcccaggtgaaaatccaggggcaaaacaaggagatgctggcagctgcctgccagatgttcctggggaagacagaggcagagatcgcccacattgccctggagacgctggaaggccaccagagggcaatcatggcccacatgactgtggaggagatctataaggacagacagaagttctcagagcaggttttcaaggtggcctcctccgacctggtcaacatgggtatcagtgtggttagctacactttgaaggacattcacgatgaccaggattacttacactctttggggaaggctcgcacagcacaagtgcagaaagatgctcggattggagaagcagaggccaagagagatgcggggatacgggaggctaaggccaagcaggagaaggtatccgcacagtgcctcagtgaaatagagatggccaaggcccagagggactatgagctgaagaaagccacctacgacattgaggtcaacacccggcgagcacaggcggacctggcctatcagctgcaggtggccaagacgaagcagcagatcgaggagcagcgggtacaggtgcaggtggtggagcgcgcccagcaggtggcagtgcaggagcaggagatagcaaggcgcgagaaggagctggaggcccgggtgcgcaagccagcggaggctgagcgctacaggctggagcgcctggcggaagcagagaaggcccagctgatcatgcaggcagaagctgaagctgagtctgtgcgggtgagttggggcatggcttctgattggcatgaggggagggcttatcagggtttcttgttctctattgcttgttttttgtcctggctgacctggaactcactgtgttaacaagatggcttcaaactcggggagatccatctacctctgcctcccaattactgggattaaaggcattcacaactgttgttgctgtcgctgttgctaacctcctcccttcttccctccttctcctcctccttctccccctctccccacgccccatgtaggaggcagggtggttcatcttgccagtgtggaggtcagatccccctggagattttaagtaaggttgttggcctgactggcaagcacctttaccctctgagtcttattggcctcagaatttggtatccttaatgagttgcctgcccgtaccctccacagatgcgaggggaagctgaggcctttgccgtaggggcccgcgctcgtgctgaggctgagcaaatggccaagaaggcagaagccttccagatgtaccaggaggccgcccagctggacatgctgctggagaaactgccccaggtggcagaagagatcagtggccccctgacctcagccaataagatcacgctggtgtctagcggaagcggaaccatgggggccgccaaagttactggggaagtactggacatcttaagccgtctgccagagagtgtggagagactcacaggcgtcagcatctcccaggtgaatcacaacaagcctttaaggacggcgtgagcccttccaagttcccaatggtacctggacatgtggcccaatggtctcattgcatgcgcctcagttggcctccctgagcatgaccccctgccaagggtgcacatctctccttgccaaatagtctgtgccttgccttggagggcttgctctccgcccatttgccagtgccctgcaccaagactttggttatcttacttcaccccaactatttaacttcctgattaaacgagactgagccctctgggtagctataaaaaaaaaaaaaaaaaa

SEQ ID NO: 3622 - DNA, 1200 bp, Rattus norvegicus
  Genbank Accession No. NM_022703
ttcggtcgactgagagatcctgagcagtgccacctcaccagcctcgagatggacaacaggaagcgcctggcctatgccatcatccagttcctgcatggccagctgcggcacggtgggctctcgtccgacgcccaggagagcctagaggttgccatccagtgtctggaaacagcctttggggtgacgctggaggacagtgaccttgctctcccgcagaccctgccagagatatttgaagcagccactgccagcaaggagatgccacaggacccgaggggccctgacaggacaccaccctctgaggaggactcagctgaggcagagcgccttaaaacagaaggtaacgagcagatgaagttggaaaactttgaggcagcagtgcacctctatggcaaagccattgagctcaaccccgccaacgccgtttacttctgtaacagagctgcggcctacagcaagctgggaaactacgtgggggcggtacaggactgtgagcgcgccattggcattgatcccgggtacagcaaggcctatggccgcatgggccttgcgctgtccagcctgaacaaacatgcggaggctgtggcgtactacaagaaggccctggagctggaccctgacaacgacacgtacaagtccaacctcaagatcgcagagctgaagttacgggaggcgccgagccctacgggcggcgtgggcagcttagacatcgctggcctgctgaacaacccgcacttcatcactatggcttcgagcttaatgaacagcccccagctccagcagctcatgtcgggaatgatctctggaggccataaccctctgggcaccccaggcagcagtccacagcacagtgacctggccagtctcatccaggcgggccagcagtttgcacagcagatgcagcagcagaacccagagttcgtggagcaaatccggagccaggtggtgcgcagccggacacccagtgccagccacgaggagcagcaagagtgacaacgctgacccgagtggcccctctgctccgcgcgcggcctcctggtgttttagcaatttctccatcgggctgctcaagagagaaactggacctgcatgttaagacggactcatccccccgccctgtgttctcttcatccctccccctttgttttttgtactcgtaactggctccacaccttcctggaagagtctacatttgactac

SEQ ID NO: 3623 - DNA, 975 bp, Rattus norvegicus
  Genbank Accession No. NM_022706
cccgcctgccgagtagtcgtcgctgccgccgccgcctccgttgttgttgtggtcgcttcgccgaagtctgcggctcaaagagccggctccgtcgcttcccgccgccatgaagtggatgtttaaggaggaccactcgctggaacacagatgcgtggaatccgcgaagatcagagcgaaataccccgaccgggttccggtgatcgttgagaaagtctctggctctcagattgttgacattgacaagaggaagtacttggtcccatctgacatcactgtggctcagttcatgtggatcatcaggaaaaggatccagcttccttctgagaaggccatcttcttgtttgtggacaagacagtcccacagtccagcctaactatgggacagctttacgagaaggaaaaagatgaagatggattcttgtatgtggcctacagcggagagaacacttttggcttctgagcccttgctgggctaggtgcacccttcctgcttgtgtatcctgtaaataactggctgttctcagttactccgccggagcctccacacagacctactagtgcatttgtaactggatttatttcttaatatattggaaggttttgttttccttagattagtaaattatcatacagagttttattttcagttttcttttgtgcactgtcctcatggctatatgctccaaggaacctgtcctccggaatcacatttaatgaagatacttccgaaatgaagggcggtaggtgtggtattaaagtgacaaggagggatgacgcattgttctggattatgttcggagtgttagacggctaagtattaaaagcccccaaattaaatccttagcaatcagaacacttgcttcactagattttgccaactgcaaatcatgttggactgagctaatctgttctttctgagactataaggtaaatgattaacaataaagcctccatgtaaaaggcaaaaaaaaaaaa

SEQ ID NO: 3624 - DNA, 701 bp, Rattus norvegicus
  Genbank Accession No. NM_022707
cgcagctgagctcccagacttcacacaactaaacagtctgcattgtgacgatcacagaagccaaggcctcctaaaaggagacagctcgcgtttggctgcctgctgtcaactttttatctttctcttgactacttaaaaaagacttgtcttcctacttttgtcttcctggcatcatggaaaaagtccaataccttactcgctcggctattaggagagcctcgactattgaaatgccccagcaagcgcgtcagaacctccagaacctctttatcaatttctgtctcatcttgatatgtctgctgctgatatgcatcattgtgatgcttctgtgacaagctgtcgccaccgcagacctgcaccatgccaacgcagttacaacctggccctccaccacgaggggagggcagtgccgccgccttttccctgctgggacatcgtcgtgaagggtcacgatttaagagtgagactgatggcagccagtgtgatcatcgctgatcttgtaactttacacgactagtgtgccacaatgtagctgcccgtttcctcagtgtggctcataaatgtctttcctaaatacttctgacattgtagtatgagattttaattttgaaacagcactacaaaaaaagttacactttctatatccagcactagaaagttcaacttatagcattcagtttggggaataaatgaaatttaaa

SEQ ID NO: 3625 - DNA, 1626 bp, Rattus norvegicus
  Genbank Accession No. NM_022714
gcggcccctcatctccgtgagccccgaggcttctcttggccaaggtcctaggagtgatccgattgagagcggcgccccaaagctgccgggctggccggggtgggcggggaggcacctggacgctgcactctctggtggctccgcgtcgcgccaggtccctcgcagccacgcggggcgcgcactcccactcccaacgcgcgcggctccggagcgcaatggacgcggcgctgctcctcagcctgctggaggccaactgcagcctggcactggccgaagagctgcttttggacggctggggagagcccccggaccccgaaggtccctactcctactgcaacacgaccttggaccagatcgggacctgctggccccagagcgcgcctggagccctagtggagagaccatgccccgaatacttcaacggcatcaagtacaacacgacccggaatgcctacagagaatgcctggagaatgggacctgggcctcaaggatcaactactcacactgtgaacccattttggatgacaagcagaggaagtatgacctgcattaccgaatcgccctcatcatcaactacctgggccactgtgtttccgtggtggccctggtggctgctttcctgcttttcctagtgctgcggagtatccgctgcctgcggaatgtgatccactggaacctcatcaccaccttcatcctgagaaacatcacgtggttcctgctgcaactcatcgaccacgaagtgcatgagggcaatgaggtctggtgccgctgcgtcaccaccatattcaactactttgtggtcaccaacttcttctggatgtttgtggaaggctgctacctgcacacggccatcgtcatgacgtactccacggagcatctgcgcaagtggctcttcctcttcattggatggtgcataccctgccctatcattgtcgcctgggcagttggcaaactctactatgagaatgagcagtgctggtttggcaaggaacctggtgacttagtggactacatctaccagggccccatcatcctcgtgctcctcatcaattttgtgtttctgttcaacatcgtcaggatcctgatgacaaaactgcgagcctccaccacatccgagaccatccagtacaggaaggcagtgaaggccaccctggtcctcctccccctgttgggcatcacctacatgctcttctttgtcaatcctggagaggacgacctgtcacagattgtgttcatctacttcaactctttcctgcagtcctttcagggtttctttgtgtccgttttctactgcttcttcaatggagaggtgcgctccgccctgagaaagcggtggcaccgttggcaggaccaccacgccctccgagtgcctgtggcccgggccatgtccattcccacatcgcccaccaggatcagcttccacagcatcaagcagacagctgccgtgtgatcccctgtcacccatctgcccagcactccaccaccgaggcggcttcctcattcttcacagccttccctgggtcctccttgctacactgacccttgggtgcaggagaagggggggtggatgaactctcctgccggaagaaaggaaaactatgaaatggaggctctgaaagaccagg

SEQ ID NO: 3626 - DNA, 2756 bp, Rattus norvegicus
  Genbank Accession No. NM_022715
tgtggcttgcagctgccagctaccctgctaaatgtttggtgggaaaagcttgggattcaccatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatgaacctcttcagcacagcttcgggttgctggggctggggtctgatggtcagccgccagcacagaagtgatccggcagcccggggaagacttgctctcccaggctctccgaagcagccatgctgtgccttaggtcaacactgactgcactgacaatggataaaataaattgacaactgta

SEQ ID NO: 3627 - DNA, 2611 bp, Rattus norvegicus
  Genbank Accession No. NM_022853
ccgcggtctcccgagcgcctcggtccgatgctcggcagcccctcggtacgcagtggcccgccgcgccctccgcctcgccagtacagccgagcgccggcgcttgagtagctgcgcggccggcggtttctccacagcgccgctcccgcgtcagcgccgagcttcaggccgccgccatgggctgctggggccgcaaccgcggccggctgctgtgcatgctgctgctgaccttcatgttcatggtgctggaggtggtggtgagccgggtgaccgcgtcgctcgccatgctgtccgactccttccacatgctgtcggacgtgctggcgctcgtggtggcgctggtggccgagcgcttcgcccggaggactcacgccacgcagaagaacacattcggctggatccgcgctgaggtgatgggcgcgctggtgaacgccatcttcctcacggggctgtgcttcgccatcctgctggaagccgtcgagcgcttcatcgagccgcatgagatgcagcagccgctcgtggtgcttagcgtcggcgtggcggggctgctagtcaacgtgctggggctctgcctgttccaccaccacagcggcgagggccagggcgcaggccacggccactcgcacggccacggccacggccacctcgccaagggcgcgcgcaaggcgggccgcgcggggggcgaagcgggcgcgccgccgggccgggcgccggaccaggagccggaccaggaggagaccaacacgctagtggctaacaccagcaattccaacgggctgaaggcggaccaggcagagccagagaagttgagaagtgatgatccagtggatgtacaggtaaatgggaatctcatccaggagtcagacagtctggaatcagaagacaacagggctggacagctgaacatgcgaggagtgtttctgcacgtccttggagatgccctgggctctgtgatcgttgttgtgaatgccttggtcttctacttttcctggaagggttgtactgaagacgacttttgtgtgaacccgtgttttcctgatccctgcaaatcgtctgtagagctgatgaacagcacccaggcccccatgcacgaggctggtccgtgctgggtcctctacctagatccaaccctgtgcattataatggtttgtatacttctttacacgacgtacccactgctcaaggagtccgctctcattcttctacagactgttcctaagcaaattgatatcaaacatttggtaaaagagctacgagatgttgaaggagtggaggaagtccatgagttacacgtctggcagctcgccggaagcaggatcatcgccactgctcatataaaatgtgaagacccagcttcatacatgcaggtggccaaaaccattaaagatgtttttcacaatcatggaattcacgccaccaccatccagcctgaattcgctagcgtaggctctaaatcaagtgtcgtcccgtgtgagctcgcctgcagaactcagtgtgctttgaagcagtgctgtgggacacggccacaggtccattctggaaaggaggcagagaaggctccaacagttagcatttcttgtttagaactcagtgaaaacctagagaagaagcccaggaggactaaagctgaaggcagtgtccccgctgtggtgatagagattaaaaatgtgccaaacaaacagcccgaatcatctttgtgagccttgagaaagatgtgatatttgactttgcttttaaactgcaagagaaaatagactccattgaaatgctaagtttgccacgtagtgtaattgaagtcctcgtctggtcgcacagtttaattctatttttgtcagaacgtaatggaactgcagaatagagtgcgctacagcacagcctcgcgattactagtgcatagtgcagctgtgctggagcacgctttgaaagccagtttaacactatgttacatttttgtttaaagtaagtatagaccttatatgacataatgacatttgattcctggttttcccatgataaaaattagggggataaataaaattgttactggaatttctctgcttttctttcccccattgttatatcttatctgttaggattgtaattgctaggcctttaaagtcatcaagcttgtttcctctgatgttgaggggtagttacgtgccctttgagatcataagcctagcataattgcagcatgtttccagagcaagtcatgactattagcaggaaacgagattagttactactctgttctccacttctgagtagtcgagtaaaccgtgaggtaattcacaagatgagttagagtttacacattgtagagcatataggggagaagagcaaggaagaaggcaatatgtcagttattacctattaatgtggagattatagctctaaattaccttgaaaatctcaaatggctttattctaccaaagtcagtctaaacacttctgccagtgttgctttctttcaaagactggtattagcaacattgagctaaaagttctaaatgcatgaatagttttgaaaatgcagactccttaactgcaaactattaaattgtgtcttaaaaaaacttccatagtgacctgtcagatggattgaatacctttc

SEQ ID NO: 3628 - DNA, 6683 bp, Rattus norvegicus
  Genbank Accession No. NM_022861
gggtaatcggattcaaaacaacattagagcaacaactttgcctacatacaatctggtatcacggtcgcctcgttcagcaaagcagacgaggatcgcttgtatttctgaaaaccggaaataaagacactttcagtttgagaaaggggcagacggaagcaatggtcacacagaagaggacacacctcctgagatttccttttcaaatgtcctacgtggacagcctctggaggatggagtccgtggtttcgctgaatgcgtttacctctaggcgtggcctgtagtgagcgtcactccaccctgccatagccaggtgctctaatggtgctctagtagtgactagagataccccacgcagggtgaagccctcatctaggctgtgaagtgatctgttttggaaagtatgagggttttaataagacagtgcacaggacaacctgagaataggagaaaagcgtcacaatagaataaaggtcactatctatcatgtcaccattcctcctggagggagccccaggcttgagaagggacgtggaaaccggtaggagtcggggtggggggggatcctctccacagtcagagaagcagaaaataactcccaggaggagggcctctcagaaaggccatgcagaagaaccttcaggagactctctttcccatccaaggcttcggcttcccatgactggaagggctttttggtcacacgggctgtttcggtcatctgtgctcctctaagtaattacttatccacactcctgaatgacttcagtagaatcatcagcttgatcactagcacttccctatctgcggtgagcagacgtctgtgctgtgtctgctcagaaaagtctcaaacaatggccaccgatggaaacctcccagggcagatcctactcaactgcttcttcgagtcggatgactcaagatgcttcagttcccactgactgtctctagccagcatggtcttaaccagagaagataatcaagaacaattagaaaaggtattgaagtgggaaatggagggtcggggatgaagcgacatggccggcgaccgggccccagcgtaagctctgagccccgcgctgcgcccgccgcgctctggccgcctggagtcatgtctctgctgtgcgtgggagtcaaaaaagccaagtttgacggtgcccaagagaagttcaacacatacgtgacgctgaaggtgcagaacgtgaagagcactaccatagctgtacgcggcagccagcctagctgggagcaggacttcatgtttgagatcaaccgcctggatctgggcctgacggtggaggtgtggaacaagggtctcatctgggacacaatggtgggtactgtgtggatcccacttcggaccatccgtcagtccaatgaggagggtccgggagaatggctgacactggactctcaggccatcatggcggacagtgagatctgtgggaccaaggaccccaccttccaccgcatcctcctggacgcacattttgagctgcctttggacatccccgaggaggaggcgcgctactgggccaagaagctggagcagctgaatgccatgcgtgaccaagatgagtactcctttcaggaccagcaggacaagccactgccggtgcccagcagccagtgctgcaactggaattactttggctggggagaacagaatgatgatcccgacagtgccgtggatgaccgggacagtgattataggagtgagacgagcaacagcatcccaccgccttactacacgacttcgcagcccaatgcttcggtgcaccagtactccgtgcggccaccccctctggggtcccgggagtcctacagcgactccatgcacagctatgaagagttctctgagccgcgggcactcagtcccacaggcagcagccgctatgcttccagtggggagctgagccagggcagctcccagctgagtgaggacttcgacccggatgagcacagcctacagggctcagagctggatgacgagagggaccgagattcttatcactcctgccacagctctgtgagctaccacaaggactcaccccgctgggaccaggatgaggaggacctggaggacctggaggacctggaagatgaggagttgcccgaggaagaggagttggaagaggaggagttggaggaggaggaggagttggaggaagaggaattggagttggaggaggaggaggaggtgcctgatgacctggccagctatacccagcaggaggacaccactgtggctgagcccaaagagttcaagcggatcagcttcccaacagctgcacctcagaaggaagacaaagtttcagctgtgcccattgaggcccccgatgtgtccaaaggcatccccaaggcagccacacctgaagagaaggcagctgcggagtgtgcacaggaagcggagccccccaagtctgaggagagtttcagatctcgagaggctgaggagggccaggaagggcaggatgccatgtccagggccaaagccaactggttgcgagccttcaacaaggtgcgcatgcagctgcaggaggcccgaggagaaggagagatgtccaagtctctgtggttcaaaggcggccctggtggtggccttatcatcattgacagcatgccagacatcaggaagcggaagcccattcccctcgtgagcgacctggctatgtctctggtccagtcacggaaggcgggcatcacctcggccttggcctccagcacgttgaacaatgaagagttgaaaaaccacgtttacaagaagaccctgcaagccttaatctaccccatctcctgcaccacgccgcacaacttcgaggtgtggacggccaccactcccacctactgctacgagtgcgaggggctgctgtggggcatcgcgcggcagggcatgcgctgcaccgagtgcggcgttaagtgccacgagaagtgccaagacctgctcaacgcggactgcctgcagcgggcggctgagaagagttctaagcatggcgctgaagaccgcacgcagaacatcatcatggtgctgaaggaccgcatgaagatccgcgagcgcaacaagcctgagatcttcgagctgatccaggaggtcttcgcggtcaccaagagcgcacacacacagcagatgaaggccgtcaagcagagtgtgctggatggcacatccaagtggtctgccaaaattagcatcacggtggtctgtgcccagggcttgcaggccaaggacaagacaggatccagtgacccttatgtcaccgtccaggttgggaagaccaagaaaaggacaaaaaccatctacgggaaccttaacccagtgtgggaagagaatttccactttgaatgtcacaactcctctgaccggatcaaggtgcgtgtgttggatgaagacgatgacatcaaatcccgtgtgaagcaaaggtttaagagggagtctgatgacttcctagggcagacaatcatcgaggtgcggacgcttagcggcgagatggatgtgtggtacaatctggacaagagaacagacaagtctgctgtgtcgggcgccattcggcttcacatcagtgtggagatcaaaggggaggagaaggtggcaccctaccatgtccagtacacctgtctgcatgagaacctgttccattttgtgacggatgtacagaacaatggcgtggtgaagattcccgatgccaaaggtgacgacgcctggaaggtttactatgatgagactgcccaggagatcgtggatgagtttgccatgcgctatggcgttgaatccatctaccaagccatgacccactttgcctgcctctcctccaagtacatgtgccctggggtacccgctgtcatgagcaccctgcttgccaacatcaacgcctactacgcacacaccaccgcctccaccaacgtgtctgcctccgaccgcttcgctgcctccaatttcgggaaagagcgctttgtgaaacttctggaccagctgcacaactccctgcggattgacctgtccatgtaccggaacaacttcccggccagcagccccgagcggctgcaggatctcaagtccacagtggacctgcttaccagcatcaccttcttccggatgaaggttcaggaactgcagagtccgccacgtgccagtcaggtggtgaaggactgcgtgaaggcgtgcctcaactccacctacgagtacatcttcaacaactgtcatgagctctatggccgggagtaccagacagacccggccaagaagggggaggtccccccggaggagcaaggccctagcatcaagaacctggatttctggtccaagctcatcaccctcatcgtgtctatcattgaggaggataagaactcctacacaccctgcctcaatcagtttccccaggagctgaatgtggggaagatcagtgctgaggtgatgtggagcctgtttgcccaggacatgaagtacgccatggaggaacacgacaagcaccggctgtgtaagagcgcagactacatgaacctgcatttcaaggtcaagtggttgtacaacgagtacgtggctgaactgcccaccttcaaggaccgcgtgccggagtaccctgcgtggtttgagcccttcgtcatccagtggttagatgagaatgaggaggtgtcccgggacttcctgcatggtgcactcgagcgggacaagaaggatgggttccagcagacatcggagcacgccctgttctcttgctcggtagtggacgtcttctcccagctcaaccagagctttgagatcatcaagaagctggagtgtcctgacccccagattgtgggccactacatgcggcgctttgccaagaccattagcaatgtgcttctccagtacgccgacatcgtctccaaggacttcgcttcctactgctccaaggagaaggagaaagtgccctgcatcctcatgaacaacacacagcagctgcgggtgcagctggagaagatgttcgaggcgatgggtgggaaggagctggacgccgaggccagcggaaccctgaaggagctgcaggtgaaactcaacaatgtcctggatgaactcagccacgtgtttgccaccagcttccagccacacatcgaggagtgtgtcagacaaatgggtgacatcctaagccaagtgaagggcacgggcaacgtgcccgccagtgcctgcagcagcgtggcacaggacgcagacaacgtgctacagcccatcatggatcttctggacagcaacctcaccctgtttgccaaaatctgtgagaagacggttctgaagcgggtgctgaaggagctgtggaagctggtgatgaacaccatggagaggaccattgtcctgccgccactcactgaccagacgatgattggtaccctcttgagaaaacatggcaagggcctagaaaagggcagggtgaaactgccaagccactcagacgggacacaaatgatcttcaatgccgccaaggagctgggccagctgtccaaactgaaggatcacatggtgcgagaagaagccaagagcttgaccccgaagcagtgtgccgtggttgaactggccctggacaccatcaagcaatacttccacgcggggggcgtgggcctcaagaagacctttctcgagaaaagcccggaccttcagtccctgcgctacgccctgtcgctctacacacaggccaccgacctgctcatcaaaaccttcgtgcagacgcagtcagcgcaggtccatggtggaaaggggactaggtttacccttagtgaagacgtttgtcctgagatgggctcgggtgtggaagaccctgtaggtgaagtatccgtccacgtggagctgttcacgcatccgggaactggggaacagaaggtcacagtgaaggtggtggccgccaacgacctcaagtggcagacttctggcatcttccgtccgttcattgaggtcaacatcgttggacctcagctcagcgacaagaaacgaaagttcgccaccaaatcgaaaaacaacagctgggcgcccaaatataacgagagcttccagttctccctgagcgccgacgcgggacccgagtgctacgagttgcaggtgtgcgtgaaggactactgcttcgcgcgcgaggaccgcacggtggagctggcggtgctgcagctgcgggagctggctcagcgcgggagcgccgcgtgctggctgccgctcggccgccgcatccacatggacgacacggggctcacagtgctgcgtatcctgtcgcagcgcagcaatgacgaggtggccaaggagttcgtcaagctcaagtccgacacgcgctcggccgaggagggcggtgccgcgcctgcgccctagcgcgcgttttggcggcggggcggggcctgggaagggatgaggtcccgccttccgtaggccaccgcctctccagaggccacgcccctccacctcagtggccttggctggggaggccctgccccctgcccctggaaaagccatagagggtccggtgcccagggcatggactgggcagggctgcctgggaggctgggtcgcagcctctggtgtctgcaaaatacagggcgggatggactctcaaaagcacaccggccctcggcgcacagctggggctgcgggcacccctctccgcggaccccgccctcagcagcgggcccactggcagctggcgaccccctgctcgtgtcacacagggcgggctgagctc

SEQ ID NO: 3629 - DNA, 861 bp, Rattus norvegicus
  Genbank Accession No. NM_022867
ggcacgagccaggacccccgcgcgccatgccgtccgagaagaccttcaaacagcgccggagcttcgaacaaagagtggaagatgtccggctcatccgggagcagcaccccaccaagatcccagtgattatagagcgatacaagggtgagaagcagctgcccgtcctggacaagaccaagttccttgtacctgatcacgtgaatatgagcgaactcatcaagataattagaaggcgcctgcagctcaatgctaaccaagccttcttcctcctggtgaatgggcacagcatggtgagtgtgtccacacccatctctgaagtgtacgagagcgagagagatgaagacggcttcctgtacatggtctatgcctcccaggagacgttcgggacagcactggctgttacatacatgtcagctctgaaggcaacagcaacaggaagagagccatgcttgtgacagacatacagccacttccaactaaagcaagcctctgcttcctgctacctgcatggagcccactgtgacactcagaccatccccggtcactcactcgtgtctgagaatctcagtgagagctgcctctgtcacggaccggaagccaacacagccacctctcgacctgctccccacagcacccaccctccctgcatgcaagctgtccctgctaacccccaatgttatgttacactgtgtaaatccccactgctgccgtgtgtgggttgtgtacgtcgtcatgtccctggtttataactatggtgcggtcgggaaggattcctgtaatgctgctctaaggatctggctcaggcagccattgtaggacacctgtactctgatgcactaagtccaataaaggcacaactgg

SEQ ID NO: 3630 - DNA, 2045 bp, Rattus norvegicus
  Genbank Accession No. NM_022924
ggctgtggtgaccggaacaagcccggggtctacactgacgtggccaattacctggattagatcccaggagctgacacactatgttgcacgtccgcggcctggggctacctggctgcctggctctggctgccctggctagcctggtacacagtcagcatgtgttcctggcccctcagcaagcactgtcgctgctccagcgggtccgcagagccaacagcggcttcctggaggagctccgaaagggcaacctggagcgtgagtgcgtggaagagcagtgcagctatgaggaggcttttgaggccctggagtctccccaagacacggatgtgttctgggccaagtacacagtgtgtgattcagtgaggaaacctcgagagaccttcatggactgtctagaaggtcgctgtgctatggatctgggtctgaactaccatgggaatgtgagtgtcacccataccggcatcgagtgtcagctgtggcgaagccgctacccacacaggcctgacatcaactccaccacccatcctggggctgacctgaaggagaacttctgccgaaatccagacagcagtacctcagggccctggtgctacaccacagaccctactgtgcgcagagaggaatgcagtatccctgtctgtggtcaggagggccgtaccactgtgaaaatgactcctcgctcaagaggttccaaggagaatctgtcgcctccattgggagagtgcctcctcgagcgtggccggctgtaccaggggaacttagctgtgacaacacttgggtccccctgcctggcctgggacagtttgccaaccaagaccctgagcaagtaccagaacttcgaccctgaggtgaaactcgtgcaaaacttctgccgcaatccagaccgggatgaggagggcgcgtggtgctttgttgcgcagcagcctggttttgaatactgcagcctcaactactgtgatgaagcggtgggagaggagaaccatgacggggacgagtccatcgcaggacgcaccaccgacgcggagttccacaccttcttcgatgagaggactttcggccttggggaggcagactgtggcctgcggcctttgttcgagaagaagtccttgacagacaaaacggaaaaggagcttcttgattcttacatagatgggcgcatcgtggagggctgggacgctgagaagggtatcgccccatggcaggtgatgctttttcggaagagtccccaagagctgctgtgtggagccagccttatcagtgatcgatgggtcctcactgctgcccactgcattctgtacccaccctgggacaagaacttcactgagaatgacctcctggtgcgcattggcaagcactccagaaccagatatgagcggaatgttgaaaagatctccatgctggaaaagatctacatccaccccagatataactggcgggaaaacctagaccgtgacattgctctgctcaagctaaagaagccagtgcccttcagtgactacattcaccccgtgtgcttgccagacaagcagacagtaaccagtttgctccaggctggttataaagggcgggtgacaggctggggcaaccttcgggagacgtggacaaccaacatcaacgagatacagcccagcgtcctgcaggtggtgaacctgcccattgtagagcgaccagtgtgcaaggcctctacccggatacgcattactgacaacatgttctgtgctggcttcaaggtgaatgacaccaagcgaggagatgcttgtgaaggtgacagtgggggaccttttgtcatgaagagcccctacaaccaccgctggtaccaaatgggtattgtctcctggggtgaaggctgtgaccggaatgggaaatatggcttctacacgcacgtgttccgtctgaaaaggtggatgcagaaagtcattgatcagcatagataggtttgtgggtgggtgagagacccacagtatgggatcctcattgcaaaatcacagaaaccagttcaaaatatttttgtggtttgtttctgttctcaataaaagtgattgtcg

SEQ ID NO: 3631 - DNA, 1610 bp, Rattus norvegicus
  Genbank Accession No. NM_022934
ggccgggcggaactttccagaacgctcggtgggtggtagaggagcagcgtctggccgagctgcgctgtgctacgctcctctttccgctctccggcgccggcccgctcaccggctgtaaaaaatggtgaaagaaactacttactatgatgttctgggggtcaaacccaatgccacccaggaagaattgaaaaaggcatatagaaaattggccttgaagtaccaccctgataaaaatccaaatgaaggagaaaagtttaaacagatttctcaagcttatgaagttcttgctgattccaagaaaagggaactatatgataaagggggcgagcaggcgattaaggagggcggagcaggtggaggttttggctcgcccatggatatctttgatatgttctttggaggaggaggaaggatgcaaagagaaaggagaggtaaaaatgtcgtgcatcagctctcagtgaccttagaagacttatataatggtgcaacaaggaaactggctctgcaaaaaaatgtgatttgtgacaaatgtgaaggccgaggtggtaagaaaggagcagtagagtgctgtcccaactgccgggggactggcatgcagatcaggattcatcagattggaccaggaatggttcagcaaattcagtcagtgtgcatggagtgccagggtcatggagaacgcatcagtcctaaagacagatgtaaaagctgcaatggaagaaagatagttcgagagaagaaaattttagaagttcatattgataaaggcatgaaagatggtcagaagataacattccacggtgaaggagaccaagaaccaggactggagccaggagatattatcattgtgttagatcagaaggaccatgctgtttttacaaggcgaggagaagaccttttcatgtgtatggacatacagctggttgaagcattgtgtggcttccaaaagccaatatctactcttgacaaccgaaccatagtcatcacctctcatccaggtcagattgtcaagcatggggatataaaatgtgtgctaaatgaaggtatgccaatataccgtcggccatatgaaaagggacgtctaatcattgagtttaaggtaaactttcctgaaaatggctttctctctcctgataaactctctttgctggaaaaactccttcctgaaaggaaggaagtagaagagactgatgaaatggatcaggtagaactggtggactttgatccaaatcaggaaagacggcgtcattataatggagaagcgtatgaggatgatgagcatcaccccagaggtggcgttcagtgtcagacctcttaatgggccagtcactctttgaccttgtgtatgcagtagtgaatgtgggaaggactgtaatcataatatgctcactacttggctgttgtttttgttttaatattcaactatagtagtgttttaaaagttaaatgaagaataaacacaaatataaaagctctgactttgccctgtatgtatgatgactttaatgttcaagatgaaaatgaatacttgtaaaaaactagtttaaaaaatgccctagcatctgttaggccatatcttgtgtaactgataatagcgtgtacattagactgac

SEQ ID NO: 3632 - DNA, 1992 bp, Rattus norvegicus
  Genbank Accession No. NM_022936
cttcttgtctttgtcagcttggcgctgcagcccgggccatcatggcgctgcgtgtggccgcgttcgaccttgacggagtgctggccctcccctctatagccggggttctgcgccacaccgaggaggccctggcgctgcccagagacttcctacttggcgctttccagatgaaattcccagagggacccactgagcaactcatgaaaggaaagatcacattttcccagtgggtaccactcatggatgaaagctgcaggaagtcctccaaagcctgtggagccagtctacctgagaatttctccataagtgaaatattcagccaagccatggcagcaagaagcatcaaccgccccatgcttcaggcagctgctgctctcaaaaagaaaggattcacaacgtgcattgtcaccaacaactggctggacgacagtgacaagagagacatcctggcccagatgatgtgtgagctgagccaacactttgacttcctcatagagtcctgtcaggtcgggatgatcaagcctgagcctcagatctacaagtttgtactggacaccctgaaggcaaaacccaatgaggttgttttcctagatgactttggaagtaatctgaagccagcccgtgacatggggatggttaccatcctggtccgcgacacagcctcggctttgagagaactggagaaagtcacagggacacagtttcctgaggcacctctgccagtcccgtgcagtccaaatgatgtcagccatgggtatgtgacagtgaagccagggatccgtctgcactttgtggagatgggctctggccctgctatatgcctctgtcatgggtttcctgagagctggttttcttggaggtaccagatccctgctctggcccaggcgggctttcgtgttctagctatagacatgaaaggctatggagactcatcttctcctccagaaatagaagaatatgctatggaattgctgtgtgaggagatggtgacattcctgaataaactgggaatccctcaagcagtgttcattggccatgactgggctggtgtgctggtgtggaatatggctctcttccaccctgagagagtgagggctgtggccagtttgaacactccattaatgccaccaaatcctgaggtgtcccccatggaagttatcagatcgatcccagttttcaactatcagctgtactttcaagagccaggagtggctgaggctgaactggaaaagaacatgagtcggactttcaaaagcttcttccgaaccagtgatgatatgggtctcctcactgtgaataaagccactgaaatggggggaatccttgtgggaactccagaagatcccaaggtcagcaaaattactactgaggaggaaatagagtattacatacagcagttcaagaagtctggcttcagaggccctctaaactggtatcgaaacacagaaagaaactggaagtggagctgtaaggcgttgggaaggaagatcttggtccctgccctgatggtcacagctgagaaggacattgtactccgtcctgaaatgtccaagaacatggaaaactggatccctttcctgaaaaggggacacatcgaagactgtggtcactggacacagatagagaaaccggcagaggtgaaccagattctcatcaagtggctgaagactgaaatccagaacccatcggtgacctccaagatttagccagtggcgtgtcctctgctggggacacattttcatttctggacgtggccttatccacagccagcagcatcgttcttttgccagcagtgattttctttaaatgaaaatgatcagatgtgatgtaattttagatcaggaagaaagtggtgtgtctgattcttttgaggatgactgtatcaccaaaggagagatcacaccccaatagggaggcatggggcagcccagtttgtacctttgtagccaaacccaagcctgctctttctgaagcagctgatcagagagtagg

SEQ ID NO: 3633 - DNA, 1600 bp, Rattus norvegicus
  Genbank Accession No. NM_022937
gggaggggggcggggaccacggcgacgacgcgggggacggcggggccccgcggggagaggggagggcgggcccgggcggaaaggagggggtctccccggacgtgggaggggggcggcggcgcctcgtccagccgcggcgcgcgcccagccccgcctacagaccccagccggccactccagctctacacccgtctcccagccagaggtgctgcatgaggggccgcaggggcgatcgcatgaccatcaacatccaggagcacatggccatcaacgtgtgccctggacccatcaggcccatccgccagatctccgactacttccctcgcagggggccaggaccagagggtggcggcggcggcaggggcttcggggaagccccagctcatctggcccctctggctctggccccccctgcggctctccttggggccactacacccgacgatggagctgaggtagacagctacgactcggatgataccactgccctgggcacgctggaatttgaccttctctatgatcaggcttcctgcatgctgcactgtagaatcctcagggccaagggcctcaagcccatggatttcaacggcctggctgacccctatgtaaagctgcacctcctgccaggagcctgcaaggccaataagctaaaaaccaagacacagaggaacacactgaacccagtgtggaacgaggagctgacgtacagtggaatcacagatgacgacatcacccacaaggtgctcaggatctcggtctgtgatgaggacaagctgagtcacaatgaatttattggggagatccgagtgcccctccgccgcctcaagccttcacagaagaagcattttaacatctgccttgagcgtcaggtcccgcttccttcgccctcttcaatgtctgcggcgctgaggggcatatcctgttacctgaaggagctagagcaggcagagcagggacctgggctgttggaagagcgcgggcgcatcctgctgagcctcagctacagctctcggcggcatgggctgctggtgggcattgttcgctgtgctcacctggctgcaatggatgttaacggctactctgacccttatgtgaagacgtacttgagaccagacgtggataagaaatccaagcataagacgtgtgtaaagaagaagacgctgaacccggaatttaatgaggaattcttttatgagatggaactctccactctggctaccaagaccctggaagtcacagtctgggactacgacattggcaaatccaatgacttcataggtggtgtgtctctggggccaggagcccggggagaggcccagaaacactggagagactgtctacatcagccggacacagcagtggagcgctggcataccctgaccagcgagctgcccccagcagcaggggcgttgccgttggcctgaacagactgcagctgcccagcacaggccctctgcggccgggtccagtacccaaccttcgcacgagtgtgttgcacgtttacatgggtgggacgccctgccccacactacctgtcttatttttgtgagtttctgtgaccgtgggtctatcttcttgtgagggattgtggagagctata

SEQ ID NO: 3634 - DNA, 819 bp, Rattus norvegicus
  Genbank Accession No. NM_022939
atgtcctacggtcccttagacatgtatcggaatccgggccgtcggagcctccgggacttcagcagcatcatccagacgtgcagcggcaacatccagcggatcagccaagccactgctcagataaagaatttgatgagccaacttggaactaagcaggactcaagcaaactccaggaaaatttgcaacagttccagcactccacaaatcagcttgccaaggagacaaatgagttgctgaaggagttagggtccttgcccctacccttgtctgcatcagagcagcgccaacagaagcttcagaaggagcggctcatgaatgacttctcgtcggccttgaacaatttccaggttgtgcagagaaaggtatctgagaaggagaaagaaagcatcgcgagagcacgggctggatcccgtctttctgcagaagacaggcaaagagaagagcagctcgtctcatttgacagccatgaggagtggaaccagatgcagagccaggaggaagaggcggccatcactgagcaagacctggaacttattaaagagagggaaacggcgattcagcagctggaggctgacattttggatgtcaatcagatctttaaagacttagctatgatgatccacgaccaaggtgatctgattgatagcatagaagccaatgtggaaagctcagaggtgcatgtggaaagagcctctgatcagctacagagagctgcttactatcagaaaaaatctcgcaagaagatgtgtatcctcgtgcttgtcctctcagtgattgttacagtcttggtagttgttatctgggttgcttctaagtga

SEQ ID NO: 3635 - DNA, 4828 bp, Rattus norvegicus
  Genbank Accession No. NM_022944
cgggcggcggatggccatcttaagtggccgcggggagtccagggaggcttccccgggctaggagtcaccagagtcgccccagagttgaggccggcgctgctggcggcggcggctacgcggagatcgaggcggccggcgcggcaagcgtggaccccggatactgggctctctcaggctggtggatcctcaggcccggaacccgggccaggcccagcctccactccaagcttccctgggcggatggcgcggaggcaggcatcggcggcgctgagccctacgcgggccatggcctcagtgtgtggggcaccgagtcccgggggcgcgctaggcagccaggcccctgcctggtatcaccgtgacctgagccgcgcggctgcggaggagctgctagctcgggcaggccgcgatggcagcttcctggtgcgagacagcgagagcgtggcgggggccttcgcactctgcgtcctgtatcaaaagcacgtgcacacctaccgcattctgccagatggagaggatttcctggctgtgcagacctcacagggcgttcctgtgcgccgcttccagaccctgggtgagcttataggcctgtatgcccagcccaaccagggtcttgtctgtgctctgctgctgcctgtagagggggagagagagccagatccaccggatgaccgagatgcctcagatgtggaggacgagaaacccccactacccccgcgctctggctctaccagcatttctgtccctgcggggcctagcagccccctgccagcccctgagactcccacaactccagcagctgagagcactcctaatggactcagcactgtgtcacatgagtatctgaagggcagctacgggctggacctggaggctgtacgaggcggagccagcaacttgccccatctcacccgaacccttgtcacctcatgccgtaggctacacagcgaggtggacaaggtcctgtcaggcctagagatcctgtcgaaggtgtttgaccagcagagctcacccatggtgacccgccttttgcagcagcagagcctaccacagactggagagcaagagttggagagccttgtgctgaagctatctgtgctaaaggacttcctgtcaggcatccagaagaaggccctaaaggcactgcaggacatgagctccacagcacctccggctccattgcagccctccatacgaaaggccaagaccatccctgtgcaagcctttgaggtgaagctggatgtgacactgggtgacctgaccaagatcgggaagtcccagaagttcacactgagcgtggatgtggagggtgggaggctggtactgctgaggagacagcgtgactcccaggaggactggacgaccttcacacacgaccggatccggcagctcattaaatcccagcgtgtgcagaacaagctgggtgttgtgtttgaaaaggagaaagatcggacgcagcgcaaggacttcatctttgtcagtgcccggaagcgagaagccttctgccagcttctgcagctcatgaagaacaagcattccaagcaggatgaacctgacatgatctccgtcttcataggcacctggaacatgggaagtgtaccaccaccaaaaaacgtgacatcttggttcacatcaaagggactggggaaagccctggatgaggtcacagtgactataccccacgatatctatgtctttgggactcaggagaactcagtgggtgacagagagtggctggatctgctgcgtgggggcctcaaggagcttacagatctggattaccgtccgattgctatgcagtcactgtggaacatcaaggtggccgtgctggtcaagccagaacatgagaaccgcatcagccacgttagtacgtccagtgtgaagactggtatcgccaataccctggggaacaagggagctgtgggtgtttccttcatgttcaatggcacttcttttggcttcgtgaattgccatctcacctcagggaatgagaagactactcggcggaaccagaattatctggacatcctgcgtcttctctcattgggtgatcggcagctcagtgcctttgacatctctttgaggttcactcatctcttctggtttggggaccttaactaccgcttagacatggatatccaggagatcctgaactacattagtaggagagagtttgagcccctgctcagggtggaccagctcaacctggagcgggagaagcataaggtcttccttcgatttagtgaggaggagatatctttcccacccacctaccgctacgagcggggttcccgagacacatatgcttggcacaagcagaagccaactggggtccggaccaatgtgccttcatggtgtgaccggattctatggaaatcctatcctgaaacccacatcatctgcaattcctatggttgcactgatgacattgttaccagtgaccattctcctgtgtttgggacatttgaggttggagtgacttcccagttcatctccaagaaaggtctctctaagacctcagaccaggcctacattgagtttgagagcatcgaggccatcgtgaagacggccagccgcaccaagttcttcattgagttctattctacctgcttggaagagtacaagaagagcttcgagaatgacgctcagagcagtgacaacatcaatttcctcaaggtgcagtggtcctcgcgccagctgcccacgctcaagccaattctggctgacattgagtacctgcaggatcagcatctcctgctcacagtcaagtccatggatggctacgaatcatatggggagtgtgtggttgcactcaaatccatgattggcagcacggcccagcagttcctgaccttcttgtcccaccgtggagaggagacaggcaacattcgtggctccatgaaggtgcgggtgcccacagaacgcctgggcacccgtgagcggctctatgaatggattagcattgataaggatgacacaggagccaaaagcaaggctccttcagtgttgcggggcagccaggagcacagatctgggagccgcaagccaacttccacagaggcctcctgtccactgtccaagttgtttgaagagcctgaaaagccaccaccgactggcaggcccccagccccaccacgggcagttcctagggaggagtccttgaaccccaggttgaagtcagaggggacacctgaacaggaaggagtagcagcccctccacccaagaacagcttcaataaccctgcctactacgtccttgaaggggtcccacatcagctgctgcccctggagccaacctcatttgccagggcccctatcccacctaccaccaagaacaaagtggccatcacagtgcctgctcctcagcttgggcgccaccggacccctcgtgtgggggagggaagctcttcggatgaggactctgggggcacactgcctcctccagacttcccacctccaccactgccagactcagccatcttcctgccccctaacctggatcctttatcaatgccagtggtcaggggccgaagtgtgggtgaggcccgtggcccaccacctcccaaggcccatccaagaccaccactaccgccgggcacctcacctgccagtacttttttggaagaggttgcaagtgcggatgaccggtcttgctcagtactgcagatggccaagacactcagtgaggtagattattctcctgggcctggacgctcagcactcctccccaaccccttggaattgcagcttccccgagggccctcggactacggacggcccctcagcttccctccaccccgcatccgggagagcatccaagaagacttggcagaggaggctccgtgcccgcagggcgggcgggccagcgggctgggagaggcgggcatgggtgcctggctgcgggccatcggcttggagcgctatgaggagggcctggtgcacaatggctgggacgacctggagtttctcagtgacatcactgaggaagacctcgaggaagctggggtgcaggatcctgctcacaagcgccttcttctggacacgctgcagctcagcaagtgatagcagagatgccgccgagctgccaaagcagagctggaagggcacatgaaaccaggggtgaaagttttgaggggtgtggcagtgcatctctgtctatttattggggaccagagttccctactgcccaattgtttggggcgttctagttagaacatcgtgctccccacctagcttttaggcccagggtcaggggtttagtagcctgtggtaattgtgaagcacggtggttactccagtgcagacacctccctgcctcggttgtgcgtggggtatggttgggcacatctgggtcctcacttccactgatgtttccacctccctccctcgggcctgaactccaggggaagagttcctcgtagctcctactctgggaacgtacgtccgtccgtccggaaatgaaggaagagcccaggaccgggctggatttatttaagtttttctgtgtgggttttgggaagggagggcacgttaattttattggggtggggcaggacctcggccttaaaatgccagtttgcctagttctggctgttcctctggttcgaagaagcgctcttgcccagggaatgcgtggcagccggcggatgggggggggggggcagcctcgggttgccccggcaccagaagacagtgcttttgcagtttatcccatcttgggcactcagaaaggttgccggcttgatgtcttcaataaattaagttttatttggattgagcaaaatcaccttaataaattacacgtttttcaaagaaaaaaaaaaaaaaaaaa

SEQ ID NO: 3636 - DNA, 2138 bp, Rattus norvegicus
  Genbank Accession No. NM_022947
ggctagcacgggggccggcaccagcaggttttagaggcaggtgtcatgatgttgtccgcggtgttgaggagaaccgcgccagcgcctcggctcttcctagggttaatcaaatctccatctcttcaaagccggggaggtgcttacaaccgtagcgtaatcaccggagaccgcggggagccgcagcggctgagaactgccgcctgggtgcgccctggagcatcttctgtcttgttccccggacggggggcagccaccggggggcgccgtggagaacgcaccgagatcccatacctgactgccgcctcgtctggacgcggtcctagcccggaagaaacactcccaggacaagacagctggaatggggtccccaacaaggcgggattgggcatgtgggccttggccatggcgctggtggttcagtgctacaacaagaatccatctaacaaggatgcagctttgatggaagctgcccgagccaataatgtgcaggaagtcagaaggctgttatcagaaggtgcagatgtcaacgcaaggcacaaacttggctggacagcattgatggtggcagccatcagccacaatgagagtgtggtacaggttctccttgctgctggagctgacccaaaccttggggacgacttcagcagtgtctacaagactgccaatgaacagggagtccattctttggaagtcctagtcactcgagaggatgacttcaacaaccgactaaaccaccgtgcaagtttcaaaggctgcacagccctgcactatgctgtcctggccgacgactacagcatcgtcaaggaactactgggtggaggagccaacccccttcagaggaatgagatgggacacacacccctggattatgcccgggaaggggaggttatgaagcttctgaaaacttctgaaaccaagtacatggagaagcagaggaagcgtgaggcagaagaacggcgccgcttcccactggagcagcgactggagcagcacatcattggccaggagagtgccattgctaccgttggtgctgcgatccggaggaaggagaatggctggtacgatgaggagcaccctctagtcttcctcttcttgggatcatctggaatagggaaaactgagctggccaagcagacagcaaagtatatgcacaaagatgccaaaaagggcttcatccggctcgacatgtctgagttccaggagcgacatgaggtagccaagtttatcggttctccgccaggctacatcggccatgaagaaggtggccaactgaccaagaaactgaaacagtgcccaaatgcagtagttctctttgacgaggtggacaaggcccatccagatgtgctcaccatcatgctgcagctgtttgatgagggccgcctgacagatggcaaggggaagaccattgactgcaaggatgccatcttcatcatgacttccaatgtagccagtgatgagatcgcccagcatgcattgcaactgagacaggaagctttggagatgagccgaaatcgaatagctgaaaaccttggggatgtccagattagtgacaagatcaccatctcaaagaacttcaaagagaatatgatccgacccatcctgaaagctcacttccggagagacgagtttctgggaaggatcaatgagatcgtctacttcctccctttctgccactcggagctcatccagctggtcaacaaggaactgaacttctgggccaagagagccaagcagagacacaacatcacactactgtgggaccgcgaggtggcagacgtgttggttgatggctacaacgtccagtatggtgcccgctccattaagcatgaggtagagcgccgtgtggtaaaccagctggcggcagcctatgagcaggacctgctaccagggggctgcaccctgcgtatcactgtggaggactcagacaagcagctcctcaagagccctgagctgccctcgccccaggctgaaaagcgtccgcctacactgcgactggagatcattgataaggacagcaagacccacaaactggacatccaggcaccactccaccccgagaaggtgtgctacaccatctagcatccacctgcctgtgccctgaacatctaataaaggccccttgctgtggcatggcaacc

SEQ ID NO: 3637 - DNA, 2699 bp, Rattus norvegicus
  Genbank Accession No. NM_022948
tcgggtctggtctcaacagcctggtctgggggagtcactccagatgacatccactgtcccggaactctgccaagaggggggtgggtcaggcgaaccagtttagggagcccccgcccttccctgctgctcagcgtcacgcgtgacgtccgggtgatggctgggaggaaagcggagagctgtgaggaaggcgggtctgagagctgctagaggctgtaaatccccggaaagcaagatgggcgacttgcccttaaatatcaacatccaggaacctcgatgggaccaaagcacattcctaggcagagcccggcacttcttcacagttactgatccccgaaatctcctgctgtccgggaaacagttggaagcttctcggaacatcgtgcagaattacagggctggtgtggtaactcctgggctcactgaggaccagctatggagagccaaatacgtgtatgactcagcattccacccggacacaggggagaaggtggtcttgattggtcgcatgtcggcccaggtgcccatgaacatgaccattactggctgcatgctcaccttctacaggaagactccaactgtggtgttctggcagtgggtgaatcagtccttcaatgctattgtgaattactctaatcgcagtggagacgctcctatcactgtgcagcagctgggaacggcctatgtgagtgccaccactggggctgtggctactgctctgggactcaagtctctcaccaagcacctacccccactagtgggtcgattcgtaccctttgcagctgtggctgccgccaactgcatcaacatccccctgatgaggcagagggagctgcaggtgggcatcccagtgactgatgaagctggtcagagacttggccactcggtgactgctgccaaacagggcatcttccaggtggtggtatcgagaatcggcatggcgatccccgccatggccattcccccggtgatcatgaacactctggagaagaaagacttcctcaagcgccgcccctggctgggggcccccctgcaggtgggactggtaggcttctgcttggtatttgccacacctctgtgctgcgctctttttccccagagaagctctatacatgtgaccaggctggagccggagctgagagctcagatccaagcacaaaaacccagcatcgatgtggtttactacaacaaggggctttgaggggaatcggcctctgtccctgtccttacctccttaggctgcttctttggtgccacttctcaatgctaccacctgtttaatcttccgggtactgggcaggggggcttgatgtggggagcagccactgagaccagcaaccttagactgggggaggcacccctataagcctcttctctcctctctggtttcaaagagcaagtcacaaagcccatccctcctgtgtctgtgtgcgtgcgtgcagacatacctaggcagtgcatggaactgttcgttcatttgctcctgaatgctaaggcagaagtgctgttctaggatgtcctgatgtttgtcttctctctcggtctcctgcccacctcacagcaagccaggtgataggcgagaatcctttccctaagctattcctctggccaagtcatttctgatagcatcttagccttctgaccccaagataagcgccaggatcccagaacacagactgaaggacatctgcagatcttaacccttccagttttgaatagctggctctgaaagctggttcaggagctgggctggcagaggaagcagggtgggatcagggaagcagggggctcatacttgctggactccacatcctgggatggctccactcctctcttctcttcctatggaacatgaggatgtctctgtagcctgcagtgcccctaccctgcttttagagatagtcttgggcattcttggtctgttctgatgactcatgtcatgactcagaaagaaatcccacaatcccaattccttccccaattagaaagccacacaggcagagcaagcattctcttcaggaactgccaccccctgtacccacttatagggggaccggtgtgggaacggtgcttaaacacaggcctcaagcgtacaatatcaagacaggtaattctgtgtttcattgactcctcttagacacacccacctcagctccttcctttccatctaccccgtctctgaaagaacccagggcttcacaatgctaggcaagtgctctaccactgagctacatccccagtgccccctcttccttccttcctgtctctttctttcttttttgtttttgtttttcaaatatggtttctctatgtagccctggctgtcctggaactcagagatctgattgcctaagacagtgagttctgggattaaaggcatataccaccattgccagcagcccttcttgttcctaagacatggatggccctgtgctccctctgcccttcaaaaagaggagggacccaggccttcatagctggaccaaatggaagatgggtttaggaatggcatgagtggtaatgactccagtgtgtagaattatatctgcactctaaatccatgacctctagctaaaaggcgaatggggtccccagtgatatccacggagaccactttcactcaccccctcctccagtgacaacaggtgtcatgtcatggtgtcaataaactgcagtcctgtctaaaaaaaaaaaaaaaaaaa

SEQ ID NO: 3638 - DNA, 715 bp, Rattus norvegicus
  Genbank Accession No. NM_022949
tctcgctgagcccgccaacatggtgttcaggcgtttcgtggaggttggccgagtggcctacatctcctttgggccccatgctggaaagctggtcgcaatcgtagatgttattgatcaaaacagggctttagtggatggaccctgcacccgggtgaggagacaggccatgcctttcaaatgcatgcagctcactgacttcatcctcaagttcccacacagtgcgcgccagaagtatgtacggaaagcttgggagaaggcagacatcaatacaaagtgggccgccacacgatgggccaagaaaattgatgccagagaaaggaaagccaagatgacagattttgatcggttcaaagtcatgaaggcaaagaaaatgaggaacagaataatcaagactgaagtgaagaaactccagagagctgctctcctgaaagcttctcctaaaaaagctgctgttgctaaggctgccattgcggccgctgcagcagctaaagccaaggtcccagccaagaaggcaacaggaccaggccagaaggccgcagcgcagaaggcctctgcacagaaggctgcaggccagaaggcagcgccccctgctaaaggtcagaagggtcagaagaccccggcccagaaggcacctgctccaaaggcagctggcaagaaagcatgaggaggctacacaaagaataaaggttctttttgactgaaaaaaaaaaaaaaa

SEQ ID NO: 3639 - DNA, 4131 bp, Rattus norvegicus
  Genbank Accession No. NM_022951
ctcggagaaagacaggccggccatcaggaaaacaaacaagcctcagcaacatctaaacccttgaaaggatcctgagagaggggggaaagggaaaacagcagccaccagcccaaccacttgtgtcttctgcccctccccacctatcttgcccaccccaccagcccacgctgcttgggacttgaaatctgtggccgaaggaccgtcaccacataacttcaaaaataatcaaccaccctccctacccaaacccacccaatctcactcatccagcatttcctttttggagtccactcagaatttttttcaacgaccccctctccctaatggagttgggtggggggaaaatgaaaactgagttggtctttacttttttaagagactttttgatccaatgaggccccacaagtaactgagtttgggtcctggttggttgttttattttttttcctccaaaattttacccctcccccctgagcccgaggtgctgacgtcgcaaaaaaattggataaagccaccatcatgggttcaggacccatagaccccaaagaacttctcaagggcctagatagcttccttactcgggatggagaagtgaagagtgtggatggaattgccaagatcttcagtctaatgaaggaggcacgaaagatggtgagtcgatgcacgtacttgaatattatcctgcagacccgggcgccggaggtgctagtcaagtttattgacgtcggcggctacaagcttctgaacagttggttaacgtattcaaagacgaccaacaacattcctctcctacagcagattctgctgactctgcagcacctcccactgactgtggaccacctcaagcagaacaacacagcgaagctagtgaagcagctcagcaagtcaagcgaggacgaagagctccggaaattggcatcagtccttgtcagtgactggatggctgtcatccgctcccagagtagcacccagcctgcagagaaagataagaagaaaaggaaggaagaggggaaaagtcgaaccacgcttcctgagcggcctttgactgaagtgaaggctgaaacccgggctgaggaagccccagagaagaagaaggagaagcccaagtcacttagaactacggcacccagtcatgccaagttccgttctactggactggagctggacaccccatctttggtgcctgtgaagaagaactccagcactgtggttgtgtcagacaagtacaacctgaagcccatccccctcaagcggcagagtgccacagctgctccaggcgatgctgccccgcctgcagagaagaagtacaagcccctcaacacaacccccaataccaccaaagaaattaaagtgaagatcatccccccacagcccatggagggcctcggttttctggatgctctcaattccgcccctgtcccaggcatcaaaattaagaagaagaagaaggttctatcacctactgctgccaagcccagcccttttgaagggaaaacaagcactgagccaagcacagccaaaccttcctccccagagcctgcagcccccgctgagcccatggacacagaccgtcctggcacccctgtccccgctgtggaagtcccggagctcatggatgcagcctcttcggagccaggagctctggatgcaaagcctgtggaaagccctggagatcccaaccagctgactcgaaagggcagaaagagaaaaactgtgacgtggcctgaggagggcaagctgagggagtatttctacttcgaactggatgaaactgagcgagtgaatgtgaacaagatcaaggactttggggaggctgctaagcgtgagatactgtcggaccgacatgcttttgagacagcccggcgactaagccatgacaatatggaggagaaagtgccctgggtatgtcccaggcctctggttctgccctcacctcttgtcatccctggaagcaacagccaggagcgatacatccaggctgagcgggagaagggcatccttcaggagctcttcctgaacaaggagagtcctcacgagcctgatcctgagccgtatgaacccattcctcccaaactcatccccttggatgaggagtgcgccatggatgagactccgtatgttgagaccctggagcctggagggtctggtggctcacctgatggagcaggaggctccaagctgcctccagttctggccaatcttatggggagcatgggagcagggaagagcccccagggccctggaggcggtggcatcaatgttcaggagatcctcacttccataatgggcagtccaaacaaccacccttcagaggagctgctgaaacagccagactactcagacaagctgaagcagatgctggtgccacatgggctcctaggtcctggtcctgtagccaatggcttcccaccaggaggccctgggggccccaagggtatgcagcatttcccccctggtcctggagggcccatgccaggtccccatggaggccctggtggaccagtgggtccacgtctcctgggtcccccaccaccttctcggggaggtgatccattctgggatggcccaggtgaccccatgcgaggtggcccaatgcgtgggggtccaggacctggtcctggaccataccacagaggccgagggggtcgtggaggaaatgaaccgccaccaccccctccattccgaggagccagaggaggtcgttctggaggaggccccccaaatggccgagggggtcctggtggaggtggcatggttggaggtggtgggcaccgcccccatgaaggccctggagggagcatgggcagtggacatcggtctcatgagggccctggagggagcatgggcagtggacatcggtctcatgaaggccctggacacgggggaccccatggccaccggccacatgacgtccctagccatcgaggccacgaccatcgagggccaccacctcatgaacaccgcggtcatgatggccatgggggaggcggccaccgagggcatgatggaggccacagtcacggaggagacatgtcaaaccgccctgtctgccgacacttcatgatgaagggcaactgccgctatgagaacaactgtgccttctaccacccaggggtcaacgggcccccactgccctaggcctgcctgccctacccgcacccctgtggactgcagctttgctccttccacttggttatggcttctgtgaggcccactttccttttccccagctgatgaggagccggccccctcagttcccacctggttgggtttctgggggtttctgattcctggtgtgcattgatgtacatattccctccagtctggagcggagaggagagagactggactgctgagacggctggcttcactttgtgaggagatttgccctgtgccccaaaccccttccagtattagccccgatgcctgagaacctgaagccggccaccctggagacctctgctctccacatgcacacggaactgagttggtcagctgcacttaggaaaccgtccaagctaagctcattatcttcacagggtgagggggtggtgaggggtaccatatatcccactgcactgagggctcaagctggctgaagctgagttctggaactaccccccacttgtgccccacatgggccagtcactgttgagtcctttctcaagaaggactgcaactgttacttcccaggtcatcgtgggtctgctaggttcagtgatggcacattcatatctgtgtccagtggaagttgtatctggcagaggggtggcctgtagtgttgggccactcttgcctacagccattttcgagactccgtgaggccagctttcattaactttagccgggtataccgggcctgacgcactacatgcactgcctttgggagtgggctggctccttaccccgtaaggagccctgtcagtgaggcttcctgggtagactcagcaggaggggcccttcccagtcctctcctccccctgtcttggcatcagttgttttctatgaaaacagtgggttggttttgtgcagggtcttgggttagaaccaatggatttgaggagttttttcttttggttttgtatattttgtacattaataataaacagtggaaagagaagcagctcattt

SEQ ID NO: 3640 - DNA, 797 bp, Rattus norvegicus
  Genbank Accession No. NM_022952
  misc_feature (1)..(797): n = a or c or g or t
agccctgggccccacaactgcaagcagagccggagccgcccagttacagcgggacccgggcctctggggtccanacaggggtcgccatgatccgattcattctcatccagaaccgggcaggcaagacacgcctggccaagtggtatatgcagttcgatgatgacgagaagcagaagttgatcgaggaagtgcacgccgtggtcaccgtcagggatgccaagcacaccaactttgtggagttccggaacttcaagatcatctaccggcgctacgctggcctctacttctgcatctgcgttgacgtcaacgacaacaatctggcctatcttgaaggcatccacaacttcgtagaagtgttaaatgaatacttccacaatgtctgtgaactggacctggtgttcaacttctacaggttttacacggtggtagatgagattttcttggcaggagagatccgagagaggagccagacgaaggtgctgaagcagctgctgatgctgcagtcgctggagtgagggggggcttccgccccagcccggcntgntgggccaacatgcntgtttgtcccctgccaggtttgaggcccaccccagcagccccttccnttctttagntggcccagaggagtgacccagcagggtttaggccacaggggaggaggccagaacccactgcctttgggccctaagtggatggcagaggccaccgtgatgtcccgagtaactgtgccattattgtgtgatgctgtgagtgtgcgtgtgtgcagcccccaataaacctgtggtcctgcctgnaaa

SEQ ID NO: 3641 - DNA, 4950 bp, Rattus norvegicus
  Genbank Accession No. NM_022953
ctgggagcatctaggtgctactcgagccgcaagggcgcatcgtacgatccccccggctcttcggtccctcggtggggatagcacctggagatagccccggacggggatggtcagcggctgcggccgtctgacacacgagcgggacacggcgagggcaccatggcgctaacgccccagcgcgggtcctcttcggggttgagccgaccagagctgtggctgctgctatgggcagccgcgtggcgcctgggggccacggcgtgccccgccctctgcacctgcaccggcactacagtggactgccacggcacgggtttgcaggccatccccaagaacatcccacggaacaccgagcgcctggaactcaatggtaacaatatcactcggatccataagaatgactttgctgggctcaagcagcttcgagtgttgcagctgatggagaaccagattggagctgtggaacggggagcttttgatgacatgaaggagttggagcggctacgactgaaccgcaaccagctgcaagtgttgcctgaactactgttccagaacaaccaggctctgtccagactggacctgagtgagaattctctccaggctgtgcccagaaaggctttccgaggagccacagacctcaaaaatctacagctggacaagaaccagatcagctgcatcgaggaaggggccttccgtgccctacggggactggaggttctgaccctgaacaacaacaacatcaccaccatccctgtgtccagtttcaaccatatgcccaagcttcggaccttccggctgcactccaaccacctgttctgtgactgtcacctggcctggctctcgcagtggctgagacagaggcccaccatcgggctcttcacccagtgctctgggcccgccagccttcggggcctcaatgtggcagaggtgcaaaagagtgagttcagctgctcaggccagggggaggctgcacaagtacctgcctgcaccctctcatccggttcctgcccagccatgtgcagctgtagcaatggcatcgtggactgccgtggcaaaggcctcactgccatccctgctaaccttccggagacgatgaccgagatccgcctggagctgaacggtatcaaatccatcccaccaggagccttctctccctacagaaagctgcgcaggatagacctgagtaacaaccagattgctgagattgcacccgatgccttccaaggcctccgctccttgaattccctggtcctctatggcaacaagatcacagacttgccccgaggtgtatttggaggcctgtacaccctccagctgctgcttctgaatgccaacaagatcaactgcatccggcctgatgccttccaggacctgcagaacctctctctgctctccctatatgacaacaagatccagagtctcgccaagggcaccttcacctccctgcgggccatccagacactgcatctggcccagaaccctttcatctgtgactgtaacctcaagtggctggcagacttcttacgtaccaaccccattgagacaactggggcccgctgtgccagcccccggcgccttgccaacaagcgtatcgggcagatcaaaagcaagaagttccggtgctcagccaaagagcagtacttcattccagggacggaggattaccacctgaacagcgagtgtacgagtgacgtggcctgtccccacaagtgccgctgtgaggccagtgtggtggagtgctctggcctgaagctctctaagatccctgagcgaatcccccagtccacgactgagctacgactgaacaacaatgagatttcaatcctagaggccactgggttgtttaagaagctctcacatctgaagaaaataaacctgagcaacaacaaggtgtcagagattgaagacgggacgtttgaaggcgccacctccgtcagcgagctgcacctgaccgccaaccagctggagtctgtcagaagcggcatgttccggggtctagatggcttgcggaccctgatgctgaggaacaaccgtatcagctgcatccacaatgacagcttcactgggctgcgtaacgtgcggctcctgtctctttacgacaaccacatcaccaccatctcccctggagccttcgacaccctccaggccctgtccacactaaacctcctggccaacccattcaactgcaactgccagttggcctggctgggggactggcttcggaagaggaaaattgtgacagggaaccctcgctgtcagaacccagacttcctgcggcagattcctctgcaagatgtggccttccctgacttcaggtgtgaggaaggccaggaggaggtgggctgcctgccccgcccacagtgcccccaagagtgcgcctgcctggacaccgtggtccggtgtagcaacaagcacctccaggctctgcccaagggcatccccaagaatgtcacagaactctacttggatgggaaccagttcacactggttccgggacagctgtctaccttcaagtatctgcagcttgtcgacctgagcaacaacaagatcagctccttaagcaactcttccttcaccaacatgagtcagctgaccacactgatcctcagctacaacgccctccagtgcatcccccctctggccttccaaggacttcgttcactgcgcttgctgtctttgcatggcaatgatgtctccaccctccaagagggaatctttgcagacgtgacgtctctgtctcacctggccattggtgccaaccccctgtactgcgactgccacctccgatggctctccagctgggtgaagactggctacaaggaacctggcattgcccgctgtgctggacccccagagatggagggcaaactgttgctcaccacacctgccaagaagtttgaatgccaaggtccccccagcctggcggttcaggccaagtgtgatccctgcttgtccagcccatgccagaatcagggcacttgtcacaatgaccctcttgaggtatacaggtgtacctgccccagtggctacaagggccgaaactgtgaggtgtctctggacagctgttccagcaacccatgtggaaatgggggaacctgccatgcccaggagggcgaggatgctggcttcacgtgctcctgtccttccggctttgaagggctgacgtgtggaatgaacacagatgattgtgtgaagcacgactgtgtcaatgggggtgtctgtgtggatggcatagggaattacacatgtcagtgccccctgcagtacacaggaagggcctgtgaacagctagtggacttctgctctccggatctgaacccatgtcagcatgaggcccaatgtgttggcaccccagaggggcccaggtgtgagtgtgtgccaggctacacgggtgacaattgcagcaaaaaccaggacgactgcaaggaccaccagtgtcagaacggggctcagtgtgtggatgagatcaacagctacgcctgtctctgtgctgagggctacagcggacagctctgtgagatcccacctgcccccaggaactcctgtgaagggactgagtgccagaatggagccaactgtgtagaccagggcagccggcccgtatgccagtgcctaccaggctttggaggtcccgaatgtgagaagttgctcagtgtcaactttgtggaccgggacacttacctgcagttcactgacctgcagaactggcctcgggccaacatcactcttcaggtctccacagcagaggacaatgggatcctcctctacaatggggataatgaccacattgcagttgagctgtaccagggccatgtccgtgttagctacgacccaggcagctaccccagctctgctatctacagtgctgaaacaatcaacgatgggcagttccacacagttgagctggtgacctttgaccagatggtgaacctctccatcgatggtggcagccccatgaccatggacaactttggaaagcactacacactcaacagtgaggcccccctctatgtgggagggatgcccgtggatgtgaactcagctgccttccgcctgtggcagatcctcaatggcaccagcttccacggttgcatccggaatctatacatcaacaacgaactgcaggacttcaccaagacacagatgaagccgggcgtggtgcccggctgcgagccctgccgaaaactctactgtctacatggcatttgccagcccaacgccaccccagggcccgtgtgccactgcgaggctggctgggggggcctgcactgtgaccagccagtggacggcccctgccatggccacaagtgtgtccatgggaaatgcgtgcccctcgatgcacttgcctacagctgccaatgccaggatggatactcgggggctctgtgcaaccaggtcggggctgtggcagagccctgtgggggcttacagtgcctgcatggtcactgccaggcctcggccaccagaggggcacactgtgtgtgcagcccaggtttttcaggcgagctgtgtgagcaagagtccgagtgccggggggaccctgtccgggactttcaccgggtccagaggggctatgccatctgccagaccacgcgcccactgtcatgggtggaatgccggggcgcgtgcccgggccagggctgctgccagggcctgcggctgaagcggaggaagctcaccttcgagtgcagcgatgggacctcgtttgctgaggaggtggagaagcccaccaagtgcggctgtgccccgtgtgcgtaacgtgcgggtggcacactagcagctgggctggggcgggcatcaccaggatagcgcttgggtcctggtgggcgcggggacactgagctgcctttccagcggactgcactgccagggcagaggagcaaggcccgggttgccaagccctctcccaaagtgccttgcacagataggcgcttaataaatatttgttgaatg

SEQ ID NO: 3642 - DNA, 1495 bp, Rattus norvegicus
  Genbank Accession No. NM_022960
gtgagcagggagggaggggccgacagcagaggcagacaaagattaagtcacagctccaattgggacaggccctcacacagtcaagtatctctctagtcacctccagagatccgtgtggggctaatcaggtttttgtttgtttgtttgtttttggtttggttttggttttaatgtggtagtgaaagcagggaaccgagcaagcagaccttggtggaaagtgtacctctggcagaaaccccaagatgccttctgagaaggacggtgccaagaagagcctcatgcagaggctggccctgaagagccggatagcgaaggagacactctccgagttcctgggcacctttataatgattgtccttggatgtagctctattgcccaagcggtcctcagtcgagaacgttttggcgggatcatcactatcaatattggatttgcatcggcagtcgtgatggctctctatgtgacatttggtatctctgggggccacatcaacccagctgtgtcttttgcaatgtgcgcctttggaaggatggagtggttcaagttcccattttatgtgggagcccagtttttgggagcctttgttggggctgcaacggtctttggcatttattatgatggactcatggcctttgctggcggaaaactgctcgtcgtaggagaaaatgcaacagcattcatttttgcaacatatccagctccattcatatccacgccaggtgcctttgtagaccaagtggtgtctaccatgttcctccttctgatcgtctttgccatgtttgactccagaaacctgggtgtccccagaggcctggagcctgttgtcattggcctcctgatcattgtcctttcctgttctctcggactcaactctggctgtgccatgaacccagctcgagacctcagtcccaggctcttcactgcactggcaggatgggggtttgaggtcttcacagttggaaataacttctggtggatacctgtcgtgggtcctatgattggtgctttcctgggaggtcttatctacattctttttatccaaatgcatcactcgaagctcgacccagacatgaaggcagagccatctgagaacaacctagagaaacacgagctcagtgtcatcatgtagtgggatggccagatctgcagttaccgttcatccagttctttcttcagagaagatgtcacctgtgtgcctatgcagacttggggcgggggaatctacctgtctgctagttttctctagccaactgggacaaaaaaattacaaaggcatccgtggaaaactccaccagtcacccctccccagaatagcactgactgtttatgatgggtatttgatggaagtccttactcctaggtgattgctaagaattttgaaacttgaccatgtgcttggctggatagcctcagagacctttttttaccctgtatgaaattgtgtcatcaaaggctctgttttcacaatctataaatacaacattctaaaactgg

SEQ ID NO: 3643 - DNA, 5579 bp, Rattus norvegicus
  Genbank Accession No. NM_022962
ttttaaattttggttggtggcggcagtgctgggccggaggaaagaagggacacggagtcctccctcgctcagccaccccctccccgcttccccctgggccgggctccgggagatgtgccgggcggggggcccggcttcgcggagccgcgggaggagcgcgcacggccgaccccgaagcgccgctggacaggctggtgggccaggccttggtaccctggtgatgcggggcaaggccccccccacagtccgctgagatcaccgtgcccgcccctggccttcgccatggcccgcttggctgcagcactctggagtctctgtgtgacgactgtcctcgtcacctctgctacccaaggcctgagccgggctggactcccatttggattgatgcgccgggagctagcatgcgaaggctaccccattgagctgcggtgcccgggcagtgacgtcatcatggtggagaatgcaaactatgggcgcacagatgacaagatctgcgatgccgacccttttcagatggagaacgtgcagtgctacctgcctgacgccttcaaaatcatgtcacagagatgtaataaccgaacccagtgtgtggtggtggccggctctgacgcctttcctgacccctgtcctggaacctacaagtacctggaggtgcagtacgactgtgtcccttacaaagtggagcagaaagtcttcgtgtgcccagggacactgcagaaggtgctggagcccacctccacacatgaatcggagcaccagtctggcgcatggtgcaaggacccactgcaggcaggtgaccgtatctacgttatgccctggatcccctaccgcacggacacactgaccgagtatgcttcctgggaggactatgtggctgcacgccacaccaccacgtacagactgcccaaccgtgtagatggcactggctttgtggtatatgatggtgccgtcttctataacaaggaacgtactcgcaacattgtcaaatatgacctgcggacccgcatcaagagcggagaaacagtcataaacacagccaactaccacgacacctcaccttatcgctggggaggcaaaaccgacattgacctggcagtggatgagaacgggctgtgggtcatctatgccaccgaggggaacaacgggcgtctggtggtgagccagctcaacccctacacactgcgtttcgagggcacctgggaaacaggctatgacaagcgctcagcctccaatgccttcatggtgtgtggtgtcctctatgtgctgcgctctgtttatgtggatgacgacagtgaggcagcaggcaaccgcgtggactatgcctttaacaccaatgcaaaccgagaggagcccgtcagtctcgccttccccaacccctaccagtttgtatcttctgttgactacaatccccgggacaaccagctgtatgtgtggaacaactatttcgtggtgcgctacagcctggagtttggacccccagatcccagtgctggcccagccacttccccacctctcagtaccaccaccacagctcggcctacgcccctcaccagcacagcctcacctgcagccaccactccactccgccgggcgcccctcaccacgcacccagtaggtgccatcaaccagctgggacctgacctgcctccagccacagccccagcacccagtacccggcggcctccagcccccaatctgcatgtgtcccctgagctcttctgtgaaccccgagaggtccggcgggtccagtggccagctacccagcagggtatgctggtagagagaccttgccccaagggaactcgaggaattgcctcgttccagtgcctcccagctctggggctctggaatcctcggggccctgacctcagcaactgcacttccccctgggtcaaccaagtcgcccagaagatcaagagtggagagaatgcagccaacattgctagtgagctggcccgccacacgcggggctccatctatgctggggacgtgtcctcatcggtgaagctgatggagcaactgctagatatcctggatgcccagctccaggccctacggcccattgaacgagagtcagctggcaagaactacaataagatgcacaagcgagagagaacctgcaaggactatatcaaggctgtggtggagacagtggacaacctgcttcggccagaggcacttgagtcatggaaagacatgaatgccaccgaacaggtccatacggccaccatgctcctagatgtcttagaggagggtgccttcctgctggccgacaatgtcagagaacctgctcgcttcttggctgccaagcagaatgtggtcctggaggtcactgtcctgagcacagagggtcaagtgcaggagttggtgttcccccaggagtatgccagtgagagctccattcagctgtccgccaacaccatcaagcagaacagccgcaatggtgtggtgaaggttgtcttcattctctacaacaacctgggcctcttcttgtccacggagaatgccacagtgaagctggcaggtgaggcagggaccggtggccctggaggtgcctccctggtggttaactcacaggtcatcgcagcatccatcaataaggagtccagccgtgtcttcctcatggaccctgtcatctttactgtggcccacttggaggccaagaaccacttcaatgcaaactgctccttctggaactactcagagcgctccatgctgggctactggtcaacccagggctgccgactggtggagtccaataagacccataccacatgtgcctgcagccacctcaccaacttcgcagtgctcatggctcaccgagagatctaccaaggccgtattaatgagctgttgctgtcagtcatcacctgggttggcattgtcatctccctggtctgtctggctatctgcatctccaccttctgcttcctgcggggcctgcagaccgaccgcaacaccatccacaagaacctgtgcatcaacctcttccttgcagagctgctcttcctggttggaatagacaaaactcagtatgaggtcgcctgccctatctttgcgggcctgctgcactacttcttcctggccgccttctcctggctgtgcctagagggcgtgcacctctacctcctgctggtcgaggtgttcgagagcgaatattcacgcaccaagtactattacctgggcggctactgcttcccagccctggtggtaggcatcgcagccgccattgactaccgaagctacggcactgagaaggcctgctggctgagggtggataactatttcatctggagcttcattgggcccgtctcctttgttattgtggtgaacctggtgttcctcatggtgaccctgcacaagatgatccgaagctcatccgtgctcaagcctgactccagccgccttgacaacatcaagtcctgggcgctgggtgccattgcactgctcttcctgctgggcctcacctgggctttcggcctcctcttcatcaacaaggagtcagtagtaatggcttacctcttcacaaccttcaacgccttccagggggtcttcatctttgtctttcactgcgccttacagaaaaaggtgcacaaggagtacagcaagtgcctgcgtcactcctactgctgcattcgctccccacctgggggggctcacggctcccttaagacctcagccatgcgaagtaacacccgctactacacagggacccagagccgaatccggaggatgtggaatgacaccgtgaggaagcagacagagtcgtcctttatggcaggggacatcaacagcacccccaccctgaaccgaggtaccatggggaaccacctactgaccaaccctgtgctacagccccgtgggggcactagcccatacaatacactcattgcagagtctgtgggcttcaatccctcctcgcccccagtcttcaactccccaggaagctacagggaacctaagcaccccttgggcggccgggaagcctgtggcatggacacactgccccttaatggcaacttcaacaacagctactccttgcgaagtggtgatttccctccgggggatgggggtcctgagccaccccgaggccgaaacctagcggatgctgcggcctttgagaagatgatcatctcagagctggtgcacaacaaccttcggggggccagtgggggcgccaaaggtcctccaccagagcctcctgtgccacccgtgccaggagtcagtgaggacgaggctggtgggcctgggggtgctgaccgggctgagattgaacttctctacaaggccctggaggagccactgctgctgccccgggcccagtcggtgctgtaccagagtgatctggatgagtcggagagctgtacggcagaggatggggccaccagccggcccctctcctcccctcccggccgggactccctctatgccagcggggccaacctgcgggactcgccctcctacccggacagcagccccgaagggcctaatgaggccctgccccctcccccacctgctccccctgggcccccagaaatctactacacctctcgcccgccggccctggtggctcggaatcccctacagggctactaccaggtgcggcggcccagccatgagggctacctggcagcccccagccttgaggggccagggcccgatggggatgggcaaatgcagttggtcactagtctctgaggggcctcatggaccagaggcctggccagggagggaatccaggaggggctctggtgggagcagagactgatggaggcagtggctggtgggccactctctccaggtgcccctctgcctgtgggccccacagtccccttggggactatgacctgggccccaggtgccagggttagtagacagggtttccaccagccacaagccccagcctctttaggggagtgcattgaggagaagcccccagggccctaggagtgagggagaagctggtaggtgtgaccaacgtccaaagctccctccctttggagggagaaagcaagggataaggcttccctaggtgtacaggggtggccacttttgaggtggccgaagccttgcaggatacaccctatctgctgctcactcttcttcgtccaccagaaaggagcagtgggacagatggacagggtccttccatgctacagttccttgcttcttggagactgggccttacatcctgagagagcccaggcccaggggatggatggggttgtgagggctggtggttaatggtggaactttctctgaagctcctttctcccttgctattggtccctatctcccgagcaagcctaccctaaacccccagagtgcacccaatgaccccctcccttggggtgactcctgatgaagcacaactccccgcagggccccaacccactgcagtggccatatttgggcagttcccagtcctgtgggctgggctatctggggagcagatgtggggtctggggctccctgaggagtgggtcctgggtttggatctttccctagggggtcctcttacccttctcttcctcccctattgctgtaaatatttcaacaaaatggaaaaaaaaaaaaaa

SEQ ID NO: 3644 - DNA, 3810 bp, Rattus norvegicus
  Genbank Accession No. NM_023092
gatagactcgagcggaatcgacgccggaggtcccaaggcccactcccacccagcctggccaggccggctacagtgggatccaggggtcgagactccgatccccctaagccaaagggcctgcaaggggcagtgcgggggggggggctagcccctccctcggtgaccgtgcgccggagcactgattaacgcgggcacggagcagggcaccaggtcgcaggatgcgctaccgggcgtcggccctgggcagtgacggggtacgagtgaccatggagagcgccttgactgcccgagaccgggtgggggtgcaagactttgttctgctggagaacttcaccagtgaggctgccttcattgagaacctccggcgtcgattccgggagaacctcatttatacctacattggccctgtcctggtctctgtcaacccctaccgggacctacagatctacacacggcaacatatggaacgctaccgtggcgtcagtttctatgaagtgccgcctcatctgtttgcagtggctgacactgtataccgggcgcttcgtactgagcgtcgggaccaagcagtgatgatttctggagagagtggggcagggaagacagaggccaccaagagattgctccagttctatgcagagacctgcccagcccctgaaaggggtggcgcagtgcgagaccgcctgttgcagagcaaccctgtgctggaggcctttgggaatgccaagactctccgcaacgacaactccagccgctttgggaagtacatggatgtgcagtttgacttcaagggtgcccctgtgggaggccacattctcagttacctcctggagaagtctcgagtggtacaccagaatcacggagaacggaacttccacgtcttttaccagctcctggaggggggggaggaggaggctcttcgtcgtctgggcttggaacggaacccccagagctacttgtacctggtgaagggccagtgtgccaaggtctcctccatcaatgacaagagtgactggaaggttgtgaggaaggcgctgtcagtcattgacttcactgaggatgaagtggaggacttgctaagcatcgtggccagcgtcctacatctgggcaatatccactttgctgctgatgaggacagcaatgcccaggttactactgagaaccagctcaaatatctgaccaggctccttggtgtggaaggcacaacactgagggaagccctgacccacaggaagatcatcgccaagggggaagagctcctgagcccactgaaccttgaacaggctgcatatgcaagggatgctcttgccaaggctgtgtacagccgcactttcacctggttggtcagaaagatcaataggtctctggcctctaaggacgctgagagccccagctggcgaagcaccacagttcttgggctcctggacatttatggcttcgaagtgtttcagcataacagcttcgagcagttctgcatcaactattgcaatgagaagctgcagcagctcttcattgagctgactctcaagtccgagcaggaggaatacgaggcagagggcatcgcgtgggaacctgtccaatacttcaacaacaagatcatctgtgacctggtggaggagaaattcaagggcatcatctccatcttggatgaagagtgcctgcgtcctggggaggccacagacctgaccttcctggagaagctggaggacacaatcaagcaccaccctcacttcctgacgcacaagcttgctgaccagaagaccaggaaatccctcgaccgaggggagttccgccttcttcattatgcgggagaggtgacctacagcgtgactgggtttctggataaaaacaatgacctcctcttccggaacctgaaggagaccatgtgcagctccacgaaccccatcatggcccagtgctttgacaagagtgagctcagtgacaagaagcggccagagacggtggccacccagttcaagatgagcctcttgcagctagtggagatcctgaggtctaaggaacctgcttatatccggtgcatcaagccaaatgacgccaaacagccgggtcgctttgatgaggtgctcatccgacaccaagtgaagtacctgggacttatggagaatctgcgtgtgcgcagagctggctttgcctaccgtcgaaaatatgaggctttcctgcagaggtacaagtcactgtgcccagagacatggcccgtgtggacaggacggccccaggatggggtggctgtgttggtcagacaccttggctataagccagaagagtacaaaatgggcaggactaagatcttcatccgattccccaagaccttgtttgccacagaggactccctggaagtccgacggcagagtctagccaccaagatccaggcggcgtggaggggctttcattggcggcagaaatttctccgggtgaagcgatcagccatctgtatccagtcctggtggcgcggtacactgggccggaggaaggcagccaaaaggaagtgggcagcccagactatccgtagactcatccgtggcttcattttgcgtcatgcaccccggtgccctgagaatgccttcttcctggaccacgtgcgcacgtcatttttgcttaacctgaggcgacaactaccccggaatgttctggacacctcctggcccacacccccacctgccctgagagaggcctcggagctgctccgggagctatgcatgaagaacatggtgtggaaatactgccggagtatcagccctgagtggaagcagcagctgcagcaaaaggcggtggctagtgaaattttcaagggcaagaaggacaattacccccagagtgtccccagacttttcatcagcacacggcttggcacagaggagatcagccccagagtgcttcaggccttgggctctgaacccatccagtatgcagtgcctgtggtaaaatacgaccgtaagggctacaagcctcgttcccggcagctgctgctcacacccagtgctgtggtcatcgtggaggatgccaaagtcaagcagagaattgattatgccaacctaactggaatctccgtcagtagcctgagtgatagcctgtttgtgcttcacgtgcagcgtgaagacagcaagcagaagggagatgtggtactgcagagcgatcatgtgatcgagacactaaccaagacggccctcagtgctgaccgtgtgaataatatcaacatcaaccagggcagcatcacgtttgcagggggtccaggcagggatggcatcatcgacttcacatctggctcagagcttctcatcaccaaggctaagaatggccacctggctgtggtggccccacggctgaattctcggtgatgaaggtgccggtggacccctcctgactcctgatgctttgcttagtcccctcctcccctcccagttaccaaagactcaagcttccagacagggatccagggacaccctcaaagcccacctgcagactcctgccccctgctcatcctctcttgaggtgatcaggaaccagggagcttccccaggagtgggccaggccgggccaagcaatagaaaagcagaggtctgagcaggccaggccagccctctgctgatgccaaatatctaagagaagggaattttaactgaggttttctctgagactttttgatgctttataggaaactatttttttaaaaaagtcattttcctatcctaaacacactggatgtgttttccctgactcaaacaggacaaggaatgtagctgaaagactgactgggctggctgaggccccccctctctgccaagcctctcctca

SEQ ID NO: 3645 - DNA, 4620 bp, Rattus norvegicus
  Genbank Accession No. NM_023103
taagctctgtcctcctgtcctcctgtcatcctgtcctcctgtccttccatcatgaagaagaatagagaggctcagctgtgccttttttcagctcttcttgccttcctgccctttgcttccttgctcaatggaaactcgaagtatatggtgctggtcccttcccagctctacaccgagacccctgagaaaatctgcctgcatctataccatctgaatgagacagtgactgtgacagcttccttgatatctcaaaggggaacgagaaaactgttcgatgagcttgtggttgacaaggacttgttccactgtctttccttcactatccctagattgccctcttctgaagaggaggagtcactcgacatcaacattgaaggggcaaagcataaattcagcgaaaggcgtgtggtgcttgtgaagaacaaagaaagtgttgtctttgtccagactgataagcccgtgtacaagccaggacagtcagttaaatttcgggttgtctctatggataaaaatctacaccccctgaatgagttgtttcctctggcttacattgaggatccgaaaatgaaccgaattatgcagtggcaggacattaagacagagaatgggcttaagcaattgtccttcagcctgtcagcagagcccattcagggcccctacaagatagtgattctcaaacagtcaggagtgaaggaagagcattccttcaccgtcatggaattcgtgcttcccagatttggtgtcgatgtgaaggtcccaaacgccatctctgtgtacgatgaaataatcaatgtgactgcctgtgcgatatatacctatgggaagcctgttccaggacatgtaaagataagtctttgccatggaaatccttcctttagctctgagacaaagtctgcatgcaaagaagaggactccgagctagacaacaacggctgcagcacacaagaagtgaacatcactgagttccaattaaaggaaaattacctcaaaatgcaccaggctttccatgtgaatgcaactgttacagaagaagggacagggtcagagttcagtggatctggaagaattgaagtcgaaagaaccagaaacaaattcctatttctgaaagcagactcacacttcagacacgggatcccattctttgtgaaaatccgcctagtggatatcaagggagatcctatcccaaatgagcaggtcttcatcaaagcacaagaagctggctacaccaatgctactaccactgatcagcatggcttggcaaagttctccatagataccagcagcatctcaggctattccctcaatatcaaagtctaccacaaggaggaaagttcatgtatccattcctcttgcacagcagaaagacacgcagaggaacatcatacggcctatgctgtttactccctcagcaagagctacatctaccttgacacagaagctggcgtcttgccctgcaaccagatccacacagttcaggcgcattttattctgaaggggcaggtcttgggagtgctgccacagattgttttccactacctggtcatggcccagggcagcatcctccagactggaaaccacactcatcaagtggagccaggagtatctcaagtacaaggcaacttcgccttggagatccctgtggagttcagcatggttcccgtggctaaaatgctcatctacaccatcttgcctgatggagaagtgattgcagattctgtaacgtttcaagttgaaaaatgtcttcgcaacaaagtgcacctgagcttcagcccatcccaaagtcttccagcctcacaaacccatatgcgggttacagcttctcctcagtccctctgtggcctgagagctgtggaccaaagcgtgctgctgctgaagcctgaggctgagctctccccttccttgatatatgatctaccaggtatgcaagacagcaacttcattccaagttcttatcatccatttgaagacgaatatgattgtttgatgtaccaaccaagagacactgaagagctcacatactcagtaccatatggacgagagaaggatgtctacagatatgtgagggacatgggtttaacagcattcaccaacttgaagatcaaacatcctacatattgttatgaaatgaacatggttgtactatcagcacctgctgtggaatctgaactttcaccaagagggggagagtttgaaatgatgcccttgggagtaaataaaagtccactacctaaagagccaccacgtaaagatccaccacctaaagatccagttattgagaccattaggaattattttcctgaaacctggatctgggatttagtcacagtaaactcctcaggagtgactgaagtggaaatgacagtccctgacaccatcactgagtggaaggctggagccctctgcctgtctaatgacactggtcttggcctctcttctgtggcaactctccaagccttccagcccttctttgtggagctcacaatgccctactctgtgatccgtggagaagccttcatgctcaaggccacagtgatgaactacctccctacaagcttgccgatggctgtgcagctggaagcttctcctgatttcacagctgtcccagtgggaaatgaccaagattcttattgccttggtgccaatgggaggcacacctcatcctggttggtaactcccaaatctttagggaatgtgaatttctctgtgtctgtggaagcacaacagtccccagagctctgtggttctcaggtagccacagtgcctgaaaccgggagaaaggacacagtagtcaaagtcttgatagttgagcctgaaggaatcaagaaagagcataccttcagctcacttctctgcgcatcagatgctgagctgtcagaaacattgtctctgctgcttccaccaacagtagtgaaagattcagccagagcacatttctctgtgatgggtgatatcttgagttcagccataaaaaacacacaaaatcttatccaaatgccctatggctgtggggagcagaacatggtcctttttgctccaaacatctatgttctgaaatatctgaatgaaactcaacagctgacagagaagatcaagtccaaggcccttggttacctcagagctggttatcagagagaactgaactacaaacacaaagatggctcctacagtgcttttggggatcacaatggccagggtcaaggaaacacttggctcacagcctttgtgctcaagtcttttgcccaagctcgagccttcatcttcatcgacgaatcacacatcaccgacgccttcacctggctctccaagcagcagaaggacagtggctgcttcaggagctccggatcactgttcaacaatgccatgaaggggggagtcgatgatgaaatcaccctctctgcctatataaccatggcccttctggaaagttcactcccagacacggatcctgttgtctccaaagccctgggctgcctagaggcatcttgggagaccatagagcaaggaagaaatggcagctttgtgtacaccaagacactgatggcctatgctttcgctcttgcgggaaaccaggaaaagagaaacgaaatcctgaaatcccttgataaggaagctataagggaagacaactccatccactgggaaagacctcagaaacccacaaaatcagagggttatctgtacacaccccaggcttcctctgctgaagtagagatgagtgcctatgtcgtcttagctcgcctcactgcccagccagccccatcccctgaggacctggctttgtcaatgggcaccatcaagtggctcacaaagcagcagaattcccatggcggcttctcctccacacaggacactgtggtggcccttgatgctctgtccaaatacggagcagctactttttccaaaagccagaaaactcctttggtgaccattcaatcttcagggtcattttcccaaaagttccaagtagacaacagtaatcgcctgttactgcagcaggtctcattaccagacattcctgggaactataccgtcagtgtgtcaggggaaggatgtgtgtatgctcagaccacgctgagatacaacatgcccttggagaagcagcagcctgcatttgctctaaaggtgcagacagtacccctgacttgtaacaaccccaaaggccagaacagcttccagatctcactagaaatcagttacacggggagccgtccagcctccaacatggtgattgctgatgtgaagatgctctctggcttcatcccattgaaaccaacagtgaagaagcttgaaagattagagcacgtaagcagaacagaagtgaccaccaacaacgtcctgttatatttggaccaggtaaccaatcagacactgtccttctccttcatcattcaacaagacatcccagtaaagaacctgcagcctgccattgtgaaagtgtatgactactatgagacagatgaagtggcttttgctgaatacagcagcccctgcagctcagacaaacaaaatgtttgaaactcatatctgtggacaaggcattgctggaatccccaaaccagagaactttcaaggtggtgatttgtgtttgtctctgaaatacaaatactgaacaatcttggt

SEQ ID NO: 3646 - DNA, 3190 bp, Rattus norvegicus
  Genbank Accession No. NM_023104
tctcgcgctgtggttcgtccgcgccacgctgagccgctccacgccttgcgctctccgctgtctccgcagctaaagcccgggcagccccggccacgcagctccgcaaccatgtccaagctggcacggctcgagcgcgaggagatcatggagtgccaggtgatgtgggagcctgacagcaagaaggacacgcagatggaccgcttccgggcggccgtgggtactgcctgcggcctggcgcttgggaattacgatgacttataccactggtctgtccggtcgtattcagacttctgggctgagttctggaagttcagtggaattgtctgctctcgcatgtatgatgaggttgtggacacatccaaaggaattgcagatgtccctgagtggttcagaggcagccgcctcaactatgcagagaaccttctgcggcacaaggagaacgacagagtcgccctttacgtggcccgggaaggcagagaggagattgcgaaggtgactttcgaagagcttcggcagcaggtggctctgtttgcagccgccatgaggaagatgggcgtgaagaaaggggaccgtgtggtcggttatctccccaacagtgcccatgccgtggaggccatgctggctgctgccagtattggagccatttggagttctacctcaccagactttggtgtgaatggtgtcctggaccgcttttctcaaattcagccgaaacttatcttctcggtggaagctgtggtctacaacggcaaggaacacggccacctggagaagctgcagcgagtcgtgaaaggacttcctgaccttcagcgagtggtgctgatcccctatgtcctcccaagggagaagatagacatttccaagatccccaacagcatgtttctggatgacttcctggcaagcgggacaggtgcgcaggcaccacagctcgagtttgaacagctgcccttcagccatcccctgttcatcatgttctcctcgggcacgacaggagcgcccaagtgcatggtgcactctgctgggggcaccctcatccagcacctgaaggagcacgtgctacatggcaacatgacaagcagtgacatcctgctctactacaccacggtcggctggatgatgtggaactggatggtgtcagcgctggccacaggagcatccttggttctgtacgatggctccccgctggttccaacacccaatgtgttgtgggaccttgtggacaggataggaatcaccatcctgggaacgggagccaagtggctgtcagtgctggaggagaaggacatgaagccgatggaaactcacaacctccacacgctccacacgatcctgtccaccggctcgccactgaaagcccagagctatgagtatgtgtacagatgcatcaagagcaccgtgctcctcggctccatctcaggtggcactgacatcatctcctgtttcatgggccagaactcatctattcctgtgtacaagggtgagatccaagcccggaacctcggcatggccgtggaagcctgggacgaggaagggaaaaccgtctggggagcgagtggcgagctggtttgcaccaagcccataccctgccagcccacgcacttctggaacgacgagaacggcagcaagtacaggaaggcttacttctccaaatacccaggtgtctgggcacacggcgactactgcaggatcaaccccaagacaggaggtatcgtcatgttgggccggagtgatggcaccctcaaccccaatggcgtacgctttggcagctcggagatctacaacattgtggaagccttcgatgaggtggaggacagcctttgtgtgccccagtacaacagggatggtgaggagcgggtagtcctgtttctgaagatggcctctgggcacactttccagcccgacctcgtgaagcacatccgtgatgccatccgccttggcctgtctgctcgccacgtgcccagcctcatcctggagacccaaggcattccatacacaatcaacggcaagaaagtggaggtggccgtgaagcaggtgatagctgggaagactgtggagcaccggggggccttctccaaccctgagtccctggacctgtatcgggacatccctgagctgcaggacttctgaaccaatggctcgcactcggtccagctgtgcacgtgatggaacttagggacagcagctgctccggtggcccaggcactacgcactccacgggctcagagacagcttccctgtttcggagtcatgggtggggaccaggtctgtctcctgagctccaggatgtgcctggccttcggagaccaaaagggtacactgaggcctgtcttggccctgctgctataggtcagcacacagccttgcaggcgcagggctggtgacatttggtgacaacacactggaggagcgatgtggccttcagcctcatgagcccacagttccacctcgctctatgaaggtgaaatcttacctgtattctctgcccttaataactggtctggcttcctcaggtgtactgtcttctcgagagctgcctgaagccagggcacctggtccagcaggcctgtcacctcacacttggctgttgggatgcctgggctgatggctctgtctgccaaggccagaacaccattctagggaactgcgagtgaatcctccagacagccaagagctctctgctgtggcaagtcccctctgctggcgagcgtccccgactgtttctgggtcttaacagcacaagtatttgaatgggtcaaacgtcaatgttactggaggatctgccgtctggaggcacttgaatcccctgggtgtctaccctaggttaccacttagctgtgtgctgggcggtgtgatcctggagtcttcccgggatggagctgcccggcctcagaggaaaatggccgcgtgctccctcctaatagttccgggctctttctcttgtgactgtactccatgtttgtaaatgacgtctcaggctttggctgccaggactcaatggtgcttcttgtctagcacacagaatatgtcataaatcctggtgattatacttttgtatttctttctttctttttttttttttaaaactgagcacaacataaaaccttttaaaaatatcttggattttaactctataagggaaaagtgctatgaagaattttatggaataaacctgtgccatgcacgcctatcc

SEQ ID NO: 3647 - DNA, 861 bp, Rattus norvegicus
  Genbank Accession No. NM_023950
cgaaagtggagcaaggccggagctttgaccataaagcccaaggcggcggcgttggcgacggtgtttggggctggcagctccgaggagcctgctggagccggagtcgaacctctctgtcgcggcctgcgttgtgtctcctcctctgttgaccctgcgcttcaaggatgacctctaggaagaaagtgttgctgaaggtcatcatcctgggagactctggtgttggaaagacatcgctcatgaaccagtatgtgaataagaagttcagtaaccagtacaaagccacaataggagcagactttctgaccaaggaggtgatggtggatgacagacttgttaccatgcagatctgggacacagctggtcaagaacggttccagtctcttggtgtggccttctacagaggtgcagattgctgcgttctggtgtttgatgtgactgcccccaacacattcaaaacccttgacagctggagagacgagtttctcatccaggccagcccccgggatcctgagaacttcccttttgttgtgttgggaaacaagattgacctggaaaacagacaagtggccacaaagagggcacaggcttggtgctacagcaaaaacaacattccttacttcgagaccagtgccaaggaggccatcaatgtggaacaggccttccagacaattgctcggaatgcccttaaacaggaaacggaagtggagctgtacaatgaattccctgaacccatcaaactggacaagaacgagcgggccaaggcctccgcagagagctgcagctgttgaagaggcagtgagcacagagcacagagtccttcacagaccaagaacacacacgtaggccttcaacacgcgtccc

SEQ ID NO: 3648 - DNA, 6111 bp, Rattus norvegicus
  Genbank Accession No. NM_023979
gtggacggggcgggcccagctgtgtttgagtgctccgcggtcctgggagccagagacctggaggaagcgagctgggtagacggctttctccgctcgcggaagggtgtgagaggagtgtgtgggggtcggcagctagaggtgtgtgcagtcagccaccggcgaggagctgagacagtcgccgcagctttccgagccgcatccgcttcccgcccggggcagctccggctggaggggtgaagcggcggctggagtggccgtgcttttgtgtcctggatccgggtaccctccctcccctggtgcagcccgaggcaagtccatcgaggtgatcactcctcgacgccgctcggaaatcctgggcatcccccctgcgccccgagcggctgatacccaggtgaggcacctgaggtgtcaggacctgcccggggcgcggggtgtccggaagccaggcgggagccccggctgctttttggcaatcgattctcatctgtgaccctccccgagctgttttctatcgaatctcatctgtgatcctcccccggctgctcttcccaggacaactccggtgcaaaggcttggctcatgctcgacggcgaggggagaaaaaaagctgagggacaatggatgcaaaggcccgaaattgtttgcttcaacataaagaagctctggaaaaggacatcaaaacatcctacatcatggatcacatgatcagtaatggcgtcttaacagtagtagaggaggaaaaggtcaaaagtcaggccactcaatatcaacgagcagctgctttaattaaaatgatacttaataaagacaattatgcctacatttcattctacaacgctctactacacgagggctataaagaccttgctggacttctgcatagcggccttcctcttgtgtcttcttccagcggcaaggacacagacggtggaaacacttcatttgtaaggacagtgctgtgtgaaggtggagtgccacagaggccagtcatctttgtcactaggaagaagctggtcagtgcgattcagcagaagctctggaaactgaatggggagccagggtgggtcaccatctatggaatggcaggctgtggcaagtctgtattagctgcggaagctgttcgcgaccatgccctcctagaaggttgtttttcagggggcgtacactgggtttccatcggaaaacaagacaagtccgggcttctaatgaagctgcagaatctttgcacgcggttgggtcaagaagagagtttctctcagaggctcccgcttaacattgaggaggccaaagaccgtctccgtgttctgatgctgcgaaaacacccaaggtctctgttgatcttggatgacgtttgggatccttgggtgttaaaggcttttgacaaccagtgtcagattcttcttaccaccagagataagagtgttaccgattcagtaatgggtcctaagtatgttatccctgtggagagtggtctagggaaagagaagggacttgaaatcttgtcactttttgttaatatgaagaaagaagatctgccagtggaggctcacagtattataaaggagtgcaaaggctctcctctcgtcgtgtctttagttggtgcgcttttacgggattttcccaatcgctgggcatactacctcaggcagcttcagaataagcagtttaagagaataaggaaatcttcatcttatgactacgaggctctggatgaagccatgtccataagtgtggagatgctcagagaagacatcaaggactactacacagacctctccatccttcagaaggatgtcaaggtgcctacgaaggtgctgtgtgttctctgggacttggaaacggaagaagttgaagacatcttgcaggagttcgttaataagtctctcttattctgtaatcggaatgggaagtcattttgttattatttacacgatcttcaagtagatttccttacagagaagaatcgaagtcagctccaggatctgcacaggaagatggtcactcaatttcagaggtatcaccagccgcatacgctgtctccaggtcaggaggactgcatgtactggtacaacttcctggcctatcatatggccagtgccggtatgcacaaagaactttgtgctttaatgttttccctggattggattaaagcaaaaacagaacttgtcggccctgcgcatctgattcatgagttcgtggaatataggcatatactggatgaaaaggattgtgcagtctgtgagaattttcaggagtttttatctttaaacggacaccttcttggacgacagccatttcctaacattgtgcaactgggcctctgtgaaccagagacttccgaagtttatcaacaagcaaagctgcaggccaagcaggaggtggataccgggcggctttacctggaatggatcaacaaaaaaaccatcaagaatctgtcccgcttagtcgttcgcccccatacagacgccgtgtaccatgcgtgtttttctcaggatggtcagagaatagcttcttgtggagctgataaaaccttgcaggtgtttaaagccgagacaggagagaaacttcttgacattaaagctcatgaagatgaggtgctttgctgtgcgttctcctcagatgacagttacatagcaacctgctcagtggataagaaagttaagatttgggattctgggactgggaagctagtgcacacctacgaagaacactcagagcaggtcaattgctgccatttcaccaataagagcaaccaccttcttttggccaccgggtcaaatgactccttccttaagctctgggatttgaatcaaaaagaatgccgaaataccatgttcggtcacacgaactcagtcacccactgcaggttctcaccagacgatgagctcttggcgagttgctcagccgacgggactttaaagctttgggatgtgagatcagcaaacgagaagaaaagcattaatgtgaagcgcttcttcctgagttcagaagacccaccagaggacgtggaggtgatcgtgaaatgttgctcctggtctgcagatggcgacagaataatagtggcagcaaaaaacaaagtcctccttcttgatattcatactagtggcctgctgactgagatccacacaggtcatcacagcaccatccagtactgtgacttctccccctacgaccatttggcagtgattgccctgtctcagtactgtgtggagttgtggaacatagactcccgggtaaaggtggctgactgcaggggacatttaagttgggtccacggtgtgatgttttctcctgatggctcctcgttcttgacagcttctgatgaccaaacaataagggtctgggagacaagaaaggtgtgcaagaactctgccattgtgttaaagcaggaaatagatgtcgtgtttcaagaaaacgaaatgatggtccttgcagttgacaacataagaggcctacaactcattgctggaaaaacaggccagattgattacctgcctgaagcccaagtgagttgctgctgcctaagtccacatcttgagtacgttgcatttggagatgaagagggagccattaagattatagaacttccaaacaacagagttttcagctctgggattgggcacaagaaagctgtacggcacatccagttcacagctgatgggaagacactgatttcaagttctgaagactctgtgattcaggtgtggaattggcagacagaggagtatgtatttctgcaagcccatcaggaaacagtaaaggacttcagactcctgagagattcacgattgctttcctggtcattcgatggaacggtgaaggtgtggaatgtcattaccggaagaattgaaagagactttacttgtcatcagggcacagtgctttcctgtgctatctcttctgatgccaccaagttttcatctacctcagctgataagaccgccaagatctggagttttgaactcccttcccctcttcatgagctgaagggccataacagctgtgtccgctgctctgccttctcgctggatggcatcctgttagcaactggagatgacaatggagaaatcaggatatggaatgtctcagatggccagcttcttcatttgtgtgctccgatttccatagaagaaggaacggctacccacggaggctgggtgactgatgtttgcttctctcctgacagaaaaatgcttgtctctgccggaggataccttaagtggtggaatgttgttactggggagtcctcacagaccttctacaccaatggaacaaacctcaagaaaatacatgtgtcccctgacttcagaacatatgtgaccgttgataatcttggtattttatatattttacaggttttagagtaaagtgactgagccttaatgtagctcagccccttaattttaaattgaaaaaaaattgaaactgtgcatcaactttcgataaagctgtgaattgtactgcagtattgcaaacattgtttacagccggatcaataatgcatatagtataatagtatatctccacaaacacacaggcttttactgttttttaaatacaatcattgttattaacagtttgtcctcaacatgcaaatgaatgtaaatatgtaccttgttaggctatgggtaaactctttgatgcattcagattggttggcaaaattaatgccaattgtttgaaggattctatatgttgaagctgtcattatgcaggctatgccgcagggtgatagtggtcagtatggtgggtgggttttttgacccatgcttaccccaggggtctggctttccaaatcagtcaattgtgttgcgtcttcacactctttaaatttgctttaaggtattgcatcctggtgcacagtctgcggcatgatttctgataacccagttctttctctgagcgagtcatgtgttagagagatctctctgtaccacaaggtagctgtgcatttggctggactctggccctcagagtctttgaactgggcaccaccctgcactcccttagttgttttgtttggtctttaaagagaggctatcttggcatcaatatgtagaccaggttagccttgaactcagagatcagcctgcctctgcctcctgagttctgggattgaaggtatgggccaccactgcctttctctctcagttttatacttactactttactaagcttgacctcttttaacctcttctccatagctaggtgttagtaagccagtgaaatagtaccacacattcccctttgatcccttgtatgtcatcaccaaggccgtactctttatgactttcaagagtcacagaaaaccctccccccatacacccatgtctccctgggaaatgagagctcattgcgttatgcagtgattttgatcctcctgcatcagactcctaagtatctgggagaggtgtcttttgatgcagaaaaaaaccaaaccaaaacaaaactgtgcaacaccactaccaagtttttttttttaaacctccttttagggtctttaattgaagcttgtttaatcactgtcccctgaaatattactaagggcaacagagataaattagtagtagatgtagtttttatataaataaaaaaatcaaatatcttcattttgcaataggaattaatgtgtcttagcaatagtagtcgataggaagctgtttgtgtggtcgtgcatattgccagctgtggtgtgggcagagggaaggaagcacaagtgtgttttagagtttacttctctatggtgctgaagattgaaaccagggccttgcacacactagacaagccctctaccacccggctgcactcctggcccttaggtggatttcagattagatattcccagggcgttttcaggagctgtaaatagagtgaacaaaatcttgtatagagttcaggaagtttgttcttttctaaccttttttgttaggttgaggaaccactttacctacttactgtgatataagccaatgtgattagtggaaatcttaattttataaaataaatattagaagaagtatgtcggggttggggatttagctcagtggtagagcgcttgcctaggaagcgcaaggccctgggttcggtccccagctccgaaaaaaaagaacc

SEQ ID NO: 3649 - DNA, 1408 bp, Rattus norvegicus
  Genbank Accession No. NM_024125
acgggaccgggacgcagcggagcccgcgggccccgcgttcatgcaccgcctgctggcctgggacgcagcatgcctcccgccgccgcccgccgcctttagacccatggaagtggccaacttctactacgagcccgactgcctggcctacggggccaaggcggcccgcgccgcgccgcgcgcccccgccgccgagccggccatcggcgagcacgagcgcgccatcgacttcagcccctacctggagccgctcgcgcccgccgccgcggacttcgccgcgcccgcgcccgcgcaccacgacttcctttccgacctcttcgccgacgactacggcgccaagccgagcaagaagccgtccgactacggttacgtgagcctcggccgcgcgggcgccaaggccgcaccgcccgcctgcttcccgccgccgcctcccgccgcactcaaggccgagccgggcttcgaacccgcggactgcaagcgcgcggacgacgcgcccgccatggcggccggcttcccgttcgccctgcgcgcctacctgggctaccaggcgacgccgagcggcagcagcggcagcctgtccacgtcgtcgtcgtccagcccgcccgggacgccgagccccgccgacgccaaggccgcgcccgccgcctgcttcgcggggccgccggccgcgcccgccaaggccaaggccaagaaggcggtggacaagctgagcgacgagtacaagatgcggcgcgagcgcaacaacatcgcggtgcgcaagagccgcgacaaggccaagatgcgcaacctggagacgcagcacaaggtgctggagctgacggcggagaacgagcggctgcagaagaaggtggagcagctgtcgcgagagctcagcacgctgcggaacttgttcaagcagctgcccgagccgctgctggcctcggcgggtcactgctagcccggcgggggtggcgtgggggcgccgcggccaccctgggcaccgtgcgccctgccccgcgcgctccgtccccgcgcgcgcccggggcaccgtgcgtgcaccgcgcgcacctgcacctgcaccgaggggacaccgtgggcaccgcgcgcacgcacctgcaccgcgcaccgggtttcgggacttgatgcaatccggatcaaacgtggctgagcgcgtgtggacacgggactgacgcaacacacgtgtaactgtcagccgggccctgagtaatcacttaaagatgttcctgcggggttgttgctgttgatgtttttgtttttgttttttgttttttgttttttttttggtcttattatttttttgtattatataaaaaagttctatttctatgagaaaagaggcgtatgtatattttgagaaccttttccgtttcgagcattaaagtgaagacattttaaaaaaaaacggcacgag

SEQ ID NO: 3650 - DNA, 711 bp, Rattus norvegicus
  Genbank Accession No. NM_024127
gggactcgcacttgcaatatgactttggaggaattctcggccgcagagcagaagatcgaaaggatggacacggtgggcgatgccctggaggaagtgctcagcaaggctcggagtcagcgcaccataactgtcggcgtgtacgaggcagccaagctgctcaacgtagacccggacaacgtggtcctgtgcctgctggctgcggatgaagatgacgaccgggacgtggctctgcagatccatttcaccctcattcgtgctttctgttgcgagaacgacatcaacatcctgcgggtcagcaacccgggtcggctggcagagctgttgctactggagaacgacaagagccccgctgagagcgggggcctggcgcagaccccggacttacactgtgtgctggtgacgaacccacattcatcacaatggaaggatcctgccttaagtcaacttatttgtttttgccgggaaagtcgctacatggatcagtgggtgccagtgattaatctccccgaacggtgattccccgaacggtgatggcatctgaatggaaataactgaaccaaattgcactgaagttttgaaatacctttgtagttactcaagcagtcactccccacgctgatgcaaggattacagaaactgatgtcaaggggctgagttcaactacaggagggctaggagatgactttgcagatggacagagaggtgaaaata

SEQ ID NO: 3651 - DNA, 4432 bp, Rattus norvegicus
  Genbank Accession No. NM_024130
gaattcccgcagagtgagactcatcagctggcgagcggggctcagtgtctctgggttcaggaatccttgggcagtagaagggacttactcctcagccccatcactgcccctacccctcccgagggaggcccatggatggagggaggtccgttgctgacggcttctgagccggtccatgcaggcccatcaccctgacccctcctgcctaggtttctgcctttctctgtctttggctagctgggggagggggtagagtccgggtgagcaacatggcccagagcaagaggcacatgtacaatcggacgcccagtggcagcaggatgagtacggaggcaagcgcccggcccctgcgggtcggctcccgtgtggaggtgattgggaagggccaccgtggtactgtggcctatgttggagctacactctttgccactggcaagtgggtgggcgtgatcctggatgaagcaaaaggcaagaacgatggtaccgttcagggaaggaagtatttcacatgcgatgaaggccacggcatctttgtacgccaatcccagatccaagtatttgaagatggagcagatactacttccccagagactcctgattcttctgcttcaaagatcctcaagagagagggagctgatgcagctgcaaagaccagcaaactgcggggactgaagcctaagaaggcaccgacagcccgaaagaccacaactcgacggcccaagcctactcgcccagccagtactggggtggctgggcccagtagctccttgggcccctctggatcagcatcagccggtgaactgagcagcagtgagcccagcaccccagctcagactccgctggcagcacccatcatccccacaccggccctcacctctcctggagcagcacccccacttccttctccctctaaggaagaggaagggctgagggaccaggtacgggacctggaggagaagctggagaccttgcgtctgaaacgctcagaagacaaagcaaagctgaaggagctggagaagcacaagatccagctggagcaggtgcaggaatggaagagcaaaatgcaggagcagcaggcggacctgcagcggcgcctcaaggaggcgaaggaagccaaggaggcactggaggcaaaggagcgctacatggaggagatggcagacacagccgacgccatcgagatggccactctggacaaggagatggccgaggagcgggccgagtccctgcagcaggaggtggaggcactgaaggaacgagtagacgaactcaccacagacttggagatcctcaaggctgaaattgaagagaaaggctctgatggggctgcgtccagctaccagctcaaacagctggaggagcagaatgcccgcctgaaggacgccctggtgaggatgcgagatctctcttcctcagagaagcaggagcatgtgaagctccagaagctcatggaaaagaagaaccaggagctggaggttgtgaggcagcagcgtgagcgtcttcaggaggaactgagccaggcagagagcaccatcgatgagctcaaagagcaggtggacgctgctctgggagctgaggagatggtggagatgctgactgaccggaacctgaatctggaggagaaagtgcgagaattacgggagactgtgggggacttggaagcgatgaatgagatgaatgacgagctgcaggagaacgcacgcgagacagaactggagctgcgtgagcagctggacatggcaggcgcccgagtaagggaggcccagaagcgagtggaagccgcccaggagacggtcgccgactaccagcagaccatcaagaagtaccgccagttgactgcccacctacaggatgtcaatcgggagctgaccaaccagcaggaagcgtctgtggagagacagcagcagccaccgccagagacttttgatttcaaaatcaagtttgctgagaccaaggctcatgccaaggcgatcgagatggagttgaggcagatggaagttgcccaggccaaccggcacatgtccctgctgacggcctttatgcctgacagcttccttcggccagggggagaccatgactgtgtcctggtgctgctgctcatgccccgactcatctgcaaggcagagctcatccggaagcaggcccaggagaagtttgacctgagtgagaactgttcggagcggcctgggctgcgaggggctgctggggagcagctaagctttgccgccgggctggtgtactcgctgagtctgctgcaggccacactgcaccgctacgagcatgccctctctcagtgcagcgtggacgtgtacaagaaggtaggcagcctgtacccggagatgagtgcccacgagcgctccttagatttcctcatcgagctgctgcacaaggatcagctggacgagactgtcaacgtggagcccctcaccaaggccatcaagtactaccagcatctgtacagcatccacctcgctgagcagcccgaggagtccaccatgcagctggctgaccacatcaagttcacccagagtgccctggattgtatgagcgtggaggtggggcggctgcgtgccttcttgcagggtgggcaggaggcaacagatattgctcttcttctgcgagacctggaaacatcctgcagtgacatccgtcagttctgcaagaagatccgacggcgaatgccagggacggatgctcctgggatcccagcagcgctggccttcggctcacaggtgtctgacacactcctggactgcaggaagcacctgacgtgggtggtagctgttctgcaggaggtggcagctgcagccgcccagctcatcgcccccttggcagagaacgaggggctgcccgtggctgcactggaggagctggctttcaaagcaagcgagcagatctacgggagcccctccagcagcccctacgaatgtctgcgccagtcatgctccatcctcatcagcacgatgaacaagttggccacagccatgcaggaaggcgagtatgacgcagagcggcccccgagcaagcctcctccagttgaaccttggcctgcagcactgcgtgcagagatcacagatgctgaaggtctgggtttgaagcttgaggatcgagagacagtcatcaaggagttaaagaagtcactcaagattaagggagaggagctgagtgaggccaacgtgcggctgagcctcctggagaagaagctggacagcgctgccaaggatgctgatgagcgaatcgagaaagttcagactcggctggaggagacgcagaccctgctacggaagaaggagaaagagtttgaggagacaatggatgcactccaggctgacatagaccagctggaggcagagaagacagagctcaagcagcgcctgaacagccagtccaagcgcactattgagggactccggggcccccctccatcaggcattgctaccctggtctctggcattgctggtgaggaacaacagcgagggggcactcctgggcaggctccaggcgccttgccaggcccggggccggtgaaggactcaccactgctgcttcagcagatctctgccatgaggttacacatctctcagctccagcatgagaacagcatcctcagaggagcccagatgaaggcgtccttggcagctctgccccctctgcatgttgcaaagttttccctcccaccccatgagggccctggtggtaacctcctgtctggggcactgtatcgcaagaccagccagctgttggagaaactaaaccaactgagcacttacacccacgtagtagacatcacccgaagcagcccggcctgcaagagcccatccgctcagcttatggaacaagtggcccagctcaagtctctgagcgacaccatcgagaagctcaaggatgaggtcctcaaggagacagtaactcagcgtcctggagctactgttcccactgactttgccaccttcccttcatctgccttcctgagggccaaggaagagcagcaagacgacacagtctacatgggcaaagtgaccttctcgtgtgcggcaggcctcggacagcgacaccgcctggtgctgacccaggagcagctgcaccagcttcacggtcgtctcatctcctaagcactccttccctgccttccctttggtcccactgcccagtgcacggccacctcagccactcccgggttgaaccacatgctaacttcttgagtggttcaccttcgcctggtctggtcagggttctgctacttccgtaacctgggtttgcctgtttacccctggcctcttccatatttgctgttcatctgctccctctttcctgaggggcctcagggcattggaggggctgacacccctccactacagattgagtgaggtctccctgactgaggacttcaccccttgattaaagcaacttctgcttcaaaaaaaaggaattc

SEQ ID NO: 3652 - DNA, 628 bp, Rattus norvegicus
  Genbank Accession No. NM_024131
tgaattcctggaacctcaactggctcccactgctctctcggtgcagttaccgtttggcgatccctctcctgctaacatgccgttcgttgagttggaaacaaacttgccggctagccgcatacccgcagggctggagaaccggttgtgtgcggccacagccaccatcctggacaaacccgaagaccgcgtgagcgtgacgatacgaccgggcatgaccttgttgatgaacaaatccacagagccctgcgcccacctcctgatctcttccatcggtgttgtgggcaccgcggagcagaaccgcagccacagctccagcttcttcaagttcctcaccgaggagctgtccctggaccaggacaggatcattatccgattcttccccttggagccctggcagatcggaaagaaaggaactgttatgacgtttctgtgatggagacaaggaacgcagggcgtttgcttgagcctgtccagagcccttccagagaggcctcctggcagatacgataccagatccctcttttgcataagtgtctgtgatctcactgacctgttttcctctcccccagcctcgtgaacgagagagcaataaagaagagagcataatcccaaaaaaaaaaaaaaaaaa

SEQ ID NO: 3653 - DNA, 2472 bp, Rattus norvegicus
  Genbank Accession No. NM_024132
ggtttgtgcgagccgagttctctcgggtggcggtcggctgcaggagatcatggtgctgagcgaagtgtggaccacgctgtctggggtctccggggtttgcctagcctgcagcttgttgtcggcggcggtggtcctgcgatggaccgggcgccagaaggcccggggcgcggcgaccagggcgcggcagaagcagcgagccagcctggagaccatggacaaggcggtgcagcgcttccggctgcagaatcctgacctggactcggaggccttgctgaccctgcccctactccaactggtacagaagttacagagtggagagctgtccccagaggctgtgttctttacttacctgggaaaggcctgggaagtgaacaaagggaccaactgcgtgacctcctatctgaccgactgtgagactcagctgtcccaggccccacggcagggcctgctctatggtgtccctgtgagcctcaaggaatgcttcagctacaagggccacgactccacactgggcttgagcctgaatgagggcatgccatcggaatctgactgtgtggtggtgcaagtgttgaagctgcagggagctgtgccctttgtgcataccaatgtcccccagtccatgttaagctttgactgcagtaaccctctctttggccagaccatgaacccatggaagtcctccaagagcccaggaggttcctcagggggtgagggggctctcattggatctggaggttcccctctgggtttaggcactgacattggcggcagcatccggttcccttctgccttctgcggcatctgtggcctcaagcctactggcaaccgcctcagcaagagtggcctgaagggctgtgtctatggacagacggcagtgcagctttctcttggccccatggcccgggatgtggagagcctggcgctatgcctgaaagctctactgtgtgagcacttgttcaccttggaccctaccgtgcctcccttgcccttcagagaggaggtctatagaagttctagacccctgcgtgtggggtactatgagactgacaactataccatgcccagcccagctatgaggagggctctgatagagaccaagcagagacttgaggctgctggccacacgctgattcccttcttacccaacaacataccctacgccctggaggtcctgtctgcgggcggcctgttcagtgacggtggccgcagttttctccaaaacttcaaaggtgactttgtggatccctgcttgggagacctgatcttaattctgaggctgcccagctggtttaaaagactgctgagcctcctgctgaagcctctgtttcctcggctggcagcctttctcaacagtatgcgtcctcggtcagctgaaaagctgtggaaactgcagcatgagattgagatgtatcgccagtctgtgattgcccagtggaaagcgatgaacttggatgtgctgctgacccccatgttgggccctgctctggatttgaacacaccgggcagagccacaggggctatcagctacaccgttctctacaactgcctggacttccctgcgggggtggtgcctgtcaccactgtgaccgccgaggacgatgcccagatggaactctacaaaggctactttggggatatctgggacatcatcctgaagaaggccatgaaaaatagtgtcggtctgcctgtggctgtgcagtgcgtggctctgccctggcaggaagagctgtgtctgaggttcatgcgggaggtggaacagctgatgacccctcaaaagcagccatcgtgagggtcgttcatccgccagctctggaggacctaaggcccatgcgctgtgcactgtagccccatgtattcaggagccaccacccacgagggaacgcccagcacagggaagaggtgtctacctgccctcccctggactcctgcagccacaaccaagtctggaccttcctccccgttatggtctactttccatcctgattccctgctttttatggcagccagcaggaatgacgtgggccaaggatcaccaacattcaaaaacaatgcgtttatctattttctgggtatctccattagggccctgggaaccagagtgctgggaaggctgtccagaccctccagagctggctgtaaccacatcactctcctgctccaaagcctccctagttctgtcacccacaagatagacacagggacatgtccttggcacttgactcctgtccttcctttcttattcagattgaccccagccttgatggaccctgcccctgcacttccttcctcagtccacctctctgccgacacgccctttttatggctcctctatttgttgtggagacaaggtttctctcagtagccctggctgtccaggacctcactctgtagatgaggctggctttcaactcacaaggctgcctgcctgggtgctgggattaaaggcgtatgccaccacaaagaaaaaaaaaa

SEQ ID NO: 3654 - DNA, 806 bp, Rattus norvegicus
  Genbank Accession No. NM_024134
gcttgaatctaatacgtcgatcataccatgttgaagatgagcgggtggcagcgacagagccaaaataacagccggaacctgaggagagagaaaccggtccaattacagtcatggcagctgagtctctgcctttcgcctttgagacagtgtccagctgggagctggaagcctggtatgaggatctgcaggaggtcctgtcctcagatgaaattgggggcacctatatctcatccccaggaaacgaagaggaagaatcaaaaaccttcactactcttgaccctgcatccctagcttggctgactgaggagccagggccagcagaggtcacaagcacctcccaaagccctcgctctccagattccagtcagagttctatggctcaggaagaagaagaggaagatcaaggaagaactaggaaacggaaacagagtggtcagtgcgcagcccgggctgggaaacagcgactgaaggagaaggagcaggagaatgagaggaaagtggcacagcttgctgaagagaacgagcggctcaacgaggaaatcgagcgcctgaccagggaggtagagaccacacggcgggctctgatcgaccgcatggtcagtctgcaccaagcatgaactgttggcatcacctcctgtctgtctctcccggagtgtacccagcaccatcacgccagtgccaagcatgtaatctccagtgcacatgctgaggaggggactgagggtagaccaaaggagaggggcttgtacactgtacattctttattcattccatacccagtaaagtgactttgtgtgaaaaaaaaa

SEQ ID NO: 3655 - DNA, 718 bp, Rattus norvegicus
  Genbank Accession No. NM_024136
tgtggcttctggttggggagccagtgtgtcctattgctatccatatggagaatatcatgcccttcgccttgctgggactgtgtgtggggctggcagctggcacagagggtgcagtggtgaaggacttcgacataagcaagtttttaggcttctggtatgagattgcctttgcctccaagatgggtacacctggcttggcacacaaggaggagaagatgggagccatggtggtcgagctgaaagagaaccttctggctctgaccaccacctactacagtgaggaccactgtgtgctggagaaggttacagctactgagggggatggtccggcgaagtttcaggtcaccagactatcaggaaagaaagaagttgttgttgaagccaccgactacctgacctatgccataattgatatcacctctttggtggctggggcagtccatcggaccatgaaactgtacagccggagtttggacgacaatggggaagccctttataatttccggaagataacctcggaccatggcttttcagaaacggacctatacatcctcaagcatgacttaacctgtgtgaaggtattgcaatcggctgctgaatcaaggccctgaagcagggatggatctgaggaggaagcagcagctcggcctacctggcctctccttccctacccaaggggtccccacacctgtgcaaaataaagcttgctaccacccgc

SEQ ID NO: 3656 - DNA, 2897 bp, Rattus norvegicus
  Genbank Accession No. NM_024138
aggcaccaaaccctagtttgccggggcctccggagcagctggctgagggttcctgtcgctgcctgggccgggtgtgacctcccgtccacacagacccagacaccagcctggcaccctgcggtgccaaattaatgcacagtatttctcttccagggtgtgaagccttcctattggaacctcggtgctgggacagtgggactcagagcagctctctagacgccaggtccacgctcatggctgatgatgtcaggtactaacaacgtcgcccaggcccggaagctggtggagcagttgcgcatcgaagctgggatcgaacgcatcaaggtctccaaggcctcgtcagaactgatgagctactgtgagcaacatgcccggaatgaccccttgctggttggtgtaccagcctctgaaaatccattcaaagacaaaaagccttgcataattctctagttctctctctcttcctccctccttcctctccctctctttctccccaccccaaaggtattgtccagtttttcctgtaagaaaaaaatatttgaatcccttctactttgaattttaaaggaacagaaaccattgtgaatgcctggagcctcctgacctagctggagttcgtcctggcctaactttagcctcatccaccccctcccgtcgagaaccactgatgtgacagtttttaagctccccttagttggcctggggaaagggttctgttggccaacggcgagcctagcaagtttgcggaccatagctgcagtcctcgggtcccacataaaacatgcaggtgcggtgtcagaaggctgagatggaaggatccccgaggcttggggactgcatcctagcagccagtaaactccagacagtgagaaacgatgcctccaaacacaaggcagaggaggatacccagccttgacctctggctccacacgcggcacacacaatgcaccctgtactacccagtgtcattctcgagtggccctgtcgtgtgcacggtgacagtgatgccctttctccagagagttggcccattctagaaacgggcatttgggtctccatacaaaggaagcacttgctggtatggccgagtgtgtaactttgtctccgaagcctgagatccatgtgttcattggtgactcctcgtttttctcccagttacacagatggttgtgagggcagaagtgcagatttaattatcttgaggtgattgagaaggaccgatggggttctccatcccacacgtgactgtgcctccagatcccccttcctgggtcaaactattttttaactaactagaacccaagtccctcaatgtgtggactgtggccattttctgcactccttcattgggagattcatctctgaccacacccccaacccctcactgagggattctagacggggctccacccctgaccacgccccagtcccccattgagggattctagaaggggttccacctctgaccatgcctcagccccctactggggattctagaaggggctccaccctgaccacgcccccagacccttactggtaaattctagatggcactccacttctgaggcgggcatcttctctattgtgtgagcagagccctagagtccaggctggcctggactggaactggagatcttcctgcctctggctccggagtacctacctgataggcctgtgttgcatgcctggcatcggattggacggaagatgacagaccgtctgtctatgacagtgacagtggcaggtctagggaggacacagcttaggtgtgccagtgtggtctgcagccatacacaaaggcatctcaagcatttgagactccagttacctctttctcctgccggatcagtgtgggagcagaaatgaagccagtccagttactccctgcagctctggtggaaatctgcttcccaaaccctgtgccaggctcatccctggacagttgctcaaactgcccatgggcaaagtgaatggagctggcagatctggctcctagcctattaggcacaacctaccacctagataaggtggcagccccccccctccccagtccatttgatggaatcagggaaagaagtttgggatgtgactaagggggaggggcactgcaggtgctaagagaggaccctgtttccccctccatgggccacagagagcacagaccaagggtcaggcccctcctgtgcactgactcccaattactggtcagagagggccaggactttggtgagcctgactctcagaacctgtggtggaatcagaaaagccagtgtccctccagaactgcagccacctttcattaggctaggaaccaggtcccagcaggtgtgtctccagctgcactggcaggggacagtgaggagagaggaaaggacatacattctggggaccgggactgcagaacacccagccagtatggtagaaacctgggttccaccccaagctcgcaaaaaaacaggcatgggcactggggatgtagaggcaggaagatcagaacttcagggtctttctcagccacaggatgggctcaaggttagcctgggctgcatgagaccatgtctcaaagacagaaatctcagtgtgctctctcatgttcctaacacgcctgattgtttccctctggaggctgctgtgccagcctggccagcctgcgtttggtcgcagccttgtttctcagctctgggacaaaaactcaaatctgcatctctgcccacacctccagttccccctccccgggtgactcacaggccaaggacaaagtggcctcttgctcccagggagggtaggatgtgctggtgtagcctgtgtacgtcctaagcactggagccctgcctcggcctagagacgcttagggaaaccagaacacatcagagcaattaggagccaagaatggtggc

SEQ ID NO: 3657 - DNA, 1213 bp, Rattus norvegicus
  Genbank Accession No. NM_024148
agacagactccattctttgtgcagtgaggggctccctgcctcgttgggaggcagcgtagtaaacactgcttcggtgctccagacgcctaagggctttcgttacagcgatgccgaagcgggggaagagagcggcagcggaagacggggaagaacccaagtccgagccagagaccaagaagagtaagggggcagcaaagaaaactgagaaggaggccgcaggagagggccctgtcctgtatgaggaccctccagatcagaaaacgtcagccagtggcaaatctgccacactcaagatatgctcctggaatgtggatgggcttcgagcctggattaaaaagaaaggcttggattgggtaaaggaagaagcaccagacatcttgtgcctccaagagaccaaatgctcagagaacaaactcccggctgaactgcaagagctgcctggactcacccatcagtactggtcagctccatcagacaaagaaggatatagtggtgtgggcctactttcccgccaatgcccgctcaaagtctcttatggcattggtgaggaagaacatgatcaagaaggccgggtgattgtggctgaatttgagtcctttatcttggtaacagcctatgttccgaacgcaggaaggggtctggtaagactggagtaccgacagcgatgggatgaagccttcagaaagtttctaaaggacttggcttcccggaaacctcttgtgctgtgtggggatctcaatgtggctcatgaagaaatagaccttcgtaaccccaaaggaaacaaaaagaatgctggttttactccccaggagcgccaaggctttggggaaatgctacaggctgtaccactggctgacagcttccggcatctctaccccaacactgcctacgcttatactttctggacttacatgatgaatgcccgctctaagaatgttggttggcgccttgattactttttgctgtctcactctcttttacctgctttgtgcgacagcaagatccggtccaaggctcttggcagtgaccactgtcccatcaccctttacctagcactgtgacactcccctcaagtagcttcatgctgggaaatagcctcctctcctccaggagaccagtgcgttatctcttcttcaggtgtttactcccctctaaaccaaacttctggtttcctttaaacaatccaagtgaaataaaagtcctacttttcaac

SEQ ID NO: 3658 - DNA, 1058 bp, Rattus norvegicus
  Genbank Accession No. NM_024149
cctccttctgctgttgctccccatccccccgcggccggccggttccagccctcgccccgcgtcccctgcccgcgcccccgccccgggccccgccatgggcctcacggtgtccgcgctcttttcgcggatcttcgggaagaagcagatgcggatccttatggttggcttggatgcggctggcaagactaccatcctgtacaaactgaagttgggggagattgtcaccaccatccccaccataggcttcaatgtggaaacagtggaatataagaacatctgtttcacagtctgggatgtcggaggccaggataagattcggcctttgtggcggcactacttccagaacactcagggcctcatctttgtggtggacagcaatgaccgggagcgggtccaggagtctgctgatgaactccagaagatgctgcaggaggatgagcttcgggatgcggtgctgttggtgtttgccaacaagcaggacatgcccaatgccatgcctgtgagcgaactgactgacaagctggggcttcaacacttgcgtagccgcacgtggtacgtccaggccacctgtgccacccaaggcacaggcctgtatgatggtctggactggctgtcccatgagctatcaaagcgctagccagccaggggcaggcccctgctgcccggaagctcccgcgtgcatcccgggatggccagactcccgggactcctcaggcagtgcccttccttcccacttttcctccccacagacaggcctctgctcctgtgcctgcctgcatgctctctcttgttgttggagcctggagccttgctctctgggcacagagggttctgctctcctgcctgctgggacctgtggaagggcttcctggccaaggccccctcttccaggggaggagcagggatctggatttaatttcgttttggttttggtttttttggtttttttctgttttgggtgtacccttggggccaggtttggggggaggaaagtgagggctccgggtggtgctatgatgtgggactggatattgagtaataaatttgctgtggtttgt

SEQ ID NO: 3659 - DNA, 1608 bp, Rattus norvegicus
  Genbank Accession No. NM_024151
gacagccgaacacttaacgccgcgccggagccaccgcaccagtcgccgagcaggtcccggtcccgctacgtcgtgtcccgcggctctgccgacactccggcctgagagacgggtcttcagccttttctcttccgcccactcagttgtgagccggaaccgtgaaggcccgagggcggaccagaccctctctttttttgaccatcaagtgccaccaccgctatgggcctcaccatctcctctctcttctcgcgcctcttcggcaagaagcagatgcgcattttgatggttggattggatgctgcgggcaagacgacgattctgtataaactgaaactaggggagatagtcaccaccattcctaccattggttttaatgtggaaacagtagaatataagaacatttgtttcacagtttgggatgttggtggtcaagataaaattaggcctctctggaggcattacttccagaatacccagggtctcattttcgtggtagatagcaatgatcgtgaaagaattcaggaaggagcagccgtgctgcagaaaatgcttctggaagatgagctgcaggatgctgtgctgctgctttttgccaacaaacaggatttgccaaatgctatggccatcagtgagatgacagacaagttaggtcttcagtctctccggaacagaacatggtatgtccaagccacttgtgctacacaaggaactggtctgtacgaggggctggattggctgtcaaatgaactttcaaaacgctaaatgaaactggatatctaaccaaggacatgtttgatagaattggtctaggcttgttacaacaaaattagtttgcatcttggttattaaaggatatctgagacggtttgggcagaaattacagcatttaaaacttgttttgttgccaattattgtttaccaagaacaatgttgctgtttagcaatatgcttgggtttaagagaaattctccttgggggaaaaaagtgtccattattatacttcccctgaacctgaatgcctggatagatagcgattgtgacacccttaaataaatctgttttgagtgttttttgagcccacaccaataatgttttaaagttacccccttggaactcactgatacctatcattcctcgggcagtctgctgagttaaaaatgtagcattccatttgtatttatttcccccttgccaaaaagatttttctaataatgcttgtactggccagggatgagctccacaacactattcagttttcttgtactgaggattcccccacctccctcacattattgactcctggcttctatcagccaaactttgatgtagtttggatttgatagctaattctgggctggtttcaaagagttcatattgagataacttttaatactcagcaaattgtcttcctttatattatcttttttatgttgcatgttgccttttggaatcagcctgactctttgcccagcatatgatagttctgctggtattttactgtttactgatgaacatatcttcattaagaattttttgaaaactcatcaaattcaatgaataagttttcttcataacccatttggaattattcctaataaaatgattttt

SEQ ID NO: 3660 - DNA, 995 bp, Rattus norvegicus
  Genbank Accession No. NM_024152
agcaggcacgttcgcgcaagccgggccgcagggcgtcctcgcggcggggcggctacttttcgggctcgcagcggcggcggcgttgtaggctgaggggacccgggacacctgaatgcccccggccccggctcttccgacgcgatggggaaggtgctatccaagatcttcgggaacaaggaaatgcggatcctcatgctgggcctggacgcagccggcaagacaacgatcctgtacaagttgaagctgggccagtctgtgaccaccattcccacggtgggtttcaacgtggagacggtgacttacaaaaacgtcaagttcaacgtgtgggatgtgggcggccaggacaagatccggccgctctggcggcattactacaccgggacccagggtctgatcttcgtggtagactgcgccgaccgggaccgcatcgatgaggcccgccaggagctgcaccgcattatcaatgaccgggagatgagggacgccataatcctcatcttcgccaacaagcaggacctgcctgatgccatgaaaccccatgagatccaggagaaactgggcctgacccggattcgggacaggaactggtatgtgcagccctcctgtgccacctccggggacggactctatgaggggctcacatggttaacctctaactacaaatcctaatgagcgccctccacccagcccccggaaggagagaaatcaaaaacccattcataggattatcgccaccatcatcacctctttcaattgccactctcttttttgaaactgaactcgagttactgttctaccgtttagtggggttgggggttttctttgttccccttaccccccctcttctatttcctttcggctttgcgttaggatgctctgatctgacatttgacacgaatacagtgctatatgctcttgtgacttccagcaaacggggtaatagcaactcttggtaaagtcctttataataatggttgattttttttttttatttc

SEQ ID NO: 3661 - DNA, 2739 bp, Rattus norvegicus
  Genbank Accession No. NM_024156
ggaattcccgtctatctgtctgccctgatccgaggcctccccagagcgtggtttctgctgcagaacctgagaccatggccaaaatagcacagggtgccatgtaccgaggctctgtccacgacttcgcagactttgatgcaaatcaggatgccgaggctttgtacacagccatgaagggcttcggcagtgacaaggagtccatattggagctgatcacctcccgcagcaacaagcagaggcaggagatctgccagagttacaagtccctctatggcaaggacctcatcgcagacttgaagtatgagttgacagggaagttcgagcgactgatagtgaacctgatgaggccgcttgcctattgtgacgccaaagagattaaagacgctatctcgggcattggcactgatgagaagtgcctcattgaaattttggcttcccggaccaatgagcagatacaccagctggtggccgcatacaaagatgcctatgagagagacctggagtctgacatcattggagacacttcaggccacttccagaagatgctggtggtactgctccagggaacccgggagaatgacgatgttgtgagtgaggacttggtccagcaggatgtccaggacctgtatgaggcaggggaattgaaatggggaacagatgaggcccagttcatctatatcttgggaaaccgtagcaaacagcacctacgattggtgtttgatgagtacctgaagaccacagggaagcccatcgaagccagtatcagaggggagctgtctggagactttgagaagctgatgttggccgtggtgaagtgcatccgaagtaccccggagtattttgctgaaaggctgttcaaagccatgaagggcctggggactcgagacaacactctgatccgtatcatggtctccaggagcgaactggatatgcttgacatccgggagatcttccggaccaagtatgagaagtcactctacagcatgatcaagaatgatacctctggtgaatacaagaaggctttgctgaagctatgtggaggggacgatgatgccgctggccagttcttcccggaggcagcacaggtggcctatcagatgtgggaacttagtgcagtgtcccgagtcgagctgaagggtaccgtgcgtgcggccaacgatttcaaccccgatgctgatgccaaaggcctgcggaaagccatgaagggaattggaaccgacgaagccaccatcatcgacatcatcacacagcgcagcaatgtccagcggcagcagatccggcagaccttcaaatctcactttggccgggatttaatggccgacctgaagtccgagatctcaggagacctggcaaggctgatcctggggctcatgatgccacctgcccattacgatgctaagcagctgaagaaagctatggagggagccggcacagatgaaaaggctcttatagaaatcctggccacccggaccaatgctgaaatccgagccatcaatgaggcctacaaggaggattatcacaagtccctggaggatgccctgagctcggacacatctggccacttcaaaaggatcctcatttctctggccacagggaatcgagaggaaggaggagaaaaccgggaccaggctcaggaagatgctcaggtggctgctgagatcttggaaatagcagacacacccagtggagacaaaacctccttggagactcgattcatgaccgtcctgtgcacccgtagctatccccacctgcgcagagtcttccaggagttcatcaagaaaaccaactatgacatagagcatgtcatcaagaaggagatgtctggggacgtcaaggacgcatttgtggccatcgttcagagtgtcaagaacaagcctctcttctttgctgacaaactgtacaagtccatgaagggtgccggcacggatgagaagaccctcaccagggtgatggtgtcccggagtgagatagacctgctcaacatccggagggaattcattgagaaatatgacaagtctccacaccaagccattgaaggtgacacctctggagacttcatgaaggctttgctggcgctctgtggtggagaagactaaaactcatggccttggagggtccccctgccatgcagtggccaaccgcaccagccaccgtgacctgaccaagccattgctccagcttcagagactaaggaagaagtgaggggtggagttggactgtgatccggctggggtgctctcttgccattgagggtcccaggcggtcccttctgttatccctcctgctcatggctaagtggctggtgaaccacagccatatatgcattcaaccctgctccccgtctgcctccttctccgcccaccctagcttccatccctccacacgaatccctgcctgatttaagctttgtcacatctctaaacacctccttggatggagccaccctgcccccagccctgaacagccgggggagggtagagagttcctcagagctggctcccagctgtgtccatcattggagtggcagcaggcaggtttcatacagtgctgtggactcgagaagccgttacactggactggaatggtggacagttgggtcacttactggaccccaatggagaaaagtgtgtcaccactcctcgccaagtctctgcttgtcttttccaataaattcggaaaagtggatcaagaataccttggcagggaataggggggcaaagtttagaacagagggaattc

SEQ ID NO: 3662 - DNA, 2021 bp, Rattus norvegicus
  Genbank Accession No. NM_024157
atgaagctcgctctgcttattctgctactcttgaatcctcacttgagttcttccaagaacacaccagcctcaggtcagcctcaggaggatctggtagagcagaaatgcttactgaaaaactacacgcatcactcctgtgacaaagtcttctgccagccatggcagaaatgtatcgagggaacctgtgcctgcaaactcccttaccagtgcccaaaggccgggaccccggtgtgcgccactaatggaagaggctacccgacatactgtcacctgaagagtttcgaatgtcttcacccggagataaagttctcgaataatggaacatgcacagctgaagaaaagtttaatgtttccttaatttatggaagcacagatacagagggaattgttcaagttaaactcgtggaccaagatgagaaaatgttcatatgtaaaaatagctggagcaccgtggaagccaacgtggcctgcttcgacctcggatttccactgggtgttcgtgacatacaaggaaggtttaatatacctgtaaatcacaaaataaactccaccgaatgcctgcatgtgcgttgccagggagtagagaccagtttggcagagtgtacctttaccaagaagagttcgaaggctccccatggcttggcaggtgtagtgtgctacacacaggatgcagatttcccaacaagtcagtccttccagtgtgtgaatgggaagcgcattcctcaggagaaagcctgtgatggtgtcaacgactgtggagatcaaagtgatgagctgtgttgcaaaggttgccgaggccaagccttcctttgcaagtcgggagtttgcatcccaaaccaacgtaagtgtaacggtgaggtggactgcatcaccggcgaggacgagagtggctgtgaagaagacaaaaagaataaaattcataaaggccttgcacggtcagaccaaggaggagaaactgaaattgagactgaagaaacagaaatgttgactcctgatatggacacagaaagaaaacggataaagtccttattacctaaactatcctgtggagtcaaaagaaatactcacattcgcaggaaaagagtggtcggagggaagccagccgagatgggagattacccatggcaggtggcgattaaggatggagatagaataacctgtgggggcatttatatcggtggctgttggattctgacagctgcacactgtgtcagacccagtagatatcgcaactaccaagtatggacgtctttattagactggctaaagcctaactctcagttggcagttcagggagtgagcagagttgtcgttcatgaaaagtataacggagccacctaccagaatgacatagctttggttgaaatgaaaaaacacccgggcaagaaagaatgtgagctcatcaattctgtccctgcctgtgtcccatggtctccatatctattccaaccgaatgacagatgcatcatttctggatggggtcgagaaaaagataaccaaaaagtctactcactcaggtggggcgaagtcgacctaataggcaactgctcgaggttttacccgggtcgctactatgaaaaagagatgcagtgtgcgggtaccagtgatgggtccattgatgcctgcaaaggagactctggaggccccttggtctgcaaggatgtcaacaatgtcacttatgtttggggcattgtgagctggggagaaaactgtgggaaaccagagttcccaggtgtttacaccagagtggccagctattttgattggattagctactacgtgggaagaccccttgtttctcaatacaatgtctgaagctacgacctccttctttctgcacttcttctttccagggttatactttaattgaaatgaaactgtataattagttctcctcgatgctggcaagaagcaagtcttactggctagttcctaaagtttcttcaaagtttatgccattttagaattctgtcatataatccccaataaatattccagttaagcacacaaaaaaaaaaaaa

SEQ ID NO: 3663 - DNA, 937 bp, Rattus norvegicus
  Genbank Accession No. NM_024161
ccgcgcggccgcctccgcggctcccggaacgcagaagctggtgtagggaggcgggcagtgaaggctccgaggcttgttcacattcggggaagcagaaaattgcctcatagttactaacctaacatggctgaccagaggcagcgctcactctctacttccggggaatcgttataccatgttcttggactggacaagaatgcaacctcagatgacattaaaaagtcctatcggaagctggccctgaaatatcaccctgacaagaaccctgataacccagaggctgcagacaagtttaaggagattaacaacgcccacgcaatcctgacagacgccacgaaaagaaacatttatgacaagtatggctcgctggggctctatgtggctgagcaatttggggaggagaatgtcaacacctacttcgtactctccagctggtgggccaaggcgctgttcgtcgtctgtggcctcctcacctgctgctactgctgctgctgtttatgctgttgctttaactgctgctgtgggaagtgcaagcccaaggcacctgagggtgaagagacagaattctacgtatcccctgaagacttggaggcacagctgcagtctgatgagagggaggctacagacacaccgatcgtcatacagccagcatccgccacagagaccacccagctgacagctgactcccaccccagctatcacaccgacgggttcaactaaattcaggagaggctgtgattagagggatgaatcagcatctggccactgcaaccttagaatcatgaactgtagtcactgaagatgggaaggcagccgtcaacctgacccgctgtggctggtcagggccactcccacctcctcttaagtccacccatctgtcaatccttgatacatgaagtgcgtagcatgcagtatttaaagcagtgtagctacggtc

SEQ ID NO: 3664 - DNA, 1123 bp, Rattus norvegicus
  Genbank Accession No. NM_024346
cattttccagacgccggccgcatccctcctgtcgtcgaagccccagccgcctgcagaccatggccagcaccgatctgccaatcatatagcaggcctatccccaggccctgccagtgatcactatgtcttatctgttccttgaggatctgtcttctgagaagaaaactccccattgtccatcaaaataaggataaacactgccccagccgcctccagcaccatggccagcaccgtatctgcctacaaggagaagatgaaggagctatctgtgctgtcgctcatctgttcctgcttctactcgcagcctcacccgaacaccatctaccagtatggggatatggaagtgaagcagctggataagcgggcctctggccagagcttcgaggtcatcctcaagtctccttctgacctatctccagagagccctgtgctctcttctcctcccaagaggaaggatgcttccttggaagagctgcagaagcggctggaggcagctgaggagcggaggaagactcaggaggctcaggtgctgaagcagctggcagagcgacgtgagcatgagcgggaggtgctgcacaaggcgctggaagaaaacaataactttagccccctggcggaggagaagctcaactacaagatggagctgagcaaggagattcgcgaggcgcacctggcggcgctgcgcgagcggctgcgtgagaaggaactgcacgctgctgaggtgcgcaggaacaaggagcagcgggaggaaatgtctggctaaagagcactggaccaagcagcaacaagaacattttccggttttgtttttgttttcaattctgtctagatgcgaattttgtgcctgctcctatctgctcccctgtacccccagcttcctgcttttctcccacattctgaactgtccagtccttgtgatgtgtctgaccttggactcttcctgaaggagctccctaggcaggaatatggtcccctattcagacactaggccaggtgtgactggggctctcttagtggccctcttagtggatgtgttggcaaccttaataaatctagtggcagtggcaaaaaaaaaaaaaaaaaaaaaaaaaaaaaaaaaaaaaaaaaaaaaaaaaaaaaaaaa

SEQ ID NO: 3665 - DNA, 2073 bp, Rattus norvegicus
  Genbank Accession No. NM_024351
gtctctgtgtggtctcgtcatcagcacagctgggcctacacgcaagcaaccatgtctaagggacctgcggttggcattgatcttggcaccacctactcctgtgtgggtgtcttccagcatggaaaggtggaaataattgccaatgaccagggtaaccgcaccacgccgagctatgttgctttcaccgacacagaacgattaattggggatgcggccaagaatcaggttgcaatgaaccccaccaacacagtttttgatgccaaacgtctgatcggacgtaggttcgatgatgctgttgttcagtctgacatgaagcactggcccttcatggtggtgaacgatgcaggcaggcccaaggtccaagtcgaatacaaaggggagacaaaaagtttctatcctgaggaagtgtcttcaatggttctgacaaaaatgaaggaaattgcagaagcttaccttggaaagactgttaccaatgccgtggtcaccgtgccagcttacttcaatgactctcagcgacaggcaacaaaagatgctggaactattgctggcctcaacgtacttcgaattatcaatgagccaactgctgctgctattgcctatggcttagataagaaggtcggggctgaaaggaatgtgctcatttttgacttgggaggtggcacttttgatgtgtcaatcctcactatcgaggatggaatttttgaagtcaaatcaacagctggagacacccacttgggcggagaagactttgacaaccgaatggtcaaccatttcattgctgagtttaagcgaaagcacaagaaggacatcagtgagaacaagagagctgtcaggcgtctccgcactgcctgtgagcgggccaagcgcaccctctcctccagcacccaagccagtattgagattgattctctctatgagggaattgacttctacacctccattacccgtgctcgatttgaggagttgaatgctgacctgttccgtggcacactggaccctgtagagaaggcccttcgagatgccaaactagacaagtcacagatccatgatattgtcctggtgggtggttctaccagaatccccaagatccagaaacttctgcaagacttcttcaatggaaaagagctgaataagagcattaaccccgatgaagctgttgcctatggtgcagctgtccaggcagccattctatctggagacaagtctgagaatgttcaggatttgctgctcttggatgtcactcctctttcccttgggattgaaactgctggtggagtcatgactgtcctcatcaagcgcaataccaccattcccaccaagcagacccagactttcaccacctactctgacaaccagccaggtgtactcatccaggtgtatgaaggtgaaagggccatgaccaaggacaacaacctgcttgggaagtttgagctcacaggcatacctccagcaccccgtggggttcctcagattgaggttacttttgacattgatgccaatggcatcctcaatgtttctgctgtagataagagcacaggaaaggagaacaagatcaccatcaccaatgacaagggccgcttgagtaaggaggatattgagcgcatggtccaagaagctgagaagtacaaagctgaggatgagaagcagagagataaggtttcctctaagaactcgctggagtcttatgctttcaacatgaaagcaactgttgaggatgagaaacttcaaggcaagatcaatgatgaagacaaacagaagattcttgacaagtgcaacgaaatcatcagctggctggataagaaccagactgcggagaaggaagaatttgagcatcagcagaaagaactggagaaggtctgcaaccctatcatcaccaagctgtaccagagtgctggtggcatgcctggaggaatgcctggtggcttccctggtggaggagctcctccatctggtggtgcttcttcaggccccaccattgaagaggtcgattaagtcaaagtagagggtatagcattgttccacagggacccaaaacaagtaacatggaataataaaactatttaaattggcacc

SEQ ID NO: 3666 - DNA, 2222 bp, Rattus norvegicus
  Genbank Accession No. NM_024352
cagcttaggagaatggggtggctcccactactgctgcttctggcacagtgttcaagggctcttgggcagcgctcaccgctgaatgacttccagctgcttcggggcacagagttaaggaacctgctacatccagtggtgccagggccatggcaggaggatgtggcagatgccgaggagtgtgctagacgctgtgggccccttctggactgccgagccttccactacaatatgagcagccatggttgccagctactaccgtggactcagcactctctgcgtgcacagctacaccattctagcctgtgcgatctcttccagaagaaagactatgtacggacctgcattatggacaatggggccagctaccggggcactgtggccaggacagctgatggcttgccctgccaagcctggagccgcaggttccccaatgaccacaagtacacgcccacaccgaagaatggcctggaagagaacttctgtcggaaccctgatggggaccccagaggtccctggtgctacacgacaaaccgcagcgtgcgtttccagagctgcggcatcaaatcatgcagggaggcggtttgtgtttggtgcaacggcgaggattaccgtggcgaggtagacgttacagaatcgggacgggagtgtcaacgctgggacctgcagcacccacactcgcaccctttccaccctgaaaagttcccagacaaagctctgaaagacaactattgccgtaatccggatgcatctgagcgcccctggtgctacaccacggacccgaatgttgagcgagagttctgtgacctgcccagttgcgggcccaacctgccaccgaccaccaaaggatccaagtcacaacagcgcaacaaggtcaaggcttcgaactgcttccgcggaaaaggtgaagactatcgaggcacaaccaataccacctctgcgggtgtgccctgccagcgctgggatgcgcagaatccgcaccagcaccgctttgtgccggagaaatatgcttgcaaggaccttcgtgagaatttctgccggaatcctgatggctccgaggcgccttggtgcttcacatctcgacctggtttgcgtgtggccttttgctaccagatcccacgctgcacagaagaagtggtgccagagggctgctaccatggctcaggtgaacagtatcgtggctcagtcagcaagacacgcaagggcgttcagtgccagcactggtcctcagagacaccacataagccacaattcacacccacctcagcaccacatgcaggcttggaggcaaacttttgccggaatccggatggagatagccatgggccctggtgttatactttggacccagagaccctgtttgactactgtgccctaaaacgctgtgatgatgaccagccaccatccatcttggaccccccagtccaggtgcagtttgaaaagtgtggcaagagagttgaccagagtaatagacttcgtgtggtggggggtcatcctgggaactcaccgtggacagtcagcttgcggaatcgacagggccagcatttctgtgggggttccctagtgaaggagcagtgggtactgaccgcccggcaatgcatctggtcatgccatgatcctctcacaggatatgaggtatggttgggtacaattaaccagaacccacagcctggagaagcaaacctgcagagggtctcagtggccaagacagtgtgcggacctgcaggctcccaacttgttctgctcaagctggagagacctgtgatcctgaaccatcacgtggccaggatttgcctacctcctgaacagtatgtggtacctccagggaccaactgcgagatcgctggctggggtgaatccaaaggtacaagcaatagcacagtccttcatgtggccaaaatgaaggtcatctccagtcaggaatgtaatgtgaagtaccggagacgagtacaagagagtgagatatgcaccgaggggttgctggcccctacgggcgcttgtgagggtgactacgggggcccacttgcctgctatacccatgactgctgggtcctacagggacttatcatcccgaacagagtgtgtgcacggcctcgctggccagctatcttcacacgtgtgtctgtgtttgtggactggattaacaaggtcgtgcagctggagtaggcctgctttcgatctcttagagatgacaaggctgcttatcaaactaaagcaaacttttc

SEQ ID NO: 3667 - DNA, 1016 bp, Rattus norvegicus
  Genbank Accession No. NM_024356
gacttcgaacctcattcggtgcagaactcctgtcccggtgacagccacaggtcacggccgccggctaagccgagccgcagcgcttggtagcaccttagggtgtctcgggagcaatcgcgccgggtccatggagaagccgcggggtgtaaggtgcaccaatgggttccccgagcgggagctgccgcggcccggggccagccgacctgccgagaagtcccggccgcccgaggccaagggcgcacagccagccgacgcctggaaggcagggcggccccgcagcgaggaggataacgagctgaacctccccaacctggcggccgcttactcgtccatcctgcgctcgctgggcgaggacccccagcggcaggggctgctcaagacgccctggagggcggccaccgccatgcagttcttcaccaagggataccaggagaccatctcagatgtcctgaacgatgctatatttgatgaggaccatgacgagatggtgattgtgaaggacattgacatgttttccatgtgtgagcatcacctggtcccatttgtgggaagggtccatattggttatcttcctaacaagcaagtccttggtctcagcaaacttgccaggattgtggaaatctacagtagaagactacaagttcaagaacgccttaccaaacagattgcagtggccatcacagaagccttgcagcctgctggcgtcggggtagtgattgaagcaacacacatgtgtatggtcatgcgaggtgtgcagaaaatgaacagcaagactgtcactagcaccatgctaggcgtgttccgggaagacccaaagactcgggaggagttcctcacactcatcaggagctgaacttccgtgtgcgagccccggtttgcagacccccgctgaggccagcgttatctgtctcgattgtacattccagttccagttggtatacttgtcaactttatttctcaccatgaattgtatttaataattatttatagagatgtcaaataaaggtgatcaactt

SEQ ID NO: 3668 - DNA, 3718 bp, Rattus norvegicus
  Genbank Accession No. NM_024359
gacaccgcgggcaccgattcgccatggagggcgccggcggcgagaacgagaagaaaaataggatgagttccgaacgtcgaaaagaaaagtctagggatgcagcacgatctcggcgaagcaaagagtctgaagttttttatgagcttgctcatcagttgccacttccccacaacgtgagctcccatcttgataaagcttctgttatgaggctcaccatcagttacttacgtgtgaggaaacttctaggtgctggtgatcttgacattgaagatgaaatgaaagcacagatgaactgcttttatctgaaagccctggatggctttgttatggtgctaacagatgatggtgacatgatttacatttctgataacgtgaacaaatacatggggttgactcagtttgaactaactggacacagtgtgtttgattttacccatccatgtgaccatgaggaaatgagagaaatgcttacacacagaaatggcccagtgagaaaggggaaagaacaaaacacgcagcgaagcttttttctcagaatgaaatgtaccctaacaagccgggggaggacgatgaacatcaagtcagcaacgtggaaggtgctgcactgcacaggccacattcatgtgtatgataccagcagtaaccagccgcagtgtggctacaagaaaccgcctatgacgtgcttggtgctgatttgtgaacccattcctcatccatcaaacattgaaattcctttagacagcaagacatttctcagtcgacacagcctcgatatgaaattttcttactgtgatgaaaggattactgagttgatgggttatgagccagaagaacttttgggccgttcaatttatgaatattatcatgctttggactctgatcatctgaccaaaactcatcatgacatgtttactaaaggacaagtcaccacaggacagtacaggatgcttgcaaaaagaggtggatatgtctgggttgagactcaagcaactgttatatataatacgaagaactctcagccacagtgcattgtgtgtgtgaattatgttgtaagtggtattattcagcacgacttgattttctcccttcaacaaacagaatctgtcctcaaaccagttgaatcttcagatatgaaaatgacccagctgttcactaaagtggaatctgaggacacgagctgcctcttcgacaagcttaagaaagagcccgatgccctgactctgctagctccagcggctggggacacgatcatatcactggacttcggcagcgatgacacggaaactgaagaccaacaacttgaagatgtcccgttgtacaatgatgtaatgttcccctcttctaatgagaaattaaatataaatctggcaatgtctccattacctgcctctgaaactccaaagccacttcgaagtagtgctgatcctgcactgaatcaagaggttgcattgaagttagagtcaagcccagagtcactgggactttcttttaccatgccccagattcaagatcagccagcaagtccttctgatggaagcactagacaaagctcacctgagcctaacagtcccagtgagtactgctttgatgtggacagcgatatggtcaatgtattcaagttggaactggtggaaaaactgtttgctgaagacacagaagcgaagaatccattttcagctcaggacactgatttagacttggaaatgctggctccctatatcccaatggatgatgatttccagttacgttcctttgatcagttgtcaccattagagagcaattctccaagccctccgagtgtgagcacagttacaggattccagcagacccagttacagaaacctaccatcactgtcactgccaccgcaactgccaccactgatgaatcaaaagcagtgacgaaggacaatatagaagacattaaaatactgattgcatctccaccttctacccaagtacctcaagaaatgaccactgctaaggcatcagcatacagtggtactcacagtcggacagcctcaccagacagagcaggaaagagagtcatagaaaaaacagacaaagctcatccaaggagccttaacctatctgtcactttgaatcaaagaaatactgttcctgaagaagaattaaacccaaagacaatagctttgcagaatgctcagaggaagcgaaaaatggaacatgatggctccctttttcaagcagcaggaattggaacgttactgcagcaaccaggtgaccgtgcccctactatgtcgctttcttggaaacgagtgaaaggatacatatctagtgaacaggatggaatggagcagaagacaatttttttaataccctctgatttagcatgtagactgctggggcagtcaatggatgagagtggattaccacagctgaccagttacgattgtgaagttaatgctcccatacaaggcagcagaaacctactgcagggtgaagaattactcagagctttggatcaagttaactgagcttttcctaatctcattcctttgattgttaatttttgtgttcagttgttgttgttgtctgtggggtttcgtttctgttggttgttttggacactggtggctcagcagtctatttatattttctatatctcatttagaggcctggctacagtactgcaccaactcagatagtttagtttgggccccttcctccttcattttcactgatgctctttttaccatgtccttcgaatgccagatcacagcacattcacagctccccagcatttcaccaatgcattgctgtagtgtcgtttaaaatgcacctttttatttatttatttttggtgagggagtttgtcccttattgaattatttttaatgaaatgccaatataattttttaagaaggcagtaaatcttcatcatgatgataggcagttgaaaattttttactcatttttttcatgttttacatgaaaataatgctttgccagcagtacatggtagccacaattgcacaatatattttcttaaaaataccagcagttactcatgcatatattctgcatttataaaactagtttttaagaagaaactttttttggcctatggaattgttaagcctggatcatgatgctgttgatcttataatgattcttaaactgtatggtttctttatatgggtaaagccatttacatgatatagagagatatgcttatatctggaaggtatatggcatttatttggataaaattctcaattgagaagttatctggtgtttctttactttaccggctcaaaagaaaacagtccctatgtagttgtggaagcttatgctaatattgtgtaattgatattaaacattaaatgttctgcctatcctgttggtataaagacattttgagcatactgtaaacaaaaaaatcatgcattgttagtaaaattgcctagtatgttaatttgttgaaaatacgatgtttggttttatgcactttgtcgctattaacatcctttttttcatatagatttcaataattgagtaattttagaagcattattttagaaatatagagttgtcatagtaaacatcttgtttttttttctttttttctatgtacattgtataaatttttcattcccttgctctttgtagttgggtctaacactaactgtactgttttgttatatcaaataaacatcttctgtggaccaggaaaaaaaaaaaaaaaaaaaaaaaaaaa

SEQ ID NO: 3669 - DNA, 1453 bp, Rattus norvegicus
  Genbank Accession No. NM_024360
gacggtatcgatcgaaccccttcgataacagcggaatcccccgtctacctctctccttggtcctggaatagcgctaccgatcacaaagtagccctaagacataataaaccctcaactgctccgtagtttttcttatgaaagccaagtaaaggggacgtaagcaaaaaaatatttttttttgcgtgaaggattccaaaaataaaattctctggggattgagaagaaagaaaaaaaggaaaatgccagctgatataatggagaaaaattcctcgtccccggtggctgctaccccagccagtgtcaacacgacaccggacaaaccaaagacagcctctgagcacagaaagtcatcaaagcctatcatggagaagaggcgccgggcaagaataaatgaaagtttgagccaactgaaaacactgattttggatgcacttaagaaagatagctcccggcattccaagctggagaaggcagacattctggaaatgacagtgaagcacctccggaacctgcagcgggcgcagatgaccgccgctctcagcacagacccgagcgtgttggggaagtaccgcgccggcttcagcgagtgcatgaacgaggtgacccgcttcctgtccacgtgtgagggcgttaacaccgaggtgcgcactcggctgctgggccacctggccaactgcatgacccagatcaacgccatgacctaccccgggcaggcgcaccccgccttgcaggcgccgccgccgccgcccccgtcaggacctggcggtccccagcacgcgccattcgcgccgccgccgccgcttgtgcccatccccgggggcgcggcgccccctcccggcagcgcaccctgcaagttgggcagccaggctggagaggctgccaaggtttttggcggcttccaagtggtgccggctcctgacggccaatttgctttcctcatccccaatggggccttcgcccacagcggcccggtcatcccggtctacaccagcaacagcgggacctcggtgggtcctaacgcagtgtcgccttccagcggctcctcgctcactgcggactccatgtggaggccgtggcggaactgaggggctcaggccactgctaatcataaactccctagcccacctctctcttctgacggacactaaatacgaacttggactttaggagagacttttataagtcggtggttactttgttgcttttttaaattctaaaaagttactttttgtagagagctgtattaagtgactgaccatgcactgcatttgtatatattttatatgttcatattggattgcgcctttgtattataaaagttgagatgacatttcgttttttacacgagatttctttttttatgtgatgccaaagatgtttgaaaaatgctcttaaaatatcttcctttggggaagtttatttgagaaaatataataaaagagtgaaggctttt

SEQ ID NO: 3670 - DNA, 1201 bp, Rattus norvegicus
  Genbank Accession No. NM_024363
agatggcggcagccgaggccgcgaactgcatcatggaggtttcctgtggccaagcagaaagtagtgagaagcccaatgctgaggacatgacatccaaagactactactttgactcctatgcccactttggcatccacgaggagatgctaaaggatgaggtgcgaaccctcacgtaccgcaactccatgtttcacaatcggcatctcttcaaagacaaggtggtgctggatgtgggctcgggcactggcatcctctgcatgttcgctgccaaggcaggggcccgcaaggtcattgggatcgagtgctccagtatctctgattatgctgtgaagattgtcaaagccaataagttagaccacgtggtgaccatcatcaagggcaaggtggaggaggtggagctgcctgtggagaaggtggacatcatcatcagcgagtggatgggttattgcctcttctatgagtccatgctcaacactgtgctgcacgctcgtgacaagtggctggcacctgatggcctcatcttcccagaccgagccaccctgtatgtgacagccattgaggaccgacagtataaagactacaagatccactggtgggagaatgtatatggctttgatatgtcctgcattaaagacgtggccatcaaggagcccctggtggacgtggtggacccaaagcagctggtcaccaacgcctgcctcataaaggaggtggacatctacacagtcaaggtggaggacctgaccttcacctccccgttttgtctgcaagtgaagaggaatgactatgtgcatgcactagtggcctacttcaacatcgagttcacccgatgccacaagaggaccggcttctctaccagtcctgagtctccatacacacattggaagcagactgtgttctacatggaggactacctaacagtgaagaccggcgaggagatttttggcactattggaatgaggcccaacgccaaaaacaatcgtgacttggactttaccatcgacctggacttcaagggtcagctgtgtgagctctcttgttccaccgactaccggatgcgctgaggaggtgccaggctggccctcctgcaaaagggggctcaggggctgggcttgggggatgggagggtacatcgtggcagtgtttttcataacttatgtttttatatggttgcgtttatgccaataaatcctcagctgac

SEQ ID NO: 3671 - DNA, 4590 bp, Rattus norvegicus
  Genbank Accession No. NM_024368
ggcacgagcagctgcaggtttgaagctgggtgagagcagctgcagcaggccaggctgggacgtttcgcctggagttagtctctccgtaactttttcctgggacagagggagaggtggctgttctttgttctcagatgtccctctaaataaaaccttttttattttatttattgttgggtgcccaggcagtcaggaagaagcactttcccactggacctccttctcagtccccctcttgattttgccccagggcagcagctacaaacagaaagccagctgtgagtgtcttcttgccaagcccagatctgcgagagatccgaagcaggactttatagctcttctcagtatggtgagttgtagctgatttggaagctggtggaggaggacagtggctctgtacagcttgtggggatctcccctgctactaccaccagccggaacaccatgggcagcgtctgtatgaggctttgggcataccttcagccttttctcccctgctggtcccaagaagcagacaaatcagtggtgattgagaatccaggggcctactgtcctccagaggccaatcgaagccaaggccagtattttgtggctctgtttgattacgaagctcgtactgcagaggacctgagcttccatgccggcgacaagctccaagtcttggacacttctcatgagggctggtggttggccagacatttggaaaagaagggacccggcttaggtcagcagctgcagggctacattccttccaattacgtggcagaggaccggagtctccaggcagaaccgtggtttttcggagcaatcaaaagagcagatgcagaaaagcaacttctgtattcagaaaaccagacgggcgcctttctaatcagagagagtgagagccagaagggtgacttctccctctcagttttagatgaaggtgttgtgaaacactacaggataagaaggttggatgaaggtggcttcttcctcaccaggagaaaaactttttcaaccttgaatgaatttgtgaactactacaccacaacaagtgatgggctgtgtgtcaagctggagaagccatgcttaaagattcaggtaccgaccccttttgatttgtcatataaaactgtggaccagtgggagatagaccgcaactccatacagcttctcaagcgactgggatctggtcagtttggagaagtttgggaaggtctgtggaataataccactccagtggctgtgaaaacgttaaaaccaggttcaatggatccaaatgacttcctcagggaggcacagataatgaagagcctaagacaccccaagctcatccagctctatgctgtttgcacattagaagatccaatttatattattacagaattgatgagacatggaagtctgcaagaatatctccaaaatgatggtgggtcgaaaatccgtttgactcaacaggtggacatggctgcacaggtagcttctggaatggcctatttggagtcccagaactatatccacagagatctggctgcaagaaatgtccttgttggtgaacataatatctataaagtagcagattttggacttgcaagagtttttaaggtggataatgaagacatctatgaatctaaacacgaaataaagctgccagtgaagtggactgcacccgaagccattcgtactaataaattcagcattaagtctgatgtgtggtcttttggaatcctgctctatgaaatcattacttatggcaaaatgccttacagcgggatgacaggtgctcaagtaattcatatgttgggtcaaaactacagactaccacagccatctaactgtccagagcaattctatagcatcatgatggaatgctggaatgtagagcccaagcaacgaccaacgttcgagaccctgcactggaaacttgaagactactttgaaccagactcttcctattctgatacaaacaacttcataaactaaacaacaaggaaaaagaagaaatataattaagatgtgaaaacgcggaactcaccagtccagaaatatcgtcttctcaaccaactgtgaaatcagcttattttgacatattcaggtggtaggatgaactcaaccatgcattctgtatcaaaaagatcatctgtgtattctattgagtaggaaacgctgcaggacagtataagatgatgtgtcatttttccctcactgcctggtaaaatcaatcacactaaatgaagttatttttcttccttttaagaactcctcacatttctatttattgtttgaaatgccgatcaagagaatcaacagatgacggtgtttactctgttactgttgtgggcattttcctgtttactgattagactggttattcattattcctcaaattgctgaatcccatcaggctgttattatgaaggaatttgattgctttgctgcacagcaggacctgtgctttgagatatttttttccctctcttttaaaatatcttgtaactacaatgatggcaaagcatgctaaatgactcgattgtacttgaagtaattgcacgtatttttcctgtgcataagaaagcgcaaggctgttgagaaaaagaattaaaatcttcctcattttgtaggaggaaatgatggagtttgctctatacctcagtatgtgtcatcagagaatcatctgcattagttttaatctcttaatgtcaggaatcagattgcaaagccgagtaattgttatgtgtgggaatataagggaactaccacactgcctaccaggtctgagaaatagatattaaagtggcttagggaagctaacagagagctggaggattgctgcagctttctaagtaataataaaaagttcctttggcacactggccgattttaaattggctgcaagacaggccaagccatgcttcagctcttgaggctaggaataatgtctaaacatggttatgaaatgtagctttcgtctgttaagactggatgcttttagtctcttcatttttttcctcaccttggtaagaacttccctgttttcttaggcaatgagtgtatcgaatgttctgcctcattggatagttagcaatacttctctaaagtcagctccatatattccatgatcttctaatgtgcagtgctgaatgaatgttccaaaaggaacattcatcctcctataggacagaagagaatatctagatggtcacaaggatcccctgggaattgaaaaacatgtcagttctttcaactaggaactaggaggcaaggcatcagggattaacttttaccagttcagtgatgtcaggaccctagctgcatttctgttgccatggtgaaaatcctgacaaaaagcaacttagaagaggcaaggtttattttagcttacaatcccatgtcattgtatcacagcaggaagtcactgtgacaagatcttgaagctgattacaccacatccacattctaagaggagagagacattcacggatagcttgcttcctgatttgtgctcaggtcaatttctacactcttaaaaagtttgggacagctttgcctaggtaatagcatgacacacaataggctggactttccaggatcaattaacgtaattaagacaatctctacagacatgtccaaaaggccagtataatatagagaatcattttcaactctttgcaactctctttctgggttattctaggtactgacaaattggatcacttaagctagccattagaccactaagactcaaactttcccatctatagcaagcattgtctgtgttcaactggtcacaggtaaccaccagtggtaagtgaggctccttgttacctttatattcaagaagataaaatgggcaacttaaccccttagaccattatcctaagcctaaacacacacacgcacgcacgcacgcacgcacgcacacacacacgcacacgtgcatgcacacacactcacctcattcccattttgggggataagcaggtggcaaacacaatcccgtgaccagtgaacaacaatcagcacagtgaatgtaaatgcaaagtgttgattggcttggaagaaagtctgcactgaagctgcgaatataaacttctccaagacaagtttcttatttgaaaaaaaaaattgagagattgattcctgagttggtgtccaatcacagaactattaaagatgaattaactgttggaattaatctatgtacatgtaagcattcatttatcatctcaaacatgtctgaactgacttgaatctgaatcatgtgtgaagaccacagagaaggaaaagcatttgtaagataaagtcgccattaatattttaatcagttgacagagcatggggtagcttccgttgtttatttcagattgcctggtcaaatgtaaccaaggagaagacattcaacaactaggtggctaaaatgaaatttttaaaaaaggactcgcttttcctgagttcatttcttcaggacagattctacttggggcgtatgtataaaggaggagcactagtctcatttcattgtacaaattcaaatgctttgcacttttatgtggtagctgataataataaatttgtagtaagttctggctttgaaatataaaaaaaaaa

SEQ ID NO: 3672 - DNA, 2411 bp, Rattus norvegicus
  Genbank Accession No. NM_024375
gccggcgcgggctcggctgagctccacgcggctcaggacagccgtgaccactgaccgggcggcgtggatgctcagcaagcagctctgccaccgcgagccaatcccgatacatcgagtcgggtcgtcggggctgtccgagtccccacagacactccagccgtggaccaggtgcacagccaacactgagccttccctgtctgccctcctgggctcagacccttcaccactgtcactcagccatggctccaggtcttgctcggatcagcttgaggtctcagctgctgcccttggtgccgctgctcctgctactgcggggcgcaggctgcggccacagagtcccctcatggtcctcactgccttcagcagctgacagtgtgcagagggacagggacctccagcagtcacccggggacgctgcagccgctctgggtccaggcgcccaggacatagtcgctgtccacatgctcaggctctatgagaagtacaaccggagaggcgctccaccaggaggaggcaacaccgtccgaagcttccgtgcccggctggatgtgatcgaccagaagcctgtgtatttcttcaacttgacttccatgcaagactcagaaatgatcctcacagccaccttccacttctactcagaacctccacggtggccccgggctcgtgaggtattctgcaagccccgagctaagaatgcatcctgccggctcctgaccccaggtctgcctgctcgcttgcacctaatcttccgcagtctctcgcagaacactgccactcaggggctgctccgcggggccatggccctgacacctccaccacgtggcctctggcaggccaaggacatctcctcaatcatcaaggctgcccgaagggatggagaacttcttctctctgctcagctggattctggagagaaggatctcggagtgccacggcccagttcccacatgccctatatccttgtctatgcaaatgacctggccatctcggagcccaacagtgtagcagtgacgctacagagatacgacccatttccagctggagactttgagcctggagcagcccccaacagctcagcggatccccgcgtgcgcagggcggcacaggtatccaaacccctgcaagacaatgaacttccagggctggacgaaagaccagcgcctgccctgcacgcccagcatttccacaagcacgagttctggtccagtcctttccgggcactgaaaccccgcaccgggcgcaaagaccgcaagaagaaagaccaggatacattcaccccctcctcctcgcaggtgctggactttgatgagaagacgatgcagaaagccaggaggcggcagtgggatgagcctcgggtctgctccaggaggtacctgaaggtggattttgcagacatcgggtggaatgaatggatcatctcacccaaatcctttgatgcctactactgtgctggagcctgcgagttccccatgcccaagatcgtccgcccgtccaaccatgccaccatccagagcatcgtcagagctgtgggcattgtccctggcatcccggagccatgctgtgtcccagacaagatgaactcccttggagtccttttcctggacgagaatcggaatgtggttctgaaggtgtaccccaatatgtccgtagagacctgtgcctgtcggtaaggtggcttcaagatggaaggcagacctccttcacccctgctgtgcagagtggcattcttggagccaggatttgactcgagcaagtcccaggtgctagacggagcttatagacagccaggctgagaccaagatctgtccaccgagccacagttctcccgttcttccgcgtcgtggtagctctgtaaggacttttttgagttcctggaaggaatctggaattcaccatggtctgaaatttgcccacatttttcaaggcctagaaatagcatgtgtccacagatgtcaaccccaaggcatctgtcctctcagaacctggaaagactatgcaaatctcggggcactccccgccccccacggcagtaaatgcttatttgaaaaccctcaagcggcatactagaaacagggcctaaagcatggcatggatgggtatttctcttacatttcactacacatgcttttatacatgcagtacgcaacatgtactcgagactgatttcttcttttaatatatgtattttgatttcaaagcaaagtggacagagttgacccccatgccccacagacgtaatactgaaagttaggtgtgggctgtttaaacatgcgtatgaaaaataatacagtgatatgctggaatactaaaaaataaccaagattctatatttttgtaaattatactttgtatactgtagattgtgagtgttctgtgtttttatggaaagctaataaattaaaggtacagtg

SEQ ID NO: 3673 - DNA, 2989 bp, Rattus norvegicus
  Genbank Accession No. NM_024381
cgggccctccgctctccctgctccgccctccgcagccctccacagtcaccccggagaccagccctgttaagctctcggctctgaagctgactgatttccatggcagccgcgaagaaagcagttctggggccattggtgggagcagtggaccagggtaccagctcgacacgttttttggttttcaattcaaaaacagctgaacttcttagtcatcatcaagtagaaataaaacaggaattcccaagagaaggatgggtagaacaagatccgaaggaaatcctgcagtctgtttatgaatgtatagagaaaacatgtgagaaacttggacagctcaatattgatatttccaacatcaaagctattggtgtcagcaaccagagggaaaccacagtagtctgggacaagctaactggagagccgctctacaatgctgtggtgtggcttgacctaagaacccaatctactgttgagaaacttagtaaaagaattccgggaaataataattttgtcaagtccaagacaggccttccacttagcacttacttcagtgcagtgaaacttcgttggctcctcgacaatgtgaaaaaggtccaagaggctgtcgaagaaaatagagctctttttgggaccattgattcatggcttatttggagtttgacagggggaatcaatggcggtgttcactgtacagatgtaacaaatgcaagcaggacgatgctttttaacattcattctttggaatgggataaagagctctgcgaattttttggaattccaatggaaattcttcccaatgttcggagttcttctgagatctatggcctaatgaaagctggggccttggaaggtgtgccaatatctgggtgtttgggggaccagtctgctgctttggtgggacaaatgtgcttccaggatggacaggccaaaaacacgtatggaacagggtgcttcttactgtgtaacacgggccataagtgtgtattttctgaacatggccttttgacaactgtggcttataaacttggcagagacaaacctgtgtattatgcattagaaggttctgtagctatagctggtgctgtaatccgctggttaagagacaaccttggaattattaagtcctctgaagaaattgaaaaacttgctaaagaagtaggtacttcttatggctgctactttgttccagcattttcagcgttatatgcaccttattgggagcctagtgcaagagggatcatctgtggactcactcagttcaccaataaatgtcatatcgcttttgctgcattagaagctgtttgttttcaaacccgagagattttggatgccatgaaccgtgactgtggaatcccactcagccatttgcaggtagatggaggaatgaccagcaataaaattcttatgcagctacaagcagacattctgtatattccagtagtgaagccctccatgcccgagacaactgctctaggagctgccatggcagctggggctgcagagggggttggtgtctggagtcttgaacctgaggatttgtcagctgtcacaatggagcggttcgaacctcagatcaatgctgaagaaagtgaaatccgttactccacctggaagaaagctgtgatgaagtccattggttgggttacaactcaatctcctgaaagtggtatcccataaataataccacctcataggaatcccaagatgcaagccctttaacgtgatatgaaaatctgactattctgtctcataatctaatgatactattcatagactctgatttttgcccataaagcactcgctgcatgatcctccaagcagacctatgccttgaaacaaagaaaatgcagcagaaagatccctccagaaacatttaatattttttttgatattgacagttaagattgggtcagtgacctttgggactgacccctgcctccactctcatgatgccctatactattccccttaaggtctaggatgaatttgtatcctgtccattgaaatgtgtcatccagtatattccagatgctgctggcctaaacttgtctgaggaaggggttgttactcacctcttcaaaatgagtggattcctgcttgtttgcttttaacagctcagatgtcttttctacatattagaagaccacaacaccactggatatttcaatggaagcggtctaaagcattattggataataacttgctattcttgttgcttagacattttctgacagtgtttgcccaaattgaatttttcaggtgttttacactgtctcactaattgtcatggcttcatggctttctgtctggatcttacagggaagaagaaactttctttttctgctttttttttcattcctcctttttatatttttactctgtatgtataacatacatacctatatattttatatgctgagggtagcccatttttaaattaagagcacattatattcagtaagttccgaattatctcagctgggaggaaagtaactgtgggatgttacagtaaaaaatcttccccccacatgattctaaaccccaaaaaaatttttccttggaattatgttttccaaaattgagcccccattgggggagtaatcccaaccccaaactaagtaggaaaaaatgtgtggataaaacccataaaatcccccccattttattacccaataaaaagatggtcttaatttctgggatgaaaaaaaaataatctccactttatttcataactggcccaaaaaaaaactatcattgcaaatgcctcccagtgaaaccaataacttctcaaatatttagaattattggttataactcactaacctagtttcctaacatcaatttaaaatttgatttatagtaaagaaataagaaaatgatgcttctaattattttgttttgtccttttggaatggaaaatattgatatattaatagaaaaagttttatttggaattaatggtagattatatttcttattctgattgtgcccg

SEQ ID NO: 3674 - DNA, 2093 bp, Rattus norvegicus
  Genbank Accession No. NM_024382
ctctggtctcatctctgccacgccactgctcagaggcacagagtgagcaacagtttggtagcgctgagtccatccactggaaattctcctcctgtctcagcggctttagctctgcagaaatgaagcatccagcctacactctccttctctctctcatcatgtctatgtgtgctgggagcaaaggccttgctgagcagctaactaaggaaaacctgaccgtgtccctcctgcctcctaacttccacaaagagaacacagtcaccaatgactggattccagaaggagaggaagatgacgactacctggacctggagaagctgctcagtgaagatgacgactacatctatgttgtcgatgcagtttccccaacagactcagaatcaagtgctggcaacatcctgcagcttttccaaggcaaaagccggatccagcgccttaacatcctcaatgcaaagtttgccttcaacctttaccgagtcctgaaggaccaggctacctcttctgataacattttcatagcacccgttggcatttccactgccatggggatgatctccttaggtttgaggggagagacccatgaggaagtacactcagttctacacttcaaagactttgtcaatgctagcagcaagtacgaggtgacaaccattcacaacctctttcgaaagctgacccatcgcctattcagaaggaattttgggtacacacttcagtcagttaatgacctttatattcagaagcagtttcccatacgggaggacttcaaagctgccatgagagagttttactttgctgaggcccaggaggctgacttctcagatcctgccttcatatcaaaggcaaacagccacattctgaagctcaccaagggcctcataaaagaagctttggagaatacagactctgctactcagatgatgattctgaactgcatctacttcaaaggagcttggatgaataaattcccagtagaaatgacgcataaccacaacttccggctgaatgagagagaagtagtaaaagtctccatgatgcaaactaaagggaacttccttgcggcaaatgaccaggagctagactgtgacattctgcagctggagtatgtagggggcatcagcatgctaattgtaattccacggaagctgtcgggaatgaagactcttgaagcacagcttacaccccaggtagtggagagatggcaaaaaagcatgacaaacagaacccgagaggtacttctgcccaagtttaagcttgagaagaattacaacctggtggaggtcctcaagtccatgggaatcacaaagctcttcaacaagaatggcaatatgtcaggcatctcagaccagaggatcatcattgatctgttcaagcaccagagtaccatcacagtgaatgaagagggtacccaagctgcagctgtaactacagtggggtttatgccgctgtctacccaagtcagattcactgttgaccgtcccttcctgttcctagtgtatgagcaccgaaccagctgtctgctgttcatgggaagagtggccaaccctgccaagtcttaatggtgctggtctgggcacctgatgtagtttggggacactctgtaatcctgttttcattctaagaggacagagatattttgatattgataatctatgtagtttgagataataatctaacagtaaacagtgtcataagtgcacagatgttaatgcaactaatggtcgtgccagctattccctagaggtcctagacacagactgcctcagcgccaacgcctctgtcactgagaatgggcagagtggagctgacactttctcctcagttagccgtaccagtcaaggtgtctcctcagccaggcccctccatatggatggtactgaggaactctcacccttccagggaggatgtccaaggagcaccattcttgcctagtggaaaagaaacctcaacatgtctgagacatttggacttaattcaaggctgaaccttttaaattcatgtaaatatcatctgttctgctttgtgtcaatagggctaccatagcctattctagagacaaataaacaaccatatttactaagcaaaaaaaaaaa

SEQ ID NO: 3675 - DNA, 543 bp, Rattus norvegicus
  Genbank Accession No. NM_024384
gagtcctctggatcctatttgcctggcactgagggaagcacgccctggaggtattgtccggtggcgaggatggagctgtacggctttgggatctccgtatagccaaagaggtccagaccatcgaagtctacaagcatgaggagtgctcaaggccccacaatgggcgctggattggatgcttggcaactgactcagactggatggtctgtggagggggcccagccctcaccctctggcacctcaggtcttccacacccactacggtctctcccattcgagcaccacagaaacatgtcaccttctacaggacctgatctgtctgctggccagggctgttgtgtcaatcactggcaactgagtgggagcttaaggccaggtgctggctcctccccaggactgctcagcctgagcctcaaccagcagccagcagccccagagtgtaaggtctgactgcatcaggcaacagctgtcgagtagacgtctttaccaacctgggctaccgagccttctcacactgtccttctgagcgtcgacaatccgtat

SEQ ID NO: 3676 - DNA, 1603 bp, Rattus norvegicus
  Genbank Accession No. NM_024385
gcggagcagccatgcagttcccgcacccggggcccgcggctgcgcccgccgtcggagtcccgctgtacgcgcccacgccgctgctgcagcccgctcacccgacgcctttctacatcgacgacatcctgggtcgcgggcccgccgctcccacgcccactcccacgctgccgtcccccaactcctccttcaccagcctcgtgtcctcctaccggaccccggtgtacgagcccacgccggtccaccccgccttctcgcatcaccccgccgccgcgctggccgctgcctatggccccggtggcttcggaggccctctgtacccgttcccgcggacggtgaacgactacacgcacgccctactccgccacgaccccctgggcaagcccttgctctggaaccccttcctacagcgacctctgcacaaaaggaaaggcggtcaagtgaggttttccaacgaccagaccatcgagctggagaagaagttcgagactcagaaatacctctccccacctgagagaaagcgtctggccaagatgttgcagctcagcgagagacaggtcaaaacctggtttcagaatcgcagagctaaatggagacgactgaagcaggagaatcctcaaagcaataaaaaggatgagttggacagtttggacacttcctgtgaccagggccaagacttgcccagtgaacagaataaaggtgcctctttggacagttctcagtgttcaccctccccagcctctccggaagaccctgaatcagagatctcagaggattccgaccaggaagtggacatcgagggtgataaaggctattttaatgctggatgacagtcatcggccgtgaccatgttcagagactggactttagaataccgttctgctacagacaaactgggaaattctgagagaaagaagtaccattcttctagcgttttgaaaatatttggcacggcgtgcattgaaaccatacttttggtttagcgtacgttttccgtaccggtgttaagttgttttgataaagtggctaaatgtgacttcgtttttaaaaagtgaattctttctatttgtgagaagtaatttgaacttttgcctgaagcttaaactataactttaaaggttttgggcggctgttctcgaatgacttttcccaaatgtgtagctgttccctcgacttcagaggtgcacttagaaagggggccagcatttggggatccatggaatgctttcaaagagcacacttggtttttacgtgacaccttacattgctgccttaactccaaagccggttcagagcacttggcccctggtgtctgttctcataagcaagatagttgataagattcttacaatcttgttttgctcggccagtgcctctgaccctggtattaagggatgacgcagtctctacaggcagggaaactgactcacttgtgactgatctcacatgaactagaaatagcaggacaattaaatgtaagtagattgtagatagtgtgttttatagaaaccgtgtctatagcatgtgtatagaattattcgttgtaaaaaaaaccctccccaaatgtttgatttttttttttaatttaatgaattaactttcatat

SEQ ID NO: 3677 - DNA, 1390 bp, Rattus norvegicus
  Genbank Accession No. NM_024386
gagactccgggcgaagatggcgacagtgaggaaggctttcccacagaggctggtgggcttggcgtccctccgggctgcgagcacctcctccatgggcaccttgccgaagcgggtgaagatcgtggaagtcggcccccgagatggtctgcagaatgaaaagagtatcgtgccgacgccagtgaaaatcaaactgatagacatgctatccgaagcagggctcccggtcatcgaggccaccagctttgtctctcccaagtgggtgccgcagatggctgaccactctgacgtcttgaagggcattcagaagtttcccggcatcaactacccggtcctgacaccaaacatgaaaggctttgaggaagcggtagctgcaggtgccaaggaagtgagcatctttggggctgcgtccgagctcttcacccggaagaatgtgaactgctctatagaggagagtttccagcgctttgatggggtcatgcaggccgcgagggctgccagcatctctgtgagagggtatgtctcctgtgccctcggatgtccctacgaggggaaggtctccccggctaaagttgctgaggtcgccaagaagttgtactcaatgggctgctatgagatctcccttggggacaccattggcgtaggcacgccaggactcatgaaagacatgctgactgctgtcctgcatgaagtgcctgtggccgcattggctgtccactgccatgacacctatggccaagctctggccaacacgttggtggccctgcagatgggagtgagcgttgtggactcctcggtggcaggactcggaggctgtccctatgcaaagggggcgtcaggaaacttggctaccgaggacctggtctacatgctgactggcttagggattcacacgggtgtgaacctccagaagctcctagaagccggggacttcatctgtcaagccctgaacagaaaaaccagttccaaagtggcacaggccacctgcaaactctgagccccttgttcacctaaaccggaactgtgggagttgggtgtacacaatgattcctggatggggaaatggaatgaaggcaaatgagccggcctcacagaggtccctctcctacatagaagggctagagctgccagcacgcccggaccagctccccagagctgcgtgcctaagcactgcttggctggccctgggtgagtccactagccagcagagctgacatccatgtgccacgaccgcgggtcccatgttctacctctgaggacagcagcgcctttgctgaaatggtgggctcaatctactgcggtggccgactgccaactccagcgtctctgggaaatctctgtacgtgattcttgaaaacagcttatgtaattaaaggtttaattttctaatatc

SEQ ID NO: 3678 - DNA, 1289 bp, Rattus norvegicus
  Genbank Accession No. NM_024391
cgcggccgcttctcactggcccagagcaagtgaagaccagtggagaatgaacccgttttcctctgagtcagcatggctctgcttgactgccactgcggtgctggggggcatgcttctctgcaaagcctggagttcagggcagctaaggagccaggtggtgtgtctggctggcctctggggaggtgcctgcctgctcagcctgtccctcctctgcagcttgttcctcttatcggtgtcctgcttcttccttctgtatgtgagttcatctgaccaagacttgttacctgtggatcaaaaggctgtgctggtgacaggtgccgattccggtttcggtcatgctttggccaagcacctggacaagctgggtttcacagtgtttgctggagtgctggataaagagggcccaggagcggaggaattgaggaaaaactgctctgagcgcctttcggtgctccagatggatgtcaccaagccagagcagataaaagatgttcacagcgaagtcgcagagaagatacaagacaaaggactgtgggctgtggtcaacaatgctggggtcttgcactttccgatcgacggggaactcattcccatgaccgtgtacagaaaatgcatggcagtgaacttcttcggagccgtcgaggtcaccaaggtgtttctgcctctacttagaaagtccaaggggaggctggttaacgtcagcagcatgggagccatgattccatttcagatggtggccgcctacgcctccacgaaggcagctataagcatgttctcagccgtcatcaggcaagagcttgccaaatggggagtcaaagtcgtgaccatccatcctggaggcttccaaacaaacatcgtaggctcacaggacagttgggataaaatggagaaggagatcctggaccacttttccaaagagattcaggagaactatggacaggaatatgtccatacgcagaagctcgccctcccggtcatgagagagatgtccaacccggatatcacccctgtgctgcgggacatccagcacgccatttgtgccaagaacccctcttccttttattgctcagggagaatgacttacctgtggatctgcttcgcggcctactccccgatcagcttattggactatattttgaaaaactattttactccaaaactcatgccaagagctttaaggacagcaagttagaagaacaagggcccgggtagggtgggaaatgccacatgcttaggatgaaagggaaacctcttattaaactaactttctacctcaaaaaaaaaaaaaa

SEQ ID NO: 3679 - DNA, 2535 bp, Rattus norvegicus
  Genbank Accession No. NM_024392
gagcagtaccccggccactgccagtgtgtgcgtggtgcaggatagactcatggcttcgcctctgaggttcgacgggcgtgtggtcctggtcaccggcgccgggggagggttgggcagagcttatgccctggcttttgcagaaagaggagcattagttgttgtgaatgacttaggaggggacttcaaaggcgttgggaaaggctcttctgccgcagacaaggtcgtggaagaaataagaaggagaggcgggaaagcggtggccaattacgattcaggcgaagcaggcgagaagcttgtgaagacagcactggacacattcggcagaatagatgttgtggtgaacaatgctgggatcctgagggaccgttccttctctaggataagtgatgaagactgggatataattcaaagagttcatttgcggggctccttccaagtgacccgggcagcatgggatcatatgaagaagcagaattatggaagaatcattatgacggcctcagcttctggaatatacagcaactttggccaggcaaattatagtgctgcaaagctgggccttctgggtctcgccaatactctcgtgattgaaggcaggaagaacaacattcattgtaacaccattgccccaaacgctgggtcacggatgacagagacggtgatgccagaagacctcgttgaagccctgaagccagagtatgtggcaccgctggtcctttggctttgccatgagagctgtgaggaaaatggtggcttgtttgaggttggagcaggatggattggaaaattgcgctgggagaggaccctgggagccattgtcaggaagcggaatcagcccatgactcccgaggcagtgagggacaactgggtgaagatctgtgacttcagcaatgccagcaagccgaagagcattcaagagtccacaggtggtataatcgaagttttacataaaatagattcagaaggaatctcacaaaatcacaccggtcaagtggcatctgcagatgcatcaggatttgctggcgtcgttggccacaaacttccttcattttcttcttcatatacggaactgcagtgcattatgtatgccctcggagtaggagcttcagtcaaaaatccaaaggacttgaagtttgtttatgaagggagtgctgacttctcctgtttgcctacatttggagtcattgtcgctcagaagtccttgacgagtggaggcttagcagaggttcctgggctgtcaatcaactttgcaaaggttcttcatggggagcagtacttggagttgtataagccacttccccgatcaggggaattaaaatgtgaagcagttattgctgacatcctggataaaggctctggcatagtgattgttatggacgtctattcttattctggcaaggaacttatatgctataatcagttctctgtcttcgttgttggctctggaggctttggtggaaaacggacatcagaaaaactcaaagcagctgtagccgtaccggatcggcctccagatgctgtactgagagataccacttcactgaatcaggccgctctgtaccgcctcagtggagactcgaatcctttacacattgacccgagctttgcgagcattgccggttttgagaaacccatattacacggattatgtacttttgggttttctgcaaggcatgttttacagcagtttgcggataatgatgtgtcaagattcaaggccattaaggttcgttttgccaaaccagtgtatccaggacaaactctacaaactgagatgtggaaggaaggaaacagaattcattttcaaaccaaggtccaagagactggagacattgtcatttccaatgcatatgtggatcttgttcctacatctggagtttccgctcagacaccttctgagggtggagcactgcagagtgctcttgtatttggggaaataggtcgacgcctcaaggatgttggacgtgaggtggtaaagaaagtaaatgctgtatttgaatggcatatcacgaaaaatgggaatgttgcagccaagtggaccattgacctgaagaacggctctggagaggtttaccaaggccctgccaaaggctctgctgacacgaccatcacaatttctgatgaggatttcatggaagtggtcctgggcaagcttaacccacagaatgccttcttcagtggcagactgaaggcccgaggaaacatcatgctgagccagaagctacagatgattctgaaagactatgccaagctctgaaggacccactgcgtgctttaataaaaccagaatcattacgttctgtctacgcagtcatgctccagccttctttgaaacgatccacggtaatgtgcagcagaaatcgcttaacattttcagattcagataactttcagattttcattttctactaatttttcacatattatttttataaggaactgtaatctagctagcaaataattgttctgttcatagatctgtatcttaataaaaaaaaagtcaaccgaaaaaaaaaaaaaaaaaaaaaaaaaaaa

SEQ ID NO: 3680 - DNA, 2230 bp, Rattus norvegicus
  Genbank Accession No. NM_024394
gaattcgggcagaccctcggtctccaaagctacatagacacttggattcaagagggcacgagaaaagggggtcttggtgatcctcccagtacaccccagaaagccaggacacccctggcagcaccactccttcagggtcagccttagtgccctgtccaagagcactgctgtgaccacagggctgcaggtaccaggacaaaaggcctagttgctctcagagagccagtactgtcctaggcccagagctgattcgactctgaaactggggcaaggaagggtcaggatggacagtggggatggaagggggagctccccaaatgtccagggcagaagaacagcaagtctccatggagagagccacactgttcctttccgtgctgatagcccagggagaaggcagccggaggagggccacccaggcccacagcaccacccagcctgctctgctgaggctgtcagatcacctcctggctaactacaagaagggagtgcggcctgtgcgggactggaggaagcccaccctggtctccattgatgtcatcatgtatgccatcctcaacgtggatgagaagaaccaggttctgaccacctacatatggtaccggcagttctggaccgacgagtttctacagtggactcctgaggacttcgacaatgtcaccaaattgtccatccccaccgacagcatctgggtccctgacatcctcatcaatgagtttgtggacgtggggaagtctccaagcattccttatgtgtatgtgcaccatcaaggtgaagtccagaactacaagcccctacagctggtgaccgcctgtagccttgacatctataacttcccgttcgatgtgcagaactgctctctgaccttcaccagctggctgcataccatccaggacatcaacatttccctgtggcgaacaccagaagaagtgaggtcggacaagagcatcttcataaatcagggcgagtgggagctgctgggggtgttcaccaaatttcaggagttcagtatagaaaccagtaacagctatgcggaaatgaagttctacgtggtcatccgccggcggcctttattctacgcagtcagcctcttgctgcccagtatcttcctcatggtcgtggacattgtgggcttttgtctgcccccggacagtggtgagagagtgtctttcaagatcacgctccttctgggatactcagtctttctcatcatcgtgtcagacacactgcctgcaacggccatcggcactcccctcattggtgtctactttgtagtgtgcatggctctgctggtgataagcctcgctgagaccatcttcattgtgcagctggtgcataagcaggatttacagcgccctgtacctgactggctgaggcacctggtcctagacagaatagcctggctgctctgcctaggggagcagcccatggcccataggcccccagccaccttccaagccaacaagactgatgactgctcagccatgggaaaccactgcagccatgtcggaagccctcaggacttggagaagacctcgaggagcagagatagccctcttccaccaccaagggaggcctcgctggctgtgcgtggcctcttgcaagagctgtcctccatccgccactccctggagaagcgggatgagatgcgggaggtggcaagggactggttgcgggtgggatatgtgctggacaggctgctgtttcgcatctacctgctggccgtgctggcttacagcatcaccctggtcacgctctggtccatttggcattattcctgagtgggtacagcctggcagggaggggatgtgagtcctgcatcctgtttccaacaccaattcatctgagcaaccccagtccccttgtcccctaaacttagcactgaagacccggtcagaccccccgacttcgctatcatggctttaaagcatgatatcctagatcaagaggaaccaagactcctctaacttattaagacatcaagccctggttccttttccagtacttctgtgattatggcccttgggatggctcatttccacagtttttttttcctttttgatcagaggaaagcaaattctcttgcctaggtgcctgagacgtctgtgcctgttttatccaggccccagtggcttcttcttcagctcacttgtgggtacttccctagcgctcagcctcatcaaccaacggggggaggggataataaaatgctatgatatcccccgaattc

SEQ ID NO: 3681 - DNA, 2744 bp, Rattus norvegicus
  Genbank Accession No. NM_024398
acaaaatggcgccttacagcctactggtcacccggctgcagaaggccctgggtgtgcggcagtaccatgtggcctctgccctgtgccaacgggccaaggtggccatgagccactttgagcccagtgagtacatccgatatgacctgctagagaagaacattaacattgtccgtaaacggttgaaccggcctcttactctctcggagaagattgtgtatggacacctggatgacccagccaaccaggagatcgagcggggaaagacatacctgcgtttacggcccgaccgggtggccatgcaggatgcaacagcccagatggctatgctacagtttattagcagtgggctgcccaaggtggctgtgccatcaaccatccactgtgatcatctgattgaggcccagcttgggggtgagaaagacctacgccgggccaaggacataaaccaggaagtatataatttcctggcaactgccggtgccaagtatggtgtgggcttctggaggcctggatctggaatcattcaccagatcattctagaaaactatgcataccctggagttcttctgattggcactgactcccacacccccaatgggggtggcctgggaggtatctgcattggagtagggggtgctgatgctgtggatgtcatggctgggatcccctgggagccgaagtgtcccaaggtgattggcgtgaagctgacgggcaccctctctggttggacctcacccaaagatgtgatcctgaaagtggccggcatcctcacagtgaaaggtggcacaggtgccattgtggaataccatggacctggtgtcgactccatctcctgcactggcatggcaacaatttgcaacatgggtgcagaaattggggccactacaccagtgttcccctacaaccacaggatgaaaaagtacctgagcaagacaggccgagcagacattgccaacctagcagaagaattcaaggatcacttagtgcctgaccctggctgccagtatgaccaagtgattgaaattaacctcaatgagctaaagccacatatcaatggaccctttacccctgacttggctcacccagtggcagatgtgggcactgtggcagagaaggaagggtggcctctggacatcagagtaggtttgattggcagctgcaccaattcaagctacgaggacatgggacgatcagcagctgtggccaagcaagccctggcgcacggactcaagtgcaagtctcagttcaccatcaccccaggctctgagcagatccgagccactatcgagcgggatggctatgcacagatcctaagggatgtgggtggaatcgttttggccaatgcctgtggcccttgcatcggccagtgggacaggaaagacatcaagaagggggagaagaatacaatcgtcacctcctacaacaggaacttcacaggccgtaatgatgcaaatcctgagacccatgcctttgtcacatccccagagattgtcacagccctggccattgcgggaacccttaagttcaacccagaaactgacttcttaacaggcaaggatggcaagaagttcaagttggaggctccagatgcagatgagcttccccgatcggactttgatccagggcaggacacataccagcacccccctaaggacagcagtggccagcgggtggatgtgagccctaccagccagcgcctgcagctcctggaaccttttgacaaatgggatggcaaagacctagaggaccagcaaatccttatcaaggtcaaagggaagtgcactactgaccacatttctgctgccggcccctggctcaagttccgtgggcatctggataacatctctaataacctgcttatcggtgccatcaacatcgaaaatggcaaagccaattctgtgcgcaatgctgtcacccaggagtttggccctgtacctgacactgctcgctactacaagaaacatggcatcaggtgggtgatgattggagatgagaactacggtgaaggctcaagccgggagcacgcagcactggagcctcgccatctggggggccgagccatcatcaccaagagcttcgcaaggatccatgaaaccaatctaaagaagcagggcttgctgcccctcacctttgctgacccctctgactacaacaagattcatccagtggacaagctgaccattcaaggcctgaaggactttgcccctggcaagcctctgaactgcatcatcaagcaccccaatgggacccaggagaccatcctgctgaaccacactttcaacgagacacagatcgagtggttccgtgcaggcagcgccctcaacaggatgaaggagctgcagcagtgaggagccaggctggctcactgtcccactctggaccctgctggggcaaaggtgcaggcccatgtgcatccacagagcctcatctggtctgtccagcatgaccacctgctctaagatggtgaccagacctgcttcttgccctccctatcctcagcccactgagtgaaccaacatggagggcacttaagatgatggagggcacttaagatgatgtcccagccccgccttcctgttcagtttggtttgtctttgagcaacccatgcaactgtatttatttttgatgacagcactccctctacagaagtttttattctgcctaatcatttcactggtggctgaaggattttagagaaacttgttcttataaggaaaaaaaaaaaaaaaaaaaaaaaaaaaaa

SEQ ID NO: 3682 - DNA, 1173 bp, Rattus norvegicus
  Genbank Accession No. NM_024403
tcgagttaagcacattcctcgataccagcaaatccctacaacatgaccgagatgagcttcctgaacagcgaagtgttggcgggggacttaatgtcccccttcgaccagtcgggtttgggggctgaagaaagcctaggtctcttagatgactatctggaggtggccaagcacttcaaacctcatgggttctccagcgacaaggcgggctcctcagaatggctggctatggatgggttggtcagtgcctcagacaccggcaaggaggatgccttttccgggacagattggatgttggagaaaatggacctgaaagagtttgacttcgatgctctgtttcgaatggatgacctggaaaccatgccagatgagcttttggccacgttggatgacacatgtgatctttttgcccctctagtccaagagactaataaggagccccctcagacagtgaacccaattggccatctcccagaaagtgtaataaaagtcgaccaggctgccccctttacattcttgcagcctcttccctgttccccagggtttctgtcttccactccagatcattcctttagtttagagctgggaagtgaggttgatatctctgaaggagataggaagcctgactctgctgcttatattactctaacccctcagtgtgtaaaggaggaagacactccctctgatagtgacagtggcatctgtatgagccctgagtcctacctgggctctccccaacacagcccttccacctccagggccccaccagacagtctgccttctccaggtgttcctcgtggttctcgacccaaaccttatgacccacctggagttagtgtgacagctaaagtgaagactgaaaagttggataagaagctgaaaaagatggagcaaaacaagacagcagctactaggtaccgccagaagaagagggctgagcaggaagccctcactggcgagtgtaaagagctagaaaagaagaacgaggctctgaaagagaaggcagattctctcgccaaagagattcagtatctaaaagacctgatagaagaggtccgtaaggcaagggggaagaagagagttccttaatagggtagtcaggtgctttgtgcttgtacatagtcttgtgatgctgtgtttgctgtaataaattattttgtagtgaaagtaaaaaaa

SEQ ID NO: 3683 - DNA, 1240 bp, Rattus norvegicus
  Genbank Accession No. NM_024404
tcgcggcggcggcgggtgtcgtctcggcggcggcggaggcagtagcactatgtcggaggagcagttcggaggggacggggcggcggcggcggcaacggcggcggtaggcggctcggcgggcgagcaggagggagccatggtggcggcggcgcagggggcagcggcggcggcgggaagcgggagcggcggcggctctgcggccggaggcaccgaaggaggcagcaccgaggcagagggagcgaagatcgacgccagtaagaatgaggaggatgaaggccattcaaactcctccccacgacacactgaagcagcgacggcacagcgggaagaatggaaaatgtttataggaggccttagctgggacaccacaaagaaagacctgaaggactacttttccaaatttggggacgttgtagactgcactctgaagttagatcctatcacagggcgatcaaggggttttggctttgtgctatttaaagagtcggagagtgtagataaggtcatggatcagaaagaacataaattgaatgggaaagtcattgatcctaaaagggccaaagccatgaaaacaaaagagcccgtcaaaaaaatttttgttggtggcctttctccagacacacctgaagaaaaaataagagagtactttggtggttttggtgaggttgaatccatagagctgcctatggacaacaagaccaataagaggcgtgggttctgtttcattacctttaaggaagaggaaccagtgaagaagataatggagaagaaataccacaatgttggtcttagtaaatgtgaaataaaagtagccatgtcgaaggagcagtatcagcagcagcagcagtggggatctagaggagggtttgcaggaagagctcgcggaagaggcggtggccccagtcaaaactggaaccagggatatagtaactattggaaccaaggctatggcagctatggatataacagccaagggtacggtggttatggaggatatgactacactggttacaacagctactatggatatggtgactatagcaatcagcagagtggttatgggaaagtatccagacgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttctatcaagttcccg

SEQ ID NO: 3684 - DNA, 3460 bp, Rattus norvegicus
  Genbank Accession No. NM_024405
ccagacaggtagtagttaaccctgaaagtcaggacagtaagtggcccgcccgctgagccgccgctgagcgcatgggcctcgccgggccgggagccaggccccgggccgcgcctccacagccgccgcgcgctggagagattgattcccttgggagctgtaagtactgaggtattagggtgcagcgctcattgttcactgatgcagagtcccaaaatgaatgtccaggagcagggtttccccttggacctcggagcaagtttcaccgaagatgccccccggcccccagtgcctggagaagagggagaactggtatccactgattcgaggcctgtcaaccacagtttctgctctgggaaaggtaccagcattaaaagtgagacctcaacagccaccccaagacgttcagatctggatctgggatatgagcctgagggcagtgcctcccccaccccaccatacttgaggtgggctgagtcactgcattccttactggatgaccaagatgggatcagcctgttcaggactttcctgaagcaggagggctgtgctgacctgctggacttctggtttgcctgcagtggcttcagaaagcttgagccttgtgactcaaatgaggaaaagaggctgaagctggcaagagccatctaccgaaagtacatcctggatagcaatggcattgtgtccagacaaaccaagccagccactaagagcttcataaaggactgcgtcatgaagcagcagatcgatcctgccatgtttgaccaggcacagacagaaatccagtccaccatggaggagaacacctacccttccttccttaagtctgacatttatttggagtacacaaggacaggctcagaaagtccaaaggtctgcagtgaccagagctcagggtccgggacagggaagggcatgtctggatacttgcccactttgaatgaagatgaagaatggaaatgtgaccaagatgcagatgaggatgatggccgagactctgtcccccccagcaggctcacccagaagctgctattggagactgctgccccgagggccccctcaagtagacggtacaacgaaggcagagagctcaggtatggatcttggagggagcctgtcaacccctactatgtcaactctggctatgccctggccccagccaccagtgccaatgacagtgagcagcagagcctgtccagtgatgctgacactctatccctcacggacagtagcgtggatggaatccccccatacaggatccgtaagcagcaccgaagggagatgcaggagagtgtccaagtcaatgggcgggtacctctacctcacattcctcgcacttaccgaatgccaaaggagatccgggtagagccacagaaatttgctgaagagcttattcaccgtctagaggctgtccagcgtactcgagaggctgaagaaaagttggaggaacggctgaagcgtgtacgcatggaggaagaaggggaagatggggaaatgccttctggccccatggcaagtcacaagctgccttctgtcccagcttggcaccatttcccacctcgctatgtggatatgggctgctccggactgcgggatgcccatgaggagaatcctgagagcatcctggatgagcatgtgcaaagggtcatgaggacacctggctgccagtcacctggcccaggccaccgctctcctgacagcgggcatgtggccaagactgcagtgctagggggtacagcatctgggcatgggaagcatgctcctaagttagggttgaagctggattcagctggcctgcaccaccataggcacgtccaccaccacgttcaccataattcagctagacccaaggagcaaatggaggctgaagctgcccgcagggtccagagcagcttctcatggggcccagaaacacatggtcatgccaagccccgaagctattcagagagcacaggcaccaaccccagtgctggggacttggcctttggtggtaaagctagtgcaccctccaaaagaaacaccaagaaggctgaatctgggaagaatgccagtgctgaggtacccagtaccacagaggatgcagagaagaaccagaagatcatgcagtggatcattgagggggagaaggagatcagtagacaccggaaggcaggccatgggtcttctgggatgaggaagcagcaggcccatgaaagctccaggcccttgtccattgaacgtcctggggccgtgcacccctgggtcagtgctcagcttcggaactctgtccagccttctcatctcttcatccaagatcccacaatgccacccaatccagcccctaatcctctgacccagctggaagaggcccgcaggcgtttggaggaagaagaaaagagagcaaacaaactgccctccaagcagaggacaaaatcacaaagaaaggcaggtggcgggagtgcaccaccatgtgacagtatcgttgtggcctactatttctgtggtgaaccaataccctaccggaccctggtgaggggccgtgctgtcaccctgggccagttcaaggagctgctaaccaagaaggggagctacagatactactttaagaaagtgagtgacgagtttgactgtggtgtggtatttgaggaagtacgggaagatgaggccatcctgcctgtctttgaagaaaagatcatcggcaaggtggaaaaggtggactgagccctgggcagcacacccagagctaccatcactactgtgcagtggcatccgccaggtgggcagccttgtcctcaggagcttggtgtagggaacaacacaagattgtcacgagctcttccaggggatgaggctgggggcctcagatgtctgctaatttctatccctctggctctgggaaagtgggggtgggagggtcatcctactgagtggttccatgggtttctctgttttgctgttcaaagggaaagccgcacctacccccacactacccctgaagcaataccaggagccatctcatgaccctcagcagctcttgcttctaaatacagtctgacctagggatactttgccctgggcttgtatcctagtgtcctcttctctctctgggacctatccactgcacctcattgggctcaggtccaggagcaggggatcctgtgggggcctctgtatattgtacatgtcactgagtgccttcaacatagctgtctcttgcctgccactgtgtgaatctggcggctgaatatctcaggcctctttgcctgtctccagccaccagcttggttcagcagagggggggggtctggtcccttccaagtgtccatgtaaatatgtacatttctcaggccagggccagcaggggataccctgagcccgtttttcatgcgatgacttgttacaattattcttttcaaaggtacttggataataatgaaataaaatgtttttgaacctccaaaaaaaaaaaaaaaaaaaaaaaaaa

SEQ ID NO: 3685 - DNA, 2939 bp, Rattus norvegicus
  Genbank Accession No. NM_024483
ggatccccgcagccgctggacgcacggagccccttcgctggccggtagcttacgctcgcgccggccgccccctcctccctctcgaccgcccctcctccgtcccgcccccgcgcggagtccccagcgctgcagaggccgccgcctgcactgccactccatgagccgccgctctcccggacacgcttgcagaggggagcagggagccggccccggcccttctttccttgtgactccgcagccaccgccggagtcggttccctcacaccaacgttcccattgggaccttcacggcccggtgacctctgtcctgctctacctgcagcactgctcccctgcagcccctctgccgcgggaacttgggcaggaccgacgggactggcacacggggctggctcgggcgctgcggcgatgcccgcgggctctctcccctccacttgctcgccctgtgcctgggctcgggccccgacctgcgccgtgagatgactttccgcgacatcctgagcgtcactttcgaaggaccccggtcgagcagtagcactgggggctccggcgcgggcggcggagctggcacggttggccccgagggtggggcggtgggcggcgtgccgggcgctacaggcggcggcgctgtggtgggaaccggcagcggcgaggacaaccagagctccacgggagaaccgggagccgcggcgagcggcgaagtaaatggctcggcggccgtcggggggctagtggtgagtgctcagggcgtgggagtgggtgtcttcctggcggccttcatcctcaccgctgtggcgggcaacctgctggtcatcctttcggtggcctgcaaccgccacctacagacggtcaccaactatttcatcgtgaacctggcggtggctgacctgcttttgagtgcagctgtgttgcccttctcagccactatggaggttctaggcttctgggccttcggccgaaccttctgcgacgtgtgggccgcggtggacgtgctgtgctgcactgcctccatccttagcctctgcaccatctctgtggaccggtacgtgggtgtgcgccactcgctcaagtacccagccattatgacagagcgcaaggccgctgccattctggctctgctttgggcggtggccctggtggtatctgtgggaccgctactaggttggaaggagccagtgcccccggatgagcgtttctgcggcatcaccgaggaggtgggctatgcaatcttctcttccgtgtgctccttctacctacccatggcagtgatcgtggtcatgtactgccgcgtgtacgtggtcgcacgcagcactacgcgcagcctcgaggcaggcatcaagagggagcccggcaaggcctccgaggtggttctgaggatccactgtcgcggcgcagcgaccagcgccaaaggatatcccggaacacagagtagcaagggccacaccttgcgcagctcgctttccgtgaggctgctcaagttttcccgcgagaaaaaggctgccaagacgttggccatcgtcgtgggtgtcttcgtcctgtgctggttccccttcttcttcgtcctgcctctgggctctctgttcccgcagctgaaaccgtcagagggtgtcttcaaggtcatcttctggctgggctacttcaatagctgtgtgaacccgctcatctacccctgctccagtcgcgagttcaagcgcgccttcctccgcctcctgcgctgccagtgtcgccgccgccgccgccgcctctgggcagtctacggccaccactggcgagcctcgaccggcgacgcgcgttccgactgcgcccccagccctcgcatcgctccccccggggcccctctagccctcactgcacacccgggtgcgggctcggcagacacgccggagacgcaggattcggtctccagcagtcgaaagccagcctccgccctccgggagtggagactgctcgggccgctacagagacccacgacccagctgcgtgcgaaggtgtccagcctgtcccataagattcgctctggggcccggcgcgcggagactgcgtgtgccctgcgctccgaggtagaagcagtgtccctaaatgttccccaagatggggcagaagctgtcatctgccaggcttatgagccgggcgactacagcaacctccgagagactgacatttaaggaccgaaactcaggctggggaaggtgctggggaaagtgcgggggccaggggtggggtgctttatgggatactgcttcggatccaagactgcccagggtggctgctccatctcacccagagcaaccggagctggacctgggggtcggagcacttcgaaggtgatgggttatggtgccgcctgctggacatagttgtccagagctcttcctgaaagggaaaggctacaggattcgcccttctcatccagtctaagaaactacttagtcaactcctagtgtctaagcagaaggcttcagctatggcttctccccttgggaggaagaggaagaggtacaaattcttgttttgctgctcccagggaaaagatccgtggacagtttctactccttactgccacctggaggaagtcaatggacctaccataggacctgccatccggcaagttttggtggcgtattggatgcccgccgaacaaatctgttgctcttccgctctgggcccactgccctcttccccacactcctaactgtatgttcccctcaccataccccccgccccgggccttactgtttacactgtgtacatagttcattgtgcctgtctgtgcccatcacttctcactgggattccaggctgccaaaggggagagccttatttatcattttgaaacctatttattggtaagagtacttatattttgttcagactgtgcaaactgtccatctttggcttgtaatgcatatagagcctccttcttctgaaatccttagacc

SEQ ID NO: 3686 - DNA, 2052 bp, Rattus norvegicus
  Genbank Accession No. NM_024484
cgggacactttgcagacatggagactgtcgttcgcagatgcccattcttatcccgagtccctcaggcctttctgcagaaggcagggaaatctctgctgttctatgctcaaaactgccccaagatgatggaagtcggggccaagccggctcctcggaccgtgtccacttcagcagcacagtgccagcaggtcaaagaaacccctccagccaatgagaaagagaaaactgccaaagccgcagtccagcaggctcctgacgagtcccagatggcacagactccagacggcacacagctcccgcctggacacccgtcaccctctacaagccagagctctgggagcaagtgccctttcctggcagcacagctagccagacgggcagcagcgtcttccgcaaggccagtctggagcttcaggaggacgtggcaggaaatgcatgctgtgaggacagaggttgctcaaagcccagtgctccccagcttggtcaatgcaaaaagggatggagaaggtccaagcccactgctgaagaacttccaggacatcatgagaaagcaaaggccagaaagagtgtctcatcttcttcaggataacttgcccaaagtcgtttccacttttcaatatgatcatttctttgagaagaaaattgacgagaaaaaaaatgaccacacctaccgagtttttaaaactgtgaaccggagagcacagatctttcccatggcagatgactacacggactccctcatcaccaataatcaggtgtcggtctggtcgagtaacgactatctaggcatgagtcgacacccacgggtgtgtggggccgtcatagagactgtgaaacagcatggtgccggtgcaggtggaactagaaatatttctggaacgagcaagttccatgtggaactggagcaggagctggctgacctccacggcaaggacgcggcgctcttgttctcttcctgcttcgtggccaacgactccactctcttcaccctggctaagatgatgccaggctgtgaaatttactctgattccgggaaccatgcctccatgatccaagggattcgcaacagtcgagtgccaaagtatatcttccgccacaatgatgtcaaccatctcagagaactgttgcagagatccgacccctcggtccccaagatcgtagcattcgaaactgtccattcaatggatggagcagtgtgccccctggaagagctgtgtgatgtggcccatgagtttggagcgatcacgtttgtggacgaggtccatgcagtagggctctatggggcttcaggtggagggatcggtgatcgggatggagtcatgccaaaaatggacatcatttctggaacactcggtaaagcgttcggctgtgttggaggatacattgccagcacgagtttgctgatcgacaccgtccggtcctacgctgcgggcttcatcttcaccacctccctgccaccaatgctgctggctggagccctggagtctgtgcggatcctgaagagcaatgagggacgtgcccttcgccgccagcaccagcgcaatgtcaagcttatgaggcagatgctaatggacgctggcctcccagtcatccactgccccagccacatcatccctgtgcgggttgccgatgctgctaaaaacacagaaatctgtgatgagttgatgaccaggcataatatctacgtccaggccattaattacccaacagtgcctcgtggggaggagctcctccggatcgcccccaccccgcaccacacaccgcagatgatgaactacttcctagagaagctgctgctcacgtggaagcgagtcgggctggaactgaagccacattcgtcagctgaatgcaacttctgcaggaggcccttacacttcgaagtgatgagcgagagagagaaagcctatttctcaggcatgagcaagatggtgtctgcccaggcctgactgtgactcagttattcacaaaccccagaccattaccatacccaaatagtagccagaattgtctttagatgtgaagtaaattatatattaaatcttaatctatagt

SEQ ID NO: 3687 - DNA, 961 bp, Rattus norvegicus
  Genbank Accession No. NM_024487
acccgggggtagtcatggcggctcggtgcgtgaggctggcgcggcgcagcctcccggctttggcgctgtcgttcaggccttctcctcgcttgttgtgcacagctacaaaacaaaagaacaatggccagaacctggaagaggacttggggcattgtgagccaaagacagatccatcctctgcagacaagaccctcctggaagagaaggtgaagctggaagagcagctgaaggagaccatggaaaaatacaaacgtgctttggcagataccgagaatctacggcagagaagccagaagctggtagaagaggccaagttatatggcatccagggtttctgcaaggacttgctggaggttgcagacatcctagagaaggcaacccagagtgttccaaaggaggaggtcagcaacaacaaccctcacctgaagagtctttatgaagggctcgtgatgactgaagtccagattcagaaggtgttcacaaaacacggcttgctcaggcttgaccccattggggcaaagttcgacccttatgaacatgaggccttgttccacacccctgtggaggggaaagaaccaggcactgtggcactagttagtaaggtgggctacaagctgcatggacgcaccctgaggccagctttggtgggggtggtgaaggacgcttagctctctccctcaaggctctggactttgtaggtcacttgctagaactcaaagggtgggcgggcttgtaatttctcatctgtgaacacatctgacccttgcccagccttgttggaaatcttaagtaagctaagcagaacatgaagctgcttgcacactgtgtcagagactctgggagtctggtcattgagtttagcattacctacttcagaagagggccagcagggcctcaggagtagcatgctaacgttgtatctgttccaccttgtgattaagtactttacacaaataaaagg

SEQ ID NO: 3688 - DNA, 1865 bp, Rattus norvegicus
  Genbank Accession No. NM_024488
cggcacgagctgaattgaggctcaggcacgccggctcaggattggtgctgggccgggccggggtctttggccggaagtggaaaaaggatgcaggaccatcagcacgtgcccatcgacatccagaccagcaagctgctcgattggctggtggacagaagacactgcaacttaaaatggcaaagcctggtgctgaccatccgggaaaagatcaacaccgccatccaggacatgccagagagccaagagattgcccagctgctctctggttcctacatccactacttccactgcctaagaatagtggaccttcttaaaggtaccgaggcttccaccaaaaatatttttggccgctactcttcacagcggatgaaggattggcaggagatcataagcctgtatgagaaggacaacacctatttagtggaactctctagcctcctggttcggaatgtcaactatgagatcccctctctgaagaagcagattgccaagtgccagcaactgcagcaagactacagccgcaaggaggaggagggccaggctggggctgctgagatgcgagagcagttctaccactcctgcaaacagtacggcatcacgggagacaatgtccgacgagagcttctggccctggtgaaggacctgccaagtcagctggctgagataggagcgggagctcagtccctgggggaagccatcgacctgtaccaggcctgtgtggagtttgtatgtgacagccccacagagcaggtgctgcccatgctgcggtacgttcagccgaagggaaactccacggtgtatgagtggaggacagggacagagccctctgtggtagagcggccacaactggaggaccctcccgagcaggtgcaagaagacgagatcgactggggcgactttggcctggaggctgtttctgactctggaaacatcatctctgctgagacccctgggatagactggggtatctccctggagtcagagtccaaggatgctggggctgacaagatagactggggtgacaatgctgttgcttcggagatcaccgtgctggagacaggaacggaggctccagagggtgttgctaggggctcagacgctctgactctccttgaataccctgagactcggaatcagttcatcgatgagctcatggagcttgagatcttcttgtctcagagagcagtagagatgagtgaggaggctgacatcctgtccgtgagccagttccagctggctcctgccatccttcagggccagaccaaggagaagatgctcagcctggtgtccacactgcagcatctgattggccagctcaccagtctggacctgcagcacctgtttatgattctggcctcaccgaggtatgtggaccgggtgacagagctcctccagcagaagctgaagcagtcccagctgttggctctgaagaaggacctgatggtggagaagcagcaggaggcgcttcaggagcaggcagcgctggagcccaagctggacctgctgctggagaagaccagagagctgcagaagctgattgaagctgacatctccaagagatacaacggccgtcctgtgaacctgatggggacctctgtgtgacgtgctggccctgtgtccgccaccagcggcctggtgggggtggacagcccaggctggtattgctggacctcaccagcaagaagccagcagaggtggagcagagccacaaggaagcacctgagtggtggcaccagcattcattgtgacctatgcaagaagtctgagtggctctgtggatctaagcctaaggcacagttgcttcttctggttatcaaggaaggcttaataaaaaaaggaagtgactcctcaaaaaaaaaaaaaaa

SEQ ID NO: 3689 - DNA, 1539 bp, Rattus norvegicus
  Genbank Accession No. NM_030826
gaattccgcgctacaggcatttttgagtccaatatcttctacagtatgtctgctgctcggctctccgcggtggcacagtccaccgtgtatgccttctccgcgcgcccgctggcgggcggggagcccgtgagcctgggctccctgcggggcaaggtgctgctcattgagaatgtcgcgtccctctgaggcaccacgacccgggactacaccgaaatgaatgatctgcagaagcgtctggggcctcgtggcctggtggtgctcggtttcccgtgcaatcagttcggacatcaggagaatggcaagaatgaagagattctgaattccctcaagtatgtccgacccggtggtgggttcgagcccaactttacattgtttgagaagtgcgaggtgaatggtgagaaggctcacccgctctttaccttcctgcggaatgccttgccagcacccagtgacgatcccactgcgctcatgaccgaccccaagtacatcatttggtccccggtgtgccgcaacgacatttcctggaactttgagaagttcctggtaggtccagacggtgttccagtgcgcagatacagcaggcgctttcgcaccatcgacatcgaacccgatatagaagccctgctgtccaagcagcctagcaacccctaaggcattcctggtatctgggcttggtgatggctggctgccctccggggggaggtttttccatgacggtgtttcctctaaatttacatggagaaacacctgatttccagaaaaatcccctcagatgggcgctggtctcgtccattcccgatgcctttacgcctaaagaaaggcggtttcaccactaagaataaagtgctgcggaattccgtgtcttcctgggcacgtttttgtatgaatattcaagaaggcaccccgattactccgtgtccctgctgctgagacttgctaagaaatatgaagccacactggagaagtgctgtgctgaaggcgatcctcctgcctgctacggcacagtgcttgcagaatttcacctcttgtagaagaacctaagaacttggtcaaactaactgtgagctttacgagaagcttggagagtatggattccaaaacgcattctggtccgatacacccagaaagcaccctaggtgtcgaccccaactctcgtggaggcagcaagaaacctgggaagagtgggcaccaagtgttgtacccttcctgaagctcagagactgccctgtgtggaagactatctgtctgccatcctgaaccgtctgtgtgtgctgcatgagaagaccccagtgagcgagaaggctcaccaagtgctgtagtgggtccctggtggaaagacggccatgtttctctgctctgacagttgacgagacatatgtccccaaagagtttaaagctgagaccttcaccttccactctgatatctgcacactcccagacaaggagaagcagataaagaagcaaacggctctcgctgagctggtgaaacacaagcccaaggccacagaagatcagctgaagacggtgatgggtgacttc

SEQ ID NO: 3690 - DNA, 2335 bp, Rattus norvegicus
  Genbank Accession No. NM_030835
cggcacgaggccggcaccagctgtcggcacgaggttggactctttcctcccggtcctgcggccctctttctccggcgcgccgcccctcggttgctcagaccgctgtgatcggaggttgccggtgctccagcgcttggcgtcccggcccagtggccgtaggcggcgtaggcaccgcgagccgagcctcccggtggccggggaacggcaagcgagcgagtccgagaggttcttggggcaggtggcgccgcgaagatggtcgccaagcagaggatccgtatggccaacgagaagcacagcaagaacataactcagcgcggcaacgtcgctaagacctcgagaaatgcccccgaagaaaaggcgtcggtaggaccctggttattggccctcttcatttttgtcgtttgtggatctgcaattttccagattattcaaagtatcaggatgggcatgtgaagtgactgaccttgagatgtttccattctcctgtgaattttaacttgaactcattcctgatgttcgatgccctggttaaaaacaattcagtaaatcaccctgcctcagaatgactttttcatatcaaccttcatgtgtcattccaaggtttcttcaagagtcattccaggtttgctagtccatgccacagtgccttgcaaaagcaccacatgaataaagcaataaaatttgattattaagttccagtagtagaccatacttattcagtacagaatgagttttatgtggttattaaaacttatgactaattagattaaatctgtgtagacagggtatagattttgttaaccctaatgtgtaaatgcaattagctaatttaaattttggaaacttaaggttttatatagctaggcactttactactcttggattgaaaaagcacactccattatagggacatgtaactatcctataatcaggtgcttataaatggacaactacacggcctagttttaccacaatcattgtcacctaaatttttttaaaaactcctagggcatatgtaagtggagatgctcactgctgcatctgtttctaatgataatgtttctgttacacagccttgagtttcgcatgagtaagtatagtcacctagggatcccatttgagactgggttgagcattttggtaacttgaatccaaagtgactgcagtttcactaaaaagctatcatggtgagatgaaattaggggatggattgctgaaggtcatacagatcagaattaacatatcaaggggtttaccggtggaggaaaaaagttaagggggaaaagtctaccaagagggaaatgccttgaaaaaataggggggaaacctgtgtgccatatgatatcttagcatgtgaattgcacttttaataccaaaaaggcacatcaactaaaaagttatgattgaaatgcccttagggttctaggtatgtcaacctaaactagcatttggagttaaatgaatttactgataaggatcagtctagtcttcctctgtatgacttagtaggttgtgattggtcagatttccttttttaactaacggtaagggtgagagtgatgaggcagggtttgaggttttctggtactattgaaaactgcaagtcctgactatgcacttagccagaacttggtgtagaccaccaagcaatatctgtgtatggaattggaagaaacctgcttatgtttgctttgttatttgcctcaggagatctctttttgaaataagctgttttccaaaggaacagaagggaaacttgctacctgttctgagagcagtgtaaacctcacaggactttggaccccctcagatgtagaggagaatgaaggaaaggaatagttagggatgcacaggaatttatctgtctctgatcaggaaagaaagctggctatgggtctgcaggggcatgactgatggttgtctgcctcttttcaccctgtaagtgaatccctgaactggattcactgaagcaagtcttggttaactaattctattttactataactttaaaagtgaaaaatattctctaaatttatagcaggtgccttatttcctttgaatcaaatcattccataccagaatttcccttggtttactattagataattggctttaagatacttttgttttgaaacatacagtgttttaattgatttgttaaattgctgtagccatcaatcatttcacatttgtaaaatacattccctttgtatcatgtaatttgcctattcagtgcattttatattcaggttgggttatgcatatttgggtcaatgaaagttgtgtctgtttgatttatgctttaaaaataaagttccctggatatttaaaaaaa

SEQ ID NO: 3691 - DNA, 2094 bp, Rattus norvegicus
  Genbank Accession No. NM_030844
ggcacgagctccgatctccgctgagaggctcctgggggccggggctccgaggaaaatggttcgatgttattaaaaatgaatcttaagaagaaaaatgaatcacagcagttaaactatggagttctgctacttgtaagaagtggagaagcctgagattacatcactgacccttgatcctccactgagctaaaacaccagctggtaattgcctatgattttatagacttccctccatctgctgggtccaagtgtccgtctgactgctctggtaccggagcatctttatttctgcatctaaacttgtaaaaagcacatcgaatcttgttccccaggagaaaatcttcaatgtaaccattttcaatgtatccgatgatacaagcgcattgtaatctccaggtagaagcagctttatcagtggaaagggtttaatagaacatatcctatcatgctttttctctgccccttctcaaatcatcagcagtagaaaagagaagaaaacatgtcaggacacaaatgttattcctgggagttgcaggatcggtttgctcaagataagtcagttgtcaataagatgcaacagaaatattgggaaacgaatgaggcctttatcaaagccacagggaagaaggaagatgaacatgtcgttgcttctgatgcagacctggatgccaagctagagctgtttcattcgattcagagaacctgtttggacttgtctaaagcaattgtgctctatcaaaagagaatatgtttcttgtctcaagaagaaaatgaactgggaaaatttctccgatcccaaggcttccaggacaaaacccgagcaggaaaaatgatgcaagccacaggaaaggccctctgcttttcctcccagcaaaggttggccttgagaaaccctttgtgtcgatttcaccaagaagtagagacttttagacatcgggccatctccgatacctggctgacagtgaaccgcatggagcagtgccggacagaatatagaggggcgttattgtggatgaaggacgtgtctcaggaactggatccagacctctacaagcaaatggagaagttcaggaaggtacagacacaagtccgcctcgcgaagaagaactttgacaaattgaagatggatgtgtgtcaaaaggtggatcttcttggagcaagcagatgtaacctcttatctcacatgctagcaacatatcagaccactctgctccacttttgggagaaaacttctcacaccatggcagccatccatgagagcttcaaaggctatcaaccatatgaattcacaacgttaaagagcttacaagaccctatgaaaaagctagtcgagaaagaaaagaagaagagctcccggagggaaaaccgggaggctgtggcacaggagccgaggcagttaatttcattggaggaagagaaccagcacaaagaatcctctacttgccagaaggaggagggaaaaagcgttccgtcgtctgtagacaagagttctgcagatgatgcatgctcaggacccatagatgaactattagacgtgaaacctgaggaagcttgcctgggtcccatggcagggaccccagaacctgaaagtggggacaaggacgacctcctgctgttgaacgagatcttcagcacttccagcctggatgaaggggagttcagcagggagtgggctgcggtgttcggagacgaccggctgaaggaaccagcccccatgggggcccagggagagccagaccccaagccccagataggctctgcgttccttccttcacagcttttagaccaaaacatgaaagatctccaggcctctctccaagagcctgccaaggctgcctcggacctgactgcctggttcagcctctttgctgacctcgaccccctatcaaatcctgatgctattgggaaaaccgataaagaacacgaattgctcaatgcatgagtctgcaaccttcaacaggggagccctccggccactccgcaacacctcatccagggcttgcagaagtctaacgtgctcagtacgctgttttaatatttacatgccattttaataaaacgagagggtcaaggccctgtttctatcgctataaa

SEQ ID NO: 3692 - DNA, 2099 bp, Rattus norvegicus
  Genbank Accession No. NM_030846
aagctaggctgctctgctgcttctgcgatcgggcggcggcggggcgagccaagctgcggcgggggacggcggtctgggcagcgggcgccgcagtcagggagcagcagtgaggttggcggccgcgggcggcacacaaggcgggccaggccgggtgagggagcggacggcacgtcgcgggtggcattgtgtgtcccagtgtgcaagaatagccccagaagaggaaaggctgagcccagagcgcttcagcagggaagattcccttccccccgcttcaggctgctgagcactgagcggcgctcagaatggaagccatcgccaaatatgacttcaaagctactgctgacgatgagctgagcttcaagaggggggacatccttaaggttttgaatgaagagtgtgatcagaactggtataaggcagaactcaatgggaaagatggcttcatccccaagaattacatagaaatgaaaccacatccgtggttttttggcaaaatccccagagcaaaggcagaagaaatgcttagcaaacagcggcatgacggggccttcctgatccgagagagcgagagcgctcctggggatttctccctgtcagtcaagtttggaaatgatgtacagcacttcaaggtgcttcgtgacggagccgggaagtacttcctgtgggtggtgaagtttaattctttgaatgagctggtagattaccacagatcaacatccgtgtccaggaaccagcagatattcctccgggacatagaacaggtgccacaggaggatggtgagctgggctttcgccgaggagacttcattcatgtcatggataactcagatcccaattggtggaaaggggcctgccatgggcagaccggcatgtttccccgcaattatgtcaccccagtgaaccggaacgtctaagaagcaaaagagattatttaaagaaagtgaaaagttgagaccgttcacaagaattacacccacacgctgcctgtcacagcctgtgagggaacgcagaacacctggctgggtcccacgggcgaccctctcacttaagttgcaacttttgggggtgggaaggggtgtttgatttcataatgccaaaacttaacctattgaatgaattacagtttttattacggaatctcgccgctactcgtgttcccttcctgtgtccttttttcgcgttctttctttcctgtccagtgcatgatgtttaaggccacatatagtccagctgatgccaataataaaagaaaagaaaccaagtgggctggtattttctctatgcaaatgtctgtggagatggatggactagaggagccggattcttcacacacaggggcagccattgtatcggggcccttggttgggattcactggagatgcctaagggcatctgcctccggcctgaagcctggagcattccatcagagttggaattagggcaggagcctgctgcccacccatggtctcctgagagccagactgcagagctgccctccccactgcctcccttcagtgtctcacttgttttcatagtgcctttgtcttatttcaagggtgttcatgagtggtgtctttaccttttttatttttttaaataagttaaagatagtccagagcttttcagttgattagtctcctatcctatgtacatattttcctctcagggcaggagaaagaggacagagaaaggagctggcagaagcagagagggtgtatttcccatcttaaatgggccagaggtcttgaaggatcagcttttacattgtgagctttgacacctgcttcagctcagactcaccggccctcagagtccctgccctccaggtcccagttgccctttctatgcctagagccactaagggtcaaaacacaaggcaggcaggggggagcgggtggcatccttccctctcataggcctacaagcaggtggaagttgaaaattctggcctttaatttttcttgctcttacaattaagtcctcgttctcagttgcacatttccccccacctgtccacgagtacgaatggcaggattcgggggctggttcgatggttgcatctctgtgcacaacagtggtgtttcgacgtcgtctccgtc

SEQ ID NO: 3693 - DNA, 737 bp, Rattus norvegicus
  Genbank Accession No. NM_030847
cgaggacagactccaactctgacttcttcagcgactctcgagacttcccgaaccaagccgtctttcctcagaccttacagtcctcccagccttcctctctgacttagagagccagaccccagccctcttcccccaggattgagtgctccgacccttcgaaggcttgcctctcctgctctgagccagcatctggcagccatgtcactcctcctgttggtggtctctgcccttcacatcctcattcttgtcttgcttttcgtggccactctggacaagtcctggtggactctcccagagaaggagtccctgaacctgtggtatgactgcacgtggaacaccaccgctaaaacgtgggcctgcagtaacgtcagtgagaacggctggctgaaggcagtgcaggcgctcatggtgctgtctctcatcctctgctgtctgtccttcatcctcttcatgatccaactctacaccatgcggagaggagggctcttctacgccaccggcctctgccagctctgcaccagtgcggctgtgttctccggggcactgatctatgccatccatgctaaggagatcctggcaaagcacccgagtggaggcagcttcggctactgcttcgccctggcctgggtggcctttccactcgccctggtcagtggcatcatctacatccacctgcggaaacgagaatgagcgctgtgtccccctagaaaataaagccctgtaaccacaaaaaaaaa

SEQ ID NO: 3694 - DNA, 1884 bp, Rattus norvegicus
  Genbank Accession No. NM_030850
caagcctttgctggagaccgctcctgtccagtccgcagctggcttcagcgccactcaggacaccggaaagatggcaccgattgccggcaagaaggccaagaggggaatcttagaacgcttaaatgctggcgaagtcgtgatcggagatgggggatttgtctttgcactggaaaagaggggctacgtaaaggctggaccctggaccccagaggctgcggtggagcaccccgaggcagttcggcagcttcatcgggagttcctcagagctggatcgaacgtcatgcagaccttcactttctatgcaagtgaggacaagctggaaaaccgagggaactacgtggcagagaagatatctgggcagaaggtcaatgaagctgcttgtgacattgcacggcaagttgctgacgaaggggatgcattggttgcaggaggtgtgagtcagacaccttcctacctcagctgcaagagtgagacggaagttaaaaagatatttcaccaacagcttgaggtcttcatgaagaagaatgtggacttcctcattgcagagtattttgaacatgttgaagaagccgtgtgggcagtcgaggccttaaaaacatccgggaagcctatagcggctaccatgtgcatcggacctgaaggagatctacatggcgtgtctcctggagagtgcgcagtgcgtttggtaaaagcaggtgccgccattgtcggtgtgaactgccacttcgaccccagcaccagcttgcagacaataaagctcatgaaggagggtctggaagcagctcggctgaaggcttacttgatgagccacgccctggcctaccacacccctgactgtggcaaacagggatttattgatctcccagaattcccctttggattggaacccagagttgccaccagatgggatattcaaaaatacgccagagaggcctacaacctgggggtcaggtacattggcggctgctgcggatttgagccctaccacatcagggccattgcagaggagctcgccccagaaaggggatttttaccaccagcttcagaaaaacatggcagctggggaagtggtttggacatgcacaccaaaccctggatcagggcaagggccaggaaagaatactggcagaatcttcgaatagcttcgggcagaccgtacaatccttcgatgtccaagccggatgcttggggagtgacgaaaggggcagcagagctgatgcagcagaaggaagccaccactgagcagcagctgagagcgctcttcgaaaaacaaaaattcaaatccgcacagtagccacaggccagcggttcggggcgaattcctccaggtccgggccacagtgtgcacccggaaggagaaggcatctctaaaccagcgtttgtgttgatgccggcttacacctgtgattggtgctagttagacaaaatggagtcacagatagcatttcacagttacaaaactacgctttagaattttacctagaaggaagaaaggagaagtccacagtaaatcctgaacacatttcctacgtgcctgtcgcattacaggcgcacaggagtcactgcagcgaagagaaagtcacccgacgtcaatctcatttcagatagggggataggacaccacctccacgagtgacatagaaccattcagggaccgtatcataagtgacacagcaaccatctatatctaagatgcttcccaagtggattccaagatcttttgagcaggacccttaggcagaaacaacacacaccagccctgtaaaacttaacagataactgatccattctgtaattctgtaatctctgttctgactgcttccattccatttcattaataaaaacatgccggttgaaaaccttcaaaaaaaaaaaaaaaaaaaa

SEQ ID NO: 3695 - DNA, 1312 bp, Rattus norvegicus
  Genbank Accession No. NM_030851
ggagctgccccaggacagaaacctcccaagacagcagtcaccatcaaaaacacaggtgaagctgtgagctctttgcttttctatccggaccacagctggatttgacctcctgtactgtgtcaacgtcaggtcactgtggatggcgtccgaggtcttgttggagctccagccctctaaccgaagcctgcaggcccctgccaacattacctcctgcgagagtgccctagaagactgggacctgctgtatcgggtgctgccagggttcgtcatcactatctgcttctttggcctcttggggaaccttttagtcttgtccttcttccttttgccttggcgacagtggtggtggcagcaacgacagaggcagcagcgcttaaccatagcggaaatctacctggctaacttggcggcttccgatctggtgtttgtcctgggcctgcccttctgggcagagaacatcgggaaccgtttcaactggcccttcggaactgacctctgccgggtggtcagcggggtcatcaaggccaacctgtttgtcagcatcttcctggtggtggctatcagtcaggaccgctacaggctcctggtataccccatgaccagctgggggtaccggcggcgacggcaagcccaagctacgtgcctgctcatctgggtagccgggggtctcttgagcatccccacattccttctacgctctgttaaagtcgtccccgatctgaacgtctctgcctgcatcctgcttttcccccacgaggcttggcactttgcaaggatggtggagttgaacgttttgggtttcctcctccccgtgactgctatcatcttcttcaactatcacatcctggcctccctgagaggacagaaggaggccagcaggactaggtgtgggggtcccaagggcagcaagacgacggggctgatcctcacactggtagcctccttcctggtctgctggtgcccttaccacttcttcgctttcctggatttcctggtccaggtaagagtgatccaggactgctcctggaaggagatcacagacctgggcctgcagctcgccaacttctttgcctttgtcaacagctgcttgaacccactgatttatgtcttcgcaggccggctccttaagaccagggttctggggactttataaatgatgcaaccgagaagcctcatgcccatgtggcccaacaggaagggactcttccaattatcctgctggaattcaaacagcagggagccaagaagcctggcttcttgaccaaccatctctggtatcataaagaccatctggtcagctgacccacagccc

SEQ ID NO: 3696 - DNA, 2546 bp, Rattus norvegicus
  Genbank Accession No. NM_030861
ctccagggaagcaacagagagaagaaaagaaaggtacatggctacttcccactctcagcctagaagaataaacccttagattgcgggggaactgagccaggcaagccacaggcagccttgagcgcccccttgcctgccctcccctgcgggggccaggatgctgaagaagcagtctgcagggcttgtgctttggggtgctatcatctttgtgggctggaatgccctgctgctcctcttcttctggacacgcccagcacctggcaggctgccctcagacagtgcccttggtgatgaccctgccagcctcacccgtgaggtcatccacctggccgaggacgccgaggcggagttggagcggcagcggggactactgcagcagatcaaggagcattattctctgtggaggcagaggtggagagttcccaccgtggcccctccagcctggccccgtgtgcctgggaccccctcaccagctgtgatccccattctggtcattgcctgtgaccgcagcactgtccggcgctgcctggataagttgttgcactatcggccctctgctgagcatttccccattattgtcagtcaagactgtgggcatgaagagacagcacaggtcattgcttcttatggcaccgctgtcacacacatccggcagccagacctgagtaacattgccgtgcagccagaccaccgtaagttccagggttactacaagattgccaggcactaccgctgggcgctaggccagatcttcaacaagttcaagttcccggctgctgtggtagtggaggatgatctggaagtggcgccggacttcttcgagtacttccaggccacctacccgctgctgaaagcagacccctccctttggtgtgtgtcggcttggaatgataatggtaaggagcagatggtggactccagcaaacctgagctgctctatcgaacagacttttttcctggccttggatggctgctgttggctgatctctgggcagaactagagcccaagtggcccaaggccttctgggacgactggatgcgcagacctgagcagcggaaggggcgggcttgtattcgtccagaaatttcaagaactatgacatttggtcgcaagggtgtgagccatgggcagttctttgaccagcatcttaaattcatcaagctgaaccagcagttcgtgcccttcacccagttggacctgtcgtacctgcagcgggaggcctatgaccgggacttccttgcccaggtctatggtgccccccagctgcaggtggagaaagtgaggaccaatgatcggaaggaactgggggaggtgcgggtacagtacactagcagagacagctttaaggcctttgctaaggccctgggtgtcatggacgacctcaagtctggtgtccccagagctggctaccgtggcattgtcactttccagttccggggtcggcgtgtccacctggcacccccagagacatggaatggctatgatcctagctggaattagtggcacctgcctttccctcctgggtctccttgccgtatgatgagccgaggcagcctgcaggccctgggctataccattctgccagtgtttcctcttggatctatagatcttccctttttgtcctggccttcccccaagtggcattctagtgcacaaatcataagatgagggttatactcctcttgtcaagggagtactgtgtggtatgttcggggcatattgaacaagaaaccactgtgtggtgtggggagggttggacctgttggaccaggcttgtagtgtcctgagttctctccaagggcatctgcggagagcttggccactccagctctcctgaccaggcctctccaccctgatctggctcctgttagtacatgagcccactttatgtaccttccccactttctccaccttccccagggtggggccggattatggaagaaggaatagatttgtggccaactgagactaaccaaagggattcactgtcagagttagattgcatggccgggttgccggggtcactgcctcctggcttctcttcctgccgactttgccagtgctcttcttgtcctgcagtggagcagtgtgttgtgagatggaaagtaggagctaaagcaagacctctcccgtggtggagcagttgtcaggaacaatgacaggcggaaagcctacacttgggcacccctcttcttgcccatggccccccacttctgaaagttagttccctttgcattctttagggggattcagtggcagcctagtgggggacagtgggctccacgcctctttcccctggggttggtacagcctcctcccacagggcttgttcctggtggccatctcagcaaagtcaccagcagctgagaccaggacacctgtggcccttcctaagcattcccacatcttcccaggccgaggggcaggtggcaggctagagagaaagaaatttgtgtgttttgtttgttgcctgatcttagtttcatggaagaaaatggaatctacagaattattttcaaaaataaagtaaaggctgaattgtctg

SEQ ID NO: 3697 - DNA, 2207 bp, Rattus norvegicus
  Genbank Accession No. NM_030872
gtctcccggctgtgcttggccgtgcggagggccggtgccagcacctccagctccgggacagcagcgggagccaagcccgagccgcaggcgtcgtcgccatgcgctggttccgggcgctgttgaagaatgcgtccctggcaggggcgcccaagtacatcgagcacttcagcaagttctccccgtccccgctgtccatgaagcagtttctagacttcggatccagcaatgcctgcgagaaaacttcattcaccttcctccggcaggagctgcccgtgcgcctggccaacatcatgaaagagatcaacctgcttcctgaccgggtgctgagcaccccctcagtgcaactggtgcagagctggtatgtccagagtctgctggacatcatggaattcctggacaaggaccccgaggaccaccggaccctaagccagttcactgatgccctggtcaccatccggaaccggcacaatgacgtagtgcccaccatggcacagggagtgttggagtacaaggacacctatggtgatgacccagtctccaaccagaacatccagtactttttggaccgcttctacctcagccgcatctctatccgcatgctcattaaccagcacaccctcatctttgatggcagcaccaacccagcccaccccaaacacattggcagcattgatcccaactgcagcgtgtctgatgtggtgaaagatgcctatgacatggctaagctcctgtgtgacaagtattacatggcttcccctgacctggagatccaggaagtcaatgccaccaacgccacccagcccattcacatggtctacgtcccctcccacctctaccacatgctctttgaactcttcaagaatgccatgcgggccacagtggaaagccacgagtccagcctcactctccctcccatcaaaatcatggtggccctcggtgaagaagatctgtccatcaaaatgagtgaccgaggcgggggtgtccccttgaggaagatcgagaggctcttcagctacatgtactctacagctcctacaccccagcctggcactgggggtaccccgctggctggctttgggtatggactccccatttcccgcctctacgccaagtacttccagggggacttgcagctcttctctatggagggctttgggacagatgctgtcatctatctgaaggccctgtccacggactcagtggagcgcctgcctgtctacaacaagtctgcctggcgccactaccagaccatccaggaggccggtgactggtgcgtgcccagcacagagcccaagaacacatcgacgtatcgggtcagctaggggccttctcttcctggcacctgggaggatgctgccacctctgaatccagccaccacagggacttccctatctatcccctggggtacgggggtgaaactgggtctccccgatggccagatctgtctttgtagaaatcgcagtggcccatctgtggcgatccctaagtgccaatctgtctctatggagaaacctagggggtttccctggagcctggtctccatggtgatgatgcttgagggttggggacggctctacctggtggggtggccccagagacacttctcccaagaccagagctgtctgttttctaccagaaaccctgggtccccctcactgcctgcatagtcctggtctcccacgtggctgcctcgcttgccttatgcccacaccctgtacaggcacattgggctggtttcttcgtcagtagtaagaaagatggagagagactggggaaacgggggccaaccttgtctctggtcctgcagcctctctccatctccactctggacactaaagttgccactgggaacttgagaatgggtggccgttctcacccaaggcccaccgagaaggcctaagagtaacctgtccccaaggcgatcttagcaatgtttctgccgcttcctggcctggcatgtcctcacgtgtatacctcccctgcccagtgtacgctcaccctatccctgcttgagctttagaccccagacttcctatgcccactatgtgtgcacagacgactcaaacccaggatgccccatgtacatagccagttttgtaatctcagatgcctcacccttgccctccgcacacaggggttaaagccgtgtgcccctcccagtggctgggatggtgacagtgacatccacagtaaatagatgaaatga

SEQ ID NO: 3698 - DNA, 2837 bp, Rattus norvegicus
  Genbank Accession No. NM_030987
gaattcggcacgaggtggaaagcactgagacgtgaagatgagtgaacttgaccagctgcggcaggaggccgagcaactgaagaaccaaattagagatgcccgtaaagcatgtgcagatgcgactctttctcagatcacaaacaacattgatccagtgggaagaatccaaatgcgaaccaggagaacactgagggggcatctggcaaagatttatgccatgcactggggcacagactcaaggctccttgtcagcgcctctcaggatgggaaactcatcatctgggacagctataccacaaacaaggttcatgccatccctctgcgctcctcttgggtcatgacctgtgcatacgctccttctgggaattatgtggcctgtggtggcctggataacatctgctccatttacaatctgaaaactcgtgaaggaaatgtgcgtgtgagtcgtgagctggcaggacatacaggttatctatcctgttgccggttcctggatgacaatcagatagttaccagttctggagacaccacatgtgccctgtgggacatcgagaccggccagcagacaaccacgtttactggacacactggagatgtcatgagcctgtctcttgctcctgacaccagactgtttgtctctggtgcttgcgatgcttcggtcaagctctgggatgtccgagaagggatgtgccggcagacctttacaggacacgagtctgacatcaatgccatatgtttctttcccaatggcaatgcctttgccactggctcagacgatgctacatgcaggctgtttgaccttcgtgcagaccaggagctcatgacctactcccatgacaacattatctgtggtatcacatctgttcccttctccaagagtggccgcctcctcctcggtggctatgacgacttcaactgtaatgtctgggatgcactcaatgctgacagagcaggtgtcctagctggacatgacaaccgagtcagctgcttgggggtgactgatgatggcatggctgtggcaacaggatcctgggacagcttcctcaagatctggaactaaggccacagcaggtggatggatgccatggcgactggaagaccattccaaccttgaagcgttactgcgatagcatatcctatccaaccatactaacgtggacacccacacctcccctcagaacttcaaaagggcaagatcttttttccttcacttattgctgaaaccaagagcacaactcccattaagagaaggatctctgtgctgtaaactaaaacaaattgtgcatttttctggggccattgtctttggtttattttgttttgttttttgtttttgttttgtttgtcttgggcaaatttttaaaggaaatactacaataaaaatgttaaccagaaggtaaccctgagtatgattgtgagagagacacaccttcttactagttcatttgcatttaaatcagtgatcctgatctgtggcaatcatgaaaaacaagttgaagactttgtttatctggaattgtttctaaatataagtcatttgtagcaagactttggaagcattcacgtttcttccttaaacatattcctttatgttcagtagttaagagaaccagagcccatgggggtgtctgactgtcactgatgcatttttgtccctggcttgcttttttttttttttttttttttttgtctcatgtcacagatgactgtttcgcacaaacacagcatagtggaagaaaaaattcagaagcaaagtagccaagcacatgttatgatggccacgaatgcttggtcagaatccttccctttgctcagcagtgaacttattcccagcacccttccctcctcactgtccagtttctgttctttccttgggtttcctgtgaagttggagggaagtttgtagtcatgtgacactagccgtcctgcccctgctgtcagattttttttctccagagaggtgcctgtcctgtgcttggatagtcagtttgtgtatgaaacaatgtacaaatcaatgttttgaaaataatgatctcagactttctaagttaaattttaaacaatttgattgtttgccatattgggtgggtttactcttagaatcgcatgctgtagaaatgctctaaagtgcatataggactcagtccttagatgttctttttattttaagaaataacctcttcaagttgtaaccgtggcggctttgtccattactgttgctattctgcacacatatcggaagcagcaagcgctttacacactcgagtagtgggataagtcactgttttctttactttacaagatgatagtcctgttgggaatgactgctgctggcttcaggaagggagggaagctgctccgctgcctctttgccacttcctggaagcagcctccatggaacagcctttgcatctgaggcaaccatttttacaccgtgcagatcttcgtggttatcatctcaaagccatgttcagcagcagcgtttggacagcagtgttctgtgggccctcccatcccccgatatcctgcacccctcatagcagtagtggcttcgccattctgttttctgcagcgtcctgtacaaaactgtgctgtgactgtgcggtaggcctggacatggcaaagagaatacagcgaagccccttctcttcctaccaaacgactctgtagagctctctgcaccctgtaccctttccaccttttgtatttaattttaaagtcagtgtactgcaaggaggctggatgcaagatagatactatattaaactgtactgttatttaagatgtaataaagcagtttgacatgaggaaaaaaaaaaaaaaaaaaaaaaaaaaaa

SEQ ID NO: 3699 - DNA, 1786 bp, Rattus norvegicus
  Genbank Accession No. NM_030989
gggtctgctgggattgggactttcccctcccacgtgctcacactggctaaagttctgaagctccagttcattgggactttccttgctataggtagcgactacagttagggggtacctggcatccgggcccgcaccctacttcccagcagggtgtcacgctcccctgaagactggataactgtcatggaggattcacagtcggatatgagcatcgagctccctctgagtcaggagacattttcatgcttatggaaacttcttcctccagatgatattctgcccaccacagcgacagggtcacctaattccatggaagatctgttcctgccccaggatgttgcagagttgttagaaggcccagaggaagccctccaagtgtcagctcctgcagcacaggaacctggaactgaggcccctgcacccgtggcccctgcttcagctacaccgtggcctctgtcatcttccgtcccttctcaaaaaacttaccaaggcaactatggcttccacctgggcttcctgcagtcagggacagccaagtctgttatgtgcacgtactcaatttccctcaataagctgttctgccagctggcgaagacatgccctgtgcagttgtgggtcacctccacacctccacctggtacccgtgtccgtgccatggccatctacaagaagtcacaacacatgactgaggtcgtgagacgctggccccaccatgagcgttgctctgatggtgacggcctggctcctccccaacatcttatccgggtggaaggaaatccgtatgctgagtatctggacgacaggcagacttttcggcacagcgtggtggtaccgtatgagccacctgaggtcggctccgactataccactatccactacaagtacatgtgcaacagctcctgcatggggggcatgaaccgccggcccatccttaccatcatcacgctggaagactccagtgggaatcttctgggacgggacagctttgaggttcgtgtttgtgcctgtcctgggagagaccgtcggacagaggaagaaaatttccgcaaaaaagaagagcattgcccggagctgcccccagggagtgcaaagagagcactgcccaccagcacaagctcctctccccagcaaaagaaaaaaccactcgatggagaatatttcacccttaagatccgtgggcgtgagcgcttcgagatgttccgagagctgaatgaggccttggaattaaaggatgcccgtgctgccgaggagtcaggagacagcagggctcactccagctacccgaagaccaagaagggccagtctacgtcccgccataaaaaaccaatgatcaagaaagtggggcctgactcagactgacagcctctgcatcctgtccccatcaccagcctccccgtcccctcctttcttgccattttatgactttagggcttgttatgagagctgacaagacaatgctagtcccttcactgcctttttttaccttgtagatagtactcggccccctctatgcaaactggttcctggcccagattggggaatgggttggtagttgctgggtctctgctggtccagcgaaatcctatccggtcagttgttggacctggcacctacagtgaaatttcaccccaccccaccgcctgtaagattctatcttgggccctcatacgatctgtatcctccggacccatttcctccactctgcaaagcctgtctgcatttatccatcccccacccctctccctctttttatctctttttatatatccaatttcttattttacaa

SEQ ID NO: 3700 - DNA, 3019 bp, Rattus norvegicus
  Genbank Accession No. NM_030990
agagagaaaaagtaaaggacagaagaaggagactggagagaccaggatccttccagctgaacaaagtcagccgcaaaacagactagccagcaggctgcaattggagccagagtgccaaagacatgggtttgttagagtgctgtgctagatgtctggtaggggccccctttgcttccctggtggccactggattgtgtttctttggagtggcactgttctgtggatgtggacatgaagctctcactggtacagaaaagttaattgagacctatttctccaaaaactaccaggactatgagtatctcattaatgtgattcatgctttccagtatgtcatctatggaactgcctctttcttcttcctttatggggccctcctgctggccgagggcttctacaccaccggcgctgtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaagtttgtgggcatcacctatgccctgactgttgtatggctcctggtgtttgcctgctctgctgtgcctgtgtacatttacttcaatacctggaccacctgccagtctattgccttccctagcaagacctctgccagtataggcagtctctgcgctgatgccagaatgtatggtgttctcccatggaatgcttttcctggcaaggtttgtggctccaaccttctgtccatctgcaaaacagccgagttccaaatgaccttccacctgtttattgctgcatttgtgggtgctgcagccacactagtttccctgctcaccttcatgattgctgccacttacaactttgccgtccttaaactcatgggccgaggcaccaagttctgatctcccatagaaatccccctttgtctaatagcgaggctctaaccacacagcctatagtgttgtgtctcctgtcttaactctgcctttgccactgattggccctcttcttacttgatgagtataacaagaaaggagagtattgcagtgattaatctctctctgtggactctccctcttatgtacctctttcagtcattttgctccacagtgggctcctgctagaaatggggaatacctgagaaggtgattcccccgctgcaagtcgcagaggaatgaaagctctaattgagtttgcaagcatctcctgaaggccaggatgtgcttccttctcaaagggcacttccattgaggaaaacaaagtggaaagaaagattctcaggtagaaagcaggaatgtccttggtctccttgccatcagtaggagtcaaatatattctctttgatgcacaaaaccaagaactcactcttttcttcctagttccactgaagacagaaggaaataagcaatagcatttgcccaaatctgcctcctgcagctaggagaagggggtcaaagcaaggatctttcacccttagaaagagagctctgacgccagtggcaatggactatttaagccctaactcagccaaccttccttacagcattagggagcacagtgtctatttagacaaagtggggcctggaggaggggggcctcatctgtccttacagctcattaggaagagaaacagagtgttgtcaggatcgactcactcccttctccctgataacagctaccatgacaaccttgtggtttccaaggagctgagaatagaagggaactagcttatataaaataagactgtgacctaaggagcatcagttgggggatgctaaaggtgtaaattgagatgccctctggcagatgcaaaacacttaactctttggatagcatctccccccaccccatcagttgtgtcctcttggcctctggcacaatatcttcacaatggtgctcttttccttgggttttatccattcacttacagcaggtgattagaggattttgattagtttcagaatgactcctgtttcatatttcccagttgtttatctcttgtttggagctgtaccagaaagaactggagaatgattctttgagcttagttctttttcaaaagaaaaaagaaaaactggacagtaagcatcacaaaaatatttgaaattgtgtagtcccatgaaatgattgggattttccccaagtattctaccttttgtagaactaggcttggtaaatttgaacctccatttgaataacctgtccaatattttcttttctaataaatgacagatgattttgcttgctaatattatctcagcattttgaaagtttaggcttagcatagaggttattgtgtcttggtatatataggtcacataatagatttcagcaactgccagctgtttagttggtgagcttccagagagctctggagacatggtgaggacagacagaattggaaacctgaagaactcccagatttcaggcttatcctgtacttgttaactttgggtgaaagaaagaaaagcaaagaaagaaaggaaaagcctctgatctgtttttactgaaggaaaagttactgtagattttttttttttgtagatttgtgctgtcattccccaaagtgcttttgtcatgttgaaagagatataaggatttagaagaagatacttgagacttgttcttgggccagtatataaggtaaactagcaggatgcacagtagtgaggagagcttaaaggacctggaagaaaccaatcaagataaaggaaggtgaaataatctatatcttttatttggtttgattttaatatcataacagataaccaaccactccctgaaaacctcacacgtatatatacacacacgcatgcacatacaaagagagttaatcaactgcaagtgtttccttcatttctgatatagaattttgattttaacaacataaaggataaactcttagaaactcatcttacaaaatgtattttataaaattaaagaaaataaaattaagaatgttctc

SEQ ID NO: 3701 - DNA, 2100 bp, Rattus norvegicus
  Genbank Accession No. NM_030991
aattcggcacgagcagagctcacgttgcattgaagacgaaacctcggggaggtctggagctgtctttccttccctccctacccggcggctcctccactcttgctacctgcagggatcagcggacagcatcctctgaagaagacaaggttccttaactaagcaccactgacttgctggccccggcgcccagcaaccccccaccactaccatggccgaggacgcagacatgcgtaatgaactggaggagatgcagaggagggctgaccagctggctgatgagtccctggaaagcacccgtcgcatgctgcagctggtcgaagagagtaaagatgctggcatcaggactttggttatgttggatgagcaaggcgaacaactggaacgcattgaggaagggatggaccaaatcaataaggatatgaaagaagcagaaaagaatttgacggacctaggaaaattctgcgggctttgtgtgtgtccctgtaacaagcttaaatccagtgatgcttacaaaaaagcctggggcaataatcaggatggagtagtggccagccagcctgcccgtgtggtggatgaacgggagcagatggccatcagtggtggcttcatccgcagggtaacaaacgatgcccgggaaaatgaaatggatgaaaacctagagcaggtgagcggcatcatcggaaacctccgtcatatggccctagacatgggcaatgagattgacacccagaatcgccagattgacaggatcatggagaaggctgactccaacaaaaccagaattgatgaagccaaccaacgtgcaacaaagatgctgggaagtggttaaatctgcccttctgctgtgctctcctccaatgttgttggacaagagagaagagagctccttcatgcttctctcatggtattacctagtaagacttacacacacacacacacacacacacacacacacacacacacacacacacacacacacagagtcagtcacccccattgtaaatgtcctgtgtggtttgtcagcttcccaatgataccatgtgtcttttgttttctccggctctctttctttccaaaggttgtacatagtggtcatctggtgactctatttcctgacttaagatcttgggtctctctcttttttcctttttcttttctcagtggcgtttgctgaatgacaacaatttaggaatgctcaatgtactgttgatttttctcaatacacagtattgttcttgtaaaactgtgacattccacagagctactaccacagtcctttcttagggtgtcaggctctgaatctctccaaatgtgctgtctttggttcctcatggctattctttgtctttatgatttcataattagacaatgtgaaattacataacaggcattgcactaaaagtgatgtgatttatgcatttatgcatgagaactaaatagacttttagattcctacttaaacaaaaactttccatgacagtagcatactgacaagaaaacacacacaacagcaacaataacaaagcaacaactacgcatgctcagtattgggacactgtcaagattaagtcataccagcaaaacctgcagctgtgtcaccttcttctgtcaacatacagactgatcataatcatcccttctttacacacacacacacacacacacacacacacacacacacaaatggatttaacacaccattaatcatttctagcaaaatatatgtttggctgaaactatgtgaaatgggtgtaatatagggtttgtcgaatgcttttgaaagctctgttttggagacaatactcttgtggaaaacgtgaagatcttctaagtctggctcttgttgatcaccatctccctgtggtttgtcatcagtacaactctttgttgcttaatctagagctatgcacaaccaaattgctgagatgtttagatgctgataaagaaacctttaaaaaattatataaatgaatgaaatatagataaactgtgagataaatatcattacagcatgtatattaaatccctcctgtctcctctgttggtttgtgaagtgatttgacattttgtagctagtttaaaattattaaaaattataga

SEQ ID NO: 3702 - DNA, 10120 bp, Rattus norvegicus
  Genbank Accession No. NM_030995
agactcttccctgaagctgccgggctaaggctaaggccagagccaatgcctccatgaggggctccctcccacaccccggggccagaggaccctctgccaccagagtgagatcctcgagaccatcatcctagtcaaccccagtgcagacagtatcagctcagaggttcaccatcttctcagcagcccatcagctcacaaactcctgatcctgagtggacaaactttagaacctgagggagaccttatcctacagagtggtacctactcatatcaaaactttgcccaggtccttcacaaacctgagattgcccagttgcttagcaacagagacccggagatccaggccttcctcactgtttcctgcttaggggagggtgactggagccacctgggactgtccagttcccaagagaccttgcacctccggctaaatcctgagcctgtgctacccaccatggatggtgtggctgagttctccgagtatgtctctgagactgtggatgtgccatccccctttgacctgcttgaaccgcccacctcaggaggcttcctcaagctctctaagccttgctgctacatctttcctggtggccgtggggactctgctctctttgctgtcaatggctttaacatcctggtggatggcggttcggatcgcaagtcctgcttctggaagctggtgcggcacctggaccgcatcgactccgtgctgctcacacacattggggctgacaatctgccgggcatcaacggcctcctgcagcgcaaggtggcagagctagaggaggagcagtcccagggctccagcagctacagcgactgggtgaagaacctcatctcccctgagcttggagttgtgttcttcaacgtgcctgataagctccggctgcccgacgcctcccgcaaggccaagcgcagcattgaagaggcctgtctcactcttcagcacttaaaccgcctaggcatccaagccgagcctctgtatcgtgtagtcagcaacaccatcgagccactgaccctcttccacaaaatgggtgtgggtaggctggacatgtatgtcctcaaccccgtcaaggacagtaaggagatgcagttcctcatgcagaagtgggcaggcaatagtaaagccaagacaggcattgtactggccaatgggaaggaggcagagatctctgtcccctacctgacctccatcactgctctggtggtatggctcccagccaaccctactgagaagattgtgcgtgttcttttcccgggaaatgctccccagaacaagatcttggagggcttggaaaagcttcggcacctggactttctgcgctaccctgtggcaacgcagaaggacctggctgctggggccgtgcccgccaacttgaaacccagcaaaatcaaacatcgggctgacagcaaggagagcctcaaagctgctcccaagacagcagtgagcaagctggccaaacgggaggaagtgttggaagagggggccaaggaggcccgctcagagctggccaaggagttagccaagacagaaaagaaagcaaaagaaccgtctgagaagcccccagaaaaaccctccaagtccgaaagggtgaggggcgagtccagcgaagcgctgaaggccgagaaacggaggctgatcaaggacaaggccggcaagaagcacctgaaggaaaagatttcaaagctagaggagaagaaggacaaggagaaaaaggagatcaagaaggaaaggaaggagctcaagaaggaggaagggagaaaggaagagaaaaaggatgccaaaaaggacgaaaagaggaaagataccaaaccagaggtcaagaaactctccaagccagacctgaagccttttacccctgaggtccgtaagaccctctacaaagccaaggcccctggcagggtcaaggtggacaaaggccgagccgcccgtggagaaaaggagttgtcttctgagccccggacacccccagcccagaagggggctgctccgcctgcagctgtcagtgggcacagagagttggccttgtcctcaccagaggacctcacacaggactttgaggagttgaagcgtgaggagagaggtttgctggctgaacaaagagatacggggctgggtgagaaaccactccctgcagatgccacagagcaggggcacccgagcgcagccatccaggtgactcaaccctctggccctgtgctggagggagaacatgtggaaagggagaaagaggtagtcccagactccccaggggataaagggagcacaaacagaggcccagactctggggctgaggtcgagaaagagaaagaaacctgggaggaaaggaagcagagagaagcagagctgggcccagagaacactgcggccagggaggagagcgaagctgaggtaaaggaggatgtgatcgaaaaggccgagttagaggaaatggaggagactcatccttcagatgaggagggggaagagacaaaggctgagagcttttatcagaaacatacgcaggaagccctaaaggctagcccaaagagcagagaggctcttggcggccgggacctggggttccagggcaaggcacccgagaaggagacagcatcattcctaagcagtttggccacacctgcgggagccactgaacacgtctcttacattcaggatgagacaatccctggctactcagagactgagcagactatttcagatgaggagatccatgatgagccagatgaacgcccagcgccgcccagatttcctacgagtacctatgacctctctgggcctgaaggtcctggcccctttgaagccagccaggctgcagatagtgctgttccagcctcctcgagcaaaacttatggggcacctgagactgaactcacctaccctcccaacatggtcgccgcccctctggctgaagaggaacatgtgtcctcagccacgtcaatcaccgagtgtgacaaactctcttcctttgccacatcggtggctgaggaccaatctgtggcttcactcacagctccccagacggaggagacaggcaagagctccctgttgctcgacactgtcacgagtatcccctcttcccgcactgaagccacccagggcctggactatgtgccgtcagctggtaccatctcccccacctcttccctggaagaagacaagggcttcaagtcaccaccctgtgaggatttctctgtgaccggggagtcggagaagaaaggagagactgtggggagaggcttgagcggggagaaggctgtggggaaggaggaaaaatatgtagtgacgtctgagaaactgtccggtcagtatgctgctgtgtttggtgcccctggacacaccctacccccgggggaaccagccctcggagaagtggaggaacggtgcctcagcccagatgacagcacggtgaagatggcttctcctccaccatctggcccacccagtgctgcccacacgccctttcaccagtctccagtggaagacaagtctgagccgcgagactttcaggaagattcctggggagaaacaaagcattctccaggtgtgagcaaggaagactctgaagagcagacggtgaagccagggcccgaggagggcacttcagaagaggggaagggacctcctaccaggagcccccaagcccaggacatgcctgtgagcattgctgggggtcagactggctgtactatccaactcttaccagaacaagacaaagccatagtgtttgagactggagaggcaggttcgaatctcggagcagggaccctccctggagaagtgaggacatcaactgaagaagccactgaacctcagaaagatgaggtacttcgctttactgatcaaagcctttcccctgaagatgcagagtctctgtctgtcctcagtgtggtctccccagacactaccaaacaagaggccactcccaggtctccctgcagcctgaaagagcagcagccgcacaaagacctttggccaatggtgtctccagaagacacccagtcactttctttctcagaagagagtcctagcaaggagacctctctggatatctcttctaagcagctctctccagaaagccttggcaccctccagtttggagaactgaacctaggaaaggaagaaagggggcctgtgatgaaggcagaagacgactcttgccacctagctcctgtgtctattccagagccacacagggccacagtgtcacctagcacagatgagacccctgctgggactttacctggtggctctttttctcactctgcactgtcagtcgataggaagcactcacctggggagatcacgggccctggtggacactttatgacatctgatagctccctcaccaagagtcccgagtctttgtcaagtcccgccatggaagatctggccgtggagtgggaaggtaaagctccagggaaggagaaagaacctgagctaaagagtgaaacccgacagcaaaagggccagattctgccggagaaggttgctgttgtggagcaggacttgatcatacatcagaaagacggggctctggatgaggagaacaaacctggaaggcagcaggataagactccagaacagaaaggcagagacttggacgaaaaggacacggctgcagagctggacaaaggcccagaacccaaagaaaaagacttagaccgggaggaccagggccagagagcagggcctccagcagagaaggacaaggcctcagaacaaagggacacagacctgcaacagacccaggccacagaaccaagagacagagcacaagagcgcagagattcagaagaaaaggacaagagtttagagctgagagataggactcctgaagagaaagatagaatattagtacaggaagacagggctccagagcacagcatccctgaaccaacacagacagacagagctccagatcgcaaaggcacggatgataaagaacagaaggaggaggcctcagaagagaaagaacaggttttagaacaaaaagactgggccctaggaaaggagggtgagaccttggaccaagaggccagaactgctgaacagaaagatgagaccctaaaagaggacaaaactcagggacagaagagctctttcgtcgaagataaaaccacaacatcaaaagagacggtccttgaccaaaagtctgcagagaaggccgacagtgtggagcagcaggatggagccgccctggagaagaccagagctttggggctggaagagagcccagcagagggaagcaaggctcgagagcaggaaaagaaatactggaaggaacaggatgtggtccagggatggcgagaaacatctccaaccaggggagagccagtgggaggccagaaagagcctgttccagcctgggagggcaagtctcctgagcaagaagtccggtattggagggacagagacataacactacagcaggatgcatactggagggagctaagctgtgacaggaaggtctggttcccccatgagctagatggccaaggagcccgtccacggtactgtgaggaacgtgaaagcacttttcttgatgaggggccagatgaacaagaaataacccccctgcagcacactccccggagtccctggacctcggatttcaaggatttccaggagcccctgccacagaaggggctggaagtagagcgctggcttgctgagtcaccagttggcctgccaccagaggaagaggacaaactgacacgctcgccctttgagatcatctcccctccagcatccccacctgagatgactggacagagggttccttcagctccaggacaagagagccctgtcccagacactgagtccacagcacccatgaggaatgaacctaccaccccttcatggctagctgagatcccaccttgggtacctaaggacaggcctctgcctcctgcacccctctccccagctccagctcccccaacacctgccccagagccacatactcctgtgcccttctcctggggcttagctgaatatgacagtgtggtggctgccgtgcaggagggggcagcggagctggaaggcggcccatactccccactcgggaaggactatcgaaaagctgaaggggaaagggaaggagagggtggggctggagctcctgacagcagctccttcagtccaaaggtcccagaggctggtgagagccttgccaccagggacactgagcagactgagccagagcagagagagcccacaccctatcccgatgagagaagctttcagtatgcagacatctatgaacagatgatgcttactggactgggccctgcttgccccaccagggagcctccactgggggcatccggggactggcccccacacctctcaaccaaggaggaggctgctggctgcaatacttctgcagagaaggagacttcctcccctgcctcgccccaaaacctccaatctgacactccagctttcagctacgcatctctggcaggacccgctgtacctcccaggcaagaaccggatccaggacccaatgtggagcccagcatcacccctcccgcagtgccccctcgcgcccctatctccctgagcaaagacctgagtccccctcttaatggaagcactgtgagctgcagcccggacaggaggaccccatccccaaaggaaacgggccgaggtcactgggatgatggtaccaatgactcagacctggagaagggggcccgggaacagcccgagaaagagactcggtccccaagtccccatcaccccatgcctatgggccactcctcactgtggcctgaaaccgaggcatacagcagcctttcctcagactcacacctaggatctgtccgtccaagtctggacttccctgcttcagcctttggcttctcctccttgcagcctgctccccctcagctgccctctccagctgaaccccgctccgcaccctgtggctcacttgccttctctggggaccgagctctggccttggttccaggaactccaaccagaacccgacatgatgagtacctggaagtgaccaaggcacccagcctggattcctcactgccccaactcccatcacccagctctcctgggggccctcttctctctaacctgcccagacctgcctcgccagccttgtctgaagggtcctcttctgaggctaccacgcctgtgatttcaagtgtggccgaacgcttccctccaggtctcgaggcagctgaacagagtgctgaaggactgggctcaggaaaagagtcggctgcccacagcctctgggacctcactcccctgagcccagctccctcagcttcactggacttggctccagctccagctccagctccagctccagctccaggcctgcctggagacttgggcgatggtaccctgccctgccgccctgagtgcacaggggaactcaccaagaagccaagccccttcctgagcccctctggagatcatgaagccaatggcccaggagaaaccagccttaatcccccagggtttgtcacagccacggcagaaaaagaagaggctgaagcccctcatgcttgggaacgagggtcctggcctgagggagctgagaggagctcccggccggatacacttctctcatctgagcagccactgcgtcctgggaagagctccgggggcccaccctgcagtctttcttctgaagtcgaggctggacctcagggatgtgctacggatccccgcccccactgcggggagctttccccctcattcctgaaccctcctctgcctccatccacagatgacagtgacctttccacggaagaagctcggctggcaggaaaaggagggaggcgacgggtagggaggccaggggccacgggaggtccatgccctatggctgatgagacaccccccacatcagccagcgactcaggctcctcacagtcagattctgatgtcccaccagaaactgaggagtgtccatccatcacagctgaggcagccctcgactcagatgaagatggggacttcttgcctgtggacaaagctgggggagttagcggaactcaccatcccagacctggccatgacccacccccaacccccctaccagacccccgcccatcccctccacgaccggatgtttgcatggctgaccctgaggggctcagctcagagtcggggagggttgagagactacgagaaaagggacgacctggccgtagggcccctggccgggccaagcctgcatctcctgctaggcggttggatattcggggaaaacggtcacctactcctggcaaagggcctgtagatcgaacatctcgtactgtaccccgaccacggagcactccaagccaggtcacctcagcagaagaaaaggatggtcacagtcccatgtccaaaggcttagtcaatggcctcaaggcaggatcaacagccttgggctccaagggtggttccggccctcctgtgtatgtggatcttgcctatatcccaaatcactgcagcggcaagactgcggatcaggacttcttccgccgagtacgtgcgtcctactatgtggtcagtggaaatgaccctgccaatggcgagccaagccgggctgtgctggatgccctgctggaaggcaaggcccagtggggggagaaccttcaggtgactctgattcccactcatgacacggaggtgactcgtgagtggtatcagcagacacatgaacagcagcagcagctgaatgtcctggtcctggcgagcagcagcactgtggtgatgcaggacgagtcctttccagcctgcaagattgagttctgaatgacccatgctcccttccccaaggatccactcctacagttcatttagagaatggctactgctgagtcctctggggttgagggaagtagagctgggcaggggccatgtcatattattaggctaagcggaaggtcctgtccttcccctcctctctccctgggggtttcaaaaccaaaggcaatgagggggcatacaaaatcatgaaaggttatctgatgcccaaaaacccctagagccactccctctcctagcactgccaaatgctggtcttgcacgaggatgggtttcagacagcacactcctccccatggaggaagatttaacaccctctcccccagaacctcattatttatttggcattccagaaaggattgctgataatgtatatgatgcagggaaggccactgttagtaaggtgccagagctgcgcccttttttccatctcccagtccctagccaccagagtctgggttccatcagcgacctggggacatgtggctactatactgtcttattgcttccctcaatatctgaatgtctcaatccaaaacttgaagctctttagaccaagaactagggagaggaaaaaggagctcatctctcagcccctgcttcaaaccacttacagccttgggctgtacccagaccaggctacctgggcagcacaacgggcaaggagagcccccaaccccagtcgctccaagcacccctatcacttagtcttcacctaccccatttcaataagcctcattccttctcatcccctgcttggcttctctgcatgtggtcatctgctatggcctggtgtgtaatgggtttaaaaaaagccactgcctgacatccacatccactttagccatgtgtgactccctcaacattccaatcctctaccatcctgcagctgaaatgggaacactggctgcctctctaaacctaaactcttggatagagtttctgggaggtggaggctggactagagacctggggagggggatgggagggaggaggggagagaagagaagaagctatagtttaactcctccagagtgaagacaggctgagcattctactacaggacagggcctcaccccaagcaagccagtgagcagcccagccagaccctgctggactgagaaacccagctgctgacagaccctgggacttgccttctttgccaagtcaaggggaaaccaaaaggagcttccctcctattcttcctagctcccctccctgccctggctctgctcctccccacacttccctgctacagtcccagttgctgtaacagccacctccactctaacaataaaccaagttcattgcggaaaaaaaaaaaaaaaa

SEQ ID NO: 3703 - DNA, 1964 bp, Rattus norvegicus
  Genbank Accession No. NM_030998
gattcggcacgagaggaagcgttgacgagggtagctgtgctggtgtgtgctgtcctgctgacatcctttagtaggatgctggggacactggggctttggacactgcttcctgcagctgcacaagtatccccaaacaggaggacctgtgtgttctttgaggctcctggagttcggggaagcacaaaaacactgggggaagtggtagatgcaggaccaggccccccgaagggtatccgctgcctctacagccattgctgctttgggatctggaatctgacccatggccgggcacaagtggagatgcaaggatgcctagacagtgatgaacccggctgtgagtccctccactgtgaccccgtcccccgagcgcaccccagccccagctccacactcttcacatgctcctgcggtaccgacttctgcaatgccaactacagccatctgcctccttcaggaaaccgaggggctcccggcccccaggagcctcaggctaccccaggtgggcccatctggatggcgcagctgctgctgggagtgttccttgtgctgctgctgagtatcatcatcttggccctgttacaacgaaaagcctgtagagtgcaaggtgggtcagacccggagccggagccaggctcaggaggagactgcagtgaggaactgcccgagttggctgagctgcgcttctcccaggtaatccaggaaggaggtcatgcagtcgtctgggctgggaggctccagggtgagatggtagccatcaaggccttccccccaagggctgtggcccagttccgagctgagcgagctgtgtaccagctgctaggcctacagcataaccacattgttcgctttatcactgctggccagggaggtcctggccccttgccctctgggcctttgctggtactggaactgtaccctaagggctccttatgccactacttgactcagtacacgagcgactggggcagttccttgaggatggctctgtccctggccgagggcctggcgtttctccacggggagcgttggcaggatggccagtacaaaccaggtatcgctcaccgagacctgagcagccagaatgtgctcattcgggaagataggtcatgtgccatcggagacctgggccttgccttggtactccctggccttgctcagccccctgccttggcccctactcaaccccgaggcccagctgccattttggaggctggcacccagaggtacatggctccggagctcttggacaagactctagacctgcaggactggggcacagctctccagagagcggatgtttactctctggctctactactgtgggagatcctgagccgctgttccgatttgaggcctgaccacagaccaccaccttttcaattggcttatgaggcagaactgggcagcaatcccagtgcctgtgagctctgggccctggcggtcgcggagaggaagcgccccaacatcccttcctcttggagctgctctgccacagaccctagggggctgagggagctcctggaagattgctgggacgcagacccagaagcaaggctgacagctgagtgtgtgcagcagcgcctggcagccctggcttatcctcaggtggcttcctccttcccagagagctgtccacagggctgcccagagaactgccctgcagcgcctgcctctgcggctttcccctgcaggcctcagcagagttcttgtctcctcagtgttcagcaaggctctggctctaagtcctgagcctgtaagtgccactgttcaggtgtatgtaaatgagcagctcatatgaactctgtacaggctgacatgcgtgtggccgacatgcgtgtgtcgggtgtcagcctcatgcctgttgatgtcattctgtgtgggtttctaacccatcgggtagctatgctcaggaaagagaataaagcaagattcccactcaaaaaaaaaaaaaaaaaaaaaaaaaa

SEQ ID NO: 3704 - DNA, 1726 bp, Rattus norvegicus
  Genbank Accession No. NM_031003
cgatcgcgcaagtcggacccgtggatcacagcctgtagatcgcggcccgggcctggaggacaacagcaagtgaagggggttcctcttcctgaaggaggggtcatggccttcttgttgactacccgacggctggtctgcagttcccagaaaaacctccacctcttcacacctggatccagatacatcagccaagctgctgccaaagttgactttgagtttgattatgatggaccactcatgaagacagaagtcccgggccctagatctcaggagctaatgaaacagctgaacacaatccagaatgcagaggccgtgcactttttctgcaactacgaagagagccgaggcaactacctcgtggacgtggatggcaaccgcatgttggacctgtattctcagatctcctctgtacccatcggttacaaccatccggctctggcgaaactcgttcaacagcctcaaaacgcgagcactttcatcaacagacctgccctgggcatcctgcctccagagaactttgtggacaagctccgggagtccttgatgtcggtggcgcccaaaggcatgtgtcagctcatcacgatggcctgcgggtcctgctccaatgagaatgcattcaagaccatcttcatgtggtaccggagtaaagaacgaggtcagagaggtttctccaaagaggagctggagacttgcatggttaaccagagtcctggatgcccagactacagcatcctctccttcatgggtgctttccacgggaggaccatgggttgcttagcgaccacacactccaaagcaattcacaagattgacatcccttcctttgactggcccattgctccattcccacggctgaaatatcccctggaggagtttgtgacggacaatcagcaagaggaggcccgctgtctagaagaggtggaggatctaattgtgaaatatcggaaaaagaagagaacagtggctgggatcatcgtggagcccatccagtccgaaggtggagacaaccacgcatcagatgacttcttccggaagctgagagacatagccaggaagcatggctgtgccttcttggtggacgaggttcagactggaggaggctgtacaggcaagttctgggcccatgaacactggggcttggatgacccagccgacgtgatgtcgttcagcaagaagatgatgactgggggcttcttccacaaggaggagtttcgaccaagtgctccttaccggatcttcaacacctggctgggggacccatccaagaacttgctgctggctgaggtcatcaacatcatcaagcgggaagacctgctcaacaacgtggcccatgccgggaagaccctactgaccgggctgctggacctccaggcccagtacccccagttcgtcagccgggtgaggggacgaggcaccttctgttccttcgacactcccgacaaagccatacggaataaactcatcctaattgccaggaacaaaggtgtggtactggggggctgcggtgacaaatccatacgtttccgtcccacgctggtcttcagggatcaccatgcccacttgttcctcaacattttcagtggtatcttagcagacttcaagtaaagaagccatctccacgacattcagagaaagctctgtcccagcggtgtcaacttgattagtttgcctaattcatattttcacttcaaagtttatcagaggcgaatgcataaactaaagggtc

SEQ ID NO: 3705 - DNA, 2956 bp, Rattus norvegicus
  Genbank Accession No. NM_031005
gaattcggcacgaggtcagcagcaacctcctcgagcagagccgcggcggaagcgggctcaggggagcgagcccggccccgccagcccagcccagcccagcccagcccagcccaaccctgccgactccctccccacgcccgggtagcagccgccgtcgcctggagagaaggtggagaaagaaatctagcccctagcacgcacgcaccatcatggaccattatgattcccagcagaccaatgactatatgcagcctgaagaggactgggaccgggacctgctcctggatccggcctgggagaagcagcagagaaagaccttcacggcctggtgcaactcccacctgcgcaaagcagggacccagattgagaacattgaagaggacttccgagatggcctgaagctcatgctgctcctggaggtcatctcaggtgagcgtttggccaagccagagagaggcaagatgcgagtgcacaagatctccaacgtcaacaaggccctggatttcatagccagcaaaggggtcaagctggtgtccattggagctgaagaaattgtggacgggaatgtgaagatgaccctgggcatgatctggaccatcatccttcgttttgccatccaagacatctctgtggaagagacatcagctaaagaagggttgctcctgtggtgtcagaggaagacagccccatataaaaatgtcaacatccaaaacttccacatcagttggaaggatggtcttggtttctgtgccttgatccaccggcaccggcccgagttgattgactatggaaagcttcgaaaggatgatccactcacaaacctgaacacagcctttgatgtggcagagagatacctggacattccaaagatgctggatgcagaagacatcgtcggaactgcccggccagatgagaaagccattatgacctatgtgtctagcttctaccatgccttctctggagcccagaaggcggaaacagcagccaatcgcatctgtaaagtgttggccgtcaatcaagagaatgaacagcttatggaagactatgagaagctggccagtgatctgttagagtggatccgccgcaccatcccatggctggagaatcgggtgcccgagaacaccatgcaggccatgcagcagaagctggaggacttccgagactaccgacgcctgcacaagccgcccaaggtgcaggagaagtgccagctggagatcaacttcaacacactgcagaccaagctgcggctaagcaaccggcctgccttcatgccctccgagggcaggatggtctcggatatcaacaatgcctggggctgcctggaacaggcagagaagggctacgaggagtggttgctgaatgagatccggaggctagagaggttggaccacctggcagagaagttccggcagaaggcctccatccatgaagcctggacagacggcaaagaagccatgctgcggcagaaggattatgagacggccaccttgtccgagatcaaggccctactcaagaagcacgaggcctttgagagtgacctggctgcccaccaggaccgcgtggagcagatcgcggccattgcccaggagcttaatgagctggactattatgactcaccaagtgtcaacgctcgatgccaaaagatctgtgaccagtgggacaatctaggggccctgactcagaagcggagggaagctttagagcgaacagagaagctgctggagaccatcgaccagctatacttggagtacgccaagagggctgcacccttcaacaactggatggagggagccatggaggaccttcaagacaccttcatcgtacataccattgaggagatccagggactgaccacagcccatgagcagttcaaggctaccctcccggatgcagacaaggagcgcctggccatcctgggcatccacaatgaagtgtccaagattgtccagacctatcatgtcaacatggcaggcaccaacccctatacaaccatcacacctcaggagatcaatggcaaatgggaccatgtacggcagctggtgccccggagggaccaggctctaacagaggagcactcgaggcagcagcacaacgagaggttacgcaagcagtttggggcacaagccaatgtcatcggaccctggatccagaccaagatggaggagattgggaggatctccattgagatgcacggtaccctggaggaccaactcagccacctgcggcagtatgaaaagagcatcgtcaattataagccaaagattgaccagctggagggcgaccaccagctcatccaggaagcacttatcttcgacaataagcacaccaactacacaatggagcacatccgtgtgggctgggagcagctgctcaccaccattgccaggaccatcaatgaagtggagaaccagatcttgacccgggatgccaaaggcatcagccaggaacagatgaacgaattccgggcctccttcaaccactttgaccgggatcactccggcacgttgggtcccgaagagttcaaagcctgcctcatcagcttgggttatgatattggcaacgacccccagggagaggcagaatttgcccggatcatgagcattgtagaccccaaccgcttgggggtagtgacattccaggccttcatcgacttcatgtcccgagagacggctgacacagatacagcggatcaggtcatggcttccttcaagatcctggctggagataagaattacatcaccggggatgagctgcgccgcgagctgccacctgaccaagccgagtactgcatcgcgagaatggccccctacgcgggccctgactccgtgccgggtgctctagactacatgtccttctccacggcgctgtacggcgagagtgacctctaacccacccctgcctccccccaccctggccttctgcgcgtgcgccccaccctgctcctgctccgcccagt

SEQ ID NO: 3706 - DNA, 3608 bp, Rattus norvegicus
  Genbank Accession No. NM_031006
gggccttgccggcggagctatgtctcaggggttcaggggacccacaggggtgttccctcaccagacacagccctgcttggaccctagctatgagcacagcaagtggagatacctgcagccacgtgggtcggagtcttaccttaggagtttccagctccagcagatagagtttctcaaagggcggctcccagaagcacccttgattggagcacagacccagtcactaccgccattcctcccaggacactggccaaggttcccagggccacctgcccaaggaaaacaaccggaaatctgggggtttcccaggagtgtgactctcagaaatcaggggttccatataggacccccacttcctcctccacacagcaggggtccgccatggagaggtgctgaaggtctttgctcacacttccaggagctgagcatcagtcagaatccagagcagaaggtcctaaaccgcctggaagagcttggtgaggggaaggccaccactgcctacgcgctagccagagagctcaggacccccaaaaaggacatcaatcgtatattgtactccttagaaaggaagggaaaactgcatagaggagtggggaagcctcctttgtggagccttgtgcccttaagtcaggcttgcactcagccccctagagctgtgaattcagacaaggaagtccctcgaggagagcccgatttggacagtgaggacggagaccctgcctctgacttagaaggaccttctgagcttcttgatatggctgaaattaaggagaaaatctgtgactatctgttcaatgtgtcaaagtcctctgccctgaacctggctaagaacattggcctcgccaaggcccgagatgtgaatgcagtgttgattgacttagaaaggcaaggcgatgtctacagggaaggggccactcctcccatctggtacttgacggacaagaagcgtgagaggctgcagatgaagagaagtacacacagtggtcctgcagctaccccagcagctgtctcagaagccactcaaagcacctcattccctacctgccacccaccccaatcaggtggctcaagcagcatggcaacctccaaaagagtggaaaacgggcaggagcctgtgacaaagtatgaaagtaggcacgaggcccgaccaggaccagtacgactgcggcctcatgcttatcacaacggcccctctagagcagggtatgttgcctctgaaaatggcccgtgggccacagatgacatcccagataacttgaatagtatccacacagcaccaggtgagtttcgagccatcatggagatgccctccttctacagccctaccttgccacggtgttcaccctacaagaagctaactgagtgccagctgaagaaccctgtcagcgggttgttagagtatgctcagttcactagtcagacctgtgatttcaacctgatagagcagagtggaccgtcccatgaacctcgatttaaattccaggttgtcatcaatggtcgagagtttcccccagctgaggctggcagcaagaaagttgctaagcaggacgcagcagtgaaagccatggcgattctgcttcgggaagccaaagccaaagacagtggacagccagaagaattgtccaactgtcccatggaggaagacccagagaagccagcagagtcccagccccccagctcctcagcaacatccttgttctctgggaagagcccagttactacactgcttgagtgtatgcacaagctagggaactcctgtgaatttcgtctcctgtccaaagaaggccctgctcatgaccccaagttccagtactgtgtggcagtaggagcccagactttcccctctgtgagtgcccccagcaagaaagtagcaaagcagatggccgcagaggaagccatgaaagctctgcaagaggaggcggccaattccgctgatgaccagtctggaggtgcgaacacagactcacttgatgaatctgtggctcccaacaagatccggaggatcggtgagctcgtaaggtacctgaacaccaaccctgtgggtggcttgttggagtacgcccgctctcatggctttgctgctgagttcaagctcattgaccagtctggacctcctcatgaacccaagtttgtttaccaagcaaaagttgggggccgctggtttccagccgtgtgtgcacacagcaagaaacagggcaagcaagacgcagcggatgcagcccttcgtgtcttgatcggggagagcgagaaggcagagcagttgggtttcgcagaggtaaccccagtaaccggggccagtctcagaagaactatgctactcctttccaggtccccagatgcacatccaaagacacttcctctcactggtagcaccttccacgaccagatagctatgctgagccacagatgcttcaacgctctgaccaacagtttccagccctccctgctcggccgcaagatcctggctgctattattatgaagagagatcctgaggacatgggtgttgttgtcagtttggggactgggaatcgctgtgtgaaaggggactctctcagcctgaaaggagagactgtcaatgactgccatgctgaaatcatctcccggagaggcttcatcaggtttctctacagtgagctgatgaagtacaaccaccacactgccaagaacagcatattcgagctggccaggggaggagagaagctccagataaaaaagacggtttcttttcacctctacatcagcacggcaccatgtggagatggagcccactttgacaaatcctgcagtgaccgtgctgtggaaagcacagagtcccgccattaccctgtctttgaaaatcccaagcaaggcaagcttcgcaccaaggtggagaatggggaaggcacaattcctgtggagtccagtgacattgtacccacgtgggatggcatccggcttggggaaagactccgtaccatgtcctgtagtgacaaaatcctacgctggaatgtgctaggcctgcaaggggcgctgttgacacacttcctacagcctgtgtacctgaaatctgtgacattaggttaccttttcagccaagggcatctgacccgtgctatttgctgccgtgtgaccagagatgggaatgcatttgaggatggactacgttatccctttattgtcaaccaccccaaggtcggccgagtcagtgtgtatgattccaaaaggcagtccggaaagaccaaagagacaagcgtcaactggtgcttggctgatggctatgacctggagatcctggatggcaccaggggcaccgtggatggaccagggaaagagttgtcgcgggtgtctaagaagaatattttccttcagtttaagaagctctgctccttccgagcccgcagagatttgctgcagctctcctatggggaggccaagaaagctgcccgtgactacgacttagccaagaactacttcaagaaaagcctgagggacatgggctatgggaattggatcagcaaaccccaggaggaaaagaacttttatctctgtccagtgcccaatgactgatagtggggtgtgttcccatggggtcagagggaggtcatagcattcctcatcacattgggcc

SEQ ID NO: 3707 - DNA, 4008 bp, Rattus norvegicus
  Genbank Accession No. NM_031007
cccgggcagcgcgctctgcggtcgcctaccgcctgccgcccccgcgccgccgcgacgtggcaggaggcgatgcggcggcgccgctacctgcgggaccgcgccgaggcggcggcggcagcggcggcgggaggcggagaggggctgcagcggtcccgggactggctctacgagtcctactactgcatgagccagcagcacccgctcatcgtcttcctgctgctcatcgtcatgggcgcctgcctcgccctgctagccgtcttcttcgcgctcgggctggaggtggaagaccatgtggcatttttaataacggttcccactgccctggccattttctttgccatattcattcttgtctgcatagagtctgtgttcaagaagctactccgtgtgttttcgctggtgatttggatatgtctggttgccatgggatacctgttcatgtgcttcggagggactgtgtctgcctgggaccaggtgtcattcttcctcttcatcatctttgtggtatataccatgcttcccttcaacatgcgagatgccatcattgccagcatcctcacatcttcatctcatacgatagtgctgagcgtctacctgtctgcaacaccaggggccaaggagcacctgttctggcagatactggccaatgtgatcattttcatttgtgggaacttggcgggagcctaccacaagcacctcatggagcttgccttgcagcaaacctatcgggacacgtgtaattgcatcaagtcccggatcaagctggaatttgaaaaacggcagcaggaacggctcctgctctccttgctgccagctcacatcgccatggagatgaaagctgaaatcattcagaggctgcagggccccaaagcaggacagatggaaaacacaaacaacttccacaatctgtatgtcaaacgacacaccaacgtgagcatattatacgctgacattgttggcttcacccgccttgcaagcgattgctcccctggcgaactggtccacatgctgaatgaactctttgggaagtttgatcaaatagcaaaggagaatgaatgcatgagaattaaaattttaggagactgctattactgtgtttccgggctccctatatcactccctaaccatgccaagaactgtgtgaaaatgggattggatatgtgcgaagccataaagaaagtgagggatgctaccggagttgatatcaacatgcgtgtaggagtgcattctgggaacgttctctgtggtgtgattggtctccagaagtggcagtatgatgtgtggtctcatgatgttactctggcaaaccacatggaagctggaggagtccctgggcgtgttcacatttcttcagtcactctggagcacttgaatggggcttataaagtggaggaaggagatggtgagataagagacccatatttaaagcagcacttggtgaaaacctactttgtaatcaatcccaagggagagcgacggagtcctcagcatctcttcagacctcgacacactctggacggagccaagatgagagcatctgtccgcatgacccggtacttggagtcctggggagcagccaagccattcgcacatctgcaccacagagatagcatgaccacagagaatgggaagattagtaccacggatgtgccaatgggtcaacataattttcaaaatcgcaccttaagaactaagtcacagaagaagagatttgaagaagaactgaatgaaaggatgatccaagcaattgatgggatcaatgcacagaagcaatggctcaagtcagaagacattcaaagaatctccctgcttttctataacaagaatatagagaaagaataccgagctactgcactgccagcattcaagtactacgtgacctgtgcctgcctcatctttctctgcatcttcattgtacagatacttgtattgccaaaaacgtccatccttggcttctcctttggagctgcatttctctccctcatcttcatcctctttgtctgcttcgctggacagcttttgcaatgcagcaaaaaggcctccacctctctcatgtggcttttgaaatcatcaggcatcatcgccaaccgcccatggccacggatctccctcacaatcgtcaccacggctatcatactaaccatggctgtgttcaacatgtttttcctgagcaactctgaggagacaacccttcccactgccaatacatcaaatgcaaacgtttctgtcccggataaccaggcgtcgattcttcatgctcgaaacttgtttttcctcccgtacttcatatacagctgcatcctgggcttgatctcctgctccgttttcctgagggtgaactatgagttaaaaatgttaatcatgatggtggcactcgtgggctacaacaccattctactccacacccatgcccatgttctggatgcgtacagccaggtcctgtttcagagaccaggcatttggaaagacctgaagaccatgggctccgtgtcactctccatattcttcatcacgctgctggttctgggcagacagagtgaatattactgtaggttagacttcttgtggaagaacaagttcaaaaaagagcgggaggagatagaaaccatggagaacctaaatcgagtgctgctggagaacgtgcttcctgcacacgtggctgaacacttcctggccaggagcctgaaaaatgaggagctgtaccaccagtcctacgactgtgtctgtgtcatgtttgcctccattccggacttcaaggagttctacacagagtcagatgtgaacaaggaaggcttggaatgcctgcggctcctgaatgagatcattgctgactttgatgatctgctttctaagccaaagttcagtggtgttgaaaagatcaagaccattgggagcacatacatggcagccacgggactgagtgccatacccagccaggagcacgcccaggaacctgagcgtcagtacatgcacataggcaccatggtggagtttgcatatgccctggtgggaaaactggatgccatcaataagcactccttcaacgacttcaaactgcgagtgggtatcaaccatgggcctgtaatagctggcgtcataggggctcaaaagccacagtatgacatctggggcaacactgtcaacgtggccagcagaatggacagcaccggggtcctggacaaaatacaggtgactgaggagacaagcctcatcttgcagacgcttggctacacgtgtacatgtcgaggtatcatcaatgtgaaggggaaaggggacctgaagacatattttgtaaacacagagatgtcaaggtccctttctcagagcaacttggcatcctgagaagctgtctcttcctgacaagaagaatgtacttgcaggaaggtaccacgcactttctgactgcaacccttccccttcgtcctgatgtacgtgctctgccccatcctctggagcccctgcagactagttcctgtgacccagtgacatactgtttggtgtctgcgcgtgcccaggttgtcctgccacttgcactgtgcttgctcctaagcaggaggggaaggaaccatgtcctggaaggagagcattggaagaagtgatgaagaggtgaagtgaacacacattcttaaggcaataaaaccggggggtgtatattatcttctggtgcatgttcttctctggaaaatacggtagctcgtaactgcatccctagtctgatattcaaacacacagtatttgtgaataagctgatcccgtcacccaacatggagtctgtgttcacctacccatgtgtctcattgccagtggtcgtccttgggggctcagctgagactctcagcttctgtcaccttgctgtcctgtcttgtggcagcagcacgttgccatccatcaccagaattagtcctcacagcctaggaccagttttgtaccaaactcatctgatgttttgatgccatttgtcaaaagtaaggttaattcattaaaagttttatgtactttgaaaaaaaa

SEQ ID NO: 3708 - DNA, 3109 bp, Rattus norvegicus
  Genbank Accession No. NM_031008
tccagcccgccgccgagccgctcccgggtcgcaaagatgccggccgtatccaagggggaggggatgcgaggcctagcggtcttcatctccgatatccgtaactgtaaaagtaaagaagctgaaataaagaggataaataaggagctggcaaatattagatcaaaatttaaaggtgacaaggctcttgatggctacagtaagaagaagtatgtctgcaagttactcttcatctttctccttggtcatgacattgacttcggacacatggaagctgtgaatcttctgagctcaaacagatacacggaaaagcagatcggctaccttttcatctctgtattggtgaattcaaatagtgaactgatccggttgattaacaatgccatcaagaatgacctggccagccgcaatcctacatttatgggtctggccctgcactgcatcgccaatgtaggtagccgtgagatggcagaggccttcgctggagagatccccaagatcctggtggcaggagataccatggacagtgtgaagcagagcgcagccctgtgcttgttgcgcctgtacaggacgtcacctgacctagttcctatgggcgactggacatcccgtgtggtacacctcctcaatgaccagcacttgggtgtagtgactgccgcaactagcctcatcaccacactggcccagaagaatcctgaggagttcaagacctctgtctctctagctgtctctcgactgagcagaattgtgacgtccgcgtcaacagatcttcaggattatacttactactttgtcccggctccttggctgtcagtcaaacttctgagactgctgcagtgctacccacccccagaccctgcggtgcgtggccgcctgactgagtgcttggagaccatcctgaataaggcccaggagccccccaagtccaagaaagtccagcattcaaatgccaagaacgctgtgctgtttgaggccatcagcctcatcatccaccatgacagtgagcccaacctcctggtccgtgcctgcaaccagctgggccagttcctgcagcatcgggagacaaacctgcgctacctggctctggagagcatgtgcacactggccagctctgagttctctcacgaggctgtcaagacccacatcgagactgtcatcaatgccttgaagacggaacgagatgtgagtgtgcggcagcgggcagtggacctgctctacgccatgtgcgaccgaagcaacgcccagcagattgtggctgagatgctgagctacctagaaacagctgactactccatccgggaggaaattgtgctgaaggtggccatccttgctgagaagtatgcagtggactacacttggtatgtggacaccatcctcaacctcatccgcattgcaggcgactatgtgagcgaagaggtgtggtaccgcgtcatccagattgtcatcaatcgcgatgatgtgcagggttatgctgccaagacggtatttgaggcattgcaggctccagcatgtcatgagaacttggtcaaagtgggcggctacatcctgggcgagtttggaaacttgatagcgggagacccacgatccagccctctgatccagttcaacctgctccactccaagttccacttgtgcagcgtccccactcgggcactcctgctgtccacctacatcaagttcgtgaacctctttccagaggtaaaggctaccattcaggacgtgctgcgcagtgacagccaactgaagaacgcagatgtggagctgcagcagcgggctgtggagtacctgcgactgagtactgttgccagcactgatatcctggcaactgtcctggaagaaatgccacccttccctgagcgtgagtcctccatcttggccaagctgaagaagaagaagggcccaagcacagtgactgacctggaggagaccaagcgtgagcgaagcatcgatgtgaatgggggccccgaacccgttccagccagcaccagtgctgcgtccacaccttctccatcagcagacctgctgggtctgggggccgttccccctgctcccacagggccccctccctcctctggcggtgggttactggtggacgtgttctcagactcagcttctgcagttgcacctcttgcacccggctctgaagacaactttgccaggtttgtttgtaaaaacaatggtgtgttgtttgaaaaccagctgcttcaaattggactgaagtcagaatttcggcagaatttaggtcgaatgttcatattttatggtaacaagacctccacgcagttcctaaactttactccaacactaatctgtgctgacgaccttcagactaatctgaacctgcagactaagcccgtggacccaactgtggatgggggcgcacaggtgcaacaggtgatcaacattgagtgtatatctgattttacagaggcacctgtcctcaacatccagttcaggtatggtggtaccttccagaatgtttctgttaagcttcccatcactctcaacaaatttttccagcccacagaaatggcttctcaggatttctttcaacgttggaagcagttgagcaatccacagcaagaagtgcagaatatcttcaaagcaaagcatccgatggacacagaaatcactaaagcgaagattattggatttggttctgcgctcctggaagaagttgatccaaaccctgcaaattttgtgggtgctggcataatacataccaaaaccacccagatcggctgcttgttgcgcctggagccaaacctgcaagctcagatgtacagactcaccttgcgtaccagcaaagacaccgtctctcagagactatgtgaattgctgtcggaacagttctaatccacagaccagaagatcaggctctttgtttgtgcgtctctctcgtctctctcgtttgtctttgtaccacactgcagataaacaccccttgtctgaaaactgccattcaaggcacctccagtcctacacctacagccagcccctgggtgtgaagggaatgcaggacacagtttgagaagggctgcagcaggcctgccccgtcaaagaagggtgcctgggcctgggaaatcaaggcagtcctgtggttcaacctaca

SEQ ID NO: 3709 - DNA, 2156 bp, Rattus norvegicus
  Genbank Accession No. NM_031009
gcacgagacacacagcctttccagcgccacgctgtggatggggagcggccaccaggcttgaaagaagcccagagctggcgactgcacacggtcgattttaaatagtgtcagagagcaattcacctcaccaaaggagacatgatccttaactcctctactgaagatggaattaaaagaatccaagatgactgccccaaggctggcaggcacaattacatatttgtcatgatccctactctctatagcatcatctttatggtgggaatatttggaaacagcttggtggtgattgtcatttacttttacatgaagctaaagactgtggccagtgtttttcttctgaatcttgccctggctgatttatgctttttgttgactttgccactgtgggcagtctataccgctatggaataccgatggcccttcggcaaccacctatgtaagatcgcttctgccagcgtcagtttcaatctctatgccagtgtgtttctgctcacgtgtctcagcatcgatcgctacctggccattgtccacccaatgaagtctcgcctccgccgcacgatgctggtagccaaagtcacctgcatcatcatctggctaatggctggcttggccagtttgccagccgtcatctaccgaaacgtatatttcatcgagaacaccaatatcacagtttgcgcttttcattatgaatctcagaactcaacactccccattggactgggtctaacaaagaacattctgggcttcgtgttccctttccttatcattctcaccagctatactcttatttggaaagccctaaagaaggcttataaaattcagaagaacacgccaagaaatgatgacatctttaggataattatggcgattgtgcttttcttcttcttttcctgggttccccaccaaatattcacttttctggatgtgctcattcagctgggcattatccgtgactgtgaaattgctgacattgtggacaccgctatgcccatcaccatctgcatagcttattttaacaattgcctgaatcctctgttttatggctttctggggaaaaaatttaaaaaatatttcctccagcttctgaaatacattcccccaacggccaagtcacatgcaggcttgtcaacaaaaatgagcactctttcctaccgcccttcagataacatgagttcatctgccaaaaagtctgcatctttttttgaagtggagtgagagggttcaaagcctgcaagtgaagtgatttcctgacagcagaagccagaggaccatttgggctaagcagctcactcactaccgaaggagtgttcaacctccagcaatcctttcagggttgaagcagagaaagcactcagtgtacacattttcaaaagtgggaaacaaaagcttttttcccctttaaaacaaattggagcaaagccactgttaaaagcctttttttgttgactgaataactgctttaaggacaatgtcagaaattgagtggctgtatggatttgggagttagggaggaggtgtactagcagaaacgtaatgtctccagtcccctctcaattctgttacttttgatttccacttgaaggtatttagaagctattaaatctgtagacaatcaaaaggagatgggaggtcaagagtttctaagggtccaggaagctacccatctgtttagttactagtgactatgacaccattgttcctgacacaacacagttaagacttgctagacagtagtcatcaagtttcaaaatgctttgtgaagttcagccagtgtcttaagaattcagagccatgtgccaaaacagtaccacagaacagcttgtctgaataatgtcttactgtagttgcaaagccaaactgcttgtcaagctgtgattctgtcccagatagttgtgtcttcctagttggatcagtttaatttcatatctaagaaatgtataatttcatatctaagaaatgtatatgaaatgtatatgaaatgtataatttcatatctaagaaatgttaagcagatttatcataaagtatgttttatggttctaaaaatgtatattttatatatgttatgtatatctatatctctaagctgttgtttgattgaagttgtagcaaagttgtatttatcttgaaataaaaatttatcataatataaa

SEQ ID NO: 3710 - DNA, 3102 bp, Rattus norvegicus
  Genbank Accession No. NM_031011
cggggaaagcagcggactacaagagactgaactgtatctgcctctatttccaacggactcacgttcaactttcgctcacgaaaatagccgggaaaattttattagtcctttttttaaaaaaagttaatataaaattatagcaaaaaaaaaaaaaggaacctgaactttagtaacacagctggaacaatccgcagcggcggcaggagcggcgggagaagagtttaatttagttgattttctgtggttgttggttgttcgctagtctcacggtgatggaagctgcacattttttcgaagggaccgagaaactgctggaggtctggttctccagacagcagtccgacgcaagccagggatctggggaccttcgtaccatcccaagatccgagtgggatgtccttctgaaggatgtgcagtgctcaatcataagtgtgacaaagactgacaagcaggaagcttatgtactcagtgagagtagcatgtttgtctccaagagacgtttcattttgaagacatgtggtaccaccctcttactgaaagcactggttcccctgttgaagcttgctagggactacagtgggtttgactcgattcaaagcttcttttattctcgtaagaatttcatgaagccttctcaccaagggtacccacaccggaatttccaggaagaaatcgagtttcttaatgcaattttcccaaacggagcaggatattgtatgggacgtatgaattctgactgttggtacctgtacactttggatctcccagagagccgagtaatcaatcagccagatcaaaccctggaaattctgatgagtgagcttgacccagcagttatggaccagttctacatgaaagatggtgttactgcaaaggatgtcactcgtgagagtggaattcgtgacctgataccaggttctgtcattgatgccacactgttcaatccttgtggctactcaatgaatggaatgaaatcggatggaacatattggactattcacatcactccagaaccagaattttcttatgttagctttgaaacaaacctaagtcagacctcctatgatgacctgatcaggaaagttgtggaagtcttcaagccaggaaaatttgtgaccaccttgtttgttaatcagagttctaagtgtcgcacagtgctttcttcgccccagaagattgacggtttcaaacgtcttgattgccagagcgctatgttcaacgattacaattttgtttttaccagttttgctaagaaacagcaacaacagagttgattaggaaaaatgaaaaagaaaaaacgcaaaaagagaagacacacaggaggtggtggctgctttctagatgttgatcctgggggccatgctgaccgtgaccaccaccttgtagctgcagaaagccctaggtgtaatgatagtgtaatcattttgaagtgtatgcattattatatcaaggagttagatatcttgcatgaatgctctcttctgtgtttaggtgttctatgccactcttgctgtggaactgaagtgcatgtagaaaagaactctgactgtatgaatctttacgacacttgtgaaaacgattcgacttggtttatgcacagcgtaatatttctgcaggcatcgtccaaaatcccccacagacaaggctttcgtccccattagatgcggcctcagctgaccattggcgactgttctatttgctgccagagtttttacatccagttacctccactttctagagcatattctctactaatgttcaaaaccgatttctacttcatacgggtgtcttatgcaatggcaattaaagttttcttccacaagttgagtctttgtaaggaaatgattccagttgcttgttttgtgttctactgttttagtaattgctcctgcatttatagtcctatggtttttcactacccctgatgaagcaatacacggtcacactgtgggcttacattgtaatcttcaccccagatgggagctcagagacggtcccttgctcatttttccctaagatgtagaatgtggccttgctattggcatgcccttctgtggaagataaatgatggaagtgaaagtatcccgggggtgagcaaggagaaccaccccatggcagtgatgggcttggcagtgcactccgagctctcacagtggagtgcccaccatgccttcactaactcactgagcagtgataggatgcccaccaagtcagagcagaaatctaaccctaaggattctcacctcggtaagtgccgccattgccaccactttactaaaggaagtttccgctcagaggagagtctgtacttcccgcctgtcctaatgtcagctgttctctctggtctttcaccatggcgttcagatgctcaaatgaatggctgatcggccgcagggaggactctccgggttactgggcctggagaatggagaaacaggcacggtattctgacagttaatggcaccagagatgcgggctttcaagagctggcctgttagtggcatttttaagcagaaaagagcaaactagacgaagttccctatttattgccctcccactgtttccttggcagtttctggactggcgcaatgatgccttgttccttccgtatttataacgaagctaaaaagcgtttctaagcatggagtctacttggtttgaaatcaagtggttggaacactgtctggatttttactttacgcagtgttgattgaacgcttcgttggggaagccttcagtccgcttcatcggtctgttctgtaatgagcacagcacacctagtttgaattgctgtttggagggccagtgcttatttgagctgggtcttgtaacccagtagattttggcttgaggtctgactcccccatcttacgaaattaagaattctaatgttggaaattgcatagggtttgcgtggaaaaaagcccagggaaaaaaaaaaaaaaacagaaggcggactagtgatctagtgtgattacaggcggggaagttttggtgccataatttctttgttggtgttggacttttaatcagctgaaatgtatttctgtaccacaatgtaagcttcaataaaagtttgcttaattgtctagtaacatccag

SEQ ID NO: 3711 - DNA, 3320 bp, Rattus norvegicus
  Genbank Accession No. NM_031012
ctccctgcccaccagcatcatggccaagggtttctacatttccaagaccctgggcatcttgggcatcctgttaggtgtggcagccgtatgcaccatcatagctctgtcggtggtctacgctcaggagaagaacaggaatgcggagaactctgccatagcccccacgctcccaggcagcacctcagccaccacctcaactaccaaccctgctatagatgaaagcaaaccttggaaccagtatcgcttgcctaagactcttatacccgactcctaccaggtgaccttgaggccttacctcacccccaacgagcagggcctgtacatcttcaaaggttccagtactgtccgctttacctgcaacgagaccacaaatgtcatcattatccacagcaagaagctcaactacaccaacaaagggaaccacagggtggcgttgcgagccctgggtgacactccggcacctaacatcgacacaacggaactggtagagcgcacggagtacctggtggtgcacctgcagggctccctggtaaagggccatcagtacgagatggacagtgagttccagggggagctggctgatgatctggctggcttctaccgcagcgagtacatggaaggtggcaacaagaaagtggtggccaccacacagatgcaggctgccgatgctcgaaaatcctttccttgcttcgatgagccagccatgaaggcctcattcaacatcacgctcatccaccccaacaacctcaccgctctgtctaacatgcttcccaaagattccaggacccttcaggaagatccttcctggaacgtcactgagttccaccctaccccgaagatgtccacatacctgctggcctatatcgtgagcgagttcaaatatgtagaagccgtctcacccaatagagtccagattcgaatctgggctcggcccagtgccattgatgagggccatggtgattacgctctgcaagtcacaggccctatcctaaacttctttgcccaacattataatacagcctaccctctagaaaaatctgaccagattgccctgcctgacttcaacgctggagccatggagaactgggggctcgtgacctaccgagagagtgccctggtctttgaccctcagtcctcctccattagcaacaaggagcgggtggtcactgtgattgcccatgagctggcccatcagtggtttggcaacctggtgaccgtggattggtggaatgacctgtggctgaacgagggctttgcctcctatgtggaatttctgggtgctgactatgcagagcccacctggaatctgaaagacctcatagtactgaatgatgtgtaccgtgtgatggccgtggacgcgctcgcttcctcccacccgttgtccagccctgccaacgaggtcaacacgccagcccagatcagtgagctgtttgacagcatcacctacagcaagggagcctcagtccttaggatgttgtccagcttcctgacagaggacctgttcaagaagggcctttcgtcttacctccacaccttccaatactcgaacaccatttatctggacctgtgggaacaccttcagcaggcagtggacagtcagacagctatcaaactcccagcctcagtgagcaccatcatggaccgatggattctacagatgggttttcctgttatcactgtgaacaccagtacgggagaaatctaccaggaacacttcctcctggaccccacttccaaacctacccgcccctcagattttaattacctctggattgtgcccattccgtatctcaaaaatggaaaggaggatcactactggctggagaccgagaaaaaccagagtgcagaattccaaacatcctccaatgaatggctcttactgaacattaatgtaaccggctactaccaggttaactatgatgaaaacaactggaggaagattcagaatcagctgcaaacagacctttctgttatccctgtcatcaaccgtgcgcagattatccacgactccttcaacctagccagtgctggaaagctatccatcactctgccgctgagcaacaccctcttcctggccagtgaaacagaatacatgccctgggaggctgccctgagcagcctgaactacttcaagctcatgtttgaccgctcggaggtctacggccccatgaagcgctatctgaagaagcaagtcacacccctcttcgcctacttcaaaatcaaaaccaacaactggctcgaccgtcctccaacactgatggagcagtacaacgaaattaatgccatcagcaccgcctgttctagtggtctcgaagagtgtagggatctcgttgttgggctttatagtcagtggatgaacaactctgataataacccgatccaccccaaccttcggtctactgtctactgcaatgccattgctttcggtggtgaggaagagtggaactttgcttgggaacagttccggaaagcaactctggtgaacgaggcagataaactccgctcagccttggcctgtagcaacgaggtgtggattttgaacaggtacctgagttacactctgaaccccgactacatccggaagcaggatgctacctccaccatcgtcagcatcgccaacaacgtggttggacaaactctagtttgggactttgtccgaagcaactggaagaaactgtttgaagattacggcggaggatctttctcctttgccaatctcatccagggagtgacccggcgcttctcctctgagttcgagctgcagcagctggagcagtttaaagaggacaactcggccacaggctttggctccggcactcgggctctggagcaagccctggagaagactaaagccaacatcaagtgggtgaaggagaacaaagacgtggtactcaagtggttcacagaaaacagctagttagtcccgggccgagaaccatctgtcccggcgtgacgcctatgactatctcagcagcctgtgcagggtctctgtcttcagagcgccagacaccggcatctgaccctcaaggtcaaagtctccagcctatggagctagcctagctcctaattgtcagactgccagacacctcccggtccttgcccctcgtgccaactctgccccaggcccaggcctctggggctgatctcagggaagcccagctctgagtctagatttactggacaaagggtagcctagaaagagtctccctgaatgccttactactttccccccacaagacccagaaccaaagaatcaacagggcacaaagatctatatatatttttaagagaaaatgtaaataaagaatttctaaaatgag

SEQ ID NO: 3712 - DNA, 5775 bp, Rattus norvegicus
  Genbank Accession No. NM_031013
gcccgggtcccgcctcttcctcagcttggagctgggctccgaaggctgctctgggacagagtctcatactgatgaacggagagcactcaatggccacgcctggagagtcctgcgcaggcctgagggtctggaaccagacagaacaggagcctgtggcctatcacttgctcaacctgtgcttcctgcgagccgccgggagctgggtgccccccatgtacctctgggtccttggccccatctacctcctctacatccatcgccatggctgctgctacctccggatgtcccgcctcttcaaaatcaaaatggtgctcggctttgccctcatccttctctacaccttcaacgcggccgtgcctctctggaggatccaccggggcatgccccaggccccagagcttctcattcaccctaccgtgtggctcaccaccatgagcttcgccaccttcctgatccacatggagagaaagaagggggtccgtgcatctgggttgttgttcgggtactggctgctctgctgcctcgtgccagccatcgacactgtccagcaggcctccgcagggagcttccgccaggagcccctccaccacctggccacctacctgtgcttgtccctggtggtggcagagctggtgctgtcttgtctggtagaccagccacccttcttctcggaagactccaagccattgaatccatgtccagaggccgaggcctcttttccctccaaggccatgttctggtgggcctctggactgctatggaagggctacaggaaactgctggggccaaaagacctctggtcacttgagagagaaaactcttcagaagaacttgtttcccagctggaaagagaatggaggaggaacttcagtgagctgccggggcacaaagggcacagtggtatggggacccccgagacagaggccttcctgcagccagagaggagccagcggggcccgctgctcagggctatctggcgtgtgttccggtccactttcctgctggggaccctcagcctggtcattagcgatgccttcaggtttgctgttcccaagctcctcagtctgtttctggagttcatgggcgacctcgagtcctcggcttggacgggctggctcctggctgtgctgatgttcttgtcggcctgcctacagacactgtttgaacagcagtacatgtacagagtcaaggtcctgcagatgaggctgcgaacagccatcactggcctggtgtacagaaaggtcctggtcctgtccagtggttccagaaagtccagtgcagcaggggacgtggtcaacctggtgtcagtggacgtacagcggctggtcgagagcatcctccacctcaacgggctgtggctgctcttcctgtggatcattgtgtgctttgtctacctgtggcagctccttgggccctctgccctcacagccgttgctgtcttcctgagccttctccccctgaacttcttcattaccaagaagaggagcttccatcaggaagaacagatgaggcagaaggcctcccgagcacggctcaccagctccatgctcagaactgtgagaaccatcaagtcccacggctgggagtgtgccttcctggagcgactcctgcatatccggggccaggagctaggtgccctgaagacctccgccttcctcttctctgtgtctctcgtgtccttccaagtgtctacatttctggtggcgctggttgtgtttgctgtccacaccctggtggcagaggacaacgccatggatgcggagaaggcgtttgtgacgctcacggtgctcagcatccttaacaaagcccaggccttcctccccttctctgtgcactgcctcgttcaggctcgggtgtcctttgaccgcctagctgctttcctgtgcctggaagaagtagaccccaatggcatggtcttgagtccctccagatgctcctcgaaggatcgaatttctatacacaatggcaccttcgcttggtcccaggagagcccgccctgcctgcacgggatcaacctcaccgtgccccagggctgtctgctggctgttgtgggtccagtgggggctggaaagtcctccctgctgtctgccctgcttggggagctgttgaaggtagaagggtctgtgagcattgagggttccgtggcctacgtgcctcaggaggcttgggtccagaatacctctgtggtggagaatgtgtgcttcaggcaggagctggatctgccatggttgcaggaagttctagaagcctgtgccttggggtctgatgtggccagcttccctgcaggagttcacaccccagtaggggagcagggcatgaatctttctgggggccagaagcagcggctgagcttggctcgggctgtgtacagaagggctgctgtgtacctgatggatgaccccctagcagccctggatgcgcatgtcagccaggaagtcttcaaacaggtcattggccccagtggacttctccaaggtacgactcggatccttgtaacacacacgctgcatgtcctgccccaagctgaccagatcctggtgctggccaatgggaccatcgcagagatgggctcctaccaagaccttctgcataggaacggagccctggtgggtcttctggatggagccagacagcctgcaggcgaaggagaaggagaagcacatgctgcagccaccagtgatgaccttggaggcttttctggaggtgggacgcccacgcgcagaccagagaggcccagacccagtgacgcagcccctgtgaagggcagtacttcagaggcacagatggagccttctctggatgacgttgaggtcactggactgacagcaggagaggacagtgtgcagtatggccgggtgaagagcgccacatacctgagctacctgcgggcggtgggcacaccgctctgcacctacaccctgttcctcttcctctgccagcaagtggcgtccttctgccaaggctactggctgagcctctgggccgacgacccggtcgtggatgggaagcagatgcattcagccctgcgtggctccatctttggactccttggctgtctgcaagccatcggactgtttgcctccatggctgcggtgttcctgggtggagcccgagcttcatgcctgcttttccggagcctcctctgggacgtggctcgctctcccattggcttctttgagcgcacaccagtcgggaacctgctgaaccgtttttccaaggagacggacatagtggatgtggacatcccagacaagatgaggaccctgctgacctatgcctttggactcctggaggttggcctggcagtgtcgatggccacaccactggctattgtggccatcctacctcttatgctcctttatgctgggtttcagagcctctacgtggccacatgttgccagctgagacgcctggagtcggccagttactcctcagtgtgttcccatctggctgagaccttccagggcagtcaggtggtcagggccttccaggcccaggggcccttcacagctcagcacgatgccctcatggatgagaaccagaggatcagtttcccgaggctggtggctgacaggtggctggctgccaacctggagctcctggggaatggcctggtgtttgtggccgctacatgtgctgtgctgagcaaggctcacctgagtgctggcctcgcgggcttctcggtttctgctgccctccaggtaacacagactctgcagtgggtggtccgcagctggacagatctggagaacagcatggtggccgtggagcgagtacaggactacgttcacacccccaaggaggctccctggaggctgccctcctctgcagcccagcctctctggccctgtgggggacagattgagttccgagactttgggctcagacaccgaccagagctgcccatggctgtgcagggtgtgtccctgaagatccatgcaggggagaaggtgggcatcgtgggcaggacaggggccgggaagtcctccctgacttggggcctgctgcggcttcaggaggccactgagggtggtatttggatcgatggggtccccatcaccgacatggggctgcacacactgcggtccagaatcaccatcatccctcaggaccctgtcctgttcccgggctcgctgcggatgaacctggacctgcttcaggagaacacagatgagggcatctgggcagcgctggagacggtgcagctcaaggccttcgtgaccagcctgcctggccagctgcagtatgagtgctcaggccagggagatgacctgagtgtgggtcagaagcagctcctgtgtctggcacgtgcccttctccggaaaacccagatcctcatcctggatgaagccactgcctccgtggacccagggacggagatacagatgcaggcggccctcgagcgctggtttgcacagtgtacagtgctgctcattgctcaccgcctgcgctccgtgatgaactgcgccagggttctagtcatggatgaggggcaggtggcagagagtggcagtccagcacagctgctggcccagaaaggcctgttttacaggctagcccaggagtcgggcctagcctgagtcaggactcttcccaaacctcctggagccagccacagagcctgcagtagctggagatgccagagactcaggggccacatgatgcccaatctaaactcctttttgggaggaagatagcagagagagtgacagagtattggaataccagacccagaagaacccagcatgcccaggttggcttgagcaaggccacacccaccccaggccaaaaagaacagtgactctcagcccaagctgtctacttcaaggccatacccaccccaggccattcaggttggatgccctggaccggggtgatggcgtgcacatatcccctaactccttattttgaggtcattgtagagttcactcacagttttaagaagccacatggagagaagccgcaaaccctctgccctgtttattccgggggtgacaccttgtccaaccctaggacaagatgaagcatcacactgactccgactgacttgtctttacctctgctgcgtgtgcatcagtgtttggactccgtgctttgtgctctcattggtttttgagacaggatttcacatagcccaggctggccctgaactcactttgttgctgaggatggccttgaacatctgatgctcctgccttccctcccaagtgctgggattatggcctgtgtcaccacgccctgtgtgggggtctcaaacaaggctttgtgtgtgcttgacaggcactcactctaaaaactgtgttacagccccggctctggattcggttctactcctgtttaaaattgtagtggtgaagggtctcttgctcaaactggcctcaaactcgagatgctcctgtctcggtctccagagtgctggaatgacagacgtgtgccactacacctgccttgactcaccacagctaagtagtgacatccccatgggccagggctggtgagtcccgtgcgtgacagtgtgctgagcagtacccttcgcttctgctcagagatgcccttctaaagctgtggcaaagagatttccacacactgccgtgcccccccaggactgcatcatgaattgatccgccctaatagcacccatgactccctgagcagtgatatgttgggttcaggagaggattcctgcttgcttcttggacagggcttgctcttccctcgaccctgaggcttctctgattggctacccttaataaaggatttacgggatttcctttc

SEQ ID NO: 3713 - DNA, 2483 bp, Rattus norvegicus
  Genbank Accession No. NM_031016
tcgatccaatggatttcttggtttcctgtatggaatgttaacaatctgtgttatacactattgagatgcagacgtggcttcctttggcccaacactttggaggccaggattcattgtctatctctgtttgcttgaagcccaacccaccacgagccaatcctttgtcttgttctgtgtctcatagtacttttttccttggttccttctgtgcctggtaatttccgcagcggccacaacttcattaagagagaaactgtcaagttcaagaaggaagtgaagttggtctaacataccacagaaatttttctcaaaagaatcagaaaaaagggaagtacatcggcatgtttggaagggggatgccttcaaagatctttctttactgttgctgtctttgccggaattccgcgacaggtttaaatgtttctttggccacttgactactgaacacaaaatgaataactcaacaaactcctcgaacaatggcttggctattaccagtccttacaagacatttgaagtggtatttattgtccttgtggctggatccctcagtctggtgaccatcattgggaacattctggtcatggtttccattaaagtcagccgccaccttcagactgtcaacaattacttcttgttcagcctggcctgtgctgacctcatcataggtgttttctccatgaacttgtataccctctacactgtgattggctactggcctttgggacctgtagtatgtgacctatggctagcattggactatgttgtcagcaatgcctccgttatgaatctcctcatcatcagctttgatagatacttctgtgtcacgaaacctctgacctacccagttaagcggaccacaaaaatggcaggcatgatgattgcagctgcgtgggtcctttccttcatcctctgggccccagccattctcttctggcagttcatcgtaggggtgaggactgtggaggatggggaatgctatattcagttcttttccaatgcggccgtcaccttcggcactgccattgcagcgttctatctgcctgtcatcatcatgactgtgctctattggcatatatcccgggcaagcaagagtagaataaagaaggaaaagaaggaacctgtggccaaccaagacccagtatctccaagtctggtgcaaggaagaattgtaaagccaaacaataacaatatgcctggtggtgatggcggcctggaacacaacaagatccagaatggcaaggctccacgggacggcgtgactgaaacctgtgttcaaggggaggagaaagagagctccaatgattcgacgtcatcagctgctgtggcctccaatatgagagatgatgagataacccaggatgaaaacacagtttccacttcgctggaccactccagagatgacaactctaagcaaacatgcatcaaaattgtcaccaaggcccaaaaaggtgatgtgtacaccccaacgagtaccactgtagaactagttgggtcgtcgggtcagagtggggatgaaaagcagaacgttgtagcccgcaaaatcgtgaagatgcccaagcagcctgccaaaaagaagcctccaccatcccgggaaaagaaagtgaccaggacaatcttggctatcctgttggctttcatcataacgtgggcgccatacaatgtcatggtgctcatcaatactttctgtgcaccctgcatccccaatacagtatggacaattggctactggctctgttacatcaatagcaccatcaatccggcctgctatgcgctttgtaatgccaccttcaaaaagacttttaagcacctcctcatgtgtcattacaagaacataggcgctacacggtgaaaagaccatcaaaagaagaaatgtggtcgagtgtgtcttggggaagaacagcgaccagaaagctgtgtttatagtgacctgccatttcactttacagtcttactgcaacatgaaagtaaggagttttagagagacactatcattgcgcccatgctccgttttggaaagactaccttattaaactctcaccttataaaccctgtcagtttaggagcaccgagaaattgaaagaggcatgctgaaactgcagatctaaggaaaaatctctactgtctcctgctctcttgaagaagggcgtcagagtctacaatttcatgtctctgcacaagaagaataacctagtctatttgttgtttctttctgttgttcccctgtgtggcggtgagaaagaaatgacacattccatgctaacacagagacctacatggaaagaagcaggcactgtacaatgagagagaagaagaaagaaaatcaaataggatgcagagatggtctgcagagcacgagcatatatatcctcggctgtgctgtgctctgatcggaaggatttcaacacaacaacctgcttatttcttctctcttgccccctcccctgccgatggaaatcaagaaagccaacaacaaccagtcg

SEQ ID NO: 3714 - DNA, 1125 bp, Rattus norvegicus
  Genbank Accession No. NM_031017
gaaagcagtgactgaggagcttgtaccaccggtgactagatgaccatggactctggagcagacaaccagcagagtggagatgctgctgtaacagaagctgaaagtcaacaaatgacagttcaagcccagccacagattgccacattagcccaggtatccatgccagcagctcatgcgacgtcatctgctcccactgtaaccttagtgcagctgcccaatgggcagacagtccaggtccatggggtcatccaggcggcccagccatcagttattcagtctccacaagtccaaacagttcagtcttcctgtaaggacttaaaaagacttttctccggaactcagatttcaactattgcagaaagtgaagattcacaggagtctgtggatagtgtaactgattcccaaaaacgaagggaaatcctttcaaggaggccttcctacaggaaaattttgaatgacttatcttctgatgcaccaggggtgccaaggattgaagaagaaaaatcagaagaagagacttcagcccctgccatcaccactgtaacagtgccaaccccgatttaccaaactagcagtgggcagtatattgccattacccagggaggagcaatacagctggctaacaatggtaccgatggggtacagggcctgcagacattaaccatgaccaatgcagctgccactcagccgggtactaccattctacaatatgcacagaccactgatggacagcagattctagtgcccagcaaccaagttgttgttcaagctgcctctggtgatgtacaaacataccagattcgcacagcacccactagcaccattgcccctggagttgttatggcgtcctccccagcacttcctacacagcctgctgaagaagcagcacgaaagagagaggttcgtctaatgaagaacagggaagcagcaagagaatgtcgtagaaagaagaaagaatatgtgaaatgtttagagaacagagtggcagtgcttgaaaaccaaaacaaaacattgattgaggagctaaaagcacttaaggacctttactgccacaagtcagattaatttgggatttaaattttcacctatgtggtggaaaatggactggattggccacaaccagaa

SEQ ID NO: 3715 - DNA, 1852 bp, Rattus norvegicus
  Genbank Accession No. NM_031018
gcgagagaggacggaagcctgtgggagcccgtggcctttaaagtgcgattcagccctttcctccggggctagtttgtaaacacggcagcgctccgggctcgctggtggctgaaaggaacatgaattagtgacctggaaagacactagatggcaacttgggaagtattgccatcccaagtatagcaagagcttagggattcctgttaacagaataaaactcatggcccaccagctacaaagtgtctttgccatgaaacagaggacatgataaactgtttaacttaatgaaattcaagttgcatgtgaattctgccagataaaacaaggacctgtggaatatgagtgatgacaaaccctttctatgcactgcccctgggtgtggccagcgttttaccaacgaggatcatttggctgtccataaacataaacatgagatgacactgaaatttggtccagcacgtaatgacagtgtcattgtggctgatcagactccaacaccaacaaggttcctaaaaaactgtgaagaagtgggtttgtttaatgagttggcaagtccattcgagaatgaattcaagaaggcttcagaagatgacattaaaaaaatgcctctagatctgtcccctcttgcaacacccatcataagaagcaaaattgaggaaccttctgttgtagaaacaactcaccaggatagcccgttacctcaccccgagtctactaccaatgatgaaaaggaaataccattggcacaaactgcacagcccacatcagctatcgttcgtccagcatcattacaggttcccaatgtgctgctcacaagttctgactcaagtgtaattattcaacaagcagtaccttcaccaacctcaagtactgtaatcacccaggcaccatcctctaacaggccaattgttcctgtaccaggcccatttcctcttctattacatcttcctaatggacaaaccatgcccgttgctattcctgcatcaattacaagttctaatgtgcatgttccagctgcagtcccacttgttcggccagtcaccatggtgcctagtgttccaggaatcccaggcccttcctctcctcaaccggtccagtcagaagcaaaaatgagattaaaagctgctttgacccagcaacaccctccagttaccaatggtgatactgtaaaaggccacggcagtggattggttagggcccagtcagaagagtctcgtccacagtccttgcagcagccagccacgtccactacagagactccggcgtctccagctcacacaactccacagacccaaaatacaagtggccgtcgaagaagagcagctaatgaagatcctgatgagaaaaggaggaagtttctagaacgaaatagagcagcagcttcaagatgccgtcaaaaaaggaaagtatgggttcagtccttagagaagaaagcagaagacttgagctcactaaatggccagctgcagagcgaagtcaccctgctgagaaatgaagtggcacagctgaaacagcttcttctggctcataaagattgccctgtaaccgccatgcagaagaagtctggctatcatactgctgataaagatgacagctcagaagacctttccgtgccaagcagcccacatacagaagcgatccagcacagctctgtcagtacgtccaatggagtcagttcaacatcaaaaacagaagctggagccacttcagttctcacccagatggcggaccagagcaccgagcctgcactttcacagattgtcatggctccttcctcccaggcacagccctcaggaagttgattaaaaacctgcagtgcaacagggtttagatactgattagtgacttcata

SEQ ID NO: 3716 - DNA, 3132 bp, Rattus norvegicus
  Genbank Accession No. NM_031020
gccgctggaaaatgtcgcaggaaaggcccacgttctaccggcaggagctgaacaagaccgtctgggaggtgcccgagcgataccagaacctgtccccggtgggctcgggagcctacggctcggtgtgtgctgcttttgatacaaagacgggacatcgtgtggcagtgaagaagctgtcgagaccgtttcagtccatcattcacgccaaaaggacctacagggagctgcggctgctgaagcacatgaagcacgagaatgtgattggtctgttggatgtgtttacacctgcaaggtccctggaagaattcaacgatgtgtacctggtgacccatctcatgggggcagacctgaacaacatcgtgaagtgtcagaagcttaccgatgaccacgttcagtttcttatctaccagatcctgcgagggctgaagtatatacactcggctgacataatccacagggacctaaagcccagcaacctcgctgtgaatgaagactgtgagctgaagattctggattttgggctggctcggcacactgatgacgaaatgaccggctacgtggctacccggtggtacagagcccccgagattatgctgaattggatgcactacaaccagacagtggatatttggtccgtgggctgcatcatggctgagctgttgaccggaagaacgttgtttcctggtacagaccatattgatcagttgaagctcattttaagactcgttggaaccccaggggctgagcttctgaagaaaatctcctcagagtctgcaagaaactacattcagtctctggcccagatgccgaagatgaacttcgcaaatgtatttattggtgccaatcccctggctgtcgacctgctggaaaagatgctggttttggactcggataagaggatcacagcagcccaagctcttgcgcatgcctactttgctcagtaccacgaccctgatgatgagccagtggctgaaccttatgaccagtcctttgaaagcagggacttccttatagacgaatggaagagcctgacctacgatgaagtcattagctttgtgccaccgccccttgaccaagaagaaatggagtcctgagcaccttgcttctgttctgtccatcccacttcactgtgaggggaaggcctgttcatgggaactctccaaataccattcaagtgcctcttgttgaaagattccttcatggtggaagggggtgcatgtatgtgcgtagtgtttgtgtgtgtctgtctgtctgtccgtttgtccatgtatctttgtggaagtcattgtgatggcagtgacttcatgagtggtagatgctccttggcagtctgcctgctctctcagagtccgggcaggccgatgggaactgccgtctccttagggatgtgtgtgtgtatgttaagtgcaaagtaagaatattaaaatatccctgttcctagttaccttgccacttcggcttctcctgtggccctgcctttaccatatcacagtgacagagagaggctgcttcaggtctgaggctatccctcagccatgcataaagcccaagagaaccaactggctcctgggctctagcctgtgatcggcttgctcatgtcctcagaacctgtcagtctgtttgtgccttaaaaggagagaagggcgcgttgtggtagttacagaatctcagttgctggcgttctgagccaggcaaggcacagggctgttggatggccagtggggagctggacaaaacaaggcagccttcaaggaggccatgggtgcatgtttgcatgagtgtatgtgcaaccgccctccctcacctccaggagcaagctgttttctatgcttacctaagttcacctcagtgcagaggtctccagtgccaggcacaggctcctgccatcagtagcttcctatgtcatcttcacgtcatgcgggtgtttgcatgctgtgctctggagcttgtcctgtcttctggaagccctgggccgggcgtgtgaagacttcccagcagtcctatccacgcacctcagctgaggccacgggcacactgctgcttcctcactccagctacgttgtgttgaacacaactgatcctccaggtgcttgtggtgcaggaaacgggacgaacagagcacctgaacccttgccatctgacatcaccgacacaggagaacagtcctctcctctcctctcctctcctctcctaggacagtccccggctctggaatcatgttcttctcactcatggtagccagctaagaaagctgcaaaccgaacaaagggagaaccgagctcctgaagccaggagctccttttactgtccttctcaaaatagggtcattagacacagccaagtcgtcaaaggcccctttccttgtacggggcccccccgcccccggcagcttgacactgatttcagtgtctatttggggagaaagcaattttgtcttggaattttgtatgttgtaggaatccttagagagtgtggttccttctgatggggagaaagggcaaattattttaatattttgtatttcacctttataaacatgaatcctcaggggtgaagaacagtttgcataattttctgaatttcaggcactttgtgctatatgaggacccatatatttaagctttttgtgcagtaagaaagtgtaaagccaattccagtgttggacgaaacaggtctcgtatttaggtcaaggtgtctccattctctatcagtgcagggacatgcagtttctgtggggcagggtaggaccctgcatcatttggagcccagaaggaggccgactggccaggcctcaccgcctcagtatgcagtccagctccacgtcatcccctcacaatggttagtagcaacgtctgggtttgaacgccaggcgtggttatattattgaggatgcctttgcacatgtggccatgctgtgttaggactgtgccccagggcccggacttgaagctagagctggcagaagagctcctggcatccatggtgcgatgctgccgccacccagtttctccattggaagacaagggaatgagaagactgctgtgtatgtgtatttgtgaacttggttgtgatctggtatgccataggatgtcagacaatatcactggttaaagtaaagcctatttttcagat

SEQ ID NO: 3717 - DNA, 1964 bp, Rattus norvegicus
  Genbank Accession No. NM_031021
ggctgccgcggcccggtcggctttctgcgctgtagcggtctctgccgttccttggaagcacagctccccttccccgccccagtcccagtccccgtccggccgcggacataaagatgagtagctctgaggaggtgtcctggatttcctggttctgtgggctccgtggtaatgaattcttctgtgaggtggatgaagactacatccaggacaaatttaatcttactggactcaatgagcaggtgcctcactatcgacaagccctagacatgatcttggacctggaacctgatgaagagctggaagacaaccccaaccagagtgacttgattgagcaggcggccgagatgctctatgggttgatccacgcccgctacatcctcaccaaccggggcattgcacaaatgttggaaaagtaccagcaaggagactttggctactgtcctcgagtatactgtgagaaccagccgatgcttcccatcggcctttcggacatcccaggagaggccatggtgaagctctactgccccaagtgcatggacgtgtacacacccaagtcctctaggcaccaccacacggatggcgcatacttcggcactggtttccctcacatgctcttcatggtgcatcccgagtaccggcccaagcggccggccaaccagtttgtgcccaggctctacggtttcaagatccatccaatggcctaccagctgcagctccaagccgccagcaacttcaagagcccagtcaagacgattcgctgagtgccctcccacctcctctgcctgtgacaccaccgtccctccgctgccaccctttcaggaagtctatggtttttagtttaaattaaaggaattgttactgtggtggggatatgaaataaaggaagagaaggctaaaaaaaaaaaaaaaaaccgaattcggcatctcacctaggtgtatacagctgcacattaccaatggctgcagaacacccaatcatgacctctagtgctttatagcaaaagtgtaaagtggtacctgggtgaccagcattgccatggttacatccatttgcgtaatcaagcagctgtgcaactgctcttctaacagatgaacagctgcatgcatctccagcaggcatggattgtctcttgtctatgatcctcagtgcgttcacttagagtatttctagagtttgagtccttgccgtgatagagccatgtagggaatgcactgattgcatgttaccccaagcgtcatgaaaccttccgacacggtgacctatttaatggtcttgtttgttgacatgacaaattaacattcttagagttacatctcgaaaaaagcatttgtgatagataagccctttgagccttgtggctaaatttttgtggctttgtttaactttcaaaggttatatatgcactaaccttttttgatggctaagtaggctttaaattacagtaaattttttcaaataaaactggctgtaaaatatattttgaattagagttgttcactttttcatagctacttatgtttttttcccaataatttatttcacatctctaccagtgaacgcagcccatcactagaaaatgaccttgtcctgatttcagtttcaactattagttttaaagctcactgttgaataagaggaagtggtggtgcattttaaattgactttcatgtgcttttaaaatatgacagatctccttgataatgtacttttatttgatctcaagttgtataaaaccaataaatttgtgttactttgattgcagtagtatcttatgcatagtgattccatgttatatgcagactagttaggcaactgttttcttagttacaagcttcacttttgtgcagttaaaaaaacaaaagtaggctacagtctgtgccatgttgatgtacagtttctgaaattgttttacaagactttgataataaaacccttaaactcacaaaaaaaaaaaaaaaaaacc

SEQ ID NO: 3718 - DNA, 1616 bp, Rattus norvegicus
  Genbank Accession No. NM_031023
atggcgctgagtgacctcctggaactcactctgctgctgctgctgcccctgctggagcggctctcggccgaggactgcccgtgctccgaggcttctctctgccgaccgatccgccaccaccgcgacttcgaggtctttgtgtttgatgttggacagaaaacctggaaatcttatgactggtcgcagattacgactgtggcagtttttggaaaatatgactcagaacttatgtgctatgctcattcgaaaggagccagggtagtgctaaaaggtgatgtggccctgaaggacatcattaatcctaccttcagagcgtcatggatagcgcaaaaagttgccttagccaaagcacaacacatggatggaattaatatagacatagaacaggaagttgattgctcgtcacctgaatatgaagcattgacagctttggtcagagaaaccacagagggtttccatcgtgagattgagggatcacaggtaacttttgatgtagcttggtcaccaaagggcatagacaaaaggtgctataattatactgggattgcggatgcctgcgactttctttttgtgatgtcttacgatgagcaaagtcagatctggtcagaatgtattgcagccgccaatgctccctacaatcagacattaactggatatggtgactacctcaggatgggcatcagccccaggaaacttgtaatgggtattccctggtatggctatgattacatttgcctaaacctctcaaaggatgatgtctgcgccattgcaaaggtccctttcagaggggctccttgcagtgatgctgcagggcatcaggtgccctacagggtcatcatgaagcaagtaaacagttctgtttctggaagccagtggaaccaagaccagcaagctccgtactataattacaaggatcccactggccgtttgcatcaggtgtggtacgataacccccggagcatctcactaaaggcagcattcgtcaaacactacggcttgcggggcattggcatgtggaacgcgaactgtctggactactcagatgacgctctagccagagagcaaacggaggaaatgtggggagccctgagaccacggctgtgatacatacagaggaatgtcttttgtcagacggttagatttgcaggactggcctgtgtaagcagatctacctcttcaagagataaaaatatatattttgtcatgttaccctaacttacttattggtctactcaatacacaggaaagaaataaagaaactattcatttgtacttggaaaatacatacatatcttaaatatccaggaatgtaaaagcaaaaacaagtcaacttactctattaaatattcctctgtttcagtattataattatattatattataattagaaaagttgcttttagaattccatgctgaatttttcctcctgttattaaaatatactgttaaaaaccaatagggatttttaaaaatgtataactagtagacaagtgaagatactggagaagggagtgcacatgaccatagtgtgttacacacatgtatagactatcatagtaaagcccattatttttataattaatatatgctaataaaagatgtgtaacttgaaatgg

SEQ ID NO: 3719 - DNA, 4300 bp, Rattus norvegicus
  Genbank Accession No. NM_031026
gcaagatggcgccggtgggggtggagaagaagctgctgctgggtcccaacgggcccgcagtggcggctgccggcgacctgaccagtgaagaggaggaaggccagagtctatggtcttcgatcttgagcgaagtgtccacccgcgccaggtccaagctgccgtccggcaagaacattctggtgttcggtgaagatggttctggtaaaacaactctcatgaccaaactccaaggagcagagcacggcaaaaaaggaagaggcttagagtatctttacctcagcgttcatgatgaggaccgtgatgatcacacgcgctgcaatgtatggattttggatggagacctttaccacaaaggcctgctgaaatttgcagtttccgcggagtctttgcgggagaccctggtcatttttgttgcagacatgtctagaccttggactataatggaatctctacagaaatgggctagtgttttacgggagcacattgacaagatgaaaattccaccagaggaaatgagggatctggaacggaagtttatgaaagattttcaagattatatcgagcctgaagaaggttgtcagggttccccacagagaagagggcctctgacctcaggctcagatgaagacaatgttgccctccctctgggtgacaatgtgctgactcataacctggggatcccagtgttggttgtgtgcacaaagtgtgatgcagtgagcatcttggagaaggagcacgattaccgagacgagcacctggacttcatccaggcgcatctgcggggattctgcctccagtatggagctgccttgatttacacctcagtgaaggaagagaaaaaccttgacttgctgtataagtacattgttcataaaacatacggcttccacttcaccatacccgccttagttgtggaaaaggacgcagtttttatacctgcaggatgggacaatgaaaagaaaatagctattttacatgaaaattttacaaccgtgaagccagaagatgcatatgaagattttattgtaaagcctcctgtgagaaagctggtccatgacaaagagttggcagctgaggatgagcaggtgttcctgatgaaacaacaggaatcccctgccagaggaccctctggctctccaaggacgcagggtcggggtggaccagctagtgtaccaagcgcctccccaggaacatcagtaaagaagccagatccaaacatcaaaaataatgcagcaagtgaaggggtattggccagcttcttcaatagtctgttgagtaaaaagacaggctctcctggaagtcccagtgctggtggagtgcagagcacagccaagaagtcaggtacagaaggagagccccagagcttcagatccttaacagaacagtgctgtcaaacaggacaaaagactgtgttgtcaaacgttcaggaagaactggatagaatgactcgaaaaccagactccatggtaacgaactcttcaacagaaaacgaagcctgaccctcctttgaaagtgcatatgtcaaatgaccaaatacctatgtatattcatctgataagaccaggatttttctgatatggcacatgctatcagtttttggggtaggggagatgaactttaaaaaaatacatatacttcattggcttgtccgagtgtgaagtgcacatttaggacggttttgtgtcaggccccttgttagggacgtcccttggactcttgggctgcgattctcttgtgggaagtaagcgcagctgggcttgtagagtggagagaggaggcccactttctgtcagagtggagcgaacgagactaggaagtcagatggatggtttgaccagttgcgtgttagcaaattcacttgttcttgggaagcaggttaagtagcagaaagtcaggaaagagaaaggttcaagaaggacaagagaagtgcttgtggggaagctgatggttgaaggagatggaggaaagaagtgagtgagcgagagagcagcattaatgagtacgtacatgcacagtagaaaccaaatagcatcagttaagacctaacaattagaaacatttccaagctaagcactaaacagaatgggaactggacttgttctgattgcatctttaagttatgggaaatgtgttttatttgtggtgcctcaggaaggtgggctgactcgagtggtgaagcccgcagctacccaggacccacatgcttggcccaggccatgtcccttgtccttgaaaagatgctgggctctatgcacaggtaacctggggcaggcggtcactgtgttatgttcaaagtcagcagatacaaaattagatattttaaatagttcctgttctgttttgtttaattgttactttaactaccacaggctggcaactaatagaaatgggtggttgattgctcattggaccggtattggcaatgtcctatagcaagtttgggggaagtatttactgtcactgtattctggctatttggcttgtgccagttgctgccttagagcctgtggtaactttccctgatacagaaaggttctttctgtagctccctggtcgaatcgttgctgacagaccgaaaagtgggtgctttacgtggagaatggaaggggtaggcttgtgtttgtcataaactgtagcgcttctcttacaggcgtgtgagttttacgtgtcttccattaggggcatgttcatgaacactgtcaagtcacaccaccatgctgaggataacctctgtagattggagacagcactttgagttttctgtgtgacacagcacatgtaaatgcaaacactaccatgactttaatgtataaaatatttgtcatccaaaccaaggggaaaaaccacagttcacttccgtggagtttacttttttatatgaatgtttgttgttgtgtctcggcataatgttcctaatgtcattacatacatgccagatttgactaaccactaacgtagttctgggcgtaagttaacatctcgttatgtgacgaggctcctcgactgggagtcactttgtaaaggtcggaacactgttaaggaggaagcagcgtgctaacttgcctctctaacaacaaaaagatgtttcttgtgccggttttactattgaaatatattttttccttttttaattcagtttttttgttgttattttgtttttatttttttaaacatgcattgtggcttcaaatgaccaggttgtccaggcgatgacaggaagctggctggagtagaaactgtggtaaaggatcacctgatctctgtagcagccagggcaaaatgagtgacctcagaaactaggaattcttgcaaagacatgtgcctaatagtgtgacttttaaattttgatacatttaaagtgtatcatttgaacggctaggcacttttggtgttggtgtcagttgtgctctaatcaacatgactcttctagaggagactgatgcatgttactgtgtgctcaggagttgccaaagtcaccagctttgggaagcttccaggttctttaggggtttgaggagatgaggtgatttttattattttaggattctcaagcattggaaccaaaggccaaataataaacagcctttactttttaaagtaaaattaattttatttgcaagaatacacttgtatggtagactataacagacaattttatgactatttatacacattataatgattacctctgtttgtctttaagtggataactttaagagcccaacctaaaaattatagcccaaatgagggctatgaattggtctttcctaaaaatccaacagatatgctgctagattattttgttttatttgcacttttttttttcttaaataacagagagggtttctttgtattgccctggctgtcctggaactcattctgtagaccaggctgccctccagagatccgcctgcttttgcctcccaagtgctgggattggcttgtgctactgtgcacagctgcaccttttttctcttttactttttttttaattggcgttttaaaaacagtattgaaactgaaaagactgtcttctgaacttggtgaaggtgaaagtgacctctgtacatcgtgaccttaacaatgctgatgctgtaagtgaaagttcactgttgtctctctgctaagttcattggtgtttttaacctaaaattaggactgcagatgatcgcccactagccttagtccaggatgtggctctgtctgggtgcagtatgcagtcatgtggaaccttgctttctagtgctgggggaaaagatgtctaactactggcttcaataaacaagaatccagactgcta

SEQ ID NO: 3720 - DNA, 3202 bp, Rattus norvegicus
  Genbank Accession No. NM_031028
agacacctccccgacgccctcccagaagccttccccagaagaagtgtcccccctgagctgcccccccaccccaaggaggccgcccccgcccctcctcgccatgggcccggggggaccctgtaccccagtggggtggccgctgcctcttctgctggtgatggcggctggggtggctccggtgtgggcctctcactcccctcatctcccgcggcctcacccgagggtccccccgcacccctcctcagaacggcgtgcagtatacatcggggcgctgtttcccatgagcgggggctggccggggggccaggcctgccagcccgcggtggagatggcgctggaggacgttaacagccgcagagacatcctgccggactacgagctcaagcttatccaccacgacagcaagtgtgacccagggcaagccaccaagtacttgtacgaactactctacaatgaccccatcaagatcattctcatgcctggctgtagttctgtctccacacttgtagctgaggctgcccggatgtggaaccttattgtgctctcatatggctccagttcaccagccttgtcaaaccgacagcggtttcccacgttcttccggacgcatccatccgccacactccacaatcccacccgggtgaaactcttcgaaaagtggggctggaagaagatcgctaccatccaacagaccaccgaggtcttcacctcaacgctggatgacctggaggagcgagtgaaagaggctgggatcgagatcactttccgacagagtttcttctcggatccagctgtgcctgttaaaaacctgaagcgtcaagatgctcgaatcatcgtgggacttttctatgagacggaagcccggaaagttttttgtgaggtctataaggaaaggctctttgggaagaagtacgtctggttcctcatcgggtggtatgctgacaactggttcaagacctatgacccgtcaatcaattgtacagtggaagaaatgaccgaggcggtggagggccacatcaccacggagattgtcatgctgaaccctgccaacacccgaagcatttccaacatgacgtcacaggaatttgtggagaaactaaccaagcggctgaaaagacaccccgaggagactggaggcttccaggaggcaccactggcctatgatgctatctgggccttggctttggccttgaacaagacgtctggaggaggtggtcgttccggcgtgcgcctggaggactttaactacaacaaccagaccattacagaccagatctaccgggccatgaactcctcctcctttgagggcgtttctggccatgtggtctttgatgccagcggctcccggatggcatggacacttatcgagcagctacagggcggcagctacaagaagatcggctactacgacagcaccaaggatgatctttcctggtccaaaacggacaagtggattggagggtctcccccagctgaccagaccttggtcatcaagacattccgtttcctgtctcagaaactctttatctccgtctcagttctctccagcctgggcattgttcttgctgttgtctgtctgtcctttaacatctacaactcccacgttcgttatatccagaactcccagcccaacctgaacaatctgactgctgtgggctgctcactggcactggctgctgtcttccctctcgggctggatggttaccacatagggagaagccagttcccgtttgtctgccaggcccgcctttggctcttgggcttgggctttagtctgggctatggctctatgttcaccaagatctggtgggtccacacagtcttcacgaagaaggaggagaagaaggagtggaggaagaccctagagccctggaaactctatgccactgtgggcctgctggtgggcatggatgtcctgactcttgccatctggcagattgtggaccccttgcaccgaaccattgagacttttgccaaggaggaaccaaaggaagacatcgatgtctccattctgccccagttggagcactgcagctccaagaagatgaatacgtggcttggcattttctatggttacaaggggctgctgctgctgctgggaatctttcttgcttacgaaaccaagagcgtgtccactgaaaagatcaatgaccacagggccgtgggcatggctatctacaatgtcgcggtcctgtgtctcatcactgctcctgtgaccatgatcctttccagtcagcaggacgcagcctttgcctttgcctctctggccatcgtgttctcttcctacatcactctggttgtgctctttgtgcccaagatgcgcaggctgatcacccgaggggaatggcagtctgaaacgcaggacaccatgaaaacaggatcatccaccaacaacaacgaggaagagaagtcccgactgttggagaaggaaaaccgagaactggaaaagatcatcgctgaggtgtgcggtgacaaacaaccggggccccccgtgtctgagggtgggttgcccgtagtggggccttcgatagaggtttgagtgttggtggttcacagagggtctcggcctgcagaggaaccggagagggagaggggaagggttgagtttcagtcccgtcagcccgaggagagggaggggggttctgcagacttcagcccacctgaggcaaaagagcagtcactggcagtagttagggggaggccattgtgagacattggttgcccacagtgttactgtgtccgggctgtagttagggaccgtgcagtgctgggtgggggcgggaaatggcctttccacttgtctgatgcaatcttcatttattccttttttttttttttttaaatcactgattttctccatctattctctcggtgccattacgttctgtgggcttcctttgttctcccctgattcacattttaatttcctttctcactcgtacatctcgtttcatcgtctccccccccctccctccttccattccacatcgccctcctcccacactcccgattgtgtttcttcctccagaaagaggagcgcgtctctgaactgcgccatcagctccagtctcggcagcaactccgctcacggcgccaccccccaacacccccagatccctctggaggccttcccaggggaccctctgagccccctgaccggcttagctgtgatgggagtcgagtacatttgctttacaagtga

SEQ ID NO: 3721 - DNA, 468 bp, Rattus norvegicus
  Genbank Accession No. NM_031032
aaaatgagtgagtccttggtggtttgtgatgttgctgaagatttagtggaaaagctgagaaagtttcgttttcgaaaagaaacccacaatgctgctattattatgaagattgacaaggataaacgcttggtggtgctggatgaggagctcgagggtgtctctccagatgaacttaaagatgaactacctgaacggcaacctcgcttcattgtgtatagttataaataccagcacgacgatggccgggtctcctaccctctgtgctttatcttctccagtcctctggggtgcaaacctgagcagcagatgatgtacgctgggagtaagaacaagctggtccagaccgccgaactaaccaaggtatttgaaataagaaacaccgaagacctgactgaagaatggttacgtgagaaacttggatttttccactaatgtgaacttctgtgtttcttaagtatttatgtatta

SEQ ID NO: 3722 - DNA, 1423 bp, Rattus norvegicus
  Genbank Accession No. NM_031034
aggccggggcccgcgcgccatggacgcccctcagccggcgcggcgcggccgcggcctgagggcggtcatgtccggggtggtgcggaccctcagccgctgcttgctgccggccgaggccggagcccgcgagcgcagggcgggcgcggcgcgcgacgcggaacgcgaggcccgacggcgcagccgcgacatcgacgcgctgctggcccgcgagcggcgcgcggtgcggcggctggtcaagatcttgctgctgggcgccggcgagagcggcaagtccaccttcctcaagcagatgcgcatcatccacggccgggagttcgaccagaaggcgctgctggagttccgcgacaccatcttcgacaacatccttaagggctcgagggtgcttgtagacgctcgggacaagcttggcattccctggcagcactctgagaacgagaagcacgggatgtttctgatggccttcgagaacaaggcagggctgcctgtggagcctgccaccttccagctctacgttccagccctgagcgcactctggagagactccgggatcagggaagccttcagccgcagaagcgagttccagctgggtgagtcagtgaagtacttcctggataacttagaccggattggccagctgaactacttccccagtaagcaagacatcctgttggctagaaaggccaccaagggaatcgtggagcatgacttcgtgataaagaaaatcccatttaagatggtggatgtgggcggccagaggtcgcagcgccagaagtggttccagtgcttcgacgggatcacatcgatcctgttcatggtgtcctcaagcgagtatgaccaggtcctcatggaggataggcgcaccaaccggctggtggagtccatgaacatcttcgagaccatcgtcaacaacaagctcttcttcaacgtctccatcatcctcttcctcaacaagatggacctgctggtggagaaggtgaagtcggtgagcattaagaagcacttcccagacttcaagggcgacccgcaccggctggaggacgtccagcgctacctggtccagtgctttgacaggaagcgcaggaaccgcggcaagcctctgttccaccacttcaccactgccatagacaccgagaacatccgcttcgtgtttcatgccgtgaaggacaccatcctgcaggagaacctgaaagatatcatgctgcagtgagacagcccctctgccagtcctctcgtggcctctgtgtggccacatgtctctggtgtgtctgccacctgcatggacctgcagtgggcatctcgaagccacaccatctaatacctggcactaagaatgctggactgtcagccacaccagcgagctgcgggcaagaggatgggagtgtcagtgatagctactgaatcggggactgaaactactgaatcc

SEQ ID NO: 3723 - DNA, 1748 bp, Rattus norvegicus
  Genbank Accession No. NM_031035
ggcgggcgggaaggcgcctcccgcagtcgctcggaactgcggacctgagagcttcccgcagagggccggcggtgggagcggagtgggtcgggcggggccgagccgggccgtgggccgtgtgggggccaggccgggccggcggacggcaggatgggctgcaccgtgagcgccgaggacaaggcggcagccgagcgctctaagatgatcgacaagaacctgcgggaggacggcgagaaggcggcacgggaggtgaagttgcttctgttaggtgctggagaatcagggaagagcaccatcgtcaagcagatgaagatcatccacgaggatggctactcagaggaggagtgccggcagtaccgtgcggttgtctacagcaacaccatccagtctatcatggccatcgtcaaagccatgggcaacctgcagatcgactttgctgacccccagcgtgcggatgatgccaggcagctgttcgcactgtcctgtgctgccgaggagcaaggcatgcttccggaagacctgtcgggcgtcatccggaggctctgggctgaccatggtgtgcaagcctgctttggccgctcacgggaatatcaactcaatgactcagccgcttactacctgaatgacctggagcgcatagcacagagtgactatatccctacacagcaggatgtgctgcggacccgtgtgaagaccacaggcatcgtcgaaacacacttcaccttcaaggacttacacttcaagatgtttgatgtgggtggtcagcgatctgagcggaagaagtggatccactgctttgagggtgtcacggccatcatcttctgtgtcgccttgagcgcgtacgacttggtgctggctgaggatgaggagatgaatcgcatgcatgagagcatgaagctgtttgatagcatctgcaataataagtggttcacagacacctccatcatcctcttcctcaacaagaaggacctgtttgaagagaagatcacacagagccccctgaccatctgtttccctgagtacacaggggccaacaagtatgacgaggcagccagctacatccagagcaagtttgaggacctgaataaacgcaaagacaccaaggagatctacacgcacttcacatgcgccaccgacaccaagaacgtgcagtttgtgtttgatgccgtcactgacgtcatcatcaagaacaacctgaaggactgtggcctcttctgaggggcagtgggcctggcaggatgggccaccgctgactctgctccccactacctgtgaggaagatgggggcaagaagaccatgctccctgcctgttcccccagctgcttctcccctgtctcttctctctgttctcagctcccctgtcccctccctcggctctagacttgggggaggggttgccacaggcctccctgtctaaaacccacctttgtctgaggtgccgggagtggccatggtacctccttactgggcatccattcgggttttctaaccattgtcttgttctgggggtgagcggggagcgcatgcagagtttcccaaggcctatgtctggaggagtaccaattcctccagcctagacccctggctttgtccaacaccagccctgacccaagtccaaatgtttacagggagcctcctgcctaccccactctctgccgcttggaggccccaaaggaaaaagcacaagaagcgtgagagacaccaccattcctggagacaaagcccacctgctcattctcgtagcttt

SEQ ID NO: 3724 - DNA, 1744 bp, Rattus norvegicus
  Genbank Accession No. NM_031039
ctgcagtgtgaagggtgttgtcttacctctcgcagactttcccattcccagccctgatttccccactggacccttctccttctgaaccagcatcctgcctggtttgagcagtcatggcctcacgggtgaatgatcaaagccaggcttcaaggaatgggctgaagggaaaggtgctaactctggacactatgaacccatgtgtgcggagggtggagtatgcagttcgaggacccattgtgcagcgtgccttggagctggagcaggagctgcgtcagggtgtgaagaagccgtttactgaggtcatccgtgccaacattggggatgcacaagccatggggcagagacccatcaccttcttccgccaggtcctggccctctgtgtctaccccaatcttctgagcagtcctgacttcccagaggatgccaagagaagggcagaacgcatcttgcaggcctgcgggggccacagcctgggtgcctatagcattagctctggaatccagccgatccgggaggatgtggcgcaatacattgagagaagagacggaggcatccccgcagacccgaacaacatatttctatccacaggggccagcgatgccatcgtgacaatgctcaagctgctggtatctggcgagggccgtgcacgaacaggtgtactcattcccattcctcagtacccactgtactcagccgcgctggctgaactggacgccgtgcaagtggactactacctggacgaagagcgcgcctgggctctggacatcgcagagctgcggcgcgctctgtgccaggcacgtgaccgttgctgccctcgagtactgtgcgtcatcaaccccggcaaccccactgggcaggtgcagacccgtgagtgcatcgaggccgtaatccgctttgctttcaaagaaggactcttcttgatggctgatgaggtataccaggacaacgtgtatgccgagggctctcagttccattcattcaagaaggtgctcatggagatggggccaccgtattccacgcagcaggagcttgcttctttccactcagtctctaagggctacatgggcgagtgcgggtttcgtggtggctatgtggaggtggtaaacatggatgctgaggtgcagaaacagatggggaagctgatgagtgtgcggctgtgtccaccagtgccaggccaggccttgatggacatggtggtcagtccgccaacaccctccgagccgtccttcaagcagtttcaagcagagagacaggaggtgctggctgaactggcagccaaggctaagctcacggagcaggtcttcaatgaggctcccgggatccgctgcaacccagtgcagggcgccatgtattccttccctcaagtgcagctgcccttgaaagcggtgcagcgtgctcaggaactgggcctggcccctgacatgttcttctgcctgtgcctcctggaagagactggcatctgcgttgtgcccgggagtggctttgggcagcaggagggcacctatcatttccggatgaccattctgccccccatggagaaactgcggctgctgctggaaaaactcagtcacttccatgccaagttcacccatgagtactcctgaagccactgctagggccacactggacagtctctgacgcaacaaaccgagggtccttaggaaccctcagtatttctgattttgtctagggtctcggtaactgtcctgcgggtccctaataaatctgatgtcagcctgaaaaa

SEQ ID NO: 3725 - DNA, 966 bp, Rattus norvegicus
  Genbank Accession No. NM_031042
cagcgtccggctctggactgtctatcgctctctgacgttcagtcccgggtcgctgcttgtgcgcgcacgccgcctcacacgacaaacttatggcggagcgcggggaactcgatctgacgggcgccaaacagaacaccggcgtgtggctggtgaaggttcctaaatatttgtcccagcaatgggcaaaagcccctggaagaggtgaagttgggaaactgaggattgccaagaatcaaggaaggactgaggtatcatttactttgaatgaggatcttgcgaatattcatgatatcggtgggaaaccagcttcagtcagtgctcctagagaacatccatttgtcttgcaaagtgttggaggacagacattaacagtgttcaccgagagctcctcagataaactgtcattggaaggaatagtggttcagagggcggaatgccgacctgctgccagtgaaaactacatgaaactaaagagattgcaaatagaagaatcttccaaacctgtaaggctctcacaacaggctgacaaagttgtaaccaccaattacaagcctgtcgctaaccatcagtacaatattgaatatgaaaggaagaagaaagaagatggaaagcgagctcgggcagacaaacaacacgtcctagacatgctgttctcagcctttgagaaacatcagtactataatcttaaggacttggtggacatcacaaagcaacctgtgggatacctgaaagaaatcttgaaagaaatcggcattcagaatgtaaaaggaattcacaagaatacgtgggagctgaagccagagtacaggcattaccaaacagaggagaagagcgactgagagaagcgtgtgcaacagttacaggcagatctctgccaccacacgctgactgcctgcccaccctgacaggacaaagacaactgagtctgtctgccattcctcagtaaactgttaaagctgggactcc

SEQ ID NO: 3726 - DNA, 1624 bp, Rattus norvegicus
  Genbank Accession No. NM_031043
cagcaccatgacagatcaggcttttgtgacgctcaccacaaacgatgcctatgccaaaggggcgctggtcctgggctcatctttgaaacagcacaggactactaggaggacggttgtactcgccagcccacaggtttcagactccatgagaaaagttttagagactgtctttgatgaagtcatcatggtagatgtcttggacagtggtgattctgctcatctaaccttaatgaagaggcctgagttgggcatcacgttgactaaactccactgctggtcactcactcagtattccaaatgtgtgttcatggatgcagatactctggttctctcaaatattgatgatctttttgaaagagaagaattgtcagcagcaccagacccagggtggcctgactgtttcaattctggagtctttgtctatcaaccctcaattgaaacgtataaccagctgttgcatcttgcttctgagcaaggtagttttgatggtggggaccagggcctactgaatacatattttagtggctgggcaacgacagatatcacaaaacacttgccatttgtgtataacctgagcagcctctcaatatactcctacctcccggcatttaaagcgtttggtaaaaatgccaaagttgtgcacttcctgggacgaaccaagccatggaattacacgtacaatccccaaacaaaaagtgtcaaatgtgaatcccaggacccaattgtgagtcacccagagtttctgaacctgtggtgggacaccttcaccaccaatgtcttacccctgctccaacaccatggccttgtcaaagatgccggttcctatctaatgatggaacatgtcacaggagccttgtcagacctgtcctttggggaggccccacctgcatcacagccttctttgtcctcagaagaaaggaaggaacggtgggaacagggccaggctgattatatgggagcagattcttttgataacatcaagagaaaacttgacacttacctacagtagaagcactgccattttcttgtggacacatccatgtcttaggcacgtttcgatacatagtatgtgaagtctgttacaattgttagaggctttcactaaacctcagcagatgaggggtttgggcaggacaacaggtgagaactgggcaaatgttattaagtaataattctattatgtggacaagtgttgtgtttaaccctagactttttcaaaaactctaaattcttaaattgccaatgtgtgataaagaaaagccaacattgagctactaaattaggctctttcaaatggtgcagaacttgactctccatcttcaaaacaaggtatgagattctccaatatttgcttgttgtatccttcactagacctgcaatgtagaattgttcaaagcctgtcagagaagtagccttctagactaaagtggcctttattaacactgcggagtgattcataagcctaccagctagtgttagttcaccagttttctatgcaccatgaaggcggcatgcagacctgctctttctcagttatctacttgaaaattgcagtgtgctctctgatggtagctgtggaagcactgtgtataacaaataaagacttattgacataaaaaaaaaa

SEQ ID NO: 3727 - DNA, 3177 bp, Rattus norvegicus
  Genbank Accession No. NM_031047
gctgccttggccagagtccggagcagccgccgcccgagcgccccgagctcagttcgctgcctgcgccggctgtctcccggccagacccgaccccgacccggctcggcccggctccacgctcaggtacaccggatagggccacgatggaggtgatgaaccttattgaacagcccatcaaggtgacggagtggcagcagacgtacacctatgactcgggcatccactccggtgtcaatacctgtgtgccctctgtcagcagcaagggcctcctcgatgaggatgacacctgcggcagacagtacacactcaagaaaactaccacctacacacaaggggtgccacagagccaaggcgacctggagtaccagatgtccaccacggccagagccaagcgggtgcgggaggccatgtgcccaggtgtctcaggcgaggacagttctctcctcctggccacccaggtggaggggcagacgaccaacctgcagcgactggccgaaccatcccagctactcaagtcggccattgtacatctcatcaactaccaggacgacgcagagctggccacccgggctctgcctgagctcaccaagctgctcaacgatgaggacccggtagtggtcaccaaggcggctatgatcgtgaaccagctgtccaagaaggaggcatcccgccgtgccctgatgggctcgccccagctggtggcggctgtggtgcggaccatgcagaacaccagtgacctggatactgcccgctgtaccaccagcatcctgcacaacctctcccaccaccgagaggggctgcttgctatcttcaagtctggaggcatccccgccctggtccgaatgctcagttcccccgtagagtctgtcctgttctacgccatcaccacactgcacaacctgctgctctaccaggagggcgccaagatggcggtgcgtctggcagacggactgcagaagatggtgcccctacttaacaagaacaaccccaaattcctggccatcaccaccgactgcctgcagctcctggcctatggcaaccaggagagcaagctgatcatcctggccaatgggggaccccagggtcttgtgcagatcatgaggaactacagctacgagaagcttctgtggaccaccagccgggtgctcaaggtgctctccgtgtgccccagcaacaagcctgccatcgtggaggctggtgggatgcaggctctaggcaagcacttgacaagcaacagcccccgcctggtgcagaactgcctgtggactctgcgcaatctctcggatgtggccaccaagcaggagggcctggagaacgtgctgaagatcctggtcaatcagctgagcgtggatgatgtcaacgtcctcacctgtgccacgggccacctctccaacctgacctgcaacaacagcaaaaacaagacgctggtgacgcagaacagtggcgtggaggcgctcatccacgccatcctcagagccggagacaaggacgacatcacagagcccgccgtttgcgccctgccgcaccttaccagccgccaccctgaggctgagatggcccagaactctgtgcgcctcaactatggaatcccggccattgtgaaactgctcaaccagccgaaccagtggccactggtcaaggcaactatcggcctgatccggaacctggctctgtgccccgccaatcatgccccgctgcaggaggccgcggtcattccccgcctcgttcagctgctggtcaaggcccaccaggatgcccagcgacatgtagctgcgggcacccagcagccctacacggatggtgtgaggatggaggagatcgtggagggctgcaccggagccctgcacatcctcgcccgagatcccatgaaccgcatggagatcttccggctcaacaccattcccctgtttgtccagctcctgtattcctctgtggagaacatccagcgtgtggctgccggagtgctgtgcgagctggcccaggacaaggaggctgccgatgccatagacgcggagggcgcctctgcccctctcatggaactgctccactcccgcaatgaggggaccgcgacctacgctgctgctgtcctgttccgcatctccgaggacaagaacccagattaccgtaagcgagtgtctgtggaactcaccaactcgctcttcaagcatgacccagctgcctgggaggctgcccagagcatgatcccgatcaacgaaccctatgcagacgacatggatgcaacctaccgccccatgtactccagcgatgtgcctctggaccccctggatatgcacatggacatggatggcgactaccccatggacacctacagcgacggcctgagacctccctaccccgctgcagaccacatgctggcctagctggctccacctcactcagagctgtttctcacctggaaagctctccagagcagactgtgggacgagacagtacctaagccccgggagccagcctggacttcctgctgcacacgcgctccagagagttcctccgtagggattttgggatggtgtctctcccgcttttctgtcctgggctggggatccaggctcagtactttctccccctccccactatggctatgaccactaaagctttagactcggcctgtgtccctgtacagcagccctctctgctgactccagctgcctggacccccagggcttcctttgtttttccggggccagttttctcaatgaactaaagcatccaactgccctgacctcctgggatatccaagacacaggttcaaggcccaaacccttcacatccaaagcttcttttgaaaagttcagggaccttcttgggggtagcgggagagagtggagactttttaagtgcccctgctaggacctgcccttctcttcaggatgctaagtctgccttgcccctcccaagggtgaagctccctctcacactgctccacactggcccatctgacctgcagaagtgctctagctcacccctctggtgtgtggtgaggggctttcttctcccactcctttttgactcccaccacctcctgcacatgggtttggggaggactgaaatggaagtcccctcagagagtcttattatcaacactttatgttttggttattggtttttctttcctttttgtttttgtatagaccaaagcaaagaaaataaaataac

SEQ ID NO: 3728 - DNA, 2851 bp, Rattus norvegicus
  Genbank Accession No. NM_031049
ggtaaagggctggccggccggtggtccagagctgtgctgtcatgaccgagggcacgtgtctgcggcgtcgtgggggaccctataaaactgagcccgccaccgatctcacccgctggcggctccataatgagttgggtcggcagagatggacttattatcaagcggaggaggaccctggtcgagaacagacggggctagaggcccactctttgggactggacacaacaagttatttcaagaacttacctaaagctcaaacagcccatgagggggccctgaacggagtaaccttttatgccaagctgcaggctgaggatggacactgggctggtgattatggtggtccactcttcctcttgccaggtctcctgattacgtgtcacatagcacacatccccctgccggctggatacagagaggaaatggtacggtacttgcgctcagtgcagcttcccaatggcggctggggcttgcacattgaggacaagtccacggtgtttgggactgccctgagctatgtgtctctcagaatcctgggtattggacctgatgatcctgaccttgtgcgtgctcggaacattcttcacaaaaaaggtggtgcagtggccatcccttcctgggggaagttctggctggctgtcctgaatgtttacagctgggaaggaatcaataccctcttccctgagatgtggctgcttcctgaatggtttcctgcacatccctccactctgtggtgtcactgccggcaggtctatctgcccatgagctactgctacgccactcggctaagtgcctcagaggacccactggttcagagcctccgccaggaactctatgtggaggattatgccagcatcgattggccagcacagaagaacaacgtgtgccccgatgacatgtacacgccacacagctggctgctgcacgtggtatatggactcctcaacctgtatgaacgtttccacagtaccagcctgcggaagtgggccatccagttgctgtatgaacatgtcgcagctgatgatcggttcacgaaatgcatcagcattggcccgatctcaaaaactgtcaacatgcttattcgttggtcagtggacggaccatcctcccctgccttccaggagcacgtctcgaggatcaaagattatctttggctgggccttgacggcatgaaaatgcagggcaccaatggatcacagacctgggacacttcatttgctgtccaagccctgctggaggcaggtgcacaccgaagacctgagtttttgccctgcctgcagaaggctcacgagttcctgcggctttcccaggtcccagacaacaatcctgactaccagaagtattatcgccatatgcacaagggtggtttccccttcagcacactggactgtggctggatcgttgctgactgcacggccgaggctttgaaggctgtgctgctcctgcaggagcggtgtccctcaatcaccgagcatgtcccccgagagcgactctacgatgctgtggctgtgttgttgagcatgaggaattccgatggagggtttgctacctatgagactaagcgtggcgggtatttgctggagctgctgaacccctcagaggtctttggagacatcatgattgactacacgtatgtagagtgtacctccgcagtgatgcaggccctgaggcacttccgcgagtacttcccagaccacagggctacagagatcagggagaccctcaatcaaggcctggacttctgccgaaagaagcagagagcggatggctcgtgggagggctcctggggggtttgcttcacctatggcacctggtttggcttggaagcattcgcttgcatgggacatatctaccaaaataggactgcttgtgcagaagtagctcaggcctgccacttcctcctgtcgcggcagatggcggatgggggctggggggaggactttgagtcctgtgagcagcggcggtacgtgcagagtgccgggtcccaggtccatagtacgtgctgggccctgctgggtttgatggctgtcaggcatcccgacatctctgctcaggagagaggaatcagatgtctgctagggaaacagctccccaacggagactggcctcaggagaacatctctggggtcttcaacaagtcctgtgccatcagctacacaaattacagaaacatcttccccatctgggccctgggccgcttctccagcctgtatcctgacaatacccttgctggccacatttgagcatgtgtgcgcctgtgcggcacctggccagcgtcagcactgtacaggcccaggcagcccggtttctcagctgggtgataagcgtcctcctagcccactttggcatggttctctatttctgtagacatgaggctggggatagggtcagagtcggtgtctagacactgggcagcatgcgctcggttctgacgctagcttcagtgaggaagggaagaagttgagcttgagatccagagaggcacagtgtactccgaggctcctgggtgtcctccttgagggaacaagactgtagagctttcatgatcagtgacttccctgtgagggagcagctggcttcttcacttcctcccttgttgactgtggagtgggccccgtggtgcaggcatgctcagagaaaggctcaatggaggaggcaggccccttgctcattgtgtcctgagcagtgtctgttgtcccaggcacttacccatgactgcatcactgcacgaaataccagttttccagaaaggaagtacaaactcgctctgtactaaaaatgctactaaaagtcgtttgaatgatcaccaactcccttaataaacagacccctgatggcccagtagtaaaca

SEQ ID NO: 3729 - DNA, 551 bp, Rattus norvegicus
  Genbank Accession No. NM_031051
gggtcacgtagtcaggtcccagacttgggtcacaccgcacttaacaccgtcctccggccgtcgttcgcagtctctccgccaccatgcctatgttcatcgtgaacaccaatgttccccgcgcctccgtgccagaggggtttctctccgagctcacccagcagctggcgcaggccaccggcaagccggcacagtacatcgcagtgcacgtggtcccggaccagctcatgacttttagtggcacgagcgacccctgcgccctctgcagcctgcacagcatcggcaagatcggtggcgcccagaaccgcaactacagcaagctgctgtgcggcctgctgtccgatcgcctgcacatcagcccggaccgggtctacatcaactattacgacatgaacgcagccaacgtgggctggaacggttccaccttcgcttgagcccgggcctcacttacctgcaccgctgttcttcgagtcttgctgcacgccccgttctgtgtttatccacccgtaatgatggccaccttccggtcgggagaaataaatggtttgagacca

SEQ ID NO: 3730 - DNA, 2337 bp, Rattus norvegicus
  Genbank Accession No. NM_031052
cgtctgcaacgcgagtgcccagcgcaacgtgctaccttggaaacgcagggcctctcttcctgagcgtggcagagcggggtcccgaggatgctgctggcagccgggacgcggtatgcctaccggctgtgcggccggcgagccgcggcggctctgcagggacgcgcaggccggagctgcgcccggagcgtcagcactagctggtccccggtgggcgctgcctttaacgtcaagccccagggccacctgtgggacctgttgggagagcgacggggtctttttggagttcctgagctcagcacccctgaaggattccaagttgcccaggaggaagccttgaggaagacggagtggctggtagagcgagcatgttccacacctccagggccacagacagtcctcattttcgatgagctctcggattgcctctgcagagtggctgacttggcggactttgtgaaaattggacacccagagcaggcgttcagagaggctgcgcaggaggcctgcagaagtattggcaccatggtggaaaagttgaatacgaatgtggaattgtatcagagtctgcagaaattactagatgacaagaagcttatggattcccttgatgcagaaaccaggcgagtagccgaactatttatgtttgattttgaaatcagtggaatccatctagatgaagaaaagcgcagaagagccgtggacctcaatgttaagatcttggacttgagtagtgctttcctcatgggaaccaactttcccatcaagatccagaagcatctcttaccagagcacattcagcaccactttgctcgtgatggaaggcatttagtcatcgatggtctacatgcggaagcctccgatgacctggttcgggaggctgcttataaaatttttctttatcccaatgctgatcagttgaagtgtttggaggagttgctaagcagccgagatcttctggcaaacctagtaggctatctaccttttcccacaggccctccaggaaccatagcccagactccagagactgtcatgcagttccttgagaagctatctgaaaagctctgcgaaagaactagaaaagattttgagatgatgcaaggaatgaaaacaaaactaaatcctcaaaattctgaactaatgccttgggaccctccctactacagtggtgtgattcgtgcagagaggtataatattgagcccagtttatattgtccattcttatcccttggagcttgcatggaaggcctgaatgtcctatttaacagactgttgggcgtcaccttatatgcagaacagcccttcaaaggagaggtgtggtgtattgatgtccggaagctggctgttgttcatgaatctgaagggttgctgggctacatttactgtgattttttccagcgagcaaacaagccacagcaggattgccacttcaccatccgagggggcagattaaaggaagatggcagctatcagctcccagttgtggttctcatgctgaatctccctcatgcttccagggatttccctaccttattaactcctgggatgatggaaaatctcttccatgaaatggggcatgccatgcactcaatgctcggacgaactcggtaccagcatgtcactgggaccaggtgccctactgactttgctgaagttccgtctattctgatggagtatttttcaaatgattaccgagtagtcagccagtttgccaagcattatcagactggtcagccactgccaaaagctatggtgtctcgtctctgtgaatctaagaaggtctgtgccgccgcagaaatgcagctgcaggtcttttatgccgccctggatcaaatctaccatggccagcatcccctgaagaagtcaaccacagacatcctcatggaaacacaagagcagttttatggcttaccctatgttcctgacactgcctggcagctgaggttcagccacctggtgggatatggcgccaagtattactcatacctgatgtccagggctgtggcatccatggtctggaaggagtgcttcctacaggatccctttaacagggccgccggggagcgctaccgcagagagatgttagcccacggtgggggcaaggaacctatgctcatgattcaaggcatgctgcagaaatgtccttccatcgatgattttgtggatgcccttgtgtctgacttgaatctggactttgaaactttcttcatggattctaaatagcagaagcctggctcacgtggataggaaactcgttaccagatcctacagttatgaagccttcactccaacttcagtgttcactgaggaagaaatactttctgacaagccttaaattga

SEQ ID NO: 3731 - DNA, 2274 bp, Rattus norvegicus
  Genbank Accession No. NM_031053
atgtcatttgtagcaggagttattcggcgcctggacgagacggtagtgaatcgcatagcggcgggagaagttatccagcggccggccaatgctatcaaagagatgactgaaaactgtttagatgcaaaatctacaaatattcaagtgattgttagagaaggaggcctgaagctaattcagatccaagacaatggcactggaatcaggaaggaagatttggatattgtgtgtgagaggttcactacaagtaaactgcagacctttgaggatttagctatgatttccacctatgggtttcgcggagaggctttggcaagcataagccatgtggcccatgtcactattacaaccaaaacagctgatgggaaatgtgcatacagagcaagttactcagatggaaagctacaagcccctcctaaaccgtgtgcaggcaaccagggtaccctgatcacggtggaagaccttttttacaacataatcacaaggaagaaagctttaaaaaatcccagtgaagagtacgggaagattttggaagttgttggcaggtactcaatacacaattcaggaattagtttctcagttaaaaaacaaggcgagacagtctctgatgtcagaacactacccaatgccacgaccgtagacaacattcgctccatctttggaaatgctgttagtcgagaactgatcgaagttgggtgtgaggataaaaccctagctttcaaaatgaatggctatatctcgaatgcaaactactcagtgaagaagtgcattttcctactcttcatcaaccaccggctggtggaatcggctgccctgaagaaagccatagaagctgtatatgcagcatatttacccaaaaacacgcacccattcctgtacctcattttggaaatcagtccccagaacgtggatgtcaatgtgcaccccaccaagcatgaagttcactttctccatgaggagagtattctggagcgtgtgcagcagcacatcgagagcaagctattgggctccaattcatccaggatgtattttacccagaccttgcttccaggacttgctgggccctctggggaagccgttaaatccacgacaggcatagcttcctcatctactagtggaagtggcgacaaggttcacgcttaccaaatggtccgtacagactctcgggaccagaagctcgatgcctttatgcagcctgtaagcaggcgtctgcccagccagccccaggaccctgtccctgggaacaggacagagggctctcctgaaaaagccatgcagaaggatcaggagatatctgagctcccggcccccatggaagcagctgctgacagtgcgagtttggagagagaatcagtgattggggcttcggaagtggtggcaccccagcggcacccctccagtccaggcagctccagaaagagacatccggaggactccgatgtggaaatgatggaaaatgattcccggaaggaaatgacagctgcttgctacccccggaggaggatcattaacctcaccagtgttttgagtctccaggaagaaattaacgaccggggtcatgagactctccgggagatgctccgtaaccatacctttgtgggctgtgtgaatcctcagtgggccttggcacagcaccagaccaagctctacctcctcaacactaccaagctcagtgaagaactcttctaccagatactcatttacgattttgccaacttcggtgttctcaggttaccggaaccagcaccactctttgacttcgccatgctggccttagatagtcctgaaagtggctggacagaggaagatggcccaaaggaaggacttgcagaatacattgttgagtttttgaagaagaaagccaagatgcttgcagactatttctctgtggaaattgatgaggaagggaacctgattggattacctctcctgattgatagctatgtgccgcctttggagggactgcctatcttcattcttcgactggccactgaggtgaactgggatgaagaggagtgtttcgaaagtctcagtaaagaatgtgctgtgttttactccattcggaagcaatacatactggaggagtcagccctctcaggccagcagagtgacatgcctggctccccttcaaagccctggaagtggactgtggaacacattatctataaagccttccgctcacaccttctgcctccgaagcatttcacagaagatggcaatgtcctgcagctcgccaacctgccagatctgtgcaaagtcttcgaacgctgctaa

SEQ ID NO: 3732 - DNA, 2059 bp, Rattus norvegicus
  Genbank Accession No. NM_031057
ggcaggagaagtgatctgttatctcacctggcacatgaagcccattcctggaactatgcaaagggcagagtctggtgagccatggcggcggcagtggcggcagcagcagcagtgcggtcccggatcctgcaggtttcttctaaagtaaactccacatggtatccagcatcttctttctcttcatcatcagtgccaactgtaaagctcttcattgatgggaaattcgttgaatccaaaagtgacaaatggattgacatccacaacccagccaccaatgaggttgttggtcgggttcctcagtccaccaaagctgaaatggaggcagccgtagccgcctgcaaacgcgctttccctgcgtgggcagacacatctattttaagccggcagcaggtcctgcttcgttatcagcaactcattaaagaaaacctgaaagaaatcgccaggttaatcacattggaacaagggaagactctggctgatgctgaaggagatgtgttccgaggccttcaggtggttgagcatgcctgcagtgtgacgtccctcatgctgggagagaccatgccatctattaccaaagacatggacctttattcctaccgcctgcctctgggagtgtgtgcaggcatcgcaccatttaattttcctgccatgatccccctttggatgtttcccatggctatggtctgtggaaatactttcctaatgaaaccatcagagcgagtacctggagcaaccatgcttcttgctaagttgcttcaggattctggtgccccggacggaacactgaacatcatccatggacaacatgaagctgtaaattttatttgcgatcatccagacatcaaggcaatcagctttgtgggatccaaccaggcgggagagtacatcttcgaaagagggtcaagaaatggcaagagggttcaagccaatatgggagccaagaaccatggggtagtcatgccagatgccaataaggaaaataccctcaaccagctggttggggcagcatttggagctgctgggcagcgctgcatggctctttcaacagccgtccttgtgggagaagctaagaagtggctgccagaactggtagagcgtgccaagaatctccgcgtcaatgcaggagatcagcctggagctgatcttggtcccctgatcaccccccaggccaaagagagagtctgcaatctgattgatagtggagcaaaagagggggcttccatccttctggatgggcggaaaattaaagttaagggctacgaaaacggtaactttgttggaccaaccatcatctccaatgttaagccaagtatgacttgttacaaagaggagatttttggtccagttcttgtggtcttagagacagaaaccctggatgaagccatcaagattgttaatgacaacccatatggaaacgggactgctatctttaccaccaacggagccatagctcggaaatacgctcacatggtggatgtgggacaggtgggcgtgaatgtccccattccagtgcctttgccaatgttttccttcaccggctctcgatcttccttcaggggagacaccaatttctatggcaaacagggcatccagttttacactcagttaaagactatcacatctcagtggaaggaagaagatgctactctttcctcacctgcagtggtcatgcctaccatggggcgttagaacgttcaagactccatccagcctgagtaacttcccactgtccttggcaatcttcgtctgccatctttgctcaaaacagatccatgaggatggagtatattgcaatgaaattctttctcagaactcgcaatcccttcaaagttatagggagtacaggataacaccaacgccaggccttcacttgttctccatacttctctacggtttttgaggttaactgttgttaagcgtgaagtgtttgcctagaataagagcttagaactgtcttctaacaattcttttctgatgacttggagggacaacgtaggggcccggtccttggcaatcttcgtctgccatctttgctcaaaaacagtccatgaggatggag

SEQ ID NO: 3733 - DNA, 1806 bp, Rattus norvegicus
  Genbank Accession No. NM_031059
ggaacccaggagctcgcagaagccggtcaggagctcgcagaagccggtcgcgctcccagcctgcccgaaacccatgacccagggctgtcccgagcgccgtctgaagtgggggtccggctctgcagggccccggctgctgctatgacttctttgccactcggtgtcaaagtggaggactccgccttcgccaagcctgctgggggaggcgctgcccaggcccccggggctgctgcggccactgcaaccgccatgggcacagatgaggagggcgccaagcccaaagtgcccgcttcactcctgcccttcagcgtggaggccctcatggccgatcacaggaagcccggggcaaaggagagcgtcctggtggcttccgaaggggctcaggcggcgggtggctcggtgcagcacttgggcacccggcccgggtctctgggcgccccggacgcgccctcctcgccggggcctctcggccatttctctgttgggggactcctcaagctgccagaagatgctctggtgaaggccgagagcccggagaagctagatcggaccccgtggatgcagagtccccgcttctccccgcccccagccaggcggctgagtcccccggcctgcaccctacgcaagcacaagaccaaccgcaagcccaggacgcccttcaccacggctcagctactggctctggagcgcaagttccgccagaagcagtacctgtctattgccgagcgcgccgagttctccagctcgctcagccttaccgagacccaggtgaagatctggttccagaaccgccgtgctaaggccaagagactgcaggaggccgagttggagaagttgaagatggccgcgaagccaatgttgccgcctgctgcgttcggcctctcctttcctcttgggggtcctgcagcggtggctgcagctgccggcgcctcactctacagtgcctctggccctttccagcgcgccgcgctgcctgtagcgcccgtgggactctacaccgcccacgtaggctacagcatgtaccacctgacataggtgggcccagagtcacctccctgtggtgccatcccttccccagccacctcttctaggcagcgggagtccttcctaggaagctctgctgcccaacaccacctggccccttctcttaaacccttcgctacacagttcctcctggccatcgcatcttaaaattcctcctccctcttccgaccccttctgggaagaaaaaaaagtggccggaagtgtctaggtttttcgagaaaaatttatatttacacgtgcgagttataaatgtggaaactgggggatgcaaaggcgaagagatttatccgtggtccccagcagaattaaaggctgaaggagaccagaggccaaaaggactagaggccatgagactccatcagctgcttccggtcctgaaaccaggcaggactgcacagagaaattgttatttggtgctccaagagacgagcccagccctatagaaagcaaggagcacagctccttccattgtcagactccaaacgcattgcagcaaagcattgctctgagggggcagggtgcatgctgctggttcacgaaggtaggttgaagagactttcccaggaccagaaaaaaagaagttaaaaaacaaaatctgtttctatttaacagtacattttcgtggctctcaaacatcccttttgaagggatcgtgtgtactatgtaatatactgtatatttgaaattttattatcatttatattatagctatatttgttaaataaattaattttaagctacaaaaaaaaaaaaaaaaaaaaa

SEQ ID NO: 3734 - DNA, 1705 bp, Rattus norvegicus
  Genbank Accession No. NM_031062
gccggtgctgggctctgtagctcggtactccagcctctcgtcatggcctcggaaaagcctcaggacctaatggtcacctgcaccgcgccggtcaacatcgcggttatcaaatactggggaaagcgggatgaagcgctgatcctgcccatcaacccctccctgagcgtcacgctgcaccaggaccagctaaaaaccaccacaactgcggccattagcaaggacttcacagaggaccgcatctggctgaacggtcgtgaggaggacgtggggcagccacggctccaggcctgcctgagagagattcgccgcctggctcggaagcggaggagcacgggagacggggatgccctgcccctcagcctcggctataaggtgcacgtggcgtcagtgaacaacttccccaccgctgcaggcctggcttcctcagcagccggctacgcctgcctagcctataccttggcccgggtctacggggttgagggagacctctcagaagtggcccggcggggctcaggcagcgcatgccgcagcctctacgggggcttcgtggagtggcagatgggggaacaggccgatgggaaggacagcatcgcccggcagatagccccagagtggcactggccccagctccgagttcttatccttgtggtgagtgcagagaagaagccgacgggcagcacagtgggcatgcagaccagcgtggcgaccagtaccctgctcaagttccgggctgagtccattgtgcctgagcgcatgaaggagatgacccgttgcatccaagagcaggacttccaggccttcgcccagctgaccatgaaggacagcaaccagtttcacgccacctgcctcgacaccttcccgcccatctcctacctcaatgacacctccaggcgcatcatccagctagtccaccgcttcaacgcccaccatgggcagacgaaggtggcgtacacatttgatgcgggccccaatgctgtgatcttcactctggaggacaccgtggccgagtttgtggcggcagtaaggcacagcttcccccctgctgcgaatggagacaagtttctcaaggggctgcaggtggcacccgttcttctctccgatgagctgaaaacttcgctggctacggagcccagccctggtggggttcagtacatcattgccactcaggtgggaccaggacctcaagtcctagacgaccctcaccatcatctgctaggcccggatggcctgccacagcgggacctttgatctctcccatgtgcatctggagaaaggggttgctcccgggagctcgggagctcctgtgctgatgggccacgtccaaaggcttgcttgatgacacctaggggtgtctcctgtgatgagcagctgtctgggcagccggggacccctctcaagtgcctcaccttcctgctggctagccgaccttagggaagaggagtcggcgtctctcccaccgaagatgcccccgagggcctctaagcgtgaaggatgagggctcagacagcagtgcctctgttgagactcaggccacagtttctttgagaagcctcctggtgagggtaggggctgtggaacccacaggtagggtccattgtgggtgtggatgtaccacgaaggtgcagttgatggacccgatgaccacaggaataaagtgtgccactgctgcctgccaaaaaaaaaaaaaaaaaaaaaaaaaaaaacc

SEQ ID NO: 3735 - DNA, 1723 bp, Rattus norvegicus
  Genbank Accession No. NM_031063
gaattccatggagaagaccgggagctactgccggagtttcggctcacctgggcgctggccggggcaggagtctcaggagccatgttgtcagaagtcctgctggtgtctgctccagggaaagtcattctccatggagaacatgctgtggtccatggcaaggtagctctggcggtggccttgaacttgagaacatttctcgtgctgcgaccgcagagcaatgggaaagtgagcctcaatttaccaaacgtcggtattaagcaggtctgggatgtggccacacttcagctgctggacacaggctttcttgagcaaggcgatgtcccggcacccaccttggagcaactggagaagctgaagaaggtggcgggcctcccccgagactgtgtaggcaacgaaggcctgtctctgcttgcctttctgtacctgtacctggctatctgccggaaacagaggacactcccaagcctggacatcatggtgtggtcggaactgccccctggggcgggcttgggctccagtgcagcctactcggtgtgtgtggcagccgccctcctgactgcctgtgaggaggtcaccaacccgctcaaggacaggggctccattggcagttggcccgaggaggacctgaagtcaattaacaagtgggcctacgagggggagagagtgatccatgggaacccctctggcgtggacaattccgtcagcacctggggaggagccctgcgctaccagcaagggaagatgtcatccttgaagaggctcccagctctgcagatcctgctcaccaacaccaaggtcccacgaagcaccaaggccctcgtggctggcgtcagaagcaggctaatcaagttccctgagatcatggccccgctcctgacatcaattgacgcaatctccctggagtgtgagcgcgtgctgggagagatggcggccgcaccagtcccagaacagtaccttgtcctagaagagctaatggacatgaaccagcaccatctgaatgcccttggtgtgggccacgcctccctggaccagctctgtcaggtaacagcagcacatggactgcacagcaagctgactggcgcaggcggcggcggctgtggcatcaccctcctgaagccaggtctagagcgagcaaaagtggaggccgccaagcaggccctgaccggctgcgggtttgactgctgggagaccagcattggagcgcctggggtctccatgcactcagccacctccatagaggaccctgtccgacaagccctgggcctctgacatgtcatcctgccaagaagcttccacgtatctggggctggagttggcccctgtgctggccactaacacatttcctgctggtagtgccttgtagactctgagaggcaccacctccatggcccatctgtatcctggcactgctgaagccagacaggcatcagttgccgggtcttctgagacagcaggctgacacagtaggccttccccctgggtgattctgcctgggcctggcctctgtcggcctcacacaaactctccggctcctagccacgcaacccttctgtcctcagatgccggcccctttggaaccgcctagccagtggctcatgtctcctgtcctctctcggggatcatcggctgaggcaaggcatgccgactgctttatccccgtgtgtacctgtggacaagctgcccatggtggggcgagggaagggggaataaaatgagctcgtac

SEQ ID NO: 3736 - DNA, 710 bp, Rattus norvegicus
  Genbank Accession No. NM_031065
cttttccggttcccgcagccgcagccatgagcagcaaagtttcacgcgacaccctctacgaggcggtgcgggaagtcctgcacgggaaccagcgtaagcgccgcaagtttctggagacggtggagctgcagatcagcctgaagaactacgaccctcagaaggacaaacgcttctcgggcaccgtcaggcttaagtccacccctcgccccaagttctccgtgtgcgtcctgggggaccagcagcactgtgatgaagccaaggccgtggatatcccccacatggacatcgaggcgctcaagaagcttaacaagaacaagaagttggtcaaaaagctggccaagaagtatgatgcctttttggcctccgagtctctgatcaagcaaatcccacgtatcctgggcccaggcctaaacaaggcgggcaagttcccctccctgctgacacacaatgaaaacatggtggccaaagtggatgaggtgaaatccacaatcaagttccagatgaagaaggtgctgtgtctggccgttgccgtcggccacgtgaagatgaccgatgacgagctagtctacaacatccacctggctgtcaacttcttggtgtccttactcaagaaaaactggcagaacgtccgggctctgtacatcaagagcaccatgggcaagccccagcgtctgtattaggacgctccaataaacctcgttgctgccttc

SEQ ID NO: 3737 - DNA, 1020 bp, Rattus norvegicus
  Genbank Accession No. NM_031073
gtcgacgtccctggaaatagtcatacggatgccatggttacttctgccacgatcttacaggtgaacaaggtgatgtccatcttgttttatgtgatatttcttgcttatctccgtggcatccaaggcaacaacatggatcaaaggagtttgccagaagactctctcaattccctcattatcaagttgatccaggcggatatcttgaaaaacaagctctccaagcagatggtagatgttaaggaaaattaccagagcaccctgcccaaagcagaggcacccagagaaccagagcagggagaggccaccaggtcagaattccagccgatgattgcaacagacacagaactactacggcaacagagacgctacaattcaccccgggtcctgctgagtgacagcacccctttggagccccctcccttatatctaatggaagattatgtgggcaacccggtggtaaccaatagaacatcaccacggaggaaacgctatgcagagcataagagtcaccgaggagagtactcagtgtgtgacagtgagagcctgtgggtgaccgacaagtcctcagccattgacattcggggacaccaggttacagtgttgggagagatcaaaaccggcaactctcctgtgaaacaatatttttatgaaacgaggtgtaaagaagccaggccagtcaaaaacggttgcagggggattgatgacaaacactggaactctcagtgcaaaacgtcgcaaacctacgtccgagcactgacttcagaaaacaacaaactcgtaggctggcgctggatacgaatagacacttcctgtgtgtgtgccttgtcaagaaaaatcggaagaacatgaattggcatctgtccccacatataaattattactttaaattatatgatatgcatgtagcatataaatgtttatattgtttttatatattataagttgacctttatttattaaacttcagcaacccttacagtatataagcttttttcataatcgggctgctcaaaaaaaaaa

SEQ ID NO: 3738 - DNA, 3237 bp, Rattus norvegicus
  Genbank Accession No. NM_031074
gtctacgcgctgccccgaacggcggtcggtggcggcggcggtggcgacggtttcctggcggtcgcgcgctgctctggtgagcggcgggtgacggaaggacctgggctctcactccagacacaccgctctttctgaagcaaacactcgttttgaagatgtttaacaaatcatttggaaccccctttggtggtacagggggctttggtacaacgtcaacatttggacaaaatactggctttggtactactagtggaggagcatttggaacatctgcatttggttctagcagtaatactggaggcttatttggtaattcacagaccaaaccaggaggactgtttggtaccagttcacttagccagccagcaacctccacaagcactggttttgggtttggcacatcaacaggaacatcaaatagtttgtttggaactgcaaatacagggaccagtcttttctcatcccagaacaatgcatttgcacaaaataaaccaactggatttgggaattttggaaccagtactagcagtggaggactctttggaactacaaataccacctctaatccttttggtaacacatctggctccctctttgggccaagtagttttacagcagcacctacaggaactaccatcaaatttaatcctcccactggtacagatactatggtcaaagctggagttagcactaacatcagcaccaagcatcagtgtattactgccatgaaagaatatgaaagcaagtcattagaggagcttcgtttggaggactatcaggctaaccggaaaggcccacagaaccaagtgggggcaggtaccacaactggcttatttgggtcttctccagcgacttccagtgcaacaggactcttcagctcttccaccactaattcagccttttcatatggtcagaacaaaactgcctttggaactagcacaactggatttgggacaaatccaggtggcctctttggccaacagaatcaacagactaccagtctcttcagcaaaccatttggccaggctacaaccaccccaaatactggcttttcctttggtaataccagcacccttggacaaccaagcaccaatactatgggcctatttggtgtaacccaagcctcacagccaggaggtctttttgggaccgctacaaacaccagcactgggacagcatttgggacaggaacaggtctctttgggcagcccaatactggatttggtgcagttggttcgacgctgtttggcaataacaagcttacaacttttggaaccagcacaaccagtgctccctcatttggtacaaccagtggcgggctcttcggtaacaaaccaaccctgactttaggaaccaatacaaacacttccaattttggttttggcacaaataacagtgggagtagtatttttggaagtaagccagcagccgggactctgggaacaggacttggtacaggatttggaacagctcttggtgctggacaggcatctttgtttggaaacaaccaacctaagattggagggcctcttggtacaggagcctttggggcccctggatttaatacttcgactgccattttgggctttggcgccccccaggccccagtagctttgacagatccaaatgcttctgctgcccagcaggctgttctccagcagcacctcaatagtctaacatactcaccctttggagactcccctctcttccggaatcctatgtcagatcctaagaagaaagaagagagactgaaaccaaccaatccagcggctcagaaagctcttacaacccctactcattataaacttacacctcgccctgccaccagagtcagaccaaaggctttgcaaacaacaggtacagccaaatcacatctctttgatgggctggatgacgatgaaccatctctagccaacggagcgtttatgccgaaaaagagcatcaagaagttggttttgaaaaatcttaacaatagcaatctcttttctcctgttaatcatgattcagaagatctagcttcaccctctgagtatccagaaaatggagagagattcagcttcctgagcaaacctgttgatgagaaccatcagcaggatggagatgatgactctcttgtatcacgattttacactaatcctattgccaaacctattccacaaactccagagagtgctggaaacaaaaataacagtagcagcaatgtggaagacactttcattgctttgaacatgcgtgctgctttgcgaaatggactggaaggaagcagtgaagaaacgtctttccatgatgagtcattgcaagatgaccgagacgagatagaaaacagtgctttccaaatccatccagcaggcattgttctcacaaaagttggttattatactattccatctatggatgaccttgctaaaattaccaatgagaaaggagaatgcattgtttctgacttcaccattggccgtaaagggtatggctcaatctattttgaaggagatgtgaatttgacaaatctaaatctggatgacattgtgcatatccggaggaaagaagttattgtctatgtagatgataaccaaaagccacctgtgggtgaaggactaaataggaaggctgaagttactttggatggagtttggccaacagataaaacatcccggtgtttaataaagagtccagatcgacttgctgatatcaattatgaggggagattagaagcagtctcaagaaagcaaggggcccaattcaaggagtatcggcctgaaactggttcttgggtgtttaaggtttcccatttttctaagtatggccttcaggattctgatgaagaggaggaggaacacccacccaaaactacttcaaagaagctgaagactgcccctttgccccctgcaggccaggcaaccactttccagatgactcttaatggcaaacctgcaccccccacctcaggtagagaagggcagagaatgtgaatgcggccgtgataaagaagtcagaggtcattcagcttttcagctgttcagcccttggaactaagtgcaagggaggggcacagtgctgcaggctgttatttttttactcaagatttaaagaattctcttgctgtttggatcgttcttctacaaattgtaacttaatttctctcatttggacttgtaatgttttgatcagtgatcagcttgagatagcattttgcttgtgtggggttgatgcaaagtaaatcctacttttattgatttc

SEQ ID NO: 3739 - DNA, 3111 bp, Rattus norvegicus
  Genbank Accession No. NM_031077
gttggccaccatggggatgtaccaagtgagactgtagggaaagaaggtggtgactcgcgtgcctggctactggctgctgctcacctcgatgctacaagattcctagcaagatcaaaactgaccattaacctacctctacatccccctggcgccgttccagggccaacgccacattccctgctgggcacgcaatggccgcaccccctcccgctacagaaggctcttttggtacacgcagtccgaggtcgccatggatcggatgaagaagatcaaacggcagctgtcaatgacactccgagggggccgaggcatagacaagaccaatggtgtccctgagcagataggcctagatgagagtggtggtggtggtggcatgacccttggagaagctcccacccgtgttgcccctggggaacttcgctctattcggggcccactcagctctgcaccaggtctacctgggtttcccagtctgctctaggggccatgtacacaaatggatacgatgaagaaatatattatattgggggaaagagagtgttcttgactccaaaggcctggcctttccctcactctgcaccagagattgtgcatgaagacatgaagatgggatctgatggggagagtgaccaggcttcagccacatcctcagatgaggtgcagtctccagtgagagtgcgcatgcgcaaccaccccccacgcaagatctccactgaggatatcaacaaatgcctgtcactaccagctgacatacggctgcctgagggctaccttgagaagctgaccctcaatagccccatcggtgataagcctcttagccggcgcctccggccagtcagcttgtctgagattggctttggaaaactggagacctacatcaaactagacaagctgggtgagggtacctatgccactgtctacaaaggcaaaagcaagctcacagacaaccttgtagcacttaaggagatcagactggaacacgaagaaggggcaccctgcactgctatccgggaagtatccctgcttaaggacctcaagcatgccaacatcgtcacactacatgacattatccacacagagaagtccctcacccttgtctttgaatacttggacaaggacctgaagcagtacctggatgactgtggaaatgtcatcaacatgcacaatgtgaaactgttcctgttccagttgctccgtggcctggcctactgccacaggcagaaggtgctacaccgagacctcaagccccagaacctactcatcaacgagaggggagagctcaaactggcagactttggcctggcttacgccaagtcaattcctactaaaacatactccaacgaagtggtgacactgtggtaccggccccctgacatcttacttgggtccacagactactccggccaaattgacatgtggggtgttggctgcatcttttatgagatggccacaggccggcccctcttcccaggctccacagtggaagaacagctgcacttcatcttccgcattttgggaaccccaactgaggacacatggccaggtatcctgtccaatgaagagtttagaacatacaactaccccaagtaccgagccgaggcccttctgaggcatgcaccccgacttgaatgcgatggagctgacctcctcaccaagctgctgcagtttgagggtcgcaatcggatctctgctgaggatgccatgaaacatccattctttctcagcttgggggagcggatccacaaacttcctgacactacttccatatttgcactaaaggaggtacagctacaaaaggaggccaacattcggtccacttctatgcctgactcaggcaggccagctttccgtgtggtggataccgagttctaagccaagttttaagccacagacagaccaaggccccagcaggcagcggctggagggatgccacacccctcacaggacagcccccatctgcaatcctccctgcttgttgcctgcttacctgcctgagccacactcccctgccaacttgtcccctgccacctgtccaaacaccgaactactggcctggcctgtcaacccaaccactggcctgtctgctgggtgctaacaaagctctcaccactactttgcttgatgtgtctgtctctgtcttggtagatgctggtggaccgaatggccgtgccagctttccacactaaggctaggccttcccctcttcatcacactctctcccaggaccactaccccatggccagccaggggtttggagctagcccaggccaggctcttaatcgactttgactagaaggtagtgagtgatgccttgggtctgagcatcatttgcctgcttcccacctgtcccacttgcctctgttgtatgggcttttttttagtttcttttattgtttttttattattttaaatgaggttctcactttttaatgcaatatctctgtatacagactggttgggcactactccctgagtgtggcactcccacagtattttgtgcaatgaagtcccactcccaccctttgagaggtagggacccagaccctattcagatcctcaccatcactagaccctggaattggctatgggaaagcatgcctcagccactcaccttcctcccctacctagcgttcccagctatagggggacctgagaactaccagagagtgggagatggacatggtggggcctactttttccctccttcagtcccgtagccagggcctccttccttctcagggtcttccccagcccagctctgcctagccctcctgccctgtcctactcggtgctgttgagtaggggctctgcctggaatcgagcagcttagtgaggagccatatataatatgtgcacaagcaggaggacatgtgggagcttgtgcccaattgttacaccccaatccctaggagggtcaggcaggccaaggacagtctcctggatggatggtttgctccccttactccaccttaagccttgggacccttaagcagggtgggagggcaagggagggtgccctcctagtggggtttggggggattgggttcctgaatgcaccataatcgctgtatgaaatattaaaaaaaagtctaaagtgaaaaaaaaaaaaaa

SEQ ID NO: 3740 - DNA, 3205 bp, Rattus norvegicus
  Genbank Accession No. NM_031083
ttactatggcatcggtagtgtcctgacagttcggaaagcaggaaagcaagcgccgagaagaaaggctcgggcccagcggactcttacatcgcaacccatcaaggaattgttattttgggtcctgcaagtggggtccggtccaacttgaggtagcgtgaaggccccttcaggcggcgccgcgggcagccccgcagccggggcctggtgcagccgccgcggccgctgtcagggaagcgcaggcggccaatggaacccgggagcggccgctgctgctgaggcggcggtgtcggcagtccgaccccgaccgcctgcaccccctccgcgagggtcccccggagcttggaagctcgaagtctggctgtagccatgggagacatggtagtggagcctgccaccctgaagccaacttctgagcctactcctagcccatcagggaataacgggggctccctactaagcgtcatcacggagggggtcggggaactgtcagtgattgaccctgaggtggcccagaaggcctgccaggaggtactggagaaagtcaagcttttgcatggaggtgtagccatctctagcaaaggcagcccactggagttggttaatggggatggtgtggacaatgagatccgttgcctagatgatccacctaccgagatcagggaggaagaagatgagatggagcctggtgtggtctctggcacagccaaaggaacaagaagaagacgacagaacaactcagccaaacagtcttggctcctgaggctgtttgaatcaaaactatttgacatctctatggccatttcatacttgtataactccaaggagccgggagtgcaagcctacattggcaaccggctcttctgctttcgcaatgaggatgtggacttctatttgccccagttgcttaacatgtatatccatatggatgaggatgtgggtgatgccattaaaccctacatagtccaccgttgtcgccagagcatcaacttttccctccagtgtgccctgttgcttggggcctactcttcagacatgcacatttccactcaacgacactcccgagggaccaagttacggaagctaatcctctcagatgagctgaagccagctcaccgaaagagggagctgccaactttaagcccagcccctgacacaggactgtctccctctaaaaggactcaccagcgctctaagtcagatgccacggccagcataagtctcagcagcaacctgaaacgaacagccagcaaccctaaagtggagaatgaggatgaggagctctcctccagcaccgagagtattgataattcattcagttcccctgtccggctggcccctgagcgagaattcatcaagtccttgatggcaatcggcaaacggctggccacgctccccactaaagagcaaaaaacacaaaggctgatctcagaactttccctgctcaaccataagctccctgcccgagtctggctgcccacagctggctttgaccaccacgtggtccgtgtgccccacacacaagctgttgtcctcaattccaaggataaggctccctacctgatctatgtggaagttcttgaatgtgaaaacttcgacacaactaatgttcctgcccggattcctgaaaaccgaattcggagtacgaggtctgtggagaacctgccggaatgtggtatcactcacgagcagcgggctggcagcttcagcactgtgcccaattatgacaatgacgatgaagcctggtcggtggatgacataggcgagctgcaggtggagctcccagaagtgcacaccaacagctgtgacaacatctctcagttctcggtggacagcatcaccagccaggagagcaaggagcctgtgttcattgcggcaggggacatcagacggcgcctttcagaacagctggctcacactcccacagccttcaaacgagaccctgaagacccttctgcagtcgccctcaaagagccctggcaggagaaagtgcggaggatcagagaaggttccccgtatggccatcttcccaattggcgactcctttcagtcattgtcaagtgtggagatgaccttcgccaggagctgctggctttccaggtgttgaaacaactgcagtccatttgggaacaggagcgagtgcctctttggatcaagccatataagattcttgtgatttcagctgacagtggcatgattgaaccagtagtcaacgctgtgtccatccaccaggtgaagaaacagtcacagctctccttgctcgattacttcctgcaggagcatggcagttacaccactgaggcattcctcagtgcccagcgcaattttgtgcaaagttgtgctggctactgcttggtctgctacctattacaagtcaaggacaggcacaatgggaacatccttctggacgcagaaggtcacatcatccacatcgactttggcttcatcctttccagctcaccccgaaacctgggcttcgagacgtcagcctttaagctgaccacagaatttgtggatgtaatgggcggcctgaacggtgatatgttcaactactataagatgctcatgctgcaagggctgatcgctgctcgcaaacacatggacaaggtggtacagattgtggagatcatgcagcaaggttctcagcttccttgcttccatggctccagcaccattcgcaacctcaaagagaggttccacatgagcatgactgaggagcagctgcagctgctggtggagcagatggtggacggcagcatgaggtccatcaccaccaaactctacgatggcttccagtacctcaccaatggcatcatgtgacaccactttcaggcccagaagtggtgggattgaaggcaccctccttaggaggacccttgcctaagaaaacctaaatcacaaaatcccacctacctaaccacctacccaagggaaatggaaggcaaaaaacacaaaggatcatgtggtaaccatgagagctggccaaagggtaggagagccaaccatggggtccagacttgctggggcttccccacctcttgctgtgtcagtattgccacctgacagatcccaggactcactgccctccagagaacagagatgatgaacatgaggaggactggaaccttcttcccctcggggatctcatcttttactatccctgggtcccagcaagatgggaggagtgggttcttggtacttaggactt

SEQ ID NO: 3741 - DNA, 2088 bp, Rattus norvegicus
  Genbank Accession No. NM_031087
ccggcggagcagctgtttctttaaggttgagcctctgatcagctgggaacccagcagaaggcaaaggtttctgttgatgtcttctcacctgccctgggctgtgaccgcccgggagagaccatgctcacattcatggccactgatagcgaggaagaggtgtgcgatgagcggacgtccttgatgtcagccgagagccctacatcacgttcctgccaggacagcaggccaggcccagaggatggagagaacactgcccagtggaggagccaggagaacgaggacgactgtgaggaggacccggaccactatgcctgcagtggggttcctgggcgaccatcgggcctggaggaggagctgaccctcaagtatggggcgaagcacgtgatcatgctgttcgtgcctgtcacgctgtgcatgattgtggtggtggccaccatcaagtccgtgcgtttctacacggagaagaacgggcagctcatctacacgcccttcaccgaggacacaccctctgtgggccagcggctcctcaactccgtgctgaacactctgatcatgatcagcgtcattgtggtcatgactatcttcctagtggtactctacaaatatcgctgttacaagttcatccatggctggctgatcatgtcctccctgatgctcctcttcttgttcacctacatctacctcggggaagtgttcaagacctacaatgtggccatggactaccccacactgttcctggctgtctggaacttcggggcagtgggcatggtgtgcatccactggaagggtcccctggtgctccagcaggcttacctcattgtgatcagcgcactcatggccctggtgttcatcaagtacctgccggagtggtccgcttgggtcatcttgggcgccatctctgtgtacgatctcgtggctgtgctgtgccccaaagggccactgaggatgctggtggaaactgcccaggaaagaaacgagcccatatttcctgccctcatatactcatctgccatggtgtggacggtaggcatggcgaagctggacccctcctctcagggagcactgcagctcccttacgatccagagatggaagaagactcctatgacagttttggggaaccctcataccctgaagccttcgaagctccccagcctggctacccaggggaagagccggaggaggaggaggaaaggggtgtaaagcttggtctgggagacttcatcttctacagcgttctggtgggcaaggcagcagccacaggcaacggagactggagcacgacgctggcctgctttatcgccatcctcattggcttgtgtctcaccctcctgctgctcgccgtgttcaagaaggccctgcccgccctccccatctccatcaccttcgggctcatcttttacttctccacagacaacctggtgcgtcctttcatggacacgttggcctcccaccagctctacatctgacagaagagctgcggctctgagagctgtaggacgcttcgccgaatgcaggtgtatagttttacactctagtgccatatatttttttttaaaaaaacctttctttccttacaaaagaaaaaaaaagaataaaaaagtgttgtgtttacttcgtgacgaggaagcagaagccgcccttctgtgctagctgtcttgtcaccagactgaggcttgcccgtcagagcatctgtggcacccgcaggtgggatgctgggccaacaagcctatcttcagggatgaggtcacgtgtgtggatcaggttggagaggacgcaggccccatccaggtctgtaatcaatccttcagggctgagcaggaggaacatgtgcgtcagtggggaccaggaggcacggtcaggaaggacgctaagcaccaacaccctgaccagaggacaaaagccagtttgtcgtcatgaatgcccccagtgctttgtttgtgatgtctgttacctttagtatcttagaagctgagtcctgttcttatttctgcagtggactgctgggaagtggcttaatgacaataccaatacatagatgtccctgctggaaaaaaaaaaaaaaaaaaaaaaaaaaaaaaaaaaaaaaa

SEQ ID NO: 3742 - DNA, 618 bp, Rattus norvegicus
  Genbank Accession No. NM_031090
atgtccagcatgaatcccgaatatgattatttattcaagttactcctgattggcgactctggggttggaaagtcttgccttctccttaggtttgcggatgacacgtatacggaaagctacatcagcacgattggtgtggatttcaagatacggactatagagctagacgggaaaacaatcaagcttcagatatgggacacagcaggccaggaacggtttcgaacaatcacctccagttattacagaggagcccatggaatcatagttgtgtatgatgtgacagaccaggagtccttcaataacgtgaaacagtggctgcaggagatcgatcgctacgccagcgaaaatgtcaacaagttgttggtagggaacaaatgtgacctgaccacaaagaaagtagtagactacacaacagccaaggaatttgcagattcccttggaattccatttttggaaaccagtgctaagaacgaaaagaatgtagaacagtctttcatgaccatggcagcggagattaaaaagcggatgggtcctggagcaacagctggaggtgcggagaagtccaatgttaaaatccagagcactccagtcaagcagtcaggtggaggctgctgctaa

SEQ ID NO: 3743 - DNA, 952 bp, Rattus norvegicus
  Genbank Accession No. NM_031093
cggccaggttgacagttgggcagaagctcttggttcctcttcaagtggtaatgccttcatgccaactttgccgaagtaacctggatgatatttgtcaaagttgatcctgtggtgatgcatgcctccagcattcccgcggcctcctgggtgcttgcggtgcttaccgatgcgaccgtggccgtggctcacgtggccccggagtttccgtcttcctaccagtctggatggcatggcggtgcagattcttttcagtcctctgaagactgcacacaggatggctgcaaacaagcccaagggtcagaattctttggccttacacaaagtcatcatggtgggcagtggtggtgtgggcaagtctgctctgactctgcagttcatgtatgatgagtttgtagaagactatgaacctaccaaagcagacagctacaggaagaaggtagtgctggatggggaggaagtgcagatcgacatcttagatacagcagggcaggaagactacgctgcaattagagacaactacttccgaagtggggaaggattcctctgtgtcttctctatcacagagatggagtcctttgcagctacagcggacttcagggaacagattttaagagtaaaagaagatgagaatgtcccatttctcctggttggtaacaaatcagatttagaagataaaaggcaggtttctgtagaagaggcaaaaaacagagctgaccagtggaacgttaactatgtggagacgtctgctaaaacgcgcgccaacgttgacaaggtattttttgatttaatgagggaaatacgagccagaaagatggaagacagcaaagaaaaaaatggaaaaaagaagaggaaaagtttagccaagagaatcagagaaagatgctgcattttataatcaaagcccaaactcctttcttatcctgacctgaccatactaataaatataatttat

SEQ ID NO: 3744 - DNA, 4861 bp, Rattus norvegicus
  Genbank Accession No. NM_031094
gcggtttgaatggctgtgggcccgggccctaagctcatctgaagagccgcggcctccgggtgtgccatggcatctggaggcaaccagtcgtcacctcctcctcctgctgctgcagccagctcagaggaagaggaggaggatggcgacaccgcggaccgggcgcagcccgcagggtccccaagccatcagatccaacagcggttcgaagagctgtgcagccgccttaacatggacgaggcggcacgggccgaggcctggagcagctaccgcagcatgagcgagagctacacgctggagggaaatgatctccattggttagcatgtgccttatatgtggcttgcagaaaatctgttcctactgtgagcaaagggactgctgaaggaaactatgtgtctttaactagaatccttcgatgttctgagcaaagcctaattgaattttttaacaagatgaagaagtgggaagatatggcaaatttacccccacacttccgagaacgaaccgaaagattagaaagaaacttcactgtctccgctgtgatctttaagaaatatgaacccatttttcaagacatttttaaatatccccaagaagaacaacctcgccagcaaagaggaagaaagcagaggcgacagccctgtaccacatctgaaattttccatttttgttgggtgctttttatatacgcaaaaggaaacttccccatgatcagtgatgatctggtcaattcctaccatcttctgctgtgtgcactagatttagtttatggaaatgccctacaatgctctaaccggaaagaacttgtgaaccctaattttaaaggcgtgtccgaggacggccaccccagggactctcacccgtcctctgatccaccgtgtgtcattgagaagctctgctccttacacgacggcctagtgctggaggcaaaggggataaagcagcatttctggaaaccctacattaggaagctttttgaaaagaagctcctcagggggaaggaagaaaatctcactggcttcctggagcccgggaacttcgcagagagctttaaggctgttaataaggcgtatgaagaatacgtgttagccactgggagtctggatgagcggatatttcttggcgaggatgcggaggaggaagttggaactttctcacggtgtgtaagtgctgcctcgggcacagagagtgccgaacgaacgcagatgagagacatcttgcagcagcatcttgacaagtctaaaacacttagagtctgcaacccactgactggcgtgcggtatgttcaggagaacagcccttgtgtgactcccgtctccacagcaacacacagcctgaaccgtcttcacaccatgctggccggcctcaggaatgcacccagtgagaagctagaacagatactcaggtcatgttcccgagatccgactcgggctatcgctgacaggttgagagagatgtatgaaatatattctcagcatttccagccagacgagaatgttagtaattgtgctaaagaaatggccaacaaacactttcgttttgcagaaatgctttactataaagtattagagtctgttattgagcaagaacagaagagattgggagacatggacttatctggtgttctggagcaagatgcattccataagtcactcctggcctgctgccttgaggtggtcgctttttcctataagcctcctggaaatttcccatttattgctgaaatatttgatgtaccacattatcatttttataaggtaatagaagtatttattagagcagaagacggtctttgcagagaagtggtcaaacacctcaatcagattgaagaacaaattttagaccacttggcatggaaaaccaagtccccactgtgggatagaattagagataatgaaaacagagtccctacatgtgaagaggttacaccacctcacaacctagagagaacagatgaaatctatattgctggctctcccttaactccgagaagggtgggtgaagttcgcactgatgctggaggacttggaagaagtgtgacatctccaaccacactgtatgacaggtacagttccccaacagtcagtactactagaaggcggctatttgagagtgacagtccctctgaaggaagcacggctgggcgcatccccccacaacccctagtcaatgctgtccctgtgcagaatgtatctggggagactgtttctgtcacaccagttcctggacagaccttggtcaccatggcaacagccactgtcacagccaacaatggacaaacagtgaccattccagtacaaggtattgccaacgaaaatggagggataacattcttcccagtccaagtgaatgttgggggccaggcacaggctgtgactggctctatccagcccctcagtgctcaagcgctggctggaagtctgagttcccaacaggtgacaggaacaactttgcaagtccccggtccggtggccattcaacaaatttcccctggaggacaacagcagaaccaaggccagccgttaaccagcagcagtatcaggcctcggaagactagctccttatcacttttctttagaaaggtttactacttagctggtgtccgccttcgagacctttgtacaaaactagatatttcagatgaactgaggaaaaaaatttggacctgctttgaattctctatagtccagtgtcctgaacttatgatggacagacatctggaccagttgttaatgtgtgccatttacgtgatggcaaaggtcacaaaagaagacaagtccttccagaatatcatgcgctgttacaggactcagccacaggcccggagccaggtatacagaagtgtcttgataaaagggaaaagaagaaattctggcagctgtgagaacagaagccatcagaattctccaacagaactaaatacagacagagccagtagagactccagtccagttatgaggtcaaacagcaccttaccagttccacagcccagcagtgcccctcctacaccaactcgactcacaggtgccaacagtgacattgaagaggaggaaagaggagacctcattcagttctacaacaacatctacaggaaacaaatccaaacgtttgccatgaagtactcacaggcaaactcccaaatggacacccctcccctgtctccctatccgtttgtaagaacgggctcccctcgccgagtacagttatctcaaagtcaccctatctacatttccccacataaaaacgaagcaatgctttctcctcgagagaagattttttactacttcagcaacagcccatcaaagagactgagagaaattaacagtatgatacggacaggagagactccaactaaaaagagagggattctcttggacgatggaagtgaatcgcctgcaaaaagaatttgcccagaaaatcattctgctctgttacgtcgtctccaagatgtagctaatgaccgaggttcacactgaggttagtgtccaggaggaaactatcttcacatgaactctttggcaggacttaatgcatgcagaattatggaaccttgctccgtaatccagcaactgattagaggcgggtataaaggggagcacctctgactcagtgtggcagtaaacgcctgctatctcatcacccaaggggtggaggggtaagaggaccaggagtttaaggccaacctgacttacagagcatgtctgaggccaacttggactacatgtaacccttactcaaaacaaaaaatggaagggacattttggtaagaaagaagacttattccatgtccttagagtattttattcatcccacttgcctctacctctacttagtgcttgccttcaacactgctcagaatccacacatgaattttttttttaactctgatagacttttacaatcactgcagaaagcaaatctttagaggcctttataggtcgagccagtagaggaactgtatttaaagtcattcccgcttggcatgtggctaggtccaaccatgtgctttaggatgaaaacacccgagaagtttacaatcagaacacaggatggccaacctggaagtgtccgggcactggcctaaggctcctatgcctttgagcattatcctgtcccaaggaggtgcggacagtgtgaaagccgtgcatgtctgagtgaacctgtgtacttggtggcactttagagctgtgagatgcatagcattgtgacccagattttgctgtatatttatggtggcactttctacagtgtgaactttagccagtacaagccttctaggcttagattaaacagctaatcttttctttcatgcttttctaaaggactgctgatgtagctacacgttctgggcacgtgtaggaccctcccatttatggtagtggcattacatagggatcatttagctaaataaagatttttaaatcaagttgaattgataagtatttgaaaaattatgaccccttcctttcggaagtagctatccagaagaaagtatctttgagggtactcctggcagttaaaagaataggttggagaatttaggtttttattagtacatggtaccattgacacaaattagaagatttaatagctattgattatctacacatatctttattaatcattattatcaagtaattttttaagttggattaataatcctaaggagaaaattcaatttaaattggatcactgtaaacaaagttactaggtgacttcataccgctccaaagacccagctgacaacctacagcctggcactggccaccagagtgctgtgcaaagtacgtagaaacctcttcgtaccgctactgtaattttatatgaaaatatgtgtatttttcaataaagcacttataaatt

SEQ ID NO: 3745 - DNA, 1292 bp, Rattus norvegicus
  Genbank Accession No. NM_031095
tcctagtgttacaggacatggagaaggaacgggagacactgcaggtctggaagcaacgtgtgggacaagagctcgattctgtgatcgctttctggatggagcattcccatgaccaggaacacgggggcttcttcacatgccttggccgcgatgggcaggtatatgatcacctcaaatatgtctggctgcaggggaggcaggtatggatgtattgtcgcttataccgcacttttgagcgcttccgccgtgtcgagcttctggatgcagcaaaagcaggtggtgaatttttgttgagttatgcccgggtggcaccgcctggcaagaaatgtgcttttgtgctgacccaggacggccgtccagtgaaggtgcagcggaccattttcagcgagtgcttttacaccatggccatgaatgaactgtggaaagtaacaggggaaatgcattatcagagagaagccgtagagatgatggatcagatcatccactgggtaagggaggacccagctgggctgggccggcctcagctctcgggaacactggccacagagcccatggcagtgcccatgatgctgctcaacctggtggagcagcttggagaagaagatgaggagatgaccgacaagtatgcagaactaggggactggtgtgcccataggattcttcagcatgtccagagggatggacaagttgtactggagaatgtatcagaggatggcaaagagctccctggttgccttggaagacatcagaacccaggccacacactggaagctggctggtttctgctccagtatgccctcaggaaaggtgatcccaaacttcaaaggcacattattgacaagtttctcttactgcctttccactctggatgggaccctgagcacggaggcctcttctacttccaggatgctgatgatctctgccctacccagctggaatggaacatgaagctgtggtggccacacactgaagccatgattgccttcctcatgggttacagggacagcggggacccagccttgctgaacctcttctaccaagtggctgaatacaccttccaccagtttcgtgatcctgagtacggggaatggtttggctacctgaaccaagagggaaaggtggcccttaccatcaaaggaggtccttttaaaggctgcttccatgtgccgcggtgcctggccatgtgcgagcagattttgggagccctactccaacgccttgggcccgcccccctcggctccttgcccgctgtccccactcgcgaaggctcgaaataaagctgaccctgttcc

SEQ ID NO: 3746 - DNA, 1069 bp, Rattus norvegicus
  Genbank Accession No. NM_031099
tcgcttgcgtcctggaggtgctacatactgcgcatgcgtacgcgactccggtctttttccccctagcgcggccgactctgcaggtctgcgtggagccgcagttgcgggtctctgttccgcaggatggggttcgtgaaagttgtcaagaataaggcctactttaaaagataccaagtgagatttagaaggcggcgagagggtaaaactgactactatgcacggaaacgattggtgatccaggacaaaaataagtacaacacaccgaaatacaggatgatagttcgtgtaacgaacagagacatcatctgccagattgcatatgcccgtatagaaggggatatgatcgtctgtgcagcatatgcacatgaacttccaaaatacggtgtgaaagttggcctgacaaactatgctgcagcctattgcactggcctgctgctggcccgcaggcttctgaataggtttggcatggacaagatctatgaaggccaagtggaggtgaatggagacgagtacaatgtggaaagcatagacggtcagcctggtgccttcacttgctatctggatgcgggtcttgcccgaactacaactggcaataaagtttttggcgccctgaagggagctgtggatggaggcttatctatcccccatagtactaaacgattccctggctatgactctgaaagcaaggagttcaatgcagaggtgcaccggaagcacatcatgggtcagaatgtggcagactacatgcgctacctgatggaggaggatgaggatgcgtataagaaacagttctctcagtacatcaagaacaacgtgactccagacatgatggaggagatgtataagaaagctcatgctgctatccgagagaatccagtctacgagaagaagcccaagagagaagtgaagaagaagaggtggaatcgtcccaaaatgtctcttgcccagaagaaagaccgggttgctcaaaagaaggcaagcttcctcagagctcaggaacgggctgctgaaagctaaagccattttctatgaagattttttcataaagacaataaacattgatcaaagc

SEQ ID NO: 3747 - DNA, 769 bp, Rattus norvegicus
  Genbank Accession No. NM_031100
tcaggcctgggagcgtctcttttcctctggcaccccatcgacgatcctagttgtcatcatgggccgccgccccgcccggtgttatcgctattgtaagaacaagccatacccaaagtctcgtttctgtcgtggtgtccctgatgctaagatccgcatctttgacttgggacggaagaaagcaaaagtggatgaatttccactttgtggccacatggtgtcagatgaatatgaacaactctcttctgaagctctggaggctgctcgtatttgtgccaacaaatacatggtaaagagttgtggcaaggatggctttcatatccgggtgaggctccaccctttccatgtcatccgtatcaacaagatgttgtcctgtgctggggctgacaggctccagacaggtatgcgtggtgcctttgggaaaccccaggggacagtagccagggttcacattggccaagtcatcatgtctatccgaaccaagctgcagaataaggaacatgtgattgaggctctgcgcagggccaagttcaagttccctggccggcagaagatccacatctcaaagaaatggggttttaccaagttcaatgcagatgaatttgaagacatggttgctgagaagcggctcattcctgatggctgtggtgtcaaatatatccccaatcgtggtcctcttgacaagtggagagccctgcattcctgaaggcttccacagtgcgctcctatgcgctatcaaatgaggttcaataataaagtctcgcgttcaaaa

SEQ ID NO: 3748 - DNA, 722 bp, Rattus norvegicus
  Genbank Accession No. NM_031101
tcctttccgctcggccgttctcctgtacaggaggcagccatggcgcccagccggaatggcatgatcctgaagccccacttccacaaggactggcagcagcgagtggacacgtggttcaaccagccggcccgcaagatccgcagacgcaaggcccggcaggcgaaagcgcgccgcatcgcccctcgccccgcgtccggtcccatcagccccatcgtgaggtgccctacagttagataccacaccaaggtccgggctggcaggggcttcagcctggaggagctcagggtggctggtatccacaagaaaatggcacgcaccatcggcatctccgtggacccaaggaggcgaaacaaatccacggagtcactgcaggccaacgtgcagcgcctgaaggagtaccgctccaagctcatacttttccccaggaagccttctgctccgaagaagggagacagttctgctgaagaacttaaattggccacgcagctaacaggacctgtgatgcccatccggaatgtgtacaaaaaggagaaggccagagccatcacggaagaggagaagaactttaaggctttcgccagccttcgcatggcccgagccaatgcccggctcttcggcatccgagcaaagagggcgaaagaagccgcagagcaagacgttgagaagaagaaataatgcgcggctggagagttgtaataaattttccataaagcaaaaaaaaa

SEQ ID NO: 3749 - DNA, 607 bp, Rattus norvegicus
  Genbank Accession No. NM_031102
catgggtgttgacattcgccacaacaaggaccgaaaggttcggcgcaaggagcccaagagccaggatatctacctgcggctgctagtcaagctgtacaggtttctggccagacggaccaactccaccttcaaccaggttgtgctgaaaaggttatttatgagccgaactaaccggccacctctgtccctgtcccgaatgatccggaagatgaagcttcctggtcgggagaacaaaactgctgtggttgtggggacgatcacagatgatgtgcggattctggaagtgcccaagctgaaggtgtgtgcactgagggtgagcagccgggcccgaagtcggatcctcaaggctgggggtaagatcctgaccttcgaccagctggccctggagtctcccaagggcaggggcactgtgctcttgtctggtcctcggaagggccgagaggtgtaccgacactttggcaaggccccaggaactccacacagccacaccaaaccctatgtccgttccaagggccggaagttcgagcgtgccagaggccgaagggccagccgaggctacaaaaactaaccctggctcttactgttaataaaaaagctttggatgttg

SEQ ID NO: 3750 - DNA, 703 bp, Rattus norvegicus
  Genbank Accession No. NM_031103
ctttcctttcgctgctgcgtctgcagccatgagtatgcttaggctacagaagaggcttgcctctagcgtcctccgctgtggtaaaaagaaggtgtggttggaccccaatgaaaccaacgaaatcgccaatgccaactctcgtcaacagatcaggaagctgatcaaagatggcctgatcatccggaagcctgtgactgtccattcccgggctcgatgccggaagaacaccttggcccgacggaagggcaggcatatgggcatagggaagaggaagggtactgccaacgctcggatgcccgagaaggtgacctggatgcgaaggatgaggatcctgcgccggcttctcaggagataccgggaatctaagaagattgaccgtcatatgtatcacagcctgtacctgaaggtcaaagggaatgtgttcaaaaacaagcggattctcatggagcacatccacaaactgaaggcagacaaggcccgcaagaagctactggctgaccaggctgaggctcgcaggtctaagaccaaggaagcacgaaagcgccgggaggagcgcctccaagccaagaaggaggagatcatcaagactctgtccaaggaggaagagaccaagaaatgaagcgtccctcgtgtctgtacatagtggccaggctatggcctcacatggatcagtcattaaaataaaacaagccttcgtccttgt

SEQ ID NO: 3751 - DNA, 465 bp, Rattus norvegicus
  Genbank Accession No. NM_031104
ctcctctgccgccatggctcctgtgaaaaagcttgtggcgaaggggggcaaaaaaaagaagcaggttttgaagttcacccttgactgcactcaccctgtagaagatggaatcatggatgctgccaattttgagcagttcctccaggagaggatcaaggtgaacgggaaagctggtaaccttggcggaggggttgtgaccatcgagcggagcaagagcaagatcactgtcacttccgaggagcctttctccaaaaggtatttgaaatatctcaccaaaaaatatttgaagaagaacaacctccgagactggctgcgcgtcgttgccaacagcaaggagagctacgagctgcgctacttccagatcaaccaggacgaggaggaggaggaggacgaggattaagacacattggtctgccatgttttgtattaattcataaataaaatttaggaacaaaaaaaaaaaaa

SEQ ID NO: 3752 - DNA, 366 bp, Rattus norvegicus
  Genbank Accession No. NM_031106
ttccggtctctttggcctcgccggtagaagcaagatgacgaaaggaacgtcatcctttggaaagcgtcgcaataagacgcacacgctgtgccgccgctgtggctccaaggcctaccaccttcagaagtcgacctgtggcaaatgtggctaccctgccaagcgcaagagaaagtataactggagtgccaaggctaagaggcgaaacactaccgggactggtcggatgaggcacctaaagatcgtctaccgaagattcagacatggattccgtgaaggaacaacacctaaacccaagagggcagctgttgcagcatccagttcatcttgaggatttcaatcggtcataaaataaatcttctggtttca

SEQ ID NO: 3753 - DNA, 688 bp, Rattus norvegicus
  Genbank Accession No. NM_031108
ggcgcagcgggcctagcctagtcaacatgccggtcgccagaagctgggtttgtcgcaaaacctatgtgaccccacggagacccttcgagaaatcgcgtctcgaccaggagctaaagttgattggagagtatggactccggaacaaacgtgaggtgtggagggtcaaatttaccctggcgaagattcgtaaggctgcccgggagctgttgacgctggacgagaaggatcctcggcgtctgtttgaaggcaacgctctgctgagacgacttgttcgaattggggtgctggatgagggcaagatgaagctggattacattctgggcctgaagattgaggatttcttggagagaaggctgcagacccaggtctttaagctgggcctggccaaatctattcaccatgcccgtgtgctcatccgccaacgtcacatcagggtcctcaagcaggtggtgaacatcccatctttcattgttcgcctggactctcagaagcacattgacttttccctcctttctccttatggtggtggccgcccaggacgagtgaagaggaagaatgccaagaaaggccagggtggtgctggagctggtgatgatgaggaagaggattaattaattaattaataccttgttgcactggaggattgtctagttttcccgttgacaaataaaacagaattgatacttga

SEQ ID NO: 3754 - DNA, 610 bp, Rattus norvegicus
  Genbank Accession No. NM_031109
ggggggggggggggggagcctccgcctcggaccctgtagccgccgcgatgttgatgcccaagaagaaccggattgccatctatgaactcctttttaaggaaggggtgatggttgccaaaaaagacgtccacatgcccaaacaccccgagctggcagacaagaacgttcccaaccttcacgtcatgaaggccatgcagtctctcaagtctcgaggctacgtgaaggagcagtttgcttggagacatttctactggtacctcacgaatgagggcatccagtacctccgagattacctgcacctacctccggagatcgtgcccgccaccctgcgccgcagccgtcccgagactggcaggcctcggcccaaaggtccagagggtgagcggcctgcaagattcacaagaggggaggcagacagagacacctacagaaggagcgctgtgccccctggagctgacaagaaagctgaggctggggctggctcggcaacggagttccagtttagagggggtttcggtcgtggacgtggtcagccacctcagtgaagttggagattatgttgtgttgaataaactttaaaaaaaaaaaaaaaaaaccccccccccccccc

SEQ ID NO: 3755 - DNA, 534 bp, Rattus norvegicus
  Genbank Accession No. NM_031110
agatggcggacattcagacggagcgtgcttaccaaaagcagcctacaatctttcaaaacaagaaacgtgttttgctgggagaaactggcaaggaaaaactccctcggtactacaaaaacatcggtctaggcttcaagacgcccaaggaggccatcgagggcacctacatagacaagaaatgccccttcactggtaatgtctccatccgaggacggatcctgtctggtgttgtgacgaagatgaagatgcagaggaccattgtcatccgccgggactatctccattatatccgaaagtacaaccgctttgagaagcgtcacaagaacatgtctgtgcacctgtccccctgtttcagggacgtccagattggcgacattgtcactgttggagagtgcaggcctctgagcaagactgttcgattcaatgtgctcaaggtcaccaaggctgctggcaccaagaagcagttccagaagttctgaggggggactgtagccaatgctctagaacaaataaaagttattttccaacttacag

SEQ ID NO: 3756 - DNA, 359 bp, Rattus norvegicus
  Genbank Accession No. NM_031111
tttctgtgttctccgtagacccgtgagcagggacggcctcggtatgcagaacgacgccggcgagtttgtggacctgtacgtgccgcggaaatgctccgcgagcaaccgcatcattgctgccaaggaccacgcgtccatccagatgaatgtggccgaggttgacaggagtacaggccgatttaatggtcagtttaaaacctacggcatctgcggggccattcgcaggatgggcgagtcagatgattctattctccgattggctaaggctgatggaattgtctcaaagaacttttgagccagaagaaatcgggaataatttgttataaataaaagtgataataagtaaaaaaaaaaaaaaa

SEQ ID NO: 3757 - DNA, 466 bp, Rattus norvegicus
  Genbank Accession No. NM_031112
tcctcctttacagctcgggcaccgtagccatcatgaatgacacggtaaccatccggaccaggaagttcatgacaaaccgtctgcttcagaggaaacagatggtcattgatgtccttcatcctgggaaggccacagtaccaaagacagaaattcgggaaaagctggccaagatgtacaaaaccacaccagatgtcatctttgtatttggattcagaacccactttggtggaggcaagacaactggctttggcatgatctatgattctttagattatgcaaagaagaatgagcctaaacacagacttgcgagacatggcctttatgagaagaaaaagacctcccgcaaacagcgaaaagaacgaaagaacagaatgaagaaggtcagggggactgcaaaggccaatgttggtgctggcaaaaagccaaaggagtagttctacggtgacttgatgttctgctgtgatat

SEQ ID NO: 3758 - DNA, 573 bp, Rattus norvegicus
  Genbank Accession No. NM_031114
aagactgcagcgcctcagggcccaggtttcaacagattcttcaaaatgccatcccaaatggagcatgccatggaaaccatgatgcttacatttcacaggtttgcaggggaaaaaaactacttgacaaaggaggacctgagagtgctcatggaaagggagttccctgggtttttggaaaatcaaaaggaccctctggctgtggacaaaataatgaaagacctggaccagtgccgagatggaaaagtgggcttccagagctttctatcactagtggcggggctcatcattgcatgcaatgactattttgtagtacacatgaagcagaagaagtaggccaactggagccctggtacccacaccttgatgcgtcctctcccatggggtcaactgaggaatctgccccactgcttcctgtgagcagatcaggacccttaggaaatgtgcaaataacatccaactccaattcgacaagcagagaaagaaaagttaatccaatgacagaggagctttcgagttttatattgtttgcatccggttgccctcaataaagaaagtctttttttttaagttccg

SEQ ID NO: 3759 - DNA, 1428 bp, Rattus norvegicus
  Genbank Accession No. NM_031117
ccgtctgaccgactccttgggtatattagtgcggcatctgcgtgtaacacgttgcctttattatggtggtctgaggttgttgattgtgaaatccaggatgtaggagctatgttgccgcagcctctgggctccgggatccgagagctcttttgtatcggccggtggaatctttggatgttcgagctgtattgccgcgacctgtagattcagggatcgtttacacttgagaagaactactgaacagcacgtgccagagattgaggtccaggtcaaacgtagaaggacagcctcactgagcaaccaagagtgtcacttgtacccacggcgttctcagcaacagcaaattcctgtggtggatttccaggcagaactgagacaggcgttcttagctgagacaccaagaggtggttaaagcagtattggaacttcaaggtggtggaagtcaacaaacacaggacctatccactgattgtgaaactttggtcaagcttacactgtgttaatagcctgcatcaaacctttatttattgcccttctccaagtattaaggatcttgaaattttagtgttgacaactgctattgtggaacagcaatcatgactgtgggtaagagtagcaagatgctccagcatattgactatagaatgagatgtatcctgcaagatggaagaatcttcattggcacctttaaggcttttgacaagcatatgaatttgatcctctgtgattgtgatgagttcaggaagatcaagccaaagaatgcaaaacagccagaacgtgaagaaaaacgggttttgggtctggtcttgctacgtggagagaacttggtttccatgacagtggagggtccacctcctaaagatactggcattgctcgtgtgccacttgctggtgctgcaggtggccctggtgttggaagagcagctggcagaggagtaccagcaggtgtacctattccccaagctcctgctggattagcaggccctgtccgaggagttggaggcccatcccagcaggtcatgaccccacagggaagaggcactgttgcagctgctgctgttgctgctactgctagcattgcaggagccccaacccagtacccgccaggacggggaactccacctccacctgtaggcagagcaaccccacctccaggcattatggctcctccacctggaatgagaccacccatgggcccaccaattggacttccccctgctcgagggacacctataggcatgccccctccaggaatgagaccccctcctccaggaattagaggcccacctcccccaggaatgcgtccaccaagaccctaagatacagttgataaatctcagcccttctctttccctacaatgcttcttgtgaaattgtgtcgcctgcaagcttttgacccctcttactgcattaactatagataatacc

SEQ ID NO: 3760 - DNA, 973 bp, Rattus norvegicus
  Genbank Accession No. NM_031125
tttgggctcaggtccaggcactccggccaccatgcgcgacaggacccatgagttgaggcagggggataacatctcagacgatgaagatgaggttcgagtcgcgttggtggtgcactcaggtgccgcccggctgagcagcccggacgacgagttcttccagaaggtgcagacaattcggcagactatggccaaactggagagtaaagtccgggagttggagaaacagcaggtcaccattctggccacgcctcttcccgaggagagcatgaagcagggcctgcagaacctgcgagaggagatcaaacagctggggagagaagtccgggcacagctaaaagccatagagccccagaaggaagaagctgatgagaattataattcagtcaacacaagaatgaagaaaacccagcatggggtcctgtcccagcagtttgtggagctcatcaacaagtgtaactcaatgcagtccgagtaccgagagaagaacgtggagcgcattcggcggcagctgaagatcaccaatgctggaatggtgtctgacgaggaactggagcagatgctggacagtgggcagagtgaggtgtttgtgtctaatatactgaaggacacacaggtgacccggcaggccctgaatgagatctctgcgcgacacagtgagatccagcagttggagcgcacgatccgtgaactccatgagatcttcacttttctagctaccgaggtggagatgcagggagagatgatcaatcgtatcgaaaagaacattctgagctcagcagactatgtggaacgtgggcaagaacatgtcaagatagcgctagagaatcagaagaaggcgaggaagaaaaaggtcatgattgccatctgtgtttctgtcactgttctcatcttggctgtcatcattggcatcaccataaccgttggataatgtcacatgttcttggcactgggagaaacagagacccagcatttg

SEQ ID NO: 3761 - DNA, 1777 bp, Rattus norvegicus
  Genbank Accession No. NM_031127
cagcctcaccttttctgatgataactcaaggactcggggatggaaagtcatggggaccctgataggccttggtgccgtgctggcctatcatgaccatcggtgtagggcttctcaggagtcaccacggatatactctaaagaggatgtgcgttctcacaacaaccttcaaactggagtctgggtaactctaggctctgaggtcttcgatgtcacaaaatttgtggacctgcatccaggaggacaatcaaaactgatgctagctgctggaggtcccctagaacccttctgggccctctatgctgttcacaaccagccccatgtacgtgagttactggctgagtataagattggggagctgaaccccgaagatagaatgtcccctcccttggaggcctctgacccttattccaatgaccctatgcgtcatccagccctgaggattaatagccagcgcccctttaatgcagagcctcctcctgaactgcttacagaaagctacatcacaccaaaccctattttctttacccggaaccatctgcctgtacctaacctggacccagacacctatcgcttgcatgtagtaggggcacctggaggtcagtcgctctctctctccttggatgatttgcataagttccccaaacatgaggtcactgtcactctgcagtgtgctggtaaccggcgctcggagatgaataaggtcaaggaagtgaaaggtctggagtggagaacaggggccatcagcacggcacgctgggccggggcacggctctgtgatgtcttagcccaggctggtcaccgactccgtgaaaccgaggcccatgtctgttttgaaggactggattcagaccccactggaactgcctatggggcatccatccctctggctcgggccatggatccccaagccgaggtcctcctggcttatgagatgaatggtcagcctctgcctcgtgaccatggcttccccgtaagggtggtggttcctggtgtggtaggtgctcgccatgtcaagtggttgggcagagtgagtgtggagtcagaggaaagttatagtcactggcagaggcgggattacaaaggcttttctccatctgtggactgggacactgtagactttgatctagccccatcaattcaggaactacccatccagtcagctatcacacagcctcaagatgggacgactgtagaatcaggagaggtgattatcaagggctatgcatggagtggtggtggtagggctgtgattcgagtggatgtgtctatggatggtggactgacctggcaggaagctgagctggagggagaggaacagcatcccaggaaggcctgggcttggcgaatatggcagttgaaagctcacgtgccagctgagcagaaggaattgaacatcatttgtaaagcggtagatgacagttacaatgtgcagccagacactgtggccccaatctggaaccttcgaggcgtgctcagcaatgcctggcaccgtgtccacgttcaggtggttccatgaaagcatggaacagcagtttgtacccaaaggacccctacacctctttaccaacccagccttaatcctcggtgccatagataaacgtttccttcctctactgaggggagaaagcagctctcaagacatcactttcttaccctaccatacctttacttctcatgcctcccctcaggccttgttttgcattgcttagattcttcagatatgtgtgtgatgtatggaatgtgtaaaaactgtacgttatttctttttcttcttccc

SEQ ID NO: 3762 - DNA, 2080 bp, Rattus norvegicus
  Genbank Accession No. NM_031132
cgcgcgcgcacacgctcgcctgggggacggagccccagcctcctgcgcagctctcctcggccgccgggggcctcctccgggcctccgagctccggggatcgccggccacatctggcccgcacctctgcccagcgcgctccgggcggcgcaggcatcctgagagggcgaggaataaaggcgcagcccggggtccccgaggctcggttcgcggcgccccaggggccggtctatgacgagcgacgggggctgccatgggtcgggggctgctccggggcctgtggccgctgcacatcgtcctgtggacgcgcatcgccagcacgatcccgccgcacgttcccaagtcggttaacagcgatctgatggcgggtgacaacagcggtgcggtcaagcttccacagctgtgcaagttttgcgacgtgacactgtccacttgtgacaaccagaagtcttgcatgagcaactgcagcgtcacctccatctgtgagaagccgcaggaagtctgcgtggccgtgtggaggaagaacgacaagaacattactctggagaccgtttgccacgaccccaagttcacctaccacggcttcactctggaagatgccacttctcccacgtgcgtcatgaaggaaaagaaaagggcgggcgagaccttcttcatgtgctcctgtaacacagaggagtgtaacgattacatcatctttaatgaagaatacaccaccagcagtcctgacctgttgctggtcattatccaagtgacgggcgtcagcctcctgcctccgctggggattgccatagctgtcattgccatcttctactgttaccgtgtccaccggcagcagaagttgagcccctcctgggagagcagcaagccccggaagctcatggatttcagcgacaactgcgccatcatcctggaggacgaccgctctgacatcagctctacgtgcgccaacaacatcaaccacaatacggaactgctgcccatcgagctggacacgctggtggggaagggccgcttcgccgaggtctacaaggccaagctgaagcagaacacttcagagcagtttgagaccgtggctgtcaagatcttcccctacgaggaatactcctcgtggaaaacggagaaggacatcttctctgacatcaacctgaaacacgagaacatcctgcagttcctgacggccgaggagcggaagacggagatgggcaagcagtactggctgatcacggcgtttcatgctaagggcaacctgcaggagtacctcactaggcacgtcatcagctgggaggacctgcggaagctgggcagctccctggcccggggcatcgcccatctgcacagtgaccacactccttgtgggaggcccaagatgcccattgttcacagggacctcaagagctctaacatcctagtaagaagcgatctaacctgttgcctgtgtgacttcgggttgtccttgggcctgagccctactctgtctgtggatgacctggccaacagcgggcaggtgggaacagcgagatacatggccccggaagttctagaatccaggatgaatttggagaacatggagtccttcaagcagacggatgtctactccatggctctagtactctgggaaatgacgtcgcgctgcaacgctgtgggagaagtgaaagattatgagcccccgtttggttccagagtgcgggagcacccctgtgtggagagcatgaaagacaacgtgctgagagaccgaggacggcctgaaatccccagcttctggctcaaccaccagggcatccagatcgtgtgtgagacactgaccgagtgctgggaccacgaccccgaggcccgtctcacagcccagtgtgtggcagagcgcttcagtgaactggagcacccagatagactctccgggaggagctgctcccaggagaagattccagaagacggctccctgaacactaccaaatagctttttctgggcaggctgggcaagactccggaagtccgtcctctaaccaaagaccagaggtcagcaggattgctttcctgactgatgcttctggaaaaccaaggacttgctcccttcttccctag

SEQ ID NO: 3763 - DNA, 3115 bp, Rattus norvegicus
  Genbank Accession No. NM_031135
ggagggaacacggtgcctcgggttgtgtacacgctccactgacagagcttcttgcagccgggcagccgctgatcacgcgtggccccgccagcccattggctgaggcctcacacacctttgccgctgattggtcgataccacgccccgccttccaccccgcccgcggcgcggggcaggcagagcggctacctgcatggggagggggggcagacagcgcggagcgcggtggcgtcgacgtctagtgtctcagtgctccgtctgtggctaggcagccagcagccaagcagctcgcgacctacggccaggcagccaaccatgcttaacttcggcgcttctctccagcaagcttcggaggggaaaatggaactaatttctgaaaagtccaaagagggagcacatccctgggacaaagctgaacagagtgactttgaagctgtggaagcgctcatgtccatgagctgcgactggaagtctcacttcaagaaataccttgaaaacaggcctgtcacaccagtgtctgatacctcagaggaagacagtttgcttccagggacgcctgaccttcagaccgtcccagcattctgtttgactccaccttacagcccctctgacttcgaaccctcgcaggggtcaaatctgacggcaccagcgccacctactggtcacttcagatcgctctccgatgctgccaagcctcccagcatcgctccttttaaagaggaggaaaagagcccattagctgcccctcccctccctaaggctcaagccaccagtgtcatccgtcacacagctgatgcccaactctgtaaccaccagtcctgccctgtgaaagcagctagcatcctcaactaccaggacaattctttccggagaagaacccacataaatgtcgaggctactcgaaagaacataccctgtgctgctgtgtcaccaaacagacccaagcctgagcccagcacagcggcgaatggcgctgagaaggccggcactgcgccgtatgactttgctgtgccttcctcagagacagtcatctgtaggtcttctcagccagctcccacgtccccagtacagaagtcagtactgatgtcttcacctacagtgtccactgggggagtgccacccttgcctgtcatctgccagatggttccccttccagcaaacaactctctcgttaccacagttgtccccagcagtccgcccagccagccacccgctgtctgctcacccgtgttgttcatgggcactcaggtgcccaagggcacggtcatgtttgtggtaccccagcccgttgtacagagcccaaagcctccagtggtgagccccaatggcaccagactgtctcccattgcccctgcgcctggattctctccttcagcagcaagggttactccccagattgattcgtccagagtaagaagtcacatctgtagccacccaggatgtggcaagacttactttaaaagttcccatctgaaggcccacgtgagaacacacacaggggaaaaacctttcagctgcagctggaaaggctgtgaaaggaggtttgctcgttccgatgaactgtccagacaccggcggacacacacaggtgagaagaaatttgcctgtcccatgtgtgaccgtcggttcatgagaagtgaccatttaaccaaacatgcccggcgacacctatcagccaagaagctgccaaactggcaaatggaagtgagcaagttaaatgacatcgctctgcctccggccacagcgtcggcacagtgacggccagaagatggagactcagaataaactttggtcagagtcgagccggtgaccgtgtcaaatgcttctgcaagtctgcggccctccaacagggcctaaagcagaagcccctggcctggggggaggcccagcctgggttagatgacgagaagtgcttcagccacaggcagttcacagaagggcggggttcatttcttaccacgtagagagatgagaacactcgtgtcccttgagtagttttggaaggtttcggatgagatgagcacagcacaggttttgaatcacatacacatcaggtactttgtttttgccatttatacttgagaccagctttgcagtgtgattcttttaaagcgttggtttcgagaatatagaggctgaaattacggtacagaaatgcagctagaaagtgagtttgtgtcatcttctcctagagttatcttgcttattattcctagtctttacagtcaactccgtggacgtggctaagtatagaaaactatcatttcttccactgttgttggtatttgaggttgaacagctgtacattgctaaggggagcccaaggattggaactctcattaatttaattgcttggaagtgcagctaaagttcttttttttggccttttgttttgaaagtttaggcattttactctaccttagatattagtttgcttgcagttttttgtgtagatttgaaaactgtacaccaatgtgtttcctatagacttaagatacgctgcgctttgtttagaaaacaatctggcagtgaaaatatgtgtcgtaaagaagagatgtcaagaatttgagatgactccttgagaaagatggcttatgtcatcagcaaaggacacttacgtcagacgtacactgtttctatcaaatcaggaagttagtgaccatcacagatggacaggtgtccttttatttataggagtttgtcaggatgtctgagtagataggtaggaaattgttactagaacattcacttccgacttgacaaggatattcatggtgcagatacgttcttcctgccgctgcagtgtctgggtgtccgggaaactccgagactttaaagtgtcataatgtggtcacacctgcagttctggggatccagagccttgcttgtgttctgtaagctctgtcaccgagttgtatccccacctgaaagcagtgacttttgctaacagtatttctgttctgttgtaaagtggatagaagacacacttggtagtaaaggtaaattattcaaagtccacagtgaaaaactcaccataccttcccatttaaaccgtttctgtatctcataggtttctgacatgcaaacttgaacccttgaaaaaaagagttttctt

SEQ ID NO: 3764 - DNA, 686 bp, Rattus norvegicus
  Genbank Accession No. NM_031136
gcggcctctgagcagatcgtctctccttgttcgcccagctcgctcagctccttccagcaaccatgtctgacaaacccgatatggctgagatcgagaaattcgataagtcgaagttgaagaagacagaaacacaagagaaaaatcctctgccttcaaaagaaacaattgaacaagagaagcaagctggcgaatcgtaatgaggcgagcgccgccaatatgcactgtacattccacgagcattgccttcttattttacttcttttagctgtttaacttcgtaagatgcaaagaggttggatcaagtttaaatgactgtgctgcccctttcacatcaaagaatcagaactactgaccaggaaggcctccccccgcctctcccgcccacctgctggcctggctggcagagagggaaaagaacttgcatgttggtgaaggaaaaagctgggtgggagatggtggaattgagagtaaaataaagatgtcttgcaggatataaaatgcagtttaatcagagtgccatttttttttgttcaaacgattttaattattggaatgcacaatttttttaatatgcaaataaagttttaaaacctgaaaaaaaaaaaaaaaaagaaacaacagtcgttatggccataaaacacatcatctgtgattttggagagaaccactggaaagaaagtttgagg

SEQ ID NO: 3765 - DNA, 4566 bp, Rattus norvegicus
  Genbank Accession No. NM_031137
ccagcttgcgtccatggccaccgctgcgaccgaggagcctttccctttccatggtcttctaccaaagaaagagactggggcctcctccttcctgtgccgctacccggagtatgacggacgcggggtgctcatcgccgtcctggacacaggggttgatcccggggccccgggcatgcaggtcacgactgatgggaaaccaaaaatcattgatatcattgatacaacaggaagtggtgatgtgaatactgctacagaagtagaaccaaaagatggcgaaatcactggtctttctggaagagtgcttaagattcctgcaaactggacaaatccttcaggaaaatatcatattggcattaaaaatggttatgacttctatccaaaggctctcaaggaaaggatacagaaagaacggaaggaaaaaatctgggatccaattcacagagttgcgcttgcagaagcttgtagaaaacaagaagaatttgatattgccaataatggctcttcccaagccaataaactaatcaaggaagagttgcagagtcaagtggaattacttaattcttttgagaaaaagtatagtgatccaggccctgtgtatgactgcttggtgtggcatgatggtgagacctggagagcctgtgttgattcgaatgaaaatggggacttgggtaaatctactgtattgagaaactacaaagaggctcaagaatatggttcttttggcacagctgagatgctgaattactctgttaatatttatgatgatggaaacctgctctccattgtgaccagtggaggagctcatggaacccatgtagcgagtatagctgctgggcattttccagaagagcctgaacggaatggagttgctcctggtgctcaaattctatccattaagattggtgatacaaggctaagcaccatggaaacaggcacaggcctcatcagagctatgatagaagttataaatcataagtgtgatcttgtcaactacagttatggagaagcaactcattggccaaattctgggagaatttgtgaagtaattaatgaagcagtatggaaacataatacaatttatgtttcaagtgctggaaataatggtccatgcctttctacagtgggttgtccaggaggaactacttccagcgtgataggtgttggagcttatgtttctcctgatatgatggttgcagagtattcactgagagagaaactacctgcaaatcaatatacatggtcttctagaggcccaagtgctgatggggcccttggtgtgagcatcagtgcaccaggaggtgctattgcttctgtgcctaactggacattgagggggactcagctaatgaatgggacatcaatgtcttcccccaatgcctgtggtggcattgccctggtactttcagggctgaaagcaaataatgttgactatactgttcactcagtcagaagagctctagaaaacactgcaataaaagctgacaatatagaagtatttgcccaaggacatggaattattcaggttgacaaagcttatgactacctcattcagaatacatcatttgctaacagattaggttttacagttacagttggaaataaccgtggcatctacctccgagatcctgttcaggtggctgctccttcagatcatggtgttggcattgagcctgtatttccagagaacacagaaaactctgaaaaaatatccttccagcttcatttagctttaacttcaaattcatcttgggttcaatgtcccagccatttggaactcatgaatcaatgtcggcacataaacatacgtgtggaccccaggggcttaagagaagggttacattatacagaggtatgtgggtatgatatagcatcccccaatgcaggtcctttattcagagttccaatcactgcagttatagcagcaaaagtaaatgaatcatcacattatgatctagcctttacagatgtacattttaaacctggtcagattcgaagacattttgttgaggttcctgagggggcaacttgggctgaagttaccgtgtgttcgtgttcttctgaggtatcagcaaaatttgttcttcatgcagtacagcttgtgaagcagagagcatatcgaagtcatgaattttataagttttgttcccttccagaaaaaggaacactcattgaagcctttcctgttctgggtgggaaagcaattgaattttgtattgctcgttggtgggcaagtctcagtgatgtcaatattgattataccatatcattccatggcatagtgtgtactgcaccacagttaaacattcatgcatctgaaggaatcaatcgttttgatgtccagtcctctttaaaatatgaagatctggctccttgcataactttgaagagctgggtgcaaacactacgcccagtaaatgcaaaaaccagacctttaggatcaagagatgttttgccaaataatcgccagctttatgagatggtcctgacatacagctttcatcagcccaagagcggagaagtaacacctagttgtccactcctttgtgaattattatatgagtcagaatttgacagtcagttgtggattatttttgaccagaacaaaagacagatgggctcaggcgatgcctatccacatcagtattctttgaaattggagaaaggagattatacgattcgattacagattcgtcatgagcaaatcagtgatttggatcgtctcaaagatcttccgtttattgtttcgcataggttgtctaataccttgagcttagatattcatgaaaatcatagccttgcacttctaggaaagaagaaatcaagcagtttgacattaccacccaaatataatcagccattctttgttacttccttacctgatgataaaatacctaagggggcaggacccggatgctaccttgcaggctccttgacattgtcaaagactgagcttggaaagaaagctgatgtgatccctgttcattactatctaatacctccaccaacaaagactaagaatggcagcaaagataaagaaaaggattcagaaaaagagaaagatttgaaagaagagtttactgaagctttacgagatcttaaaattcagtggatgaccaagctggattctactgacatttacaatgaattgaaagaaacatatcctgcttaccttcctttgtatgttgcacgtcttcatcaattagatgctgaaaaggagcggatgaaaagacttaatgaaattgttgatgctgccaatgctgttatttctcacatcgatcagaccgctctcgctgtttacattgccatgaagactgaccccaggcctgatgcagctactataaaaaatgatatggacaagcagaaatctaccctggtagatgccctctgcaggaaaggatgtgctctggcagaccaccttcttcatgcacagccccacgatggggcagcagctggagatgcagaagcaaaagaagaggaaggagaaagtaccttggaatctctatcagaaacctattgggaaactacaaagtggacagatctttttgacactaaggttttgacatttgcatacaagcatgcattagtaaataagatgtacgggagaggccttaagtttgcaaccaaactcgtagaagaaaaaccaacaaaagaaaactggaaaaattgtattcaactgatgaaattactcggatggacccattgtgcgtcttttactgaaaactggctccccatcatgtatcctcctgattattgtgtattctaaaatgggaaccaaaacgttaaatttcgaaagcagaaaattttatagtgaacaaatatatgaacaaatgtgtggcatttctagtctaactaatgcatgtcttcatccactatcgaatactgatcattaaaactctatgtatttatcagagaactcaatggtgtgtggcttcatacatgtaatgtagacagacctctgacatcatgctgctttcctgctgcctcccacacttggctagggagggcagagcctgcctgccagccccaacctgggtggatgcagctgctcactgcaggagaggttttcatctcttaatttttaactgtaaaacgtcatccagtttttattttataaatcaaaaaggttaaaacatgctaaatttttccaattatatagaggccttaaaaatgctacattgggtgtagctaaattatttatttgactaaaaattacgagaacataatttccagacttctaaaaataaattcaattaatgggtatggtggggaggtataaatacatggcaactgggaaaagaaacgtgttaatgtaatcttcactccggagtcacaacaagcaagttgtttttacagcatcctcaagtacacagcatcagaataagttaaaatttcatgtgttggtgccagacagttgaatctatctggttttgtaaagatatacacagtatgtttataacattgaaatcatgtaaaatacatgaataaatgtgcaaaacaacaggcacagcacaccatatgcactctgatacctgttttttataaataaaagtaaatattgaagctaaa

SEQ ID NO: 3766 - DNA, 1737 bp, Rattus norvegicus
  Genbank Accession No. NM_031138
  misc_feature (1)..(1737): n = a or c or g or t
ggggcagctgcggagcatgtcgaccccggcccgtaggaggctcatgcgggatttcaagcgattgcaagaggacccacctgtgggggtcagtggtgcaccatctgaaaacaacatcatgcagtggaacgcagttatatttggaccagaagggacaccctttgaagatggtacttttaaactagtaatagaattttctgaagaatatccaaataaaccaccaaccgttaggtttttatccaaaatgtttcatccaaatgtgtatgctgacggcagcatatgcttagacatcctgcagaaccgatggagccccacgtacgacgtctcctccatcttaacttcaattcagtctctgttggatgagccgaatccaaacagtccggccaatagccaagcagcacagctttatcaggaaaacaaacgggagtatgagaagagggtttcggccattgttgagcagagctggaatgactcataatagacacctggtctgtccacctttccatcgtcgttgtgtataatttacctcccagtaggaaggctagcaagttttaagtgccacgggttttaaggattctgcagagaaaaaagaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaaaaaaacaggcatctggactcaatggtacctgattaagcccattcctctcagacacttggatgggagacccacacctggactcttttgagcttcagttgatggaattagtgcagcttgagtcagctcaacggggtctctgtgacttgtcctccttcttctgagaccttgcctgtgaaagtattcaaaacacctgcagtattgcctttagcgagttctcatagcaaaggacatagggtgggtgggactggattcgcaggtgaaattaaacctgacagggccgtgtgtttgcattttaatttgatatactcctgaacagtccatctctgacatgctctgccacaacccttctgtgtgtttccttagttactgctaccaaatatccgtgcagccctgcattactgtttccctgggtaccgctcatccccagcccctgaaagccccctggaggtggggaagctgtccccgttgcattcatcttacacacttgcaggctagcgcatgccacacgctctattagtactggtggcttgagtaaataagcaagttcacagctatcgccctctgcagtgcttcaaacactaatgtcttctaacaaatacaactttagtgatcactttgatgccattgaacatgaaacaggtttcttgttgatactagaagatatgtcagaggactcattcaagcctcttctcctgtttttttcgtgacacacatcgataagaagctgattttttttagactaaaatgcataacttaaaatatcttgngaattttttttaaaaggaagggatagaaaaaatatgtcatgaagaaggagaaaaaaaaaaaaaaaaaaaaa

SEQ ID NO: 3767 - DNA, 1796 bp, Rattus norvegicus
  Genbank Accession No. NM_031140
gttcacagccactgcgccctcgctctcttcttgcagatcttgcagccgcagcaagccaggccacctcgtccttcgaagccatgtccaccaggtccgtgtcctcgtcctcctaccgcaggatgttcggtggctccggcacatcgagccggcccagctccaaccggagctatgtgaccacatccacccgcacctacagcctaggcagcgcgctgcgccccagcactagccgcagcctctattcctcgtccccgggtggcgcctatgtgacccggtcctccgccgtgcgcctgcggagcagcatgcccggcgtgcggctgctgcaggactccgtggacttctcgctggccgacgccatcaacaccgagttcaagaacacccgcaccaacgagaaggtggaattgcaggagctgaatgaccgcttcgccaactacatcgacaaggtgcgcttcctcgagcagcagaacaaaatcctgctggccgagctcgagcagcttaagggccagggcaagtcgcgcctgggcgacctctacgaggaggagatgagggagttgcgccggcaggtggatcagctcaccaatgacaaggcccgtgtcgaggtggagagggacaacctggccgaggacatcatgcggctgcgagaaaaattgcaggaggagatgctccagagggaggaagccgagagcaccctgcagtcattcagacaggatgttgacaatgcttctctggcacgtcttgaccttgaacgtaaagtggaatccttgcaggaagaaattgcctttttgaagaagctgcacgatgaagagatccaggagctgcaggcccagattcaggaacagcatgtccagatcgatgtggacgtttccaagcctgacctcaccgctgccctgcgtgatgtccgccagcagtatgaaagtgtggctgccaagaacctccaggaggccgaggaatggtacaagtccaagtttgctgacctctctgaggctgccaaccggaacaacgatgccctgcgccaggcaaagcaggagtcaaacgaataccggagacaggtgcagtcactcacctgcgaagtggatgcccttaaaggcactaatgagtccctggagcgccagatgcgtgaaatggaagagaattttgcccttgaagctgctaactaccaggacactattggccgcctgcaggatgagatccagaacatgaaggaagagatggctcgccaccttcgtgaataccaggacctgctcaatgtaaagatggctcttgacattgagatcgccacctacaggaagctgctggaaggggaggagagcaggatttctctgcctcttccaaacttttcttccctgaacctgagagaaactaacctggagtcacttcctctggttgacacccactccaaaagaacactcctgattaagacggttgaaaccagagacggacaggtgatcaatgagacttctcagcaccacgatgaccttgaataaaaactgcacaggctcagtgcaacggcgcagtaccagcaagaaggaaaaaaaaatcgtatcttagaaaaaagagctttcaagtgcctttactgcagttttcaggagcgcaagatagatctgggatagaaacgagctcagcacataacaactgacacccccaaaaggcgtagaaaaggtttacaaaataatctagttttacgaagaaatcttgtgctagaatactttttaaagtatttttgaataccattaaaactgctttctttttccagaaaatatctgaccaacttgttactgcttcaataaaacttcagaaat

SEQ ID NO: 3768 - DNA, 1128 bp, Rattus norvegicus
  Genbank Accession No. NM_031144
atggatgacgatatcgctgcgctcgtcgtcgacaacggctccggcatgtgcaaggccggcttcgcgggcgacgatgctccccgggccgtcttcccctccatcgtgggccgccctaggcaccagggtgtgatggtgggtatgggtcagaaggactcctacgtgggcgacgaggcccagagcaagagaggcatcctgaccctgaagtaccccattgaacacggcattgtaaccaactgggacgatatggagaagatttggcaccacactttctacaatgagctgcgtgtggcccctgaggagcaccctgtgctgctcaccgaggcccctctgaaccctaaggccaaccgtgaaaagatgacccagatcatgtttgagaccttcaacaccccagccatgtacgtagccatccaggctgtgttgtccctgtatgcctctggtcgtaccactggcattgtgatggactccggagacggggtcacccacactgtgcccatctatgagggttacgcgctccctcatgccatcctgcgtctggacctggctggccgggacctgacagactacctcatgaagatcctgaccgagcgtggctacagcttcaccaccacagctgagagggaaatcgtgcgtgacattaaagagaagctgtgctatgttgccctagacttcgagcaagagatggccactgccgcatcctcttcctccctggagaagagctatgagctgcctgacggtcaggtcatcactatcggcaatgagcggttccgatgccccgaggctctcttccagccttccttcctgggtatggaatcctgtggcatccatgaaactacattcaattccatcatgaagtgtgacgttgacatccgtaaagacctctatgccaacacagtgctgtctggtggcaccaccatgtacccaggcatcgctgacaggatgcagaaggagattactgccctggctcctagcaccatgaagatcaagatcattgctcctcctgagcgcaagtactctgtgtggattggtggctctatcctggcctcactgtccaccttccagcagatgtggatcagcaagcaggagtacgatgagtccggcccctccatcgtgcaccgcaaatgcttctag

SEQ ID NO: 3769 - DNA, 822 bp, Rattus norvegicus
  Genbank Accession No. NM_031145
ccacgcgtccggttggccgagctgtgcgcgcaccgcggcgatgggaggttcgggcagtcgcctgtctaaggagctgctggccgagtaccaggacctgacgttcctgaccaagcaggagatcctccttgcccacagacgcttttgcgagttgcttcccccagagcatcggaccgtggaagagtcactgcatacccgagtatcttttgagcagatcctcagccttccagagctcaaggccaaccccttcaaggagcgaatctgcatggtcttctccacgtcgcctaccagagacagcctgagctttgaggacttcctggacctcctgagtgtcttcagtgacacagcaaccccagacatcaagtcacactatgccttccgcatctttgactttgatgatgatggaaccctggacagagaagacctgagccggcttgtgaactgcctcacgggagagggcgaggacactcggctcagtgcttctgagatgaagcagctcatcgacaatatcctggaagagtcggacattgacagggatgggaccatcaatctctccgagttccagcacgtcatctctcgctcaccagactttgccagctcctttaagattgtcctgtgatggctttcaagtaccaacatcctgtccaagacctttccactgctgagatgtggccaaggttatgcctgcggtgtcagggccagagccggcccagcctggagagggcgctgcagagtctggccccctggcaggggaggactctcccccttgtcactgctgttgccatcactgtttttactaattggtaataaaggtttagaaatgtt

SEQ ID NO: 3770 - DNA, 1288 bp, Rattus norvegicus
  Genbank Accession No. NM_031149
gccgaaagagggaagatggcgcttgatgggccagagcagatggaactggaagaggggaaggcaggcagtggactccgtcaatattatctgtccaagattgaagaactccagttgattgtgaatgacaagagtcagaacctccggagactgcaggcccagaggaatgagctcaatgcaaaagttcgtctgttgcgggaggaactgcagctgctgcaggaacagggctcctacgttggagaagtcgtgagggccatggataagaaaaaagtgttggtcaaggtccatcctgagggcaaatttgttgttgatgtggacaagaacattgatatcaatgatgtgacacccaattgtcgggtggctctaagaaatgacagctacactctgcataagatcctgcctaacaaagtggaccctttggtatcactaatgatggtggaaaaggtgccagactcaacctacgagatgattggcgggctagacaagcagatcaaggagatcaaagaagtgattgagctgcctgtgaagcaccctgagctctttgaagccctgggcattgcacagccaaagggagtcctgctatatggacccccgggcactgggaagacgttgttggcccgggctgtggctcatcatacggactgtacctttattcgtgtctctggctctgaactggtacagaaattcattggggaaggggcaagaatggtgagggagctgtttgtcatggcccgagaacatgctccctccatcatcttcatggacgagatcgactctatcggttcttcacggctggagggaggctctggaggcgacagtgaggtacagcgcacaatgctggaactgctcaaccagctggatggctttgaggccactaagaatatcaaggttatcatggctactaataggattgatatcctggactctgccctgcttcgtcctgggaggattgacaggaaaattgaattcccacctcccaatgaggaggcccggctggacattttgaaaatccactctcggaaaatgaacttgaccagggggatcaacctgaggaaaattgctgagttgatgccaggagcttcaggggctgaagtgaagggcgtgtgcacagaggccggcatgtatgctctgcgggaacggcgtgtccacgttactcaggaggactttgagatggcagtagccaaggtcatgcaaaaggatagtgagaaaaacatgtccatcaagaagctttggaagtgagggtgtgtcctttgtgtggatccctcaaataaaggtctgtgcgataaactcc

SEQ ID NO: 3771 - DNA, 2138 bp, Rattus norvegicus
  Genbank Accession No. NM_031150
cctggaggtatcttccaacatggctaggtggcagagagtctactggttgcgttctctcttcttcgcccttgtgacttcagtaaattcattaagccttcctcagtcagagaatcctgccttcccaggcactctcatttgtgataaagatgaagtgagagtagaattttcaagcagatttgacatggaaaagtggaatccttccttggtggatacctttggtaatgaaatttcgaactgcacttatgctctggacttggaaaagtttatcctgaaattcccttacgagacctgtactataaaagtgattggtggataccaggtgaacatcagagtgcaggacaccaatgctgatgtaagctataaagatgacgtgcatcactttttctgcccagctattcaagcagagattcatgaggtctcagaaattgttgtctgcatggaggatctcatatctttttctttcccacaacttttctctaggcttgctgatgaaaatcagaatgtatctgagatgggatggattattaagattggcaatggtacaagagtccacactctgcccctgaaggatgctatagtacaaggatttaatctcctgattgacagccagaaaataaccctccatgtgccagccaatgctaccggagtagctcactatgtgcaagagagcagctatctctatactgtacagctgaagctcttgttctcaagtcctgggcagaagatcaccttctcttcacaagctatctgtgcaccagatctttctgtggcttgtaatgtgacacacatgagtcttactataccagaatttcctgggaagctaaaatctgtgggctttggacaaaggaacatccctgaggatcaatggcatgccaatggaattgacaaagaagcaacaaatggcttgagactgcatttcagaaaatctctcttgaagacaaaaccctctgaaaagtgtccattctaccagttctacttctcttcactcgagctgacctttaacttccaaggggacatgctatccacagtgattgatcccgagtgccactgtgagtcaccggtctccatagatgaactgtgtacacgggatgggtttatggactttgaggtctacagccaccaaacaaaacctgcactaaacctggagagcctcctggtgggaaactcctcctgccagcctattttcaaggttcagtctctggggcttgcaagatttcacatacctctgaatggatgtggaacacgacagaaatttgaaggtgataaagtcatctatgagaatgaaatccatgctctctgggaaaatccaccgtcaaacattattttcagaaacagtgagttcaggatgaccgtgagatgccattacatcagagacagtatgctactaagggcccatatcaaaagccattcttctccagtggcctctgtaaagccaggtccactagcgttggtcctacaaacctacccagacatatcctaccaacggccttataggaagaatgagtaccctctagtgaggtacctccgccagcccatctacatggaagtgacagtcttgaatagaaatgatcccaacatcaagctggttttagatgactgctgggcaacaacttttgaggacccagcctctgtcccccagtggcagatcattatggatggctgtgaatatgaactggacaattaccgcactactttccacgcagccaactcctctgcagcccattctggtcactaccagaggtttgatgtgaagacttttgcctttgtgtcagagtctcgggggctctccagcctgatctacttccactgcagtgccttgatctgtaaccaagcctcccctctgtgctctgtgacttgccctgcaccactgaggaacaaacgagaggccagcaaagaaggcacaatgacggttagcctcccaggacctattatcttgttgtcagatgactcttcatccaaaggtgtaatgaaccctgacagctatgagattaccaaagatattgcttctaaaacattgggtgctgtggctgcactagtgggctcagcagtcatcataggtttcatctgttacctgcataagaaaagaattgtaaggttcaattcctgattggacttttgcaaataaaagaggctgcagt

SEQ ID NO: 3772 - DNA, 1192 bp, Rattus norvegicus
  Genbank Accession No. NM_031151
cgcagctgctgtgcctgtaggtccgtgccccgcccgtcccagccatgctgtccgctctcgcccgtcctgtcggtgccgctctccgccgcagcttcagcacttcagcccagaacaatgctaaagtagctgtcctgggagcttctgggggcattgggcaacccctttcactcctcctgaagaacagtcccctcgtgagccgcctgaccctctatgacatcgctcacacacctggtgtggcagcagatctgagtcacatcgagaccagagcaaatgtgaaaggctacctcggcccggagcagctgccggactgcctaaaaggttgtgatgtggtggtcatcccagctggagtgcccaggaagccaggaatgacacgagatgacctgttcaacaccaatgctaccattgtggccacattgacggctgcctgtgcccagcactgtcctgaagccatgatttgcatcatttccaacccagttaactccaccatccccatcacagccgaagttttcaagaagcatggcgtatacaaccccaacaagatattcggtgtgacaacccttgacatcgtcagagcaaacacatttgtggcagagctaaagggtttggacccagctcgagtcaatgtgcctgtcattggtggccacgccgggaagacgatcatccccctgatctctcagtgtacccccaaggttgactttccccaagaccagctggccacactcaccgggaagatccaggaggctggcactgaagtcgtgaaggccaaggctggagcaggctctgccactctgtccatggcttatgctggagcccgctttgtcttctccctggtggacgccatgaatgggaaggaaggagtcatcgagtgctcttttgttcagtccaaagagacagagtgcacttatttctctacacccttgctgttggggaaaaaaggcctggagaagaacctaggcattggcaaaatcactccttttgaggagaaaatgattgccgaggccatccctgagctgaaagcctccatcaagaaaggcgaggactttgtgaagaacatgaagtgagtgtgagcctcgagcctccagcagcagcagcagcagcagcatcctaacttattcagcatcatgtcattgaactacttgagagtctaatttgcttgttggagggtgttgtgtcagcatcagcatccttccgg

SEQ ID NO: 3773 - DNA, 895 bp, Rattus norvegicus
  Genbank Accession No. NM_031152
atgggcacccgcgacgacgagtacgactacctctttaaagttgtccttattggagattctggtgttgggaagagtaacctcctgtctcgatttactcggaatgagtttaatctggaaagcaagagtaccattggagtagaatttgcaacaagaagcatccaggttgatgggaaaacaataaaggcacagatatgggacacagcagggcaggagcggtacagggctataacgtctgcatactatcgtggagcagtaggtgccttattggtttatgacattgctaagcatctcacatatgaaaatgtagaacgatggctgaaagaactgagagatcatgctgatagtaacattgttatcatgcttgtgggcaataagagtgatttacgtcatctcagggcagttcctacagatgaagcaagagcatttgcagagaagaatggtttgtcgttcattgagacatctgctctagattctacaaatgttgaagctgcttttcagacaattctaacagagatataccgcattgtttctcagaagcaaatgtcagacagacgtgaaaatgacatgtctccaagcaacaatgtggttcctattcatgtcccacccaccactgagaacaagccaaaggtgcagtgctgtcagaacatctaaggcgcctctctcccctagacggctgtgtatagtccatttcccaggtctgagatttaaatatatttgtaattcttgtggtcactttctgtgttttattacttccttacacttaagaatcttcccatgtcttaagtctttgatttggctttataaaatcctcaactttgtcctgaatgactcgagttctttttcatgctatggcttctctagccttagtttaataaactgaatgtttgaagtcctc

SEQ ID NO: 3774 - DNA, 1339 bp, Rattus norvegicus
  Genbank Accession No. NM_031153
ggactccgccggaccagaaatgtcgccgcccgccggcggtgcggcagcggctgcagaccctgcttcacctgtggtgctcctggcagtgcaagccgcggtgagactcctgggcgccggacatgaagacgaagcgcagctgcgaaagctgcagttgaaagccgaccctgagcggcctggacgcttccggctgggactgttaggcattgagccaggggcggtcagtttagaatggcccttggagtctatttgctataccattcgtggtcctaaccaacacgagctgcagcctccacctggaggtcctggaaccttcagtgtgcacttcctcaactctgaggaagcacagcagtgggcagcactggtgcgagatgccaccgcagaaggacaaaatggcaatgacagcacagccccagtcccaaccccagccatgtgccccacttctccaccatgttcttctgtgactccaacacctaaagcaacccaaccagagatggaccttcctcaaggttctggaaacttgaaaaaagaagagctggctacacacctggcccaggccattgcaggtggggatgagaaagcagcagcccaagtggcggcaatcctggcacagcatcatgtggctctcaatgtccagctcttagaggcctggttcccacggggtcccataaggctgcaagtcacagttgaagatgccacatcggttttatcctcttcgtcgtctgcccatgtctcactgcagatccacccacactgttccattgcagccctccaggaacaggtgttctcagagttcggtttcccaccagctgtgcagcgctgggtcattggccggtgcctgtgtatgcctgaacgaagccttgcttcctatggggtctctcaagatggggaccctgcttttctttacttgctctcagccccccgagaagtttcaggacacagccctcaacactccaagatggataggaaattaggatgcttgtttcctcagtcattggagctgcctcataacctccaggcatccagttccagtctcccaagtccccctcagcctggctggtcttgcccttcctgcaccttcatcaatgcttcaaaccgccctggctgtgagatgtgtagcacccaaaggccctgtgcttgggatccccttactgcaacttccacctagaagccaccaaaggttacagagaatatgccctcttgtcacaggcccaaccaccacctgaactttggaggggaccgctgcttgttggggacagagatgccagtgttagagaacaggggccacaagccagtaattaaagacacataagagccaaaaaaaaaaaaaaaaaaaaaaaaa

SEQ ID NO: 3775 - DNA, 5500 bp, Rattus norvegicus
  Genbank Accession No. NM_031235
gccacacggccccgggccgccgccgagcgcgccaagacgccgagacgccgaacaggtggccggaggctgcaggcgcccgggcggggacaggcgagggcaagtgaaggcggccgggctggacatggtagccgggcagctctgtgcggccgcctgctcgcgcccctagccgccggcgcgccggcgcagcggccccaccgcgccctgcgtacagtctcccggcccagcggcgctcgggccacggacggcgagggacggcggcatgaaagtgaccgtgtgcttcgggaggacccgggtggtcgtgccgtgcggagatggccgcatgaaagttttcagccttatccagcaggcggtgacccgctaccggaaggccgtggccaaggatccaaactactggatacaggtacatcgcttggagcatggggacggtgggattctagacctggatgacatcctctgtgacgttgccgatgacaaagacagactggtagcagtgtttgatgagcaggatccccaccatggaggagatggtacgagtgccagctccacgggaacccagagtccagagatattcggcagtgagctgggcaccaacaatgtttctgcttttcggccttatcaaaccacaagtgaaattgaggtcacgccttcagtccttcgggcaaatatgcctcttcacgtccgacggagcagtgacccagctttaactggcctatccacttccgtcagtgataacaacttttcctcagaggagccctccaggaaaaaccccacccgctggtccacgacagctggctttctcaagcagaacaccactggaagtcccaaaacctgcgacaggaagaaagatgaaaactacaggagcctcccacgggatcccagtagctggtccaaccagttccagagagacaacgcccgctcctctctgagtgccagccacccaatggtagaccggtggctggagaagcaagaacaggacgaggaaggcacagaagaagacagcagccgagtggagccggttggacatgctgatactggactggagaatatgcccaacttttccctcgatgatatggtaaagctcgtacaagtccccaacgatggagggcccctgggaatccatgtagtgcctttcagtgctcgaggcggcagaacactggggttgttagtgaagcggttggagaaaggtgggaaggctgaacaagaaaaccttttccacgagaatgactgcattgtgaggattaacgatggagatcttcgaaacagaagatttgagcaagcacagcatatgttccgccaagccatgcgtgcgcgagtcatttggttccacgtggtccctgcagcgaacaaggagcagtatgaacagctctcccaacgagagatgaacaactattcccctggccgcttcagccccgacagccactgtgtggccaacaggagtgtggccaacaatgcgcctcaggcgttgcccagagcacccagactgagccagccacctgagcagctggatgctcacccccgactacctcatagtgctcatgcctcaaccaaaccgcccacagccccagccttggctccaccgaatgtgcttagtaccagtgtcggcagtgtgtacaacacgaagagagtaggcaagaggctcaacattcagcttaaaaaaggtacagaaggactgggatttagcatcacttcccgagacgtaactataggtggctcagctcccatttatgtcaagaacattcttcctcgaggggctgccattcaggatggcaggctcaaggcgggagaccggctaatagaggtcaatggagtagatttagcgggcaagtcccaggaggaagttgtttccctgttgagaagcaccaagatggaggggaccgtgagccttctggtctttcgtcaagaagaggctttccacccaagggaaatgaatgccgaacccagccagatgcagagtccaaaagaaacgaaagccgaagacgaggacattgttctcacacctgacggtaccagggagtttctgactttcgaagttccactgaatgactcagggtctgcagggcttggtgtcagcgtcaaggggaaccgctccaaagagaaccatgcagatttggggatcttcgttaagtccatcattaacgggggagctgcatctaaagatgggaggctgagggtaaatgaccagctgatagctgtgaacggagagtctctgctgggcaaagccaaccaggaagccatggagactctgaggaggtccatgtccaccgagggcaacaagcgtggcatgatccagctcatcgtggcgaggcggatcagcagatgtaacgagttgcggtctcctgggagccccgctgcacccgagctgcccatagaaacagagttggatgacagagaacgcaggatctcacactccctctacagtgggatcgaggggctggatgagtctcccaccaggaatgccgcactcagcaggataatgggtgagtcaggtaaatgccagctctccccaaccgtgaacatgccacatgatgacactgtcatgattgaagatgacaggctgcctgtgctccctcctcacctctctgaccagtcctcctccagctcccatgatgacgtgggattcataatgacagaagcaggcacgtgggccaaggctaccatcagtgactcagccgactgctcattgagtccagatgttgatccggttctcgcttttcaacgagaaggatttggacgccagagtatgtcagaaaaacgcacaaagcaattttcaaatgccagtcaattggatttcgttaaaacacgaaaatcaaaaagcatggatttaggtatagctgacgagactaaactcaatacagtggatgaccagagagcaggctcccccaatagagatgtgggaccctccttgggtctgaagaaatccagctctttagaaagtctgcagacggctgttgctgaggtgaccctgaatgggaacattcctttccaccgcccacggccacgaatcatccgaggaaggggctgcaacgagagcttcagagccgccattgacaagtcctacgataagcccatggtggatgacgacgacgaaggcatggagaccttggaagaagacacagaagaaagttcaaggtcagggagggagtccgtgtccacgtccagtgatcagccttcctattctctggagagacaaatgaatggagacccagagaagagggacaaggcagagaagaaaaaggacaaagccggaaaggataagaagaaagaccgagagaaggagaaggataaactgaaagccaagaaggggatgctgaaaggcttgggggacatgttcaggtttggcaaacatcgaaaagatgacaagatggaaaaaatgggtcgaataaaaatccaggactctttcacctcagaagaggacagggtgcggatgaaggaggaacaggagaggattcaagccaaaactcgagaatttagggagcggcaagctcgagagcgcgactatgctgaaatccaagatttccatcgaacatttggctgtgatgacgagttgctgtatgggggcatgtcatcctatgatggctgcctggctctcaatgccagaccccagagcccaagagaaggtcacctgatggacactttgtatgcacaagtaaagaaacctcggagctccaaacctggggacagcaatcgatccacccctagcaaccatgaccggatacaacgtctacggcaagaattccagcaagccaaacaggatgaggacgtggaagaccggcgccgtacctacagctttgagcaatcttggtccagctcacggccagcatcgcagagtggtcggcactcggtgtcagtggaggttcaagtgcagcggcagcgccaggaggagcgagagagcttccagcaggcccagcgccagtacagctccctgccaagacaaagcaggaagaatgccagctctgtatcacaggattcctgggaacagaactacgcccctggtgaaggcttccagagtgccaaggagaaccccaggtattccagttaccagggctccaggaacggctatctaggtggccatggctttaatgccagggtcatgctggagacccaggagcttctccgacaggagcagaggcgaaaagagcagcaactgaagaagcagccaccagcggatggagtcagagggcccttccggcaagatgtacccccgtctccatctcaggtggccaggctgaacagactgcagacacccgagaaagggcggcccttctactcctgagctcaatggaggatggcagcattttgtgtcatgcaataaaggacatttccccgtgaagacttgtgctcctggagtttattttttacaaaaaccctccatttggtggtactacagaacacttctgtcactggtatcagtgcctttaagcagcaggagcaaagaaatggaaggccttaatgtctttgccacgcgtatatctcgtggaaggaccccatccccaccccaccccaacctcaagttcaaggcatctactccctgcttctcagcagtaccggaaacttcagctccatataaggtgcctgtggacgtcacagcttcatcttagagaggggaccccccctccccccgccacgtgttgccgacacccgttccctgtggacgtgacatctcggtctctggaggacggaagtggctgcagcatgcaccagagcgagggctttccagaacttcgcagcagggctacccatgttctcccactcggtctggggttccctttctttcctcagatcctcggagcgtgaaggctctagggtggtagtgaagaagctaagccataggccagtgccgtttggttctggggggtgagggtaactttccaactgccttataactccaccacccatatcacagcgattctagtcagtgtttataagtacatgcgttcagtttcagtcactcatgacactcgggaacaaggggcatgggagtggcccatgtgtacgcaccccgaggaaggagataggagctgagggaagactctctggaggagcttaggccggtctatccagtccttactttacttcgtgtcaccgtaggttgtcaagggaggcacagagtgggacaaggaaaaaggtcagtcacttgggattctgagaatcaacctcaacacagcttttgaggttgcagtcaggatttggtctcctatatcctcataccatgtcccgacctgacgaggccaacattactgagtgactctgctgtttattcacaaacagaaggagagccatcccactcgaggacctgtcgatgtccctctgagcaccgggagtcccattctccgtgcatgcctgtggcacgaggccctccgtgttcccgccgttcatctgttggtctgaacatcctgtattgtaaaccaaggctgggttgctaaagtgcctgagaatctcgatataaaaaacaaaaaacaaaaaatccttgggcaaaaagctcagagtaccatgtattaac

SEQ ID NO: 3776 - DNA, 2720 bp, Rattus norvegicus
  Genbank Accession No. NM_031236
ctaagggaagcagaagtcccggcaccggagagggaaacgcacatgggacctgagctcctggcttcagccttgccgcccgggcgctagtcccctggtccatacagaggatacggcagcttctggatacgaactgggttgtccatcgtggagtcagagaacccagaagaagagacagggccgcagcgcccatccacctgggcggaggagaaggcgcagggccaggtaggatgcggctccgcctcctgctaccagccctacccgaagggcggaggctgtgcaccttggaaccctgcctctccctctctctctccccacgggtctctgagccccagccttcagtcagtttcaggaaggaagcttgaagcggagggctacggagccagggctccccacctccaagcgcggccgatgaaggctacattttggaactggaagctcagacaaaaagaattcgtttgcaccaccagcaagaagctcagctatgtggactcccagccggaagcagctctgcctggcatttctgtcggtctgtgtgctctctgccggctccttcttcttccacctgaatggaggaaacttctttcaaaatgctctaactttctctgtcctgtgtccagactatcacctgctgaagtccccagtggccatggtatgcctaccttatccgtcgaacgcatccagtggctccccttcctgtcccgagcagtccttgctctctgggacttggacaatcacccccggaggcaggtttggtaaccagatgggacagtatgccacattgctggccctagcccagctcaatggccgccgggctttcatccagcctgagatgcataccaccctggcccctgtgttccgaatctccctgccagtgctggaccctgaggtggacagtctcacgccttggcagcacttagtcctacatgactggatgtcagaggagtactcccacctggaggacccgtttctcaagctgtctggtttcccctgctcttggacctttttccatcacctccgggaacagattcgccgggaattcaccctgcatgaccacctacgggaagacgcacagcgcctgttgagtgggctccggataggccctgcaggcatccgtcctcgtacctatgtgggtgttcacgtgcgtcgtggagactatttggaggtgatgcctaaccgctggaagggagtggtgggtgaccgagcttacctccagaaagccatggactggttccgggcccggcacaaagaccccatctttgtggtcaccagcaatggcatgagatggtgtttggagaacattgacacatcccacggtgatgtggtcttcgctggcaatggacaggagggtacgccggggaaggacttcgcactgctcacccagtgtaatcacaccatcatgactattgggacctttggcttctgggctgcctacctggctggtggagacactgtctaccttgctaacttcacccttccagattcagagtttctgaagatcttcaggcctaaggctgccttcctgcccgagtgggtgggcattaacgcagacttgtccccgctgcaggctcagtttgacccctgggagacagacagtctttttagactggcttgactcatcaagggtcagccatctgtgtctctctgctttggagtatgtctgccatcatcctggagctgggggcactcatggctggacttgcagatgagccttttggagtgctggagtgctttacagacatttcaacagggtagcattttctgacggcaggggaagcccaagtcagcactgtaagtcacagtctcttctgactttcctggctcaccttagaatcttgtggacagctgcttctgggttagggaggctaaagaaaatccagacttaccagctgggcctcctgaattcttggagtccttctagaatgttcctgagagcctggtctggtccccatgcagcagggtgcagggcccttccaagactctagacagtgaagaatttaatgacggtggatggaaaagctcagtgccacctcctgctggaaacacggagtgatgcaaacctttcaggagccagattcttgttagggagatgagaataatttgagcacatatgaagtctgtccaactccttggccccagagaaacttcaaagacttttatttagggtgggctaaaagtgggctagaggagagaaccgctgttgaaatgctccttaaggagcaatgtttaaggtgctctttaaaaaaaaaattctagaaactcttttaaaaaagagagcttaaaagttaaagaattatacaaattagtcctgaatttaggatcgagaaggtttcttcttctgaagatgctataagggatctgggatctgtgttctggaggtaaccaggcctccagaaaagaagggtatacccctgggctcacaaaatcttaaatccggctttgagaaggtcaagggtgaaggatcagaaggtgttccagaactgtgagctcagcctaagtccctataaaacacgggctggaagcaaagatgggacatttggctgacatcaggtatacttgatgctttttcaagaacggagaaagtttcctcagatagcatttaatctaattgtattcccttccaagaccaacttctattcttctcagggagtttctgtgcctttcccccaacttggcctgtacaagctagagaagggggctgtgaattaaagggccacatcgcc

SEQ ID NO: 3777 - DNA, 1531 bp, Rattus norvegicus
  Genbank Accession No. NM_031237
ctctgggcgaagcgcggatataagtagctggtggctctgccaccccaccctgcccggatcgcgacggttttcagggttctggaatcagcagggttcctctgaggccttggcgagtggctgatctgctccgtttttgcaaaaggcgcctgtgtctggcagagccggtgtgagaagaagagagaatccttccccgccgccgggataatcaagagttttggccggacctttgagtacacatcgggatagtgagaagcccggcgaaaagcacagactatggcgctgaaacggattaataaggaacttagtgatttggcccgtgaccctccagcacaatgttctgcaggtccagttggagatgacatgtttcattggcaagccacaattatgggacctaatgacagcccatatcaaggtggtgtattctttttgacaattcattttcctacagactaccccttcaaaccacctaaggttgcatttacaacaagaatttatcatccaaatattaacagtaatggcagcatttgtcttgatattctaagatcacagtggtctcctgctttaactatttctaaagttcttttatccatttgttcactgctatgtgatccaaacccagatgaccccctagtgccagagattgcacggatctataaaacagacagagacaagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttccctccctccattcattcacatgctcatctgagaagacctaagttcttccagctttggacaataactgcttttagaaactgtaaagtagttacaagagaacagttgcccaagattcagaaatttttttaaaactggagcatgtgtattatgtggccaatgtcttcactctaacttggttatgagactaaaccaatcctcactgctctaacatgctgaagaagccatctgagggggagggggatggatgctgagctgtcacatcaaaggaaacagcattattccagcagcatccattcttgtctaaaccttccactgttagagatttgaggttacatgatatactttatgctcataactgatgtggctggagaattggtattgaattatagcatcagcagaacagaaaatgtgatgtattttatgcatgtcaataaaggaatgacctgttcttgttctacagagaatggaaattggaagtcaaacaccctttgtattccaaaatagggtctcaaaacattttgtaattttcatttaaattgttaggcttggagctattagttaatctatcttccaatactgtttaatatagcactgaataaatgatgcgagttgtcaatggatgagtgatcaactaatagctctcctagtaattgatttatttttcttcaataaagttgcataaacc

SEQ ID NO: 3778 - DNA, 3732 bp, Rattus norvegicus
  Genbank Accession No. NM_031242
tgacatgctggagctgcggcaccgcgggggctgccccggccccgggggagcggggacgccgccaccccgcgagggagaggcggccggcggcgaccacgaaaccgagagcaccagcgacaaagaaacagatattgatgacaggtatggagatctcgatgccagaggagattccgatgttcctgaggtcccaccatcctcagacaggacccccgagattctcaagaaagccctgtctggactgtcatcaagatggaagaactggtggattcgtgggatcctcaccctgaccatgatctccctcttcttcctgatcatctatatggggtccttcatgctgatgcttctggttctgggcatccaggtgaagtgcttccaggagatcataaccatcgggtacagggtctaccactcctacgacctcccgtggtttagaacactaagttggtacttcctcctatgtgtgaactacttcttctatggagagacagtggcagattacttcgccacgttcgttcagaaggaggagcagctgcagttcctcattcgctaccacaggttcatatccttcgccctctacctggcaggtttctgcatgttcgtcctgagcttggtgaagaaacactaccgactacagttctatatgttcgcatggactcacgtcactttactgataaccgtcactcagtcacatcttgtcatccaaaatctgtttgaaggcatgatatggttccttgtccccatatcaagcgtcatctgcaatgatatcacggcttacctttttggatttttttttggaagaactcctttaattaagctgtctcctaagaagacctgggaaggattcattggtggtttcttctccacagtcatatttggattcattgctgcctatgtgttgtccaagtatcagtactttgtgtgcccggtggagtaccgaagcgacgtcaactccttcgtgacagaatgtgagccctcagaagtgttccagcttcagaattactccctccctccgttcctacaggcagtgctgagccgggagaccgtgagcttgtaccccttccagatacacagcattgccctttcaacatttgcatcactgatcggcccattcggaggcttcttcgccagtggattcaaaagagctttcaaaatcaaggactttgcaaacactattcctgggcatggagggataatggacaggttcgattgtcagtatttgatggcgacgttcgtgcacgtgtacatcaccagcttcatcaggggtccgaatcccagcaaagtgctccagcagctcctagtgcttcagccagagcagcagttaaacatctacagaaccctgaagatacatctcacggagaaaggcatcctgcagcccacctggaaggtgtagctgtcctgaggggacagactgctgaggaggaaggagctcacagagcagctccgactgaagtcttgcactgagccagcctggggctagaaactcagtagatgcaggttttgcagatacgaatgtttctctttctctgaaattactgtgaatatttaacaaacacgagatctgagacgagtgcgcatcagtcgccgccgtgaaagatccgtgcttttctaagatgtattttccaatgttaagttctccgcccttactggccgggctccatgatgtaggaggtttaaagagtcaagcactgtcacctgaggctgaggcccccttaggctcgtgcctggcagtgtgatccttctcacaaacactgacctttgcactgactgggagctgcctctctgtggctggggatgctcagcaggcaccctgggaagcgaggcctagggcttcctcctctactgacctcaggcatttctgcaggctgagttagattaaaaaagaaagaaaaagagcgcttgtccacttctctctcttctttttgtttgtttgtacacaccaggcaggcgccccactcctaggctctgttccggctggaccgactgcctactttcagagaaacagccatctgcccagtggaaacaccctggttttaagtagtttcaaaccaaaaggtagaggctgaaacttaccccactattgatttgtttaaaaagaaggcatcagaatccatctctgatgaaacttttggagaagcacgtaaccaacttcccaagagactcaggagtgggtcctgctcctccaccaaaacacctcacccaggacggtggtgctgtgagcaggggtggaggctgagtcggcaggctgcctggggtgagctgagcactgcatggcggtgccaggcctgcctccatctctgtgtacagcacacctggagacgagggttttccctgaagacccagctcagagccagccccctgatggcaattaacctctgtcaccttgcacttcctgtcatgccatgaaaaccaagagtaaagatcaagcagaaataatagccatgaagcagaaaagcacaggaaagccacgccctcttctgtaggtgggcagggcactgtaaacactctagcccatcacagcaccgttgttaactaagctgcctccaagtgtgctctgcagccatattgaaccaaatgtcagggtcacccgcagagatgacctagttccccaagctcagcaccgagaggtggagaaatggagacaccataaaggataatttggtcatgaaagagtaaatatttttgtttaaattagaaatggattccagtcaccacatttccttcccagtgtggatgaacccacagccatcctgggctctgtaagcacatggcgtatgtgtgagcatggcagacgctgtggtcctcagtcccaaaatgccactgttggcccctaggtgacttgtgaccctgggctccattcaggctgtgtcctctgcacgcaggcagccgagggagcattggccacattacagtgactccctctcagtcaggacaccggggagctgatgtcagcttccctgcttttgtttgtccctcgccctgccccagaagttgaccatgacccagttgcaggcaccgaggaagctgagagaagccttgtgataggatcattccccgagaacagggcagtttgcaaaggtgtaaaggatgcctggggacagggtggattctccttacccaccgtgctgtccaggcgtcgtgaggggttgcgaggcagaattatgagagcattacttaatacacgtattaaaagtcaatattcttctaaacaaaggatgaaagcaggttacggcaaaagcttttcttaaatagattttcttagagctgggtgtccattacgccatattaaaacaagggcgttccctgacaacgccctagagatgaacattttagcgtactttcacagcgtgtatattaaagtggactatacttcagcaagcaatcatcctaagagccatgtgatgagcgctacatttgcactggaagaagcttcatccagcggagtgacgcagtggacaaatgtcaggccctccaggcggggacccttcagtggaaaactgccgcttgaactgctgctgacttgttagcccgtgggatgatgatgtccgagaatggggcgttctccccagccttccttgtgggtttgcacagacagttgctgtcatggcgacacctggtttgatgaaaggtcgaggcgctgtgtatatactgtacagggtgagagtttatgatacgtgtcaatcagttctctaaatctttatactgaaactgggatagaaaaataaaaatccaaca

SEQ ID NO: 3779 - DNA, 1591 bp, Rattus norvegicus
  Genbank Accession No. NM_031315
cggctcgaaatggaggcgactctgagcctggggcccgccggccgcagctgctgggatgagccgctgagcatcaccgtgcgcggcctggtccccgagcagcccgtcacgctgcgcgcggccctgcgcgacgagaagggcgcgctcttccgagcccgcgcgctctaccgcgccgatgcccacggagagctggacctggcgcgcgcgcccgctctggggggcagcttcacggggctcgagcccatggggctgctctgggccatggagcccgaacggcctttctggcgcttggtcaagcgcgacgtgcagacgcccttcgtggtggagctggaggtgctggacggacacaaacccgacggcgggcggctgctggcgcgggcggtgcacgagcgtcacttcatggctcccggggtgcggcgggtgcccgtgcgcgagggcagggtgcgcgccacgctcttcctgcccccagaacctgggccctttcctggaatcataaacctttttggagttggaggcggccttctggagtaccgggcgagtctgctggctgggaagggttttgccgtcatggctctggcttattacaactacgacgacctccccaagaccatggaaaccatgcgcattgagtactttgaagaagccgtgaactacctgcgtggccaccctgaggtaaaaggaccaggaattgggctgcttgggatttccaaagggggtgaacttggccttgctatggcctccttcctgaagggcatcacggctgctgttgtcatcaatggctccgtggctgctgttgggaacaccatatgctacaaggatgagactataccccctgtgactatcctgagaaaccaggtcaaaatgaccaaggatggcctcaaggatgttgtagatgctttgcaaagccctctggtagaacagaagagcttcatccctgtggaaaggtctgacacgaccttcctgttcctcgttggtcaggatgaccacaactggaagagcgagttctatgccaatgagatctccaaacgcttgcaggcccacgggaaagagaagccccagatcatttgctacccagaagcagggcactatatcgagcctccttacttcccactgtgcagcgctggcatgcacctcctggtgggtgctaacatcacctttggaggggagcctaagcctcactctgtggcccagttggatgcatggcagcaactccagactttcttccacaaacagttgggtggtaagagtcatggggtgtcccctaaaatataacctgttatgtgatggttttggcaggaaaagtacaaatactttgtaggaatatcagttcagattacttcatctgaacatataaccgcttttggtttacatttttaaaaattaattttagtatcaaaatagtgctgattcaaaggctggaaatatagttcagttgtagagtccttgactgactcatgcaagttcctgggttcaatctccgtgctgtaagggaaaagagcacattttatggaaactgtagctattcaagaaatagtgcctagaatttaaaggaaccatgagtaaacactcttatgtaacttaaaaaaaaaaaaaa

SEQ ID NO: 3780 - DNA, 698 bp, Rattus norvegicus
  Genbank Accession No. NM_031318
gcgctagagggaagatggaagacttccaggcctccgaggagactgcatttgttgtggatgaagtgagcaacattgtaaaggaggctatagaaagtgccatcggcggtaacgcctaccagcacagcaaagtcaaccagtggaccactaatgttgtagaacagactttgagccaactcaccaaactggggaaaccatttaaatacattgtgacctgtgtgatcatgcagaagaatggtgctgggttacacaccgcaagttcctgcttctgggacagctccacggacgggagctgcacagtccgatgggagaacaagaccatgtactgcatcgtcagtgccttcggactgtccatctgaccgcctgactgcctcagcctccggttccagcgtttctagtccatcttaccaccagctatgttgggcggataccttcctcctctttaagttgttctgaggcactcccaaaatgtagagaaataaaccaaatgaccctggccacaggaaccacacgacggacactaggcagatgagcagccacctgtcatccaaggcaggcagtaccagttgtcttaactgtcttctcaaaggtgctaagatctcaagtctgctagtggaaacttctctactttctgaaatgattcagatacactaattttccacactttatacttttgttagaataataaattattcagaatt

SEQ ID NO: 3781 - DNA, 2743 bp, Rattus norvegicus
  Genbank Accession No. NM_031324
cgcgcctgtaacgttcgcccgtgcacgcccggcccgccagctgtccgcctgctcgcacgccgccgtccgccgcagtccgcgcccagccttgcccgctctccccctccttcggcccacgcccggctccggccatgctgtccttccagtaccctgacgtgtaccgcgacgagacctcagtacaggattatcatggacataaaatttgcgacccttatgcttggcttgaagacccagacagtgaacagacaaaggctttcgtggaggcacagaacaagatcacagtgccgtttcttgagcagtgtccaatcagaggtctatacaaggagaggatgactgagctgtatgactaccccaagtacagctgccacttcaagaaaggaaagcggtatttttatttttacaatacaggtttgcagaaccagcgagtattatatgtacaggactccttagagggggaagccagagtgttcctggatcccaacactctgtcggatgacggcacggtggcactccgaggttatgccttcagcgaagatggtgaatacttcgcctatggtctgagcgccagcggctcagactgggtgaccatcaagttcatgaaggtcgacggtgccaaagagcttcccgacgtgctggagagagtcaagttcacctgtatggcctggacgcacgatggcaaaggaatgttctacaactcatacccacagcaggacggcaagagcgacggcacagagacgtccaccaatctccaccagaagctctgttatcacgtcttggggacggatcagtcagaagacgttctgtgtgccgagttccccgatgagcctaaatggatgggaggagccgagttatccgatgacggtcgctatgtcttgttatcgatctgggagggatgtgatccagtgaatcggctgtggtactgtgacctccagcagggatccaatggtatcaacgggatcctgaagtgggtaaaactgatagacaactttgaaggggagtacgattacataaccaacgagggtacggtgttcaccttcaagaccaaccgcaactcccccaattaccggctgatcaacatcgacttcacggaccccgacgagtccaagtggaaagttctcgttccggagcacgagaaagatgtcttagagtgggtggcttgcgtcaggtccaacttcctggtcttgtgctacctccgcaacgtgaagaacattctgcagcttcacgacctgacaactggtgctctcctcaagaccttcccgctggacgtgggcagcgtggtggggtacagtgggcgcaagaaggactctgagatcttctaccagttcacatccttcttatctccaggtgtcatttaccactgtgatcttaccagagaggaactggaaccccgggttttccgagaggtgacggtgaagggaatcgatgcgtctgattaccagactatccaggttttctaccctagcaaggatggcacaaagattcccatgtttattgtgcataaaaagggcataaagttggatggctcgcatcccgctttcctgtatggctatggtggcttcaacatctccatcacacccaactacagtgtgtccaggctcatttttgtgagacatatgggcggcgtcctcgcggtagctaacatcagaggcggtggtgaatacggagaaacatggcataaaggtgggatcttggccaacaagcagaactgctttgatgacttccagtgtgctgctgagtacctcatcaaggaaggctacacaacttccaagaggctcacgatcaatggaggctccaatggcggcctcttagtggctgcttgcgcaaatcagcgcccggacctcttcggctgtgtgatcgcccaggttggagtgatggacatgttgaagttccacaaatttactattggccatgcctggaccactgattacgggtgctccgacagcaaacaacacttcgaatggcttctcaagtactcgccgctgcacaacgtgaagcttccggaggcggatgacatccagtacccgtccatgctcctcctcacggctgaccacgacgaccgcgtggtcccgctgcactcgctcaagttcatcgccacgcttcagtacatcgtgggccgcagccggaagcagagcaaccccctgctcatccacgtggacaccaaggccggccacgggccgggaaaacccaccgccaaggtgatagaagaagtctcggatatgtttgcgttcatagcgcggtgcctgaacatcgagtggatccagtaagtggggattcccggcccctcccaccagacacagaaaacctcaagggctttttcacaccatcctgaccaagaaaccaccggcgaacgctgcctggagtgagcaccgtgccgctgctcacagacagcaagccgccgagcaggactgccaccgggattttagcttttctatctcctttctagcaagcccttgatgttttggttttgttttgttttgttttccccactctctccaggcacatatattgaaagggggggaaagggagggtatgtttatataagaaactaaatggcagtgaacgtattgtgaatatcagagccctgaactcgtaaagggatctaagttaagggtcatagttgggcatactcatctataatagcataatgaagtcacgtctctaaccatagcatataaccttaaataagtgggagacctcaaggcagagtccgctgcattactaataaatgctactgaagagtggg

SEQ ID NO: 3782 - DNA, 2318 bp, Rattus norvegicus
  Genbank Accession No. NM_031325
ggagcggcgggcggagaggtgtgtggagcttgtggcttgggaggaaggcgctgtccgagagaacgtgatctgcgcggccgctgtgtcctggccttggaagtggttcagtcatggttgagatcaagaagatctgttgcattggtgcgggctacgtcggcggacccacatgcagtgtcattgctcgcatgtgccctgaaatcagggtaacggttgtggatgtcaatgaggccaggatcaatgcatggaattctccaacgcttcctatttatgagcctggactaaaagaagtagtcgaatcctgtcgagggaaaaacctctttttttctaccaatattgatgatgccatcagagaagccgatctagtgtttatttctgtgaacacaccaacaaaaacatatggaatgggaaaaggccgggcggcagatctgaagtatatcgaagcttgtgctcgccgcattgtgcagaactcaaatgggtacaaaattgtgactgagaaaagcacagtccctgtgcgggcagcggaaagcatccgccgcatatttgatgccaacacaaagcccaacttgaatctacaggttctgtccaatcctgagttcttggcagagggaacagccatcaaggacctaaagaacccagacagagtcctgattggaggggatgagaccccagagggccagagagctgttcaggcactctgtgctgtgtacgagcactgggttcccaaggaaaagatcctcaccaccaacacttggtcctcagagctttccaaactggcagccaatgcttttcttgcccagaggatcagcagcattaactccataagtgctctgtgtgaaagcacaggcgccgatgtggaagaggtggcaacggctatcgggatggaccaaagaattggaaataagtttctaaaagccagcgttggttttggtgggggctgcttccaaaaagatgttctgaatttggtttatctctgtgaggctctgaatctgcccgaagtagctcgttactggcagcaggtcatagacatgaatgactaccagaggaggaggtttgcatcacggatcatagacagcctgtttaatacagtgactgataagaagatagctatcttggggtttgcgttcaaaaaggatactggtgataccagggagtcctccagtatctacattagcaaatacctgatggacgagggtgcgcacctccacatctacgaccccaaagtacccagggagcagatagtggtggatctttctcatccaggcgtctcagcggatgaccaagtgtccagactggtgaccatttccaaggatccatatgaagcatgtgatggcgcccatgccctcgttatctgcacagagtgggacatgtttaaggaactggattatgaacggattcataaaagaatgctgaagccagccttcatatttgatggccggcgtgtcctggatgggctccacaatgagctacagaccattggcttccagattgaaacaattggcaaaaaggtatcttccaagagaattccatacactcctggtgaaattccaaagtttagtcttcaggatccacctaacaagaagcccaaagtctagacgtcgcccttttgcctgtgatgatttggtactgcagggtagccagcgtctgtctgatactaagtggtaaatgaactacgtgtttttatggaaacaaaaatatttttgtaatcatcaaatttatactagctatctgggtgttagcatatctagtaattatgagtctagaataatttttatatatttttatattattgtactctcagttactgaatggatggaaaacaatcatgttggtttaaatgtcagtttttataaataaaaatgaaaccttgaattttttagcattacaggttgttacagactgcactgtaataacacaagggaaaggcagtctcatttccctacctgttgtctctgcttatcactaaatgggacttcgaagccgtgaaatcactgtgctaggatggctgatgaaggtctctggacttttgttttaatgagattatgtcattagtggttttagttgtctttgtgtctcccaaaaccactctgtctttctctccatgcgtaactcgggcagtgctttcttttttgaaaattcagcctgaggaggaaatcagtctatggtctagttcgtcctgcctcttagcttctgtacctgcttgtcacatttgcacctatgagtcaagatatgtttgttacctttattttgatttatttctattacaattcaatttttttcctttaattaagaaaaccaataaagtctcatgtgtaaactgg

SEQ ID NO: 3783 - DNA, 3061 bp, Rattus norvegicus
  Genbank Accession No. NM_031330
tgtgaccgcggccaagcccgctcgccttctgcggcgagtagggcctcgcggcgtcatcggcggcgaggagccgctgcggcctggccgaccatgtcggacgcggctgaggagcagcccatggagacgacgggcgccaccgagaacggacacgaggccgcccccgaaggcgaggccccggtcgagcctagccctggcagcggccccgcgactccggcggggtctgtgggcgggaccacggccgccccgagcgggaaccagaacggcgccgaaggcgaccagatcaacgccagcaagaacgaggaggacgcgggaaaaatgttcgttggtggtctgagctgggataccagcaaaaaagatctaaaggattattttactaagtttggagaggtcgttgactgtacaataaaaatggatccgaacactggtcgatcaagagggtttgggtttattctcttcaaagattcttctagtgtggagaaggtcttagatcagaaggagcacagactggatggtcgtgtcattgaccctaaaaaggctatggctatgaagaaggaccctgtgaagaaaatctttgtgggaggtctaaaccctgaagccacagaggaaaagatcagagaatactttggccagtttggggagattgaggccattgaacttccaatagatcccaagttgaacaaaagacggggttttgtttttattacatttaaagaggaagaccctgtgaagaaagttctggagaaaaaattccatactgtcagtggtagcaagtgtgaaatcaaggttgcccagcccaaagaggtgtaccagcaacagcagtatggctctgggggccgaggaaatcgcaatcgagggaaccgaggcagtggtggaggtcagagtcagagttggaatcagggctacggcaactactggaaccagggctacggctaccagcagggctacgggccgggctatggcggctacgactactcgccctatggctattacggctacggccccggctacgactacagtcagggtagtacaaattacgggaagagccagcgacgtggtggtcatcagaataactacaagccatactgagaggcagcaggagcggccgagtgacgacgcacacgctttgtttggacgcggagtgaacacaattatgtaccaaatttaacttggcaaacttttatggcctgtcccatgtgcatcttatttaaaatttcccccggaaatcactctcctgtttactattccagagctctagttgttgtaggcagcgtgtggcgtctcagaggtcagagcggcattagggggctgattttattaccaggttaccctgttctagattggagggtctgcttcctgctgccgctctgcagcctggacctgtggaccctggttgtaaagagtaaactgtatcttaggaaaccagtgtcacctttttcaccttttaattttatattatttgtgtcatacatttccagtaatggaagtgttaattttactgtactttttggtaccttttgggaatctaatgtattgtaaggtattttacacgtgtcctgattttgccacgacctggatattgaagctatccaagcttttgaaataaaaatccctgagagtctggtccactaactccagggactgtgggacagaggaacaaacaagaaagaactcgaggcctcgctgagtggcacgcttgctgagtgctgccacatcccgcaagctgagcaggtatcccaactctgttcctgcccggtagaccacccgaggtgtgagtgtggtcttgtcttccagattcgtaggacagaagctccaggaggaggacccgcccaacatggcatcggagagcgggaagctatggggtggccgatttgcaggctcggtcgaccccaccatggacaagttcaactcatctatcgcctatgaccggcatctgtggaatgtggacctgcagggaagcaaggcctacagcaggggcctggagaaggcagggcttcttcaccaaagctgagatgcagcagatactgcaaggcctggacaaggtggctgaagagtgggcccaaggcatcttcaaattgtaccctaatgatgaagacatccaccttcctcaaggtgctcattgaagccatggtagaccgggcagaggcggagtgtgaagtcctcttccctgggtacacacacttgcagagagctcagcccatccgctggagccactggatcctgagtcacgccgttgcgctgacacgagatttagagagactgaaggaggtgcagaagcggatcaatgtcctgccactgggcagtggggccattgcaggcaaccctctaggtgtggaccgggagttcctctgtgcagaactgaactttggagccattacgctcaacagtatggatgccaccagcgagagagacttcgtggctgagttcctgttttgggcttctctgtgcatgacccatctcagcaggatggcagaagacctgattctctacggtaccaaggaattcaactttgtgcagctctccgatgcctacagcaccggaagcagcttgatgccccagaagaaaaacccagacagcttggagctgatccggagcaaggcgggccgagtgtttgaagtgtctgataccatgacagctgtcctccaagtagccactggagtcatctctacactgcagattcatcgtgagaacatggcacaggcactcagccctgacatgctggctaccgaccttgcctactacctggtccgcaaagggatgccattccgccagcccacgaggcctcagggaaagctgtggtcgtggcagagatgaaaggggtggctctcaaccagctgtcacttcaggagatgcagaccgtcagtcccctgttctcgagtgacgtgaatctcgtgtgggactacagccacagcgtggagcagtacacagccttgggtggcacagcacagtccagtgttgagtggcagatcagccaggtgcgggccctgctgcagatgtagcagccctagattccacccagtcaaagctgcgccccaataaagtggagccctggagaggccgccat

SEQ ID NO: 3784 - DNA, 1334 bp, Rattus norvegicus
  Genbank Accession No. NM_031331
gagcgccaggccaatcggaggtgctgttgtttgtcagtcccggagccggtccgcaaaggaaaggtggcaagatggtgttggagagcactatggtttgtgtggacaacagtgagtacatgcggaatggagacttccttcccacccggctgcaggcccagcaggatgctgtcaacattgtatgtcactcaaagacccgaagcaaccctgagaataacgtgggcttgatcacgctggccaatgactgtgaggtgctgaccacactcacccctgacactggccgaatcctctccaagctccacactgtccagcccaaaggcaagatcaccttctgcactggcatccgcgtggcccatctggctctgaagcaccggcagggcaagaatcacaagatgcgcatcatcgccttcgtgggtagccctgtggaggacaacgagaaggatctggtgaaactagctaaacgccttaagaaagaaaaagtgaatgttgacatcatcaattttggggaagaggaggtgaacacagagaagctgacagcctttgtgaacacattaaacggcaaggacggaactggatcacatctagtgacagtgcctcctgggcccagcctggccgatgctctcatcagttctcctattctagctggggaaggcggcgccatgctgggtcttggtgccagtgactttgagtttggagtagatcccagtgctgatcctgaattggccctggcccttcgtgtctctatggaagagcagcggcagcggcaggaggaggaggcacgacgggctgctgcagcctctgcagctgaggctggaattgccacacctgggactgaaggtgaacgagactcagatgatgccctactgaagatgaccatcagccagcaggagtttggccgtgcggggcttcctgacctaagcagcatgacagaggaagagcagattgcctatgccatgcagatgtccctgcagggagcagagtttggccaagcagaatcaggggacatcgatgccagctcagccatggacacatctgagccagtcaaggaggaggatgactatgacgtgatgcaggacccagagttccttcagagcgtcctagagaaccttcccggtgtggatcccaacaatgaagccattcgaaatgcaatgggctctctggcctcccaggccaccaaggatggcaagaaggacaagaaagaggaagagaagaagtgaggccggagggaggggtagccgagtctgccctggggactgtaaggatggggttggataaagacttagatgtgctctgcggccttgacaacggaataaagcttggagttttccctttgcttc

SEQ ID NO: 3785 - DNA, 4350 bp, Rattus norvegicus
  Genbank Accession No. NM_031333
cacacacacacacacacacacacacccgcacgcacacacacacgcacgcacacacacttctcggcgcgcacgcacgcccgcccttctccccgccccctccccagctccttgatctcccgtctcttttattactcctggtgcgagtccggcggactccgaggcccgctatttgttaccagctcgctctcattggcggggagcgcagagcagcggagaagggggtggggaggggaggggaagggaaggggtggccactgcccggagccgtctccgcgctgctgttggtgccgctgccgccgccgcctccggctcctcgctcggcccctctccgcctccatgtgccggatagcgggagcgccgcggaccctgctgccgcttctggcggccttgcttcaggcatctctggaggcttctggtgaacttgcattatgcaagactggatttcctgaagatgtttacagcgcggtcttaccgaaggacgtgcacgaaggccagcctcttctcaatgtgaaattcagcaactgcaatagaaaaaggaaagttcagtatgaaagcagtgaaccagcagatttcaaggtggatgaggacggcacagtgtacgctgtgagaagcttccctctctctgcagagcaggcaaagttcctgatatatgcccaagacaaagaaacccaggaaaagtggcaggtagctgttaacctgagcctggagcccagcctgactgaggagccgatgaaggaaccacatgaaattgaagaaatagtattccctagacaactcgccaagcacagcggacgtctacaaaggcagaagagagactgggtcatccctccgatcaacttgccagaaaactccagaggaccctttccgcaagagcttgtcagaatcaggtctgatagagataagaacctatctctgagatacagtgtcactgggccaggagctgaccagcctccaacgggcatcttcatcatcaaccccatctctggacaactgtcagtcacaaagcctctggacagagaactgatagcccggtttcacctgagggcacatgcagttgacatcaatggcaatcaagtggagaaccccattgacatcgtcatcaatgtcatcgacatgaatgataacagacctgagtttctgcaccaggtttggaatgggtctgttccagagggatcaaagcctgggacgtatgtgatgactgtcactgccattgatgcagatgacccaaatgccctgaatgggatgctgaggtacaggatcctctcccaggcacccagcaccccttctcccaacatgtttacaatcaacaacgagaccggggacatcatcactgtggcagctggtctggaccgagagaaagtgcaacagtatacgttaataattcaagccactgacatggaaggcaatcccacttacggcctttcaaacacagccacagccgtcatcacagtgacagatgtcaatgacaatcctccagagtttactgccatgaccttctacggagaagtccctgagaacagagtggatgtcattgtagccaacctgactgtcaccgacaaggaccagccccacacaccagcctggaatgcggcatacagaatcagtggtggagaccccacgggaaggtttgccatcctgacagaccccaacagcaatgatgggctagtcacagtggtaaaaccaattgactttgaaacgaataggatgtttgtcctcactgttgctgcagaaaaccaagtgccattagctaaggggatccagcacccacctcagtcgacagccacggtgtctgtgacagttattgatgtcaatgaaaatccttattttgccccaaatcctaaaatcattcgccaagaggaaggcctccacgcaggtaccatgctgaccactctcactgctcaggaccccgatcgatatatgcaacagaatatcagatacacaaagttatctgaccctgccaactggctgaaaatagaccctgtgaacgggcagatcaccactatcgctgttctggacagagagtcgccaaatgtcaaaaacaacatctataatgctaccttccttgcttctgacaatggaatccctcctatgagtggaacaggaacgctgcaaatctatttacttgatatcaatgacaacgcccctcaggtgttacctcaagaggccgagacttgtgaaactccagaacccaattcaattaacatcacagcgcttgattatgacatagaccccaatgcagggccctttgcatttgaccttcccttatccccagtgaccattaaaagaaactggaccatcacccggcttaagggtgattttgctcagctcaatttaaagatcaagtttttggaagctggcatctatgaagttcccatcgttatcacagattcagggaatccccccaagtccaatatttcgatcctgcgtgtgaaagtttgccaatgtgactccaatggagactgcaccgacgtagacaggatcgtgggtgcagggcttggcacgggcgccatcatcgcgatacttctgtgtatcatcatcctgctgatccttgtcctcatgttcgtggtatggatgaaacgccgggataaagagcgccaggccaagcagcttttaatagacccagaagatgatgtaagagataacatattgaaatatgatgaagaaggtggaggagaggaagaccaggactatgacttgagccagctccagcaaccagataccgtggagcctgatgccatcaaacctgtgggaatcagacggctagacgagaggcctatccacgctgagccacaatatccagtccgatccgcagccccacaccctggggatattggggacttcattaatgagggccttaaagctgctgacaatgaccccacggcgccaccatatgactcccttttagtcttcgactatgagggcagcggctccacggctggctccttgagctctctcaactcctccagcagcggcggggaccaggactatgactacctgaatgactggggaccccgcttcaagaagctggccgacatgtatggtggtggtgatgactgaacggcaggacggacttggcttttggacacgtatgaacagtttcacctgatattcccaaaaagcatacagaagctaggctttaactctgtagtccactagcaccgtgcttgctggaggctttggcgtaggctgcgaaccagtttgggctcccagggaatatcagtgatccgatactgtctggaaaacaccgagctcagctacacttgaattttacagtacagaagcactgggattttatgtgcctttttgtacctttttcagattggaattagttttctgtttaaggctttaatggtactgatttctgaaactataaggaaaagacaaaatattttgtggcgggagcagaaagttaaatgtgatacgcttcaacccacttttgttacaatgcatttgcttttgttaagatacagaatgaaacaacaagattaaaaaaaattaactcatggagtgattttgttaccttggggtgggggggtgggggatgagaccacgagataggaaaatgtacattacttctagttttagactttagattttgtttttcactaaaatcttaaaacttacgcagctggttgcagataaagggagttttcatatcaccaatttgtagcaaaattgaattttttcataaactagaatgttagacacattttggtcttaatccatgtacaccttttttattttctgtattttttccacctcgctgtaaaaatggtgtgtgtacataatgtttcatcagcatagactgtggaggagtgcagagaactcggaacatgtgtatgtattatttggactttggattcaggttttttgcatgttaatatctttcgttatgggtaaagtatttacaaaacaaagtgacatttgattcaaccgttgagctgtagttagaatactcaatttttaattttttaattttttaaattttttttaattttctttttgtttgttttgttttggggagggataaaagttcttagcacaaatgttttacataatttgtaccaaaaaaaattacacacacacacacacacacacacacacacacacacacaaataaaaggaaagaaaagtaaaaggggtggcctggtactggcagcactagcaagtgtgtgtttttaaaaaacaaaacaaacaaacaaaaaaaattaataaagagaaaaaaaagaaaaaaaagcttttaaactggagagacttctgaaacagctttgcctctgtgttgtgtaccagaatacaaacaatacacccctgaccccagcgttctgaataaaaagctaattttggatctgg

SEQ ID NO: 3786 - DNA, 4396 bp, Rattus norvegicus
  Genbank Accession No. NM_031334
ctggtgtgggagccgcggcgcactactgagttctcaagaacttctgctagacttcagcccggcctaacccggctctgcccgaccgcacccgagctcagtgtttgctcggcgtttgcccggccagccatgggagcccggtgccgcagcttctccgcgctcctgctcctgctgcaggtctcctcgtggctttgtcagcagccggagtcggagtctgactcctgccgtcccggcttcagttccgaggtctacaccttcctggtgccggagaggcacctggagagaggccacatcctgggcagagtgaaatttgaaggatgcaccggccgtccaaggacagccttcttttctgaagactcccgattcaaagtgtctacagatggcgtcatcacagtcaaacggcatctaaagcttcacaagctggagaccagttttctcgtccatgcctgggactccagttacaggaagctttctaccaaagtgacactgaagtccctgggccaccaccaccaccggcatcaccacagagaccctgtctctgaatccaacccagagctgctcacgtttcccagctttcaccagggtctgagaagacagaaacgagactgggtcatccctcccatcaactgcccggaaaatcaaaagggcgaattcccccagcgactggttcagatcaaatccaacagggacaaagagacaacggttttctacagcatcaccggcccaggagctgacaaaccccctgttggcgttttcatcattgagagggagacaggctggctgaaagtgacgcagcctctggacagagaagccattgacaagtaccttctctactctcatgctgtgtcatcaaatggggaagccgtggaggatcccatggagatagtggtcacagtcacagatcagaatgacaacaggccagagtttatccaggaggtctttgagggatctgttgcagaaggcgctcttccaggaacctccgtgatgcaggtctcagccactgatgcagacgatgacataaacacctacaatgctgccatcgcctacaccatcctcagccaagatcctgagctgcctcacaaaaacatgttcactgtcaaccgggacactggggtcatcagtgtggtcacctccggactggaccgagagagttaccctacatatactctggtggttcaggctgccgaccttcaaggcgaaggcctaagcacaacagcaaaagctgtgatcactgtcaaggatattaatgacaacgctcccatcttcaacccaagcacgtaccagggtcaagtgcttgagaatgaggtcggtgcccgtattgccacactcaaggtgactgatgatgatgcccccaacactccagcgtggaatgctgtgtacaccgtagtcaatgatcctgatcatcagttcactgtcatcacagaccccaagaccaacgagggcattctgaaaacagccaagggcttggattttgaggccaagcagcagtacattctgcacgtgacagtggaaaatgaggagccctttgaggggtctcttgtcccttccacagccactgtcaccgtggatgtggtagacgtgaatgaagcccccatttttgtgcctgcggagaagagagtcgaggtgcctgaggactttggtgtgggtctggagatcgcatcttacactgcgcgagagccagacacattcatggaacagaagatcacgtatcggatttggagggacactgccaattggctggagattaacccagagactggggtcatttccactcgggctgagatggacagagaagattcggagcatgtgaagaacagcacgtatacagctctcatcattgccacagatgatggttcacccattgccactggcacagggactcttctcctggtcctgtcagacgtcaacgacaatgctcccatcccagaacctcgaaatatgcagttctgccagagaaacccgaagccccatgtcatcaccatcttggatccagaccttcccccaaacacatcccccttcactgcagagctcacccatggggccagcgtcaactggaccattgagtacaatgacgcagaacaagaatctctcattttgcaaccaagaaaggacttagagattggcgaatacaaaatcaatctcaagctctcggataaccagaataaagaccaggtgaccacgttggaggtccacgtgtgtgactgtgaagggaccgtcaacaactgcatgaaggcgatctccctggaagcaggattacaagttcccgccatccttggaatcctgggagggatcctggccctcctgattctgatcctcctgctcctactgtttctacggaggagaacggtggtcaaagagcccttgctgccaccagatgacgatacccgggacaatgtgtattactatgatgaagagggaggtggagaagaagaccaggactttgatttgagccagctgcacaggggccttgatgccagaccggaagtgattcgaaatgatgtggctcccaccctcatgagcatgccccagtatcgtccccgtccagccaatcctgatgaaatcgggaacttcatcgatgaaaacctgaaggcagcggacagtgaccccacagcgcccccttacgactctctgttggtgtttgactatgaggggagtggttctgaagctgcctccctgagctcgctgaactcctctgagtcagatcaggaccaggactacgattatctgaacgaatggggcaaccggttcaagaagctggccgatatgtatggtggcggcgaagaagactagagagtcgttcctgtgtggcaccatgggagatgcagaatcatgatgtcagtggtctttcagctccttccctgactttgtagaagagagactgatctgagaagtatgcagattgcatactggtcccactctacctaccagtctgtctgtgttaggagggttttcactggttgttggaatctttttctaaaatgtttttgtttttacagtgctgtgatgtgatgaactgtaccctctttttgtttttgttttgagctatgttctgctccggacacacagcccccaagcccttcacccctcactaatttttttacattgtatactttcactcaattaccatgtttatgttctgtattctaatagccactaagttcctgaattctgttgcctggcccaggtgctattctgtgacacagtagtgcctgggcccttttatggtaagagacaggtttcttggtgtgggtgcaactgagctggatagtgtatgtttcaaacacctttcctgtgttctctccccacctccagagtgtctttacttattcagctgtgtgtttggggcagaacaaaaaaataatgggaccactatgcaagctgcgaagattctaaggtgcacacctgattcttaggcagatgccatagtgagatatgttgctttggttctctatccaatgctgtgaccgggacctgcagcgaggttttcggacaccgtggtttcttgcgtttctttcaaaccagcagtaaaaaatggttttttctgagagagactggagtgccaccaccaaagatagaggagagaagccaagcttggggacagcaagcatgccagtgaacctgaccactgtcatgagtcatgtgggtggccacatgtccgtgaacctggccagttggcacactgatggtgagggtacaaggaggctagacctcgtcccacaaaatttctggaagaattagggttgtctcagccaatgtttcctagctggaatcctgtccatgtatgtgttcctgaagcccaggaaatacacccctctagtgcctgcttttgatggtagttatagaaaagaccggctgatttggacctgagttgcccaatcttaagtacaaatagaaaactgagactatgctgggtgtgttggtgcacgcctttaatcccggcactcgggaggcagagacagtctcagatctctctgagttcaaggtcagcctggtatagtaagtgaattccaggacagccagggctacacagaaactctgtcttggaaaaccaaaaaagaaaactgagaatattagagattgtgcattttctcagaaagcaggaagaaaacaccactctgatgggaaaagggaggcaaggcccttgagacttttcattgaaattgctgtactcacataattttggaagcaaatgatgactgcaatcaactgtgagaactgttggtttctctgtagtttaattgtctaatgttgatagcgtgccctttgtatgtagtttgagtgtatatgtgtgtgggtgctgataattttgtattttgtggggagtggaaaaggcaagcaatcggaactgttctctaagatgcatttttatgaattttattaaagagttttgttaaactgt

SEQ ID NO: 3787 - DNA, 470 bp, Rattus norvegicus
  Genbank Accession No. NM_031335
tttctctgctctgcgacccggaccggccagtaaggagaaggtatcatgtcagacaacgaagacaatttcgatggcgatgactttgatgacgtggaggaggacgaagggcttgacgacttggaaaatgctgaggaggagggtcaggaaaatgttgagattctcccatctggtgaacgaccgcaggccaaccagaagcgtatcaccactccatacatgaccaagtacgagcgagcccgagtgctgggcacccgggctctccagattgcgatgtgtgccccagtaatggtggagctggagggggagacagaccctttgctcatcgccatgaaggaactcaaggcccggaagatccccatcatcattcgccgttacctgccagatggaagctatgaggattggggcgtggatgagctcatcatcagcgactgagcagagctgtcaggctgtgccaggcaccatctctatgccca

SEQ ID NO: 3788 - DNA, 2364 bp, Rattus norvegicus
  Genbank Accession No. NM_031337
gcggcacctgcctgccgaggtacgtggcgcagcccccagtcagcagagcggacctcggggaacccaggcagcagcgatccgcctttgcccactcataccccaggcccagcagctcctccccagccctgagacgccggacgcgcctgcgaggggacgccggcggagggtcgcgaccccgggccgcctatatgggcgcccccggcgcagcctgtcgaggtgtgaacgcggtgctgtggcaatgccaaatgagttcacctctgcaaagctgagaagtgattgctcaaggacctccctgcaatggtacacccagacccagcacaagatgagaagacccagcttgttattaaaagacatcctcaagtgcatgttggttgtgtttggagtgtggctcctgtacatcctcaagttaaattacactgctgaagaatgtgacatgaaaaaactgaattatgtagaccctgcccgaataaagagagctcatagaaacactcaggaagtctttcagaaggaatgtcgtcctgggcacgcgaagaaaactatggatctgttatttaagggcaagtacagcatggacttggagcctttcgtgcagaagatccccacagccagtgaagctgagctcaagtatgacccgccttttggattccggaagttctccagtaaagtccagagcctcttggatatgctgcctgagcacgactttcctgaacacttgagagccaagcactgcaagcgctgtgtggttattgggaacgggggcatccttcacggactagagctgggccacgcactcaaccagttcgatgtggtaataaggttaaacagcgcaccaattgagggttattctgaacatgttggaaataaaactactataaggatgacttacccagagggtgctccactgtcggacgctgaatactacgctaatgacttgttcgttgctgttttatttaagagtgttgatttcaaatggcttcaagcaatggtgaaaaatgaaagcctgccattttggattcgtctcttcttttggaagcaggtggcagaaaaaatcccactccagccaaagcatttcaggattttgaacccagttatcatcaaagaaactgccttcgacatccttcagtactcagagcctcagtcaagattctggggccatgataagaatatccccacgatcggcatcattgccattgtcttggccacgcatctgtgtgatgaagttagcctggcaggctttggatatgacctcagtcaaccaaggacccctctgcactactttgacagtcagtgcatgggcgccatgaactggcaagtcatgcacaacgtgaccacagagacccagttcctccagaagctcatcaaggagggcgtggtgcaggacctcagcgggggcatccactgagaactttgaacaccgcagacctcacttagcaatgcagctgagagctgtggtgagcagcctccccagggagtttaccctgcagctgctttggcctacagctagtgtttttaaactcagttttaaaagaaaaggaaagaacaacagcaacaacaaaagttcagccctttacacctctttgtcctatttatttgaagtcagtgttgggttttgcacaattttgtaagttaattttaagaatggggatggaaagacttttcaaagagaatcgtatggtttattgtattttaaagaagtaatttaatttgcaaaaactgtacacatgtactctccccaggtgttgaggtgggaggagaggggcttctgcaccttcgatgatggcctcgatacctgactgcgggttctgcagctctgtttggtagcactgctggcagggaaacttcctgcctcctggatgaaggaagggtttactcatcatcactggcagctgcaggaagtcgggggcctgataaacaagttcataacccctttctgctagtccgtctgccagaagactcagaggacccaagcagggcagctgttccacaggcgagccactgtcagctgagtaccgtgatgctgccccaggatgggagaagccatgtcgtcctacactgtcagggcacttttcagcttctggagaagtgtctgttctctctgccctcccaaagcacttggtgttatttaaggcgtgaggctgtctgtctgagatggttcatcagaattgtgacagccatggggagcaagacctctgcagatgaccacattgctaaagcactggagtgaaccccccctgttgtaacttaagacccatcctgaagtgccctgaagtgcccaccaaccaatgtgaaaggagaatgaggaaggggagggaaaagaacagaaagaaagaaagaaaaataataaaagcttttgaggagcccctg

SEQ ID NO: 3789 - DNA, 1536 bp, Rattus norvegicus
  Genbank Accession No. NM_031342
tgtctgtgcgggagaaaggggagaatcgcccgaacggtcgcggaactcctgggagtgaggcccagcctgcaggaagccctgcagtgtatgtgtggtaacaacatgtctgtgcccctgctcaccgacgcagccaccgtgtccggagctgagcgggaaacggccgcggttatttttttacatggacttggagacacagggcacagctgggctgacgccctctccaccatccggcttcctcatgtcaagtacatctgtccccatgcgcccaggattcctgtgacactcaacatgaagatggtaatgccctcctggtttgacctgatggggctgagtccagatgccccagaggatgaagctggcatcaagaaggccgcagagaacatcaaggctttgattgaacacgagatgaagaacgggattcctgccaaccgaatcgtcctgggtggcttttcgcagggtggggccctgtccctctatacagcacttacctgcccccaccctctggccggcatcgtggctttgagctgctggctgcctctgcaccggaacttcccccaagcagccaatggcagtgccaaggacctggccatccttcaatgccacggcgagctggaccccatggtacctgttcggtttggggccctgacagctgagaagctccggacagttgtcacacctgccagggtccagtttaagacatacccaggtgtcatgcacagctcctgtcctcaggagatggcagctgtaaaggaatttctggagaaacttctgcctccggtctaactagctgctggctccgatcgtggtccccagctcacaggggacccagcaagcaaggatctgagccggtcgagcccctgtcccttctcttcctaccctattctcttcccacaggcctctggggcaggtcgccgaggctggcgaggccttcctgctggcctcggtcatctgagaagtcagcagcaggggtgggctgctctcttaccccacttccccagaggcgggccccagcagcagtattggaggggctgaaggcagcgggagaaaggggcccagctgctgacccgctcactcaggacctcacccactagccccgctttgggccccctcctgtgacctcagggtttgcccagtgggccctcaggggccccttcccccgtgattctgcccggataatcgtctctcctgcctcactgcagctgcttctgtcacgaatgtgtccatggccccggggcccttgctgctgtaggctgcctgctgctgggcaggctggtcagtgaggaggtagagtccctcaggggcctcccctcagcccctccccacagaggggctgggccctgcctccccatggccctttcttgcaggcctggagcctgcagggctggattgaggttcaagggcccccaattccctgctgtctcaccccccattatgtccccccttagggccagggaggtggtgggggaggagttgtgtcttgtcttctgtcttcatgtggttttgggtgtttttcttgttttgtcctggattccgata

SEQ ID NO: 3790 - DNA, 2221 bp, Rattus norvegicus
  Genbank Accession No. NM_031343
ggtgtgtccccagtgcctccgaagtccctctctccagccgcacccatgcttctggcacgaatgaagccgcagtgcagcctgagctcggcggggcggaccagctgcccgagcagcccctgaggccctgcaaaaccgctgatctgctagtggtgaaggagcgcaacggtgtccagtgtctcctggcatcccaggatggtgacgcgcacccgggagacttggggcaagaagattgatttcctgctgtctgtggtgggcttcgcagtggacctggccaatgtgtggcgcttcccctatctctgctacaagaatggtggtggtgccttcctgattccatatacactgttcctcatcattgctgggatgcctctgttttacatggagctggctctggggcagttcaaccgggagggggcagccacagtgtggaagatctgccctttcttcaaaggagtgggctatgctgtgatcctcattgccctctatgttggcttttactacaatgtcatcatcgcctggtcactgtactacctcttcgcgtccttcaccttgaacctgccctggaccaactgtggccatgcctggaacagccccaactgtaccgaccccaaactcctcaacgcctcggtgctgggcgaccataccaaatactccaaatacaagttcacaccggctgcagagttttatgagcgtggtgtcctacaccttcacgagagcagtgggatccatgacatcggcctgccccagtggcagctgttgctatgcctgatggtcgttatcgttgtcctgtatgtcagcctctggaaaggagtgaagacatcgggaaaggttgtctggatcacagccaccctgccttactttgtcctctttgtgctcctggttcatggcgtcactctgcctggtgcttccaatggcatcaacgcctacctgcacattgacttctaccgcctcaaggaggccacggtatggatcgatgctgcaacccaaatattcttttccctgggagctggatttggagtcttgattgcatttgccagttacaataaatttgacaacaactgttacagggatgccttgctgaccagcaccatcaactgtgttaccagttttatttctggatttgccattttctccatccttggttacatggcccatgaacataaagtcaagattgaggatgtcgccactgaaggagctggccttgtatttgtcctgtatccagaagccatttctactctgtcgggatccacgttctgggctgtcctgttcttcctgatgctcctggctctggggctagatagctcaatgggaggcatggaggcagtcatcaccggactggctgatgacttccaggtcctgaagcgacaccgaaaactcttcacatgtgctgtcaccctcggtacctttcttctggccatgttttgcataacgaagggagggatttacgtcctcactctgctggacaccttcgcggcaggcacgtccattctctttgccgtgctcatggaggccattggagtttcctggttttatggcgtggacaggttcagcaatgacatccagcagatgatggggtttaagccaggcctgtactggagactgtgttggaagttcgtgagccccgccttcctcctgtttgtggtagtggtcagcatcatcaacttcaagccactcacctatgatgactacgtctatcctccttgggccaactgggtcgggtggggcattgccctctcatccatgatcctggtacctgcctacgtcatctacaaattcttcagcatacggggctccctttgggagagagtggcctacggaatcaccccggagaatgagcaccacctattggctctagaaatagagctttccagccttcagagctttgttattacttcatgtcccatagatcctcttttgtcgagttttcttttcatctcctgccagaaaaccttggtgtttaagaagtcaggtccagcaccattgatttgacacttgggtagcattgagaaggcagagagggttgctctgccctgtgtttgcaggtctggggaccccacagctctgccccacaggcaggatgcctggccctggttggtgaatgtgaagtctggggggtgccttccttgctctactgtctctacatctgtgtaaataggattgtttcactcccatgttctctgtgtcacagactgttcaagtatcatttgcgggctcgagcatgcat

SEQ ID NO: 3791 - DNA, 8739 bp, Rattus norvegicus
  Genbank Accession No. NM_031351
agggtagccggcgtgcggggtgtgtatgtgttcgctgggcgccggctcagccccaggaagatggtggcggcggcggcggcggcggaggcgactgaggcgcggttgagggggtacacgacggcgacagcagcgcccgcgggctggaaggagaggcagcaccgaccctgcgccgcgacaggggcctggaggccgtggccgcgcgccgggctgtgtctcccgcgggtgctgtcgcgggcgctatccccgccgccgctgctgccgctgctgccgctgctcttttcgctattgctgctgccactgccccgggaggccgaggccgctgcggtggcggcggctgtgtcaggctcggccgcagctgaggccaaggaatgtgaccggccgtgtgtcaacggcggccgctgcaaccctggcaccggccagtgcgtctgccccacgggctgggtgggcgagcaatgccagcactgcgggggccgcttcagactaactggatcttctggatttgtaacagatggacctgggaattataaatataaaacgaaatgcacatggctcattgaaggacagccaaataagataatgagacttcgattcaaccattttgctactgaatgtagctgggaccatttatatgtttatgatggggactcaatttacgcacctctgattgctgcctttagtggcctcattgttcctgaaagagatggcaatgagacggcccctgaagtcactgtcacttcaggttatgcactactgcattttttcagtgatgctgcttataatctgactggatttaatatcacttacaattttgacatgtgcccgaataattgctcaggccgaggagaatgtaagagcagtaacagcagcagcactgttgagtgtgaatgttctgaaaactggaaaggggagtcctgtgacattcctcactgtacagacaactgtggctttcctcaccgaggcatctgtaacgcaagtgacaccagagggtgctcctgcttccctcactggcagggtcctggatgttcaattcctgtgccagctaaccagtctttttggactcgagaagaatattctgacttaaagcttcccagagcctctcataaagctgtggtcaatggaaatataatgtgggttgttggcgggtatatgttcaaccattcagattacagcatggttttagcgtatgacctggcttctagggaatggctttcactaaaccattctgtgaacagtgtggttgtaagatatggtcattctttggcattacataaggataaaatctacatgtatggaggaaaaattgattcaacagggaatgtgaccaacgagctgagagtatttcatattcataatgaatcatgggtattgttaacccccaaagctaaggatcagtatgcagtggttggacactcagcacacattgttacactgtcatctggccgtgtggtcatgttggtcatcttcggtcattgtccgctctacggatatataagtgttgtgcaggaatatgacttggaaaagaacacatggagtatattacaaactcaaggtgctctagtgcaagggggttatggccacagcagtgtttatgatcacaggaccaaggctctgtatgttcatggtggctacaaggctttcagcgccaacaagtaccggcttgcagatgacctctacagataccatgtggacactcagatgtggaccattcttaaggacagccgatttttccgttacttgcatacagctgtgatagtgagtggaaccatgctggtgttcggagggaacacacacaatgacacttccatgagccacggtgccaaatgcttctcctcagacttcatggcttatgacattgcttgtgaccgatggtcagttctccccagacctgagctccatcacgatgtcaaccgatttggccactcagcagtcttgcacaacagcaccatgtatgtgttcggcggcttcaacagcctcctcctcagtgacgtcttagtcttcacctcggagcagtgtgatgcacaccgcagcgaagctgcttgtgtggcagcaggacctggcatccggtgtctgtgggacacacagtcgtctcgatgtacctcctgggagttggcaactgaagaacaagcagaaaagttaaaatcagaatgtttctctaaaagaacccttgaccatgacagatgtgaccagcacacagattgttacagctgcacagccaataccaatgactgccactggtgcaatgatcactgtgtccctgtgaaccacagctgcacagaaggccagatctccattgccaagtatgacaattgccccaaggataaccccatgtactactgcaataagaaaaccagctgcaggagctgtgccctagatcagaattgccagtgggaacctcgaaatcaagagtgcatcgccctgcccgaaaacatctgtggcattggctggcatttggtcggaaactcgtgtctgaaaatcactactgctaaggaaaattatgacaatgctaaattgtcctgtagaaaccacaatgcctttttggcttcgcttacgtcccagaagaaggtggagtttgtccttaagcagcttcgattaatgcaatcatctcagagcacgtccaagctcactctgactccatgggttggtcttcggaagatcaatgtatcttactggtgctgggaggatatgtctccattcacaaatagtttgctgcagtggatgccatctgagcccagtgatgccggcttctgtgggatcttgtcagagcctagtactcggggactgaaggctgcaacctgcatcaacccactcaatggaagtgtttgtgaaaggcctgcaaaccacagtgccaagcagtgccggacaccctgtgccctgcggacagcatgtggtgagtgcaccagcagcagctccgaatgcatgtggtgcagcaacatgaagcagtgcgtagactccaatgcctacgtagcctcctttcctttcggccagtgtatggagtggtatacaatgagcagctgcccacctgaaaattgctctggctactgtacctgcagccattgcttggagcagccaggctgtggttggtgtactgatcctagcaatactgggaaaggcaaatgtattgagggaagctataaaggacccgtgaagatgccttcacatgcctctacaggaaatgtgtacccacagccccttctgaactccagcatgtgtctagaggacagcagatacaactggtcttttattcactgtccagcttgccagtgcaatggacacagcaagtgcatcaaccagagcatctgtgagaagtgtgaggacctgaccacaggcaagcactgcgagacctgcatatctggcttctatggtgacccgactaatggaggcaaatgtcagccatgcaagtgcaacgggcacgcatcactgtgcaacaccaacactggcaagtgcttctgtaccaccaagggcgtcaagggagaggagtgccagctatgtgaggtagaaaatcgataccagggaaaccctctcaaaggaacatgttactatacccttctcattgactatcagttcacttttagcctgtcccaggaagacgaccgctattacacagccatcaattttgtggctactcctgatgaacaaaacagggatttggacatgttcatcaatgcctccaaaaacttcaacctcaacatcacctgggccaccagtttcccagctggaacccagactggagaagaggtgcctgttgtttcaaaaaccaacatcaaggaatacaaagatagcttctctaatgagaaatttgattttcgcaaccatccaaacattactttctttgtttatgtcagtaatttcacttggcccatcaaaattcaaattgccttctcccagcacagcaattttatggacctggtgcagttcttcgtgactttcttcagctgtttcctctctctgcttctggtggcggcagtggtctggaagatcaagcagagctgttgggcatccaggaggagagagcaacttcttcgggagatgcaacagatggccagccgcccttttgcttctgtaaatgttgccttggaaacagatgaagaacctcctgatctcattgggggaagtataaagactgttcctaagcccattgccctggagccctgctttggtaacaaagctgctgtcctctctgtgtttgtgaggctccctcgaggactgggaggaatccctcctcctggtcagtcaggtcttgctgtggccagtgccctggtggacatttctcagcagatgccaatagtgtacaaggagaagtcaggagctgtaaggaaccggaagcagcagccccctgcacagcctggaacctgcatttgatactggggcaggaactctccctcacagaggggcatgtggtccactaagctgtctacaggggaggctgcaggcaggaagctggtgtggggcagaagactggaaacccttgaagcatccaactcacgtgcatgatcatacaagctgttttgatggttcatcccttctgtgtccagcatctaaccttttacttctgtgtaggaaataatttaattacaagtccaggagtgatctgctctactcatgggtggaggagaccagtgtagacccagtgagagctaaaagtgatgcagaggtccctgtggaagctcaactgcaaaagtgatgccctccgtcagcagctctccagcatgtcctctcgattgatcctcagatgaattgttctcatctgaagcttgctgtctttttacaagatgtgcttttactctcttccaggaagtaggttttttcagctgagaattaataatgatctttctctttggaagtcatatcaaagtataattgatgggggccttgttttgttttgttttggagacagggtctcactgtgtggtcctagctggcctggaactcaccatgtagatcaggctggactgaactcttaaaagttgacctgcctctgcctcataaattctgggatagaaagcgtgtaccaccaggcccagcaaagagggctattctaaatgtcacggtcaatggagttagaatatagacaaatgcagttgataattccctatagaaacttgatcaatttaattttaatccattctttccttctcttttttctcactctgtcttacacacatacacacgtgcacacacacacacacactaagtgcctagactttaattagatctagcaattggaacgttagtaagcctgagtttttacatgattgcattcctacatccttgtaaactttaagtaaccaccattgcagttggttcctttgttaaagtctaatttgcagccaagaaagaataattctcatcccaagaaacacttaatagggactactagcaataggaactaaatgaccctcccccccagcctagtgtcacttggctccttctgccaaggcaccacagagtgcacttgctcatgtcatgtgcctctctgagcagacgcctgggacacctggctctgtcttcctacagctgctcgcactgacctgtgggaacctgtgggtcatccccaggctggatggagtacacactagaagagggatagtgcctggcattggggcagcatctgctcagcacacggaaaggggcctggttccctctcccctggtaggagttggtccagcctcctcccagacccagctggaggctgagaggaggtggtgaatgctaatgaggatgaaaagacatggggtgaaaggaagggacaagacccacttccaaagaagattaccatgttaagaggggtgagcagtcctctgctctgcccaggaccctgcctggacactgcattcccatttatggtgctcagtattctggcattatgcagcagcctcacacctttcctctcctgcttcataccctgcagttctcctattatctgactagaacagccctctaggcaacagtgatcaatttatgagtttggagaagctaataatcagaaggataaaagctgtagcatttcacctttaatacagtgctgaagagggagcctttctctgagccccgcactaacctcattccacacaagacttctgcaagtgacgtctccacgctgaaccctaagtcactgatgcacaacactgctgtaagactcacctctcaaaacacgactttttcgtcactattaaggagcagaaagttctagaaatgatcccaacctcgtcccctgtgcagctaggatctccccacatccctaacaaagccgagcacataagtgtctgtggtctagcgtttcatctccatagcaacccaagggactcttggccagaagaaagagagagggaagcctcactaggggttggccttatggaaggaaatcccccctctgctttgctttaaggaccaaatttctttggccaaagaagttgtttccgtgttagtcccataccttgaaataatacgtaccatggctcccacctacctgtttatgtccccccaatcacctttagggatactgtttattctttaaaaagaagcagatggcatttgtttctgctcctgtaatggagaaacagccagcttcacctgcatcccctttacagccagcagctcccttcagacgtaaagcagaggggatggcagagaagagctcagctcagagccagtgacccagtgattctgtcacgagagaacttgtatataaagtagtcatgaagacactgaccttgcacttgtacataactatactatagtgtccagaatgttcagacattcagggtgtacataaacagaaaagtatcataatgtatttttattaaacagtaacatcttgagtttcacctaatctgtttctgtgccatagactgggtatccgagctctgggagatcatcttcccagaccccagtccgtcgataaggcattgtacaccatgctggtgtgttcggtagcctcgtgcccattaggtaactaaacaatgattcagctcttagaatacaggaagagagcaagcctggtgacacacagctgtgatccaagcattcagaagacagaggcaggaagaaaaaattcaaagatggggctggagagatgcctcagtggttaaggctgctcttggacaggacactggttcagttcccagcactcacatggtggctcacaaccttctatgactacaaccccaggtaacccaacaccctcttctgtcctcctcgggtgcctgtggcggtgtacatggtgcacagcacgaacaggcaaaacacccaatacacacagaaataaagaattcaagaataccctgggctacatagcaataccctgtctcagaacaaaccaacccatgaagagccaggcagtgtgtctatttccatgaccgtacacaagcgaactcaggaagcaagagtgtccatcactgctgtaacgtcaatgctccttgtgatttcggcatctctgtggggcgaggtgttctatcactctaaagtcaaggactatgtcacctgtgaacgtctagactttgcaaaggggctctctaggctgcattgttgtggctttgtctaaaattttaatgacatttctgagaaccatgttctttttatactaaaaactggggatgggagggctcatttgttgataaatagcactattttcccacacctcagcctcctgtccccgtcctggtcttccctacacagtctggagagggctctgaaaggtccaaatcggtgtggcacaaaagcaacccattgcctcctgagctaacctggaagatgactgtcagcaaaaggaaaataccagaatatcttgaaggctagaagcgtaagatgggatctcattagggaactggatgaacaagagcagagagcctctggtgggtaacgctgcagcctgccagcgcccgccctctctcaacatagcagagtgtgcatggtaaggaagtgaatcacctccttgggggatggtgctgtttttatgaaaacctttgatccttggtgtcctttaattgatctgttcaacaaatatttactaaacacttgtaagctaagctaacattagggcagtgactgaggtgaaaacccagctctttagacagctatcatcctaggagagcttcctagaagcagaaccaagaagccagaggttcttcctaggatgagctttggcttcctaaggaaatctgaaatgttgaccctggtcacaacctcccagcacagctttggaatgagacatcagcatggcctcctctggctgagcagagcctctggagctccacaccctgcctgcagggagccctcagggtgccctccagagtgcagggagaaactggcaccttctttcctaaaggcaataacagaagctgctctcagaacttgactctgcacaaaacactagtgaagcctgctgaactaattctgcctctggaaatcttttctggttatttacagtttgttgttttgttttgatccaagcttagtttgttaatatgtgtaacttggcatctgttgcacttgtgtaaatatggagtaagtattgtaaactatttaattgctgggattggtggtgttatacatacatttaggactgcaatttttggtattttttgtattgtaaaataacagctaatttaatcaggaacaagagaattaatgggggggtctgcattttaaatgcaaatgtgaagcacttgtatataaacagaagtaaatactataatacaaaattccttctgaaataaaagtagatctggtaaaaaaaaaaaa

SEQ ID NO: 3792 - DNA, 1818 bp, Rattus norvegicus
  Genbank Accession No. NM_031353
cccagcctcctcgccgcaacccccgccgtagctgccgctgctcccgccgtcaccgcctccgagaacatggctgtgcctcccacatatgctgatcttggcaagtccgccagggatgtcttcaccaagggctacggctttggcttaataaaacttgatttgaaaacgaagtccgagaatggattggaatttactagctcaggttctgccaacacggagaccaccaaagtgaacggcagtctggaaaccaagtacagatggaccgagtatgggctgacgtttactgagaagtggaacacagacaacaccctgggcactgagatcaccgtggaagaccagcttgctcgtggactgaagctgacctttgattcatctttctcgcctaacactgggaaaaaaaatgctaaaatcaagacagggtacaagagggagcatatcaacctgggctgtgatgtggactttgacatcgctgggccctcaatccggggcgctctggtgcttggctatgagggttggctggctggctaccagatgaattttgagacctcgaagtcccgagtgacccagagcaactttgcagttggctacaagacggacgaattccagcttcatactaatgtgaatgatgggacggagtttggtggctccatttaccagaaggtgaacaagaagttggagactgctgtcaatctcgcctggaccgcaggaaacagtaacactcgctttggaatagcagccaagtatcaggtcgaccctgatgcctgcttttcggccaaagtgaacaactccagtctaattggcttagggtacactcagaccctaaaaccaggtatcaaactgacactgtcagccctgctggatggcaagaacgtcaatgcgggtggccacaagcttggtttaggactggaatttcaagcataaatgaatattgtacaatcgttaattttaaactattttgcagcatagctaccttcagagtttagtgtaccttttaatgtcatatgttggggatgcgagagttgattgataccacgttagacctccaggctaaggatgactcggctttaaggtgtttaccgtttcagaggtacagcggaaaccccattccaggaagggtcctttttagctgtaggcgtgggctgggaggagctcctctagagatgccaggctgcaagtggaagctgggaacgtgtggaccctttgtaaatctgtatccagttccgcacatgaaattgtgacttcctgaacatcgaaccccggtgtcccgatcctgtctgctcggaagcatgtacacacctacgtgaaagggacggttttttttttttttttatcggatggtcacgcccggttcccatcgtgccctgttcccatcctagcccatcagttacctgttttacaccaaaagtagtctttagggtgtagttagcaatttcttttgtgccattttagggtggagagggtgggcatgatgaagccagtcattcaggacttaattcttccttgtgttgtggtgtggttttcttcctttcttctgtttttttttttttaattccttttttttttgccattgcaccagagtatgaaatagcttccaggttgtccggctcagagctgggcgggtgattgtggtcacaccctgacaacactagggatctcaacggactcctcttgtagccgcaccactatttttagcagtttaatgggtacattatagagtcttccattttgtgtggaattagctcctccccttcaaatgctgtaattaacatcacttaaaataaaacttgaataaaatactgaaacctcaaaaaaaaaaaaaaa

SEQ ID NO: 3793 - DNA, 1380 bp, Rattus norvegicus
  Genbank Accession No. NM_031355
aggtcgcgcaggcgcagacggcgttggttcgagaagaccttcagcgttgccttggtggagcggtacgggcccaccctcgggttgtagatatgtgtagcacaccaacttactgcgacctaggaaaggctgccaaggatgtctttaacaaagggtatgggtttggcatggtcaaaatagatctgaaaaccaagtcttgtagtggagtggaattttctacttctggtcatgcttatactgatacagggaaagcatcaggcaacctagagaccaaatataaggtctgtaactacgggctcatcttcacccaaaagtggaatacagacaatactcttgggacagaaatctcttgggagaataagttggctgaagggttgaaactgacggttgataccatatttgtaccaaacacagggaagaagagtgggaaattaaaggcctcctatagacgggattgttttagtgtgggcagtaaggttgacatagatttttctggaccgaccatctatggctgggccgtgttggcctttgaaggttggcttgctggctaccagatgagttttgacacagccaaatccaaactgtgtcagaataattttgctcttggttacaaggctgaagacttccaactgcatactcatgtaaacgatggcactgaatttggaggctccatctaccagagagttaatgagaagatcgaaacatcaataaacctggcatggacagctggcagcaacaacactcgttttggcatcgctgctaagtataggctggattgtagaacttctctgtctgccaaagtaaacaatgccagtttaattggactgggttatacgcagagtctccgaccgggagtcaaactgaccctgtcagctttagtggatggaaagaacttcaatgcaggaggccacaaggttggcttgggatttgaactggaagcttaatggggttttgagtagagtatcaattgtccctggaaatgaagagaaatgacaccactatgttttggccttaaaattctgtgaaatttcaaaagtgaactttttattcttccaaagaattgtaattcttcccacaccgaagtctagagattacagatccatccagtgggaggtccttgaaggcaatgcctggaaattgtcatgtttgtgccacatttcagttgagttctgcagagttaattttaaatatgttcctcagcaacaacgtagtgtcacgttaaaggaagtgatctgcccggtctgtacatcgtgtcctgcatgtcccaactccactttccatgaccttttgttacatcagtctctgctctagtgagacctttggtttgcatcagagtaaaataaacccatcacatttggaacataaaaaaaaaaaaaaaaaaaa

SEQ ID NO: 3794 - DNA, 2485 bp, Rattus norvegicus
  Genbank Accession No. NM_031357
ccaaaatgggactccaagcccgcttcctaggactccttgctctcgtcatcgccggcaaatgcactcacagccccgagccggaccaacggtggatgctgcctccaggctgggtgtcactgggccgagtggatcccgaggaagagctgagtcttacttttgcgctgaaacagcagaacctggacagactctcggagctggtgcaggctgtgtcggatcccagctctcctcgatatggaaagtacctcaccctagaggatgtagctgagctggtccaaccatcaccactgaccctccgcactgtccaaaagtggctcttggcagctggagcccgggactgccattcagtgaccacccaggactttctgacttgctggctgagtgtccggcaggctgagctgctgcttcctggggctgagtttcatcgctatgtagggggacctgcaaagacccacattataaggtccccacatccctatcagctcccccaggccttggcccctcatgtggaccttgtggcggggctgcaccgtttcccccctttatcatctccgagacaacgtccagagccacaaggagtgggacctgttggcctgcacctgggagtgactccatctgtgcttcgtcagcgatataacctgacagcccgagatgtgggctctggcaccaccaacaatagccaggcctgtgcccagttcctggaacagtacttccataactcggatctgactgagttcatgcgcctgtttggtagcagttttgcacaccaggcctcagtagcaagagtggttggaaagcaggggcgaggccgagcgggcatcgaggccagtctagatgtggaatacctgatgagtgctggtgccaatatctccacttgggtctacagtagccctggccgccatgaggcacaggagcccttcttacaatggctcctgcttcttagcaatgagtcatccttgccgcatgtacatactgtgagttacggagacgatgaagactccctcagcagtgtctacatccagagagtcaacactgagttcatgaaggctgctgctcggggtctcaccctcctttttgcctcaggtgacactggagctgggtgttggtctgtctccggaagacacaagttccgtcctagcttccctgcttctagcccctatgtcactacagtaggaggaacctccttcaagaatcctttccttgtcacaaatgaagtagtcgactatatcagtggtggaggcttcagcaatgttttcccacagccttcataccaggaggaagcagtagcccagttcttgaagtccagctctcatctaccaccatctagttacttcaatgctagtggccgtgcttacccagatgttgccgcgctttctgatggctactgggtggtcagcaacatggtccccattccgtgggtatctggaacctcggcctctactccagtgtttgggggaattttatccttgataaatgagcacagactcctcaatggccgcccccctctaggctttctcaatcccaggctctatcagcagcatggggcaggactctttgatgtaacccatggctgccatgagtcctgtctgaatgaagaagtggagggtcagggtttctgctctggtcctggctgggatcctgtgacaggttggggaacacccaacttcccagccctactgaagactctactcaacccttgacccttccctgccctgacgagaaagcagaactgtttcctgtactacaagggaaggctcagtttctcgttattcctcaatggaagccctgatgaactcttaactgttgcctgctgcagatagcttctccctaaccctcaaatgctgtgagcaggactggactcccaaccctgtgagccatcaaactcaggtctccaaacttctacttcgagatccccaacaagatgctataaccagcattttgtctcaccccaaccccatctctccttcctctttccagcttgagatgtgaaagcagggcgagaagattcagtctgcattactgacaccagcagtcccacctaatgcttaccacctctgcactgaccgtatgctctttctcttccagctgcttcttcgttcactgaaatgagacctttgtgctaatcgtttagtctttcttcccctggcactgaagtgcaatggtctccctgacattctatccagttatacacttctcagtgttttatgggctttcttgtttaagaacaggttggtgatgggttggggatttagctcagtggtagagcgcttgcctaggaagcgcaaggccctgggttcggtccccagctccgaaaaaaagaaccaaaaaaaaaaaaagaacaggttggtgacaatctatataactattctaaggaaagttcaagtttgaaaattttaaatgttttaaatgttcttattggcaaagctcctcaacaaaataaataggtgttacaaattttgcttcaaaaaaaaaaaaaaaaaaaaaaaaa

SEQ ID NO: 3795 - DNA, 1574 bp, Rattus norvegicus
  Genbank Accession No. NM_031502
acaacttcaaagcaaatgaagttcgttctgctgctttccctcattgggttctgctgggctcaatatgacccacacactgcggatgggaggactgctattgtccacctgttcgagtggcgctgggctgatattgccaaggaatgtgagcggtacttagcacctaagggatttggaggggtgcaggtctctccacccaatgaaaatattataattaataatccatcaaggccttggtgggaaagatatcaaccaatcagctacaaaatttgctcaaggtctggaaatgaaaatgaattcaaagacatggtgacgaggtgcaacaatgttggtgtccggatttatgtggatgctgtcattaatcacatgtgtggctcgggcaatagtgcaggaacacacagtacctgtggaagttacttcaatcctaataacagggaattctcagcagttccatactctgcttggtattttaacgataataaatgtaatggagaaattaataactacaatgatgccaatcaggtcagaaattgtcgtctgtctggccttctggatcttgcactcgataaagattatgttcgaaccaaggtggctgactatatgaacaatctcattgacattggtgtagcagggttcagacttgatgctgctaagcacatgtggcctggagacataaaggcagttttggacaaactacataatctaaatacaaaatggttctcccaaggaagcagacctttcattttccaagaggtcattgatcttggtggtgaagcaattaaaggtagtgagtactttggaaatggccgcgtgacagaattcaagtatggtgcaaaacttggcacagttattcgcaaatggaatggagagaagatgtcttacttaaagaactggggagaaggttggggttttgtgcctactgacagagcccttgtgtttgtggacaaccatgacaatcagcgaggacatggtgctggaggagcatccatcctgacattctgggatgctagaatgtataaaatggcagttggatttatgttggctcatccttatggattcaccagagtaatgtcaagttaccgaaggacaagaaatttccagaatggaaaagatgtgaatgactggattggaccacctaataacaatggagtaacaaaagaagtgaccattaatccagacactacttgtggcaatgactgggtctgtgaacatcgatggcgtcaaatcaggaacatggttgccttcaggaatgtagtcaacggtcagccttttgcaaactggtgggataatggcagcaaccaagtggcttttagcagaggaaacagaggattcattgtctttaacaatgatgactgggctttgtcaagcactctacagactggtcttcctgctggcacatactgtgatgtcatttcaggagataaagtcaatggcaattgcactggacttaaagtaaatgttggcagtgatggcaaagctcacttctctattagtaactctgctgaagacccattcattgcaatccatgccgactcaaagttgtaagagtcaaattaaagagatttagattcagcacc

SEQ ID NO: 3796 - DNA, 1178 bp, Rattus norvegicus
  Genbank Accession No. NM_031509
acattaaccaactgtttagcaactcaggcatgactttgcatttttcttctaatctttcatagaaatttctggccactggacactgtgggagcagcttttaccttattggactatctccccttaagtgggaagggcttagtcaaatgcagtaaagagctataaaacaccgagaactcttgatgtgttgtgaaacttagagggagcagctttttaacaagagaactcaagcaattgctgccatgccggggaagccagtccttcactacttcgatggcagggggagaatggagcccatccggtggctcctggctgcagctggagtagagtttgaagaacaatttctgaaaactcgggatgacctggccaggctaaggaatgatgggagtttgatgttccagcaagtgcccatggtggagattgatgggatgaagctggtgcagaccagagccattctcaactacattgccaccaaatacaacctctatgggaaggacatgaaggagagagccctcatcgacatgtatgcagaaggagtggcggatctggatgaaatagttctccattacccttacattccccctggggagaaagaggcaagtcttgccaaaatcaaggacaaagcaaggaaccgttactttcctgcctttgaaaaggtgttgaagagccatggacaagattatctcgttggcaataggctgagcagggctgatgtttacctagttcaagttctctaccatgtggaagagctggaccccagcgctttggccaacttccctctgctgaaggccctgagaaccagagtcagcaacctccccacagtgaagaagtttcttcagcctggcagccagaggaagccattagaggatgagaaatgtgtagaatctgcagttaagatcttcagttaattcaggcatctatggatacactgtacccacaaagccagccttcgaaagctttgcaacaatcgcatattttgactaaatgttgaccctacttattgggaggccaacacgttttctaatgcttctgtgttaattcatatagacatgactgatgaggaattgctgggatgctatttggttgtagttaaaatttgaaatcatgatcacttcctcagatattactttgaatctcaataaaaacttcgcaagctttttaaaaaaaaaaaaaaaaaaaaa

SEQ ID NO: 3797 - DNA, 1719 bp, Rattus norvegicus
  Genbank Accession No. NM_031510
cgggtgtgagcggggttattgaagtaaaaatgtccagaaaaatccatggcggttctgtggtggaaatgcaaggagatgaaatgacacggatcatctgggaattgattaaagaaaagctcattcttccctacgtggaactggatctgcatagctatgacttaggcatagagaatcgggatgccaccaatgaccaggtcaccaaggatgctgcggaggctataaagaaatacaacgtcggcgtcaagtgtgctaccatcacccccgatgagaagagggttgaggagttcaagttgaaacaaatgtggaaatcacccaacggtaccatccggaacattctgggcggcactgtcttcagagaagctattatctgcaaaaatatcccccggctagtgacaggctgggtaaaacccatcatcattggccgacacgcctatggggaccaatacagagcaacagatttcgttgttcctgggcctggaaaagtagagataacctacacaccaaaagatgggtcgcagaaagtgacatacctggtgcatgactttgaagaaggtggtggtgttgccatgggtatgtacaaccaggataagtcaattgaagattttgcacacagttccttccaaatggctctgtcgaagggctggcctttgtatctaagcaccaagaacactattctgaagaagtatgatggacgcttcaaagacatcttccaggagatctatgacaagcaatacaagtccaagtttgaagctcagaagatctggtatgaacacaggctcatagatgacatggtggcccaggctatgaaatcagaaggaggcttcatctgggcctgtaagaactatgatggtgatgtgcagtcagactcagtagcccaaggttatggctcccttggcatgatgaccagtgtgctgatttgtccagatggtaagacggtagaagcagaggctgcccatggcactgtcacacgtcactaccgcatgtaccagaaaggacaggagacgtccaccaatcccattgcttccatttttgcctggtcccgagggttagcccacagagcaaagcttgacaacaatactgagctcagcttctttgcaaatgctttggaagaagtctgcattgagaccattgaggctggctttatgactaaggacttggctgcttgcattaaaggcttacccaatgtacagcgttctgactacttgaatacatttgagtttatggacaaacttggagaaaacttgaaggccaaactagctcaggccaaactttaaggtcaaacctgggcttagggcaaatctttgtggtaactaagtccacagtttacatatttcctttttgttttaataacactcaaggttaaaaacaagaatcattttgtaatttgtttagaagacgaagttgaacttttctatatgtttacagcctattttctttttcatacagttattgccaccttaatgaatgtggtggggaaggtttttttaattgtattttactgtgtaatagcagtctaggaattgtgttagtatctgttcacaattaactgtcactttttatttgctctaatgtaaatgaccaaaatcagaaatgctccaagggtgaacaatcactacactatgtttccccgtaaaggtgaaggagaggctcacctcccctactgtccatgagtgtgaacacagggagcaaaagtgtgcaaatgttgcactgtgtgtggaa

SEQ ID NO: 3798 - DNA, 4563 bp, Rattus norvegicus
  Genbank Accession No. NM_031511
gcctgctctccggcggagctgcgtgaggccaggccggcccccggcccccccttccggccgcccccgcctcctggcccacgcccgcccgcgctcggcccgccagcgcctccatccgggctggcggccccgcgtcgacgccgtccgccacctcgctgctaactcccgtgcagggcgccgtcggcggggcctcgctccgtcgggcctgcggatctccccaccgcctcctcctctatctacctcaacaccccattcctgcttcgccagaggaggcggtccccaccgcaggcagtccggcttgcaggtcgccggcgttgtcatcccccgcgctccccctcccagccctccccggcgcgcagcccggcagctcctctcttttcgctgcagtcccgagcagccgcggcgccgccacgcctgacccccccacaagaagccggggcttacgacggctgagggctccgtcggccctaaccgagctgggtgcccgtggccggggtgacgcctccattcctcccccctcaacaccgtcctcgatccttcgaagttgcatcctttcctctgcttagagtgcgccccccctcgcgcactcgcttacccgccacctttcctaggctcccctcctgccccctccccgttcctcctcgcctcagactccctccccctcacgtccgccctctgccttcgcctacccaagtggattaattatacgctttctgtttctctccgtgctgtcctctcccgctgtgagcctacccgcctctcgctgtcctctctccctctctccctctctgtgtcccccccctttcacgttcactctgtctctctcactatctctgccccccaactatccttgatacaacagctgacctcatttcccgatacctttcccccccccgaaaatacagtatctggcccgccccagccctaagataccctaaagaagcagaagagacgcccccctccccatcaaaaaaagccatctccccgttctgtcccgtcgcacattcggcctctgcgacttggacagagcggcgctggcagaggagtgcccggcagaagggccttcgcccgctgttcggtttgcatacccgcagcagggagatgggcggcagcgtcgccggcttccaggtaccaatggggatcccagtggggaagtcgatgttggtgcttctcatctctttggccttcgccttgtgctgcatcgctgcttaccgccccagcgagactctgtgcggaggggagcttgttgacacgcttcagtttgtctgttcggaccgcggcttctacttcagcaggccttcaagccgtgccaaccgtcgcagccgtggcatcgtggaagagtgctgcttccgcagctgcgacttggccctcctggagacatactgtgccacccccgccaagtccgagagggacgtgtctacctctcaggccgtacttccggacgacttccccagataccccgtgggcaagttcttcaaattcgacacctggagacagtccgcgggacgcctgcgcagaggcctgcctgccctcctgcgtgcccgccggggtcgcatgcttgccaaagagctcgaagcgttcagagaggccaagcgccaccgtcccctgatcgtgttaccacccaaagaccccgcccacgggggagcctcttcggagatgtccagcaaccatcagtgaaccaaattatgtggtaattctgcaatgtagtaccatcagtctgtgacctcctcttgagcagggacagctccatcatgtcccacactaaggtctctctgctccacttcccttcccaggtttctccccacccacccccatgccccgcctccccacatcaggctgctccccttgccccacaccatcgggcaaggggatcccagcaactcttcaaaaccaaatttgattggctctaaacaacccaattggcaccctccaaattatatatgaacattaaaaaaaaactttaaagcatatagtccctttacaacaaattggcttaagaaactccataactgataatctaaaaattaaataaccaaagaaattaattggctaaaaacatactaaaaattaattggcttaaaaacaattggcaaaaatcaaataatttggcccgcccccccccccttcatcttctttccatttagatctttagtcaaattggctcagacttggatctcagaacccaagaagaaaggaaggggacccaaaattttgcaggtagcatgtcattgcttcagtgctctctccttgtcactagtcacttttagcataatctggctgtgaacaacaatagccgcccaaactctttcttcactggtcattccatcacaaatgtcacccatgtcaccaaggggctgggtgaaggaacccaaggagaggaacagaacatgaaaactgaaaatagaacctaattggcacaagcccccagtcccaaaaatctcacttttcatacctactctaaaaagcacatgattatacccacacgtacatgcacacacacatgcacacaggcatgcatacacacacacacacacacacacacactattagatgagaacattgaaatggctgagcaacttcgattggaaccacattgcccaatccaaggcccatcttaaattccctgagcagtttgcatggtttgagctcctctctgaatccatctagtttctgctgccagtgtagagtcagtttggccagataaggagatggcactgccaagtgatacatgctacccgagtagcctgacccctaggtgtgctcctgggaggaaagatctgggggacaacccctaccccaagcacacctatgggccatctctgtcaatctcctggggagcccccactttttaggggctccccaggagactcacactgatgtggggagtgtgggaagtctggcggttggaggggtgggtggggggcagtgggggctgggtggggggaaactatgggtaggaagtggtcccagagaggtcttaggtggaacagtcaggaggaggcacaggtcaacttgcagaattactgaagaatcaggaccccaaattttctgtcaattgatctattcccctctttttatgtctggggcaggttttttccttttttttttttaatccctccttagcttttaatgcgctcataatcccattccctatgtaacgggggcagcgatcaagtaatgaatgcatcaagccatcaataccagcgagagccagtaacaccggctagagccatcaacaccggcttccaccatgtcctgctcccaaccatttatcaaccttttttttttttttatctgtctctatcgcttggcctgagttgggagtggagtctctgtggggtgctggccacgcacccacagagaaataaaaggaattgagaaggccgctacctggcctgacttctggggacagtggctggtccccagaagttctgaggagtggagggggcgtggggcagtgtcccctcaggtgttaggaaggtgctcggaggccacaaagatggggccccagctggccctgccagttgggggggaaggggatgtagatgtaagactagagaggttccatcaggcgggagcaagtggctgccttctgagcacttgggggaggtcctccccgtgcccctcagtgtcatcttgcccactcctcagcaccccatcttaccctcaggaggtctggagctctacagacctcctgggggcaaggtggggtgaggcctggagctggggaagcgaggaggctttaaagccttcagagccaggagaactgtgtacatggggttgtctgggccctggggcccgagggtctggtgagccgtagcagccactccacggtgcctaggactgcggcggggaacagggcggctggaggtttacctcacccccacttctgcttccagtgcagtccccctgcccaacagtcctactagtaatctagaggcctgaggcttctgggcccaggtgacaggactggcaccaccctgggggcggtgtgtgtcagccagccatggcacagagggttctcagcaagtgcctaaagaatgggccatttggaacattggacagaaactcaaagagtaaattgttataattggagaatatgaattggcctggtacccaaaatatctcgaggcaccctaaattacctgcccatttgactggacatccacccagtgttaatatgcctcgtgggatgggtgttttcaggggcatttgctgaccatcctctgtgtccccagatttgcagttctccccatcataggtcaccctgatgcaggcacctccctggcctcccatgcctagtgtggccctccatcttgttttgtctcttccctactgtcttcggtgggatcccctcttgggtcccccaatttgtcatcctgtgaagacttcccacgcgtcgaatgccatatgtcacctgtgccactgcccatgtcatccagcagtggccccgggtatttgccccaactcagtccttttaacatgcattttctggcaaaatccaaagcttgggttttgtttttaacctgttaacgcttgcaaacctaataaagcattcaaaatact

SEQ ID NO: 3799 - DNA, 1329 bp, Rattus norvegicus
  Genbank Accession No. NM_031512
gggcggttcaaggcataacaggctcatctgggatcctctccagtcaggcttccttgtgcaagtgtctgaagcagctatggcaactgtccctgaactcaactgtgaaatagcagctttcgacagtgaggagaatgacctgttctttgaggctgacagaccccaaaagattaaggattgcttccaagcccttgacttgggctgtccagatgagagcatccagcttcaaatctcacagcagcatctcgacaagagcttcaggaaggcagtgtcactcattgtggctgtggagaagctgtggcagctacctatgtcttgcccgtggagcttccaggatgaggacccaagcaccttcttttccttcatctttgaagaagagcccgtcctctgtgactcgtgggatgatgacgacctgctagtgtgtgatgttcccattagacagctgcactgcaggcttcgagatgaacaacaaaaatgcctcgtgctgtctgacccatgtgagctgaaagctctccacctcaatggacagaacataagccaacaagtggtattctccatgagctttgtacaaggagagacaagcaacgacaaaatccctgtggccttgggcctcaaggggttgaatctatacctgtcctgtgtgatgaaagacggcacacccaccctgcagctggagagtgtggatcccaaacaatacccaaagaagaagatggaaaagcggtttgtcttcaacaagatagaagtcaagaccaaagtggagtttgagtctgcacagttccccaactggtacatcagcacctctcaagcagagcacagacctgtcttcctaggaaacagcaatggtcgggacatagttgacttcaccatggaacccgtgtcttcctaaagatggctgcactattcctaatgccttccccaggacatgctagggagcccccttgtcgagaatgggcagtctccaggggaagcctttgtcctctgccaagtcaggtctctcagagccataagaaaaccgtggcacattctggtcaaagaaaacgtgtgtttccctccctgcctctgacaggcaaccacttacctatttatttatgtatttattgattggttgatctatttaagttgattcaggggggtcacgaggcagcattgtcgacagaagaatctagttgtccgtgtgtatgggatgaattgaatttggaccagtgcacagccagcactgagttctttcattgatgctgaaaatgaagagtttcatattgtgtggatgagagtgtttatgaatgaagcacaagcacatcattttgatgagtatgaaataaatgtcactaaaac

SEQ ID NO: 3800 - DNA, 3731 bp, Rattus norvegicus
  Genbank Accession No. NM_031514
atcctgcgcgcctccgggcgctcctgtgtggcccgacccgtgtcgccggttcctgaagcaggcgacgggaacaagatgtgaactgtttttcctccacagaagaagaggcccttctttcccctcccgggaaggccgatgttctgaaaaaggctgtggatgggaatggcttgccttacaatgacagaaatggagggaacctccacatctcctgcacatcagaatggtgatattcctggaaatgctaactctgtgaagcagacagagccagtccttcaagtgtacctgtaccattctcttgggcaagctgaaggagactatctgaagtttccaaatggagagtatgttgccgaagaaatttgtgtggctgcttctaaagcatgtggtattacgcctgtgtatcataatatgtttgctttaatgagtgaaacagaaaggatctggtatccacccaatcatgtcttccacatagatgagtcaaccaggcataatatactctacagaataaggttttactttcctcattggtactgcagtggcagcaacagaacctataggtacggagtatctcgtggggctgaagctcctctccttgacgactttgtcatgtcttacctttttgctcagtggcggcatgattttgttcatgggtggataaaagtacctgtgactcacgaaactcaggaagaatgtcttggcatggcagtgttagacatgatgagaatagctaaggagaaggaccagactcccctggctgtctataactccatcagctacaagacgttcttaccgaagtgcgtgcgagcgaagatccaggactatcacattttaactcggaagcggataaggtacagattccgcaggttcattcagcagttcagtcagtgcaaagccactgccaggaacctaaaacttaagtatctcataaacctggagaccctgcagtctgccttctacacagaacagtttgaagtaaaagaatctgcaagaggtccttcaggtgaggagatttttgcaaccattataataactggaaacggtggaattcagtggtcaagagggaaacataaggaaagtgagacactgacagaacaggatttacagttgtattgtgattttcctgatattattgatgtcagtattaagcaagcaaatcaggaatgctcaactgaaagtagagttgtgaccgtccacaagcaggacgggaaggtcttggaaatagaacttagctcattaaaagaagccttgtcatttgtgtcgttaattgacgggtattacagactaactgcggatgcacaccattacctctgtaaagaggtggctcctccagccgtgcttgaaaacatacacagcaactgtcacggcccaatttcaatggattttgccatcagcaaactaaagaaggcaggaaaccagactggactgtatgtacttcgatgtagccctaaggacttcaacaaatacttcctgacctttgccgttgagcgagaaaatgttattgaatataaacactgtttgattacaaagaatgagaatggagagtacaacctcagtgggactaagaggaacttcagtagtcttaaggaccttttgaattgctaccagatggaaactgtgcgctcagacagtatcatcttccagttcaccaaatgctgtcctccaaagccgaaagataaatcaaaccttcttgtcttcagaacaaatggtgtttctgatgttcagctctcaccaacattacagaggcataataatgtgaatcaaatggtgtttcacaaaatcaggaatgaagatttgatatttaatgaaagccttggccaaggcacttttacaaaaatatttaaaggtgtaagaagagaagttggagattatggtcagctgcacgaaaccgaagttcttttgaaagtcctagataaagcacatagaaactattcagagtctttctttgaagcagcaagcatgatgagtcagctttctcacaagcatttggttttgaattatggagtatgtgtctgtggagaggagaacattttggttcaagagtttgtaaaatttggatccctggatacatacctgaaaaaaaacaaaaattccataaatatactatggaaacttggagtggccaaacagttggcatgggccatgcacttcctcgaagaaaaatcccttattcatgggaatgtgtgtgccaaaaatatcctgcttatcagagaagaagacaggaaaacagggaatccacctttcatcaaacttagtgatcctgggattagcatcacagttctaccaaaggacattcttcaggagagaataccatgggtaccacctgagtgcattgaaaaccctaaaaatctaactttggcaacagacaagtggagctttggcaccactctgtgggagatctgcagtggaggagacaagcctctgagtgctctggactctcaaagaaagctgcagttctatgaagataagcaccagctcccagcacccaagtggacagagttggcaaaccttataaatacttgcatggattatgagccagacttcaggcctgccttcagagctgtcatccgtgatctgaacagcctgtttactccagattatgaactgctgacagaaaatgacatgctacccaacatgagaataggtgccctaggattttctggtgcttttgaagacagggaccctacacagtttgaagagagacacttgaaatttctacagcaacttggcaagggtaactttgggagtgtggagatgtgccgctatgacccgctgcaggacaacactggagaggtggtagctgttaagaagctccagcacagcacggaagagcatctccgagactttgaaagggaaattgaaatcctgaaatccttgcagcatgacaacatcgtgaagtacaagggagtgtgctacagtgctggtcggcgcaacctaagattaattatggaatatttgccgtatggaagtttacgagactatctccaaaaacataaagaacggatagatcacaaaaaacttctgcagtatacatcccagatatgcaagggcatggagtatcttggtacaaaaaggtatatccaccgggatctggcaacaaggaatatattggtagaaaatgagaacagagttaaaataggagattttggattaaccaaagtcttgccacaggacaaagaatactacaaagtaaaggaaccaggtgaaagtcccatattctggtatgctcccgaatccttgacagagagcaagttttctgtggcctcagatgtgtggagctttggtgtggttctgtacgaacttttcacgtatatcgagaagagcaaaagcccacctgtggaatttatgcgaatgatcggcaatgataaacaagggcagatgatcgtattccatttgatagagctactgaagaacaacggaagactgccgagaccagaagggtgcccagacgagatttatgtgatcatgacagaatgctggaacaacaatgtcaaccaacgtccctctttcagggacctttcccttcgggtggatcaaatccgggacagtatggctgcatgaaagaggtgacctttactcagagaccaagtagacttccagaaccagagcaaagctctgtagccacatggccatggactcgtgtccacgggcccttatcatgatgctagccagaaggaaatgtgatgctgtctgctcaagactttggaagcgttgtggatttttatgtaccatctgta

SEQ ID NO: 3801 - DNA, 3170 bp, Rattus norvegicus
  Genbank Accession No. NM_031521
ctgaggctggggctgtcactcattctccgctcagcggtgaacgcagctcggcagtggctggcaagaaacaattctgcaaaaataatcatatccagcctggcaattgtctgctcctcggtccattgctccgccgccgtccacagtcgcttgcaagggaaggcactgaatttaccgcggccagaacatccctcccagccggcagtttacaatgctgcgaactaaggatctcatctggactttgtttttcctgggaactgcagtttccctgcaggtagatattgttcccagccaaggagaaatcagcgttggagagtccaaattcttcctgtgtcaagtggcaggagatgccaaagataaggacatctcctggttctcccccaacggggagaaactgagcccaaaccagcagcggatctcagtggtgtggaacgatgatgactcctctaccctcaccatctacaacgccaacattgatgatgccggcatttacaagtgcgtggtcaccgctgaagacggcacccagtccgaggccactgtcaatgtgaagatcttccagaagctcatgttcaagaatgcgccaaccccacaggagtttaaggaaggggaagatgctgtgattgtctgtgatgtggtcagctctctgcccccaaccatcatctggaaacacaaaggccgagatgtcatcctgaaaaaagatgtccggttcatagtcctatccaacaactacctgcagatccgaggcatcaagaaaacagatgagggcacttaccgctgtgaaggcaggatcctggcccggggggagatcaacttcaaggacattcaggtcattgtgaatgtaccacccactgtccaggccagacagagcatcgtgaatgccactgccaacctgggccagtctgtcaccctggtgtgtgatgccgatggcttcccagagcccaccatgagctggacaaaggatggggaacccatagagaatgaggaggaagatgacgagaagcacatcttcagtgacgacagttcggagctgaccatcaggaatgtggacaaaaatgacgaagccgaatacgtctgcatcgctgagaacaaggctggcgagcaggatgcctccatccacctcaaggtcttcgcaaagcccaaaatcacctatgtagagaatcagacagccatggaactagaggagcaagtcactctgacatgtgaagcctccggagaccccattccttccatcacctggagaacgtccacccgaaacatcagcagtgaagaaaaggcatcgtggactcgaccagagaagcaagagactctagatgggcacatggtggtacgcagccatgctcgtgtgtcctccctgaccctgaagagcatccagtacacagatgctggagaatacatctgcactgccagcaacaccatcggccaggactcccagtccatgtaccttgaagttcaatatgctcccaagctccagggccctgtagctgtgtacacttgggaagggaaccaggtgaacatcacctgtgaggtctttgcctacccaagtgccacaatctcctggttccgagatggccagttgctgccaagctccaactacagcaatatcaagatctacaacaccccatctgcgagctatctggaggtaacccctgattccgaaaatgactttggaaactacaactgcacagcggtgaaccgtattggacaggagtccttggaattcatcctggttcaagcagatacaccatcttccccatccatcgaccgggtggaaccatactccagcacagcacaggtacaatttgatgagccagaagccacaggtggagttcccatcctcaaatacaaggctgagtggaagtcgctgggtgaagaagcatggcattccaagtggtatgatgccaaagaagccaacatggaagggattgtcaccatcatgggcctgaagcctgagacaaggtacgcggtacgactggcggccctcaacggcaaggggctgggcgagatcagtgcagccactgagttcaagacacagccagtccgggaacccagcgcacccaagctggaagggcagatgggagaggacgggaactccatcaaggtgaacctgatcaagcaggatgacggcggctcccccatcagacactatctggtcaagtacagagcgctcgcctccgagtggaaaccagagatcaggctcccgtccggcagtgaccacgtcatgctcaagtccctagactggaacgccgagtacgaagtatatgtggtagctgagaaccagcaaggaaaatccaaggcagctcacttcgtgttcaggacttcagcccagcccacggccatcccagccaatggcagccccactgcaggcctgagcacaggcgccattgtgggcatcctcattgtcattttcgtcctactcctggtggtcatggacatcacctgctacttcctgaacaagtgtggcctgctcatgtgcatcgctgttaacctgtgcggcaaagcggggcccggagccaagggcaaagacatggaggagggcaaggctgctttctcgaaagatgagtctaaagaacccattgtagaggtccgaacggaggaggaacggactccaaaccatgacggagggaagcacacagagcccaacgagaccacaccactgacagagcccgagaagggtcctgtagaaacaaagtccgagccccaggagtcagaagcaaagccagcgccaactgaagtcaagacggtccccaatgaagccacacaaacgaaagagaatgagagcaaagcatgatgggtaccagcaaaaagcaaagatcaaaataacaaattgacacagcggcttcaccagagcatccccaaataaccccccccccctctctctctctctcacacacacacacacacacacacacacacacacacacacacactcactcctctagtgtcttttgccttttaaaaaaacaacaaaaaacagataaacatgggattgcctttttgtaggtttctagaaagggctcctttgttgcacactcacttgttaagaaaaaaaaagagacaaaaaggttaaacccacagccaaactaggacactccgttccctgaaaccatttaaaaatcaaacaaaagggccccaaattaagaatctaggaagctcagactgaagagaaaaacaag

SEQ ID NO: 3802 - DNA, 780 bp, Rattus norvegicus
  Genbank Accession No. NM_031530
gcagagacacagacagaggccagcccagaaaccagccaactctcactgaagccagatctctcttcctccaccactatgcaggtctctgtcacgcttctgggcctgttgttcacagttgctgcctgtagcatccacgtgctgtctcagccagatgcagttaatgccccactcacctgctgctactcattcactggcaagatgatcccaatgagtcggctggagaactacaagagaatcaccagcagcaggtgtcccaaagaagctgtagtatttgtcaccaagctcaagagagagatctgtgctgaccccaataaggaatgggtccagaagtacattagaaaactggaccagaaccaagtgagatcagaaactacagtcttctataaaattgcatcaaccctaaggacttcagcacctttgaatgtgaacttgacccataaatctgaagctaatgcatccactctcttttccacaaccacctcaagcacttctgtagaagtgaccagtatgacagagaactagtgtgatttggaatgtgatgccttaagtaatgttaaacttatttaacttattgatattacactattcccttccatgaatactagaaatccttaaatgcaagatgtagatccatttttttatttctctgtgaatcctggttcaacactttcaatgtatgagagatgaatgggtaaactttgtgtttgagagtccaaggtattgtttaaaatattattatggatattcctaattattaaaagaaatatattatttttgtac

SEQ ID NO: 3803 - DNA, 2061 bp, Rattus norvegicus
  Genbank Accession No. NM_031531
aacacaccagggaagtggcaaccctgaacatcaggagtcggcaatcacagaggctggcagctggctggtatcggctctgcagcctgaagactggagaagatgacccgccttgtgacttggagctcttgatggatgggatcggctctgctctcctctccttcccagattgcatactgggagaggacactctattccatgaagaccaagacaaggggacacaactggacagtctcacattggcctccatcaatactgactttgccttcagcctctacaagaagctggctttgaggaatccacataaaaatgttgtcttctccccacttagcatctcagccgccttggccgtcgtgtccctgggagcaaagggcagcagcatggaagagattctagaaggtctcaagttcaatctcacagagacccctgagacagaaatccaccggggctttggacacctcctccagaggctcagccagccaagggacgagatacagatcagtacaggcaatgccctgtttattgaaaaacgccttcaggtcctggcagagttccaggagaaggcaaaggctctgtaccaagctgaggccttcacagctgatttccagcagtctcgtgaggccaaaaagctcatcaatgactatgtgagtaaacagacccaggggaagatccagggactgatcacaaacctagctaagaagacatccatggtactggtgaattacatctactttaaaggcaaatggaaggtgccttttgaccctcgggacacattccagtctgagttctactctggcaaaaggaggtctgtgaaagtgcccatgatgaagcttgaggacctgaccacaccctacgtccgggatgaggagctgaactgcactgttgtggagctgaagtacacaggaaatgccagcgccctgtttatcctccctgaccagggcaagatgcagcaggtggaagccagcttgcaaccagagaccctgaggagatggaaggactctctcaggcccagcatgatagatgagctctacctgcccaagttctccatctctgctgactacaacctggaggacgtccttccagagctgggcatcaaagaagtcttctccacacaggctgacctgtctgggatcacaggggataaggacctgatggtctttcaggtggtccacaaggctgttctggatgtggctgagacaggcacagaagcagccgctgccacaggggtcaaatttgttccaatgtctgcaaaactggaccctctgattatagctttcgaccggcctttcctgatgattatctctgacacagaaactgcaatagctccctttttggccaagatatttaaccccaaatgagattcgaacttcccaagagttgatgcttctcctgaggcattgagcctgtctgtgggtctctgtgtgcattttcgcttctatgctgtgattggccatggcggcatgcctggatgagacagtaactaactgtgtaacagtcctcatgtacagacgcctgtgcagagtcgctgccatgctcccaaacttcttggtaccactagctcatatttctgagcctaaaatttgtctttcccctgcccttgctctctctcccctgtatctgcctcaacccagaagccagggccccatcaggttgtctcagtcccaacttaggctctagttatatcttccttcagcgttgctgtcttgatgggactgtgcacgattaccggccaacccacatggaccaagaagaacacttgctggtccctatctttctgcagtatgtgggaatcacttggtgcccagtgctgcctcactatttccttcctctgggcacagtgctccttgcagcactggcctgactttgtccacatctggcacagagctggagccctcccttctgcagatgcatggcacctgtgggtcagaccagatccccctccccagcactcctacttagagcaatgcagcctttcttttagttcccagctgaccaacctcacacaaaagatgaccaacaacaaccaaaatgaagaggtaggagcaaaggatcaataaacacatc

SEQ ID NO: 3804 - DNA, 1593 bp, Rattus norvegicus
  Genbank Accession No. NM_031533
atgcccagaaagtggatttctgctctgttcctgctacagataagttactgtttcaaatctgggcactgtgggaaggtgttggtgtggccgatggactttagtcactggatgaatataaaaataatccttgatgaacttgtacagaggggccatgaggtcactgttctgaaaccttcggcttacttttttcttgatccgaaaaaatcgtctgaccttaagtttgaaattttttctacatctatcagtaaagatgagctgcaaaatcatttcataaaacttttggatgtgtggacttatgagttgccaagagatacatgtttgtcatattctcctatccttcaaaatctagtttatgaattttcttatttttatctaagtatttgtaaagacgctgtttcaaacaagcagctcatgacaaaactacaggaatccaagtttgatgttcttttcgcagatcctgtggcttcctgtggggatctgatagctgaactgctccacattccttttctgtacagtcttagcttctctccaggccacaaacttgaaaagtccattggaaaatttatactccctccatcttatgtgcctgtaattttgtcgggactggctggcaaaatgacattcatagacagggtaaaaaatatgatatgtatgctttatttcgacttttggttcgagagacttagacacaaggaatgggacacgttttacagtgagattttgggaaggcccaccaccgtagatgagacaatgagcaaagtagaaatatggcttattagatcctattgggatttgaaatttccccacccaacattaccaaatgttgactatattggaggactccattgcaaacctgctaaacccttgcctaaggatatggaagaatttgtccagagctctggagagcacggtgtggtggtgttttctctggggtcaatggtcagcaacatgacagaagaaaaggccaacgcaattgcatgggcccttgcccagattccacaaaaggttctttggaaatttgatggcaaaaccccagcaacattaggacccaataccagagtctacaagtggctcccgcagaatgacctcctgggtcacccaaaaaccaaagcctttgtaactcatggtggagccaatggcctctatgaggcaatctatcatggaatccctatgattggcattcctctgtttggagatcaacctgataatattgcccacatggtggccaaaggagcagctgtttcattgaatatcaggacaatgtcaaagttagattttctcagtgcactggaggaagtcatagacaatccgttctataaaaaaaatgttatgttgttgtcaaccattcaccatgaccagcctatgaagcccctggacagagctgtcttctggattgagtttatcatgcgccacaaaggggccaagcacctgagaccacttggacataaccttccctggtaccagtaccactctctggatgtgattggattcctgctcacctgttttgcagtcattgcagctcttactgtaaaatgtctcttgttcatgtaccgattctttgtaaagaaggaaaagaaaatgaagaatgagtag

SEQ ID NO: 3805 - DNA, 1748 bp, Rattus norvegicus
  Genbank Accession No. NM_031535
cttagaacctggactcagaccttcataagagccacaaagaaaccaattctgaaccctatcttggctttggatcctggaagagaatcgctaaacacagagcagacccagtgagtgagcaggtgttttggacaatggactggttgagcccatctctattataaaaatgtctcagagcaaccgggagctggtggttgactttctctcctacaagctctcccagaaaggatacagctggagtcagtttagcgatgtcgaagagaacaggactgaagccccagaagaaactgaaccagaaagggagacccccagtgccatcaatggcaacccatcctggcacctggcggatagccccgcggtgaatggagccactggccacagcagcagtttggatgcgcgggaggtaatccccatggcagcagtgaagcaagcgctgagagaggctggcgatgagtttgaactgcggtaccggagagcattcagtgatctaacatcccagcttcatataaccccagggacagcatatcagagctttgaacaggtagtgaatgaactctttcgggatggggtaaactggggtcgcattgtggccttcttctcctttggcggggcactgtgcgtggaaagcgtagacaaggagatgcaggtattggtgagtcggattgcaagttggatggccacctacctgaatgaccacctagagccttggatccaggagaacggcggctgggtaagaaccacgccccttgtgtgtccgccccttgtgtgtctctcctctgtggagatccctaactgccctttttggtctcctggcatggttgttgaagatatcgattattcaggagacattcctggcttactttaataccaggggttaactttgggaatattgatgaccctgtttttaaggaacctgtatttttcattctggctacccttgtggccccgcagtttcatagttttgttccaatttctcggcaaagaaaaacagcctgtgtgtttacttggcttaaaacctaggagagtagcaagttctccctgtgttctgctcactctcacgtaatgggtcaccttggctggggggggaaggtaatataatacctggaggaactgcagagctgataaccccaggctcctgtgtgctcgcatgcatgctattcagaccatttggtcaggcaggagccccactggcttgactggctgaatattgtctgattttagagaaggtggtctgagccaattgtgtttgtgctgtgcccctaagttcattttcaccatggttggcttgtttggggagcccttgctgtgccccaggactttgtacctcactgccctggatcagttggggatctcccagctgctctggcccagtgtttttctgctcagggccctggggcctctttactaaagcactgtttgctgctggcagacacgaaccaggtctgtgaggctccataggaaattaagatttggtgacagactggacgtgggtgtgagtcctgaccctgtcacttaactggccatgtgaccttggtcaggctgacttaccttctgggcctcagcttctcacagactgttgtgactcttaaagataaagcgagcagaagctgacaccagtgagtgccttttcttctgctcacccttgtgctcaccagggtgagatagaggtgagaatgcccttactggtgaccactgtggtaggcatttaccgttcggagggaactccattctggaataggggagaatgcgac

SEQ ID NO: 3806 - DNA, 2497 bp, Rattus norvegicus
  Genbank Accession No. NM_031541
ggaatcccgcgccgaacacgggggcgggctgcccgggccatggcgcataaaacctctggccacctgcagggctactgctgctctggccactgtcaggcacacaccttgctgctcggtttctgtcatctctgtggcctccgtcgcctctgtcgccgtccccttcaggtcctgagcccagcgactctcggccgcgcacgcggacatgggcgtcagctccagggcacgctgggtggccttggggctgggcgttctagggctgctgtgtgctgcgctcggcgttatcatgattctcatggtgccctcgctcatcaagcagcaggtgctcaagaatgtccgcatagaccccagcagcctgtcctttgggatgtggaaggagatccctgttcccttctacttgtccgtctacttcttcgaggtggtcaaccccagcgaggtcctaaatggccagaagccagtagtccgggagcgcggaccctatgtctacagggagttcagacaaaaggttaacatcaccttcaatgacaatgacacggtgtcctacatagagaaccgaagccttcgtttccagccagacaggtcccagggctcagagagtgactacattgtactgcctaacatcctggtcctgggaggggcagtgatgatggaggacaagcccacaagcctgaagctgctaatgaccttggggttggtcaccatgggccagcgggcctttatgaaccgcacggttggtgagatcctgtggggctacgaagatccctttgtgaatttcctcagcaaatatttcccagacatgttccccatcaaaggcaaatttggcctgttcgttgggatgaacgactcgagttctggcgtcttcaccgtcttcacaggtgtccagaatttcagcaagatccatctggtggataagtggaacggcctcagcgaggtcaactattggcattcggaacagtgcaacatgatcaatggtactgccgggcagatgtgggcaccattcatgacacccgaatcctcactggaattcttcagcccagaagcctgcagatctatgaagctcacctaccaggaatcaagggtgttcgaaggcatccccacttatcgcttcacggcccccgatactttgtttgccaacgggtccgtctacccacctaatgaaggcttctgcccgtgccgcgagtccggcattcagaatgtcagcacctgcaggtttggtgcgcccctgtttctctcccagccccacttctacaatgctgaccccgtgctgtcagaagctgttcttggtctgaaccctgacccaaaggagcattccttgttcctagacatccacccggtcactgggatccccatgaactgttccgtgaagatgcagctgagtctgtacatcaaatccgtcaagggcgtcgggcaaacagggaagatcgagccagtagtcctgccattgctgtggttcgaacagagcgggatgatgggtggcaagaccctgaacacgttctacacgcagctggtgctgatgccccaggttcttcactacgcgcagtatgtgctgctggggcttggaggcctcctgcttctggtgcccatcatttaccaactgcgcagccaggagaaatgctttttattttggagtggtagtaaaaagggctcgcaggataaggaggccatgcaggcctactctgagtctctgatgtcaccagctgccaagggcacggtactgcaagaagccaagctgtagggcccagaagacaccacgagccccccaaacctgatagcttggtcagaccagccgcccagtccctacaccccacttctcgaggactctctcagcggacaacccgccagtgccacgtcctgagcccccagatgtcacactgtccacacggcacatagtgtgcggaaacactcagggaccagggacagacccgctgctgagtagagcctgttgggccacaggcgacctcttctaagtgacctgtgagccaggctgtgggaactgtagctgcccctcctgtaggagctggcgccgccggggctcctgactttctccgtctttctccagcaggctgaaagccttagttcccacagaggacacagatctgtcactcctaggggctgggcaaacatcggcctcttgcgtcacggctggacaagcagttccagatcctgaccagtctgcacacacactctggcgctgtatctggcccttctcctacagtctctgctgtcacctgaacactgaattggccactgtaagtggcagcggtggcaggccccctcagggtccttatttttcaggcgtggggtcaaagagagaggtgtgggccgtctacccctggcacctagtatatctcaccagagggtagggtatacagaggcccagcgtcccacaatcgaccccttttttttctactggaagagaaattttatcgtcttttgaaagaaagtcatgactgaagcaataaaccttttcacaaattcaaaaaaaaaaaaaaaaaaaaaa

SEQ ID NO: 3807 - DNA, 1624 bp, Rattus norvegicus
  Genbank Accession No. NM_031543
gccctagcgcacatggcggttcttggcatcaccattgccttgctggtgtgggtggccaccctcctcgtcatatccatctggaagaagatctataacagttggaacctgcccccaggacctttccctcttcccatccttgggaacatttttcagctggatttgaaggatatccccaagtctttcaccaagttggcaaagcgcttcgggccagtgttcacactgcaccttggctcaaggcgcatcgtggtcctgcatggctacaaggctgtcaaggaggtgctactgaaccacaagaatgagttttctggacggggggacattcctgtgttccaggagtacaagaacaaggggattattttcaataatgggcccacatggaaggatgtgcggaggttttccctaagcattctccgagactggggaatggggaaacagggtaatgaggcccgcatccaaagggaggcgcaattcctggtggaggagctcaaaaagaccaaaggccagccttttgaccccacatttctgattggctgcgcaccctgcaatgtcattgcggatatcctcttcaacaaacgtttcgactacaatgacaagaagtgtctgaggctcatgagtttgttcaatgaaaacttctacctgctgagcaccccctggatccagctttacaataactttgcggattatctacgatacctacctggaagccatagaaaaatcatgaaaaatgtgtctgaaataaaacagtacacacttgaaaaagccaaggaacaccttcagtcactggacatcaactgcgcccgggatgtgactgactgtctcctcatagagatggagaaggaaaaacacagccaagaacccatgtacacaatggaaaatgtttctgtgactttggccgacctgttctttgcaggaactgagaccaccagcacaactctgagatatgggctcctgatcctcatgaaatacccagaaattgaagagaaacttcatgaagaaattgacagggttattgggccaagccgcgtccctgctgtcagagacagactggatatgccctacatggatgctgtggtgcatgagatccagagattcatcaatcttgtcccttccaacctaccccatgaagcaaccagagatactgtgttccaaggatatgtcatccccaagggtacagttgtgattccaactctggactccctcttatatgacagccatgagtttccagatccagagaagtttaaacctgagcatttcctgaatgaaaatgggaagttcaagtacagtgactatttcaaggcattttctgcaggaaagcgtgtgtgtgttggagaaggcctggcccgcatggaattgtttctgctcctgtctgctattctgcagcattttaacctgaagtctctggttgaccctaaggatatcgacctcagtcctgtcacagttggctttggcagtatcccaccccaatttaaactctgtgtcattccccgttcatgagacctgaaaacttcctgatatcccttccattgttatcccttaaactatgactgtttttaaaaaacccaagcatatagagttcctatcataaaatgaaaccgaaaaaataaataaaaccttgatgaattgt

SEQ ID NO: 3808 - DNA, 3915 bp, Rattus norvegicus
  Genbank Accession No. NM_031544
tgtgtgtgtgtgtgtgtacatgcgcgcgcccgtgtgtgttgggaggggcgggaaggtgattcaagggaccagttcaacacctggagaacaccaacgcttgctggtcggtttagctaccaagaccgagatgcctcgccaattccccaagttgaacatgtccgatttggacgaacatgtccggctgttggcagagaaggtgttcgctaaggtgctccgagaagaggacagcaaagatgttatgtccctgtttactgtccccaaggactgtcccatcggacagaaggaagccaaggagagggagctacagaaggagttggcagagcagaagtctgtggagacagcaaaaagaaagaagagtttcaagatgatccggtcgcagtctatgtccctgcagatgccaacacaagactggaaaggtcctccatctgtcagtccggccatgtctcctacaacccctctggtccttggagctgcttctaagcctgggctggcaccctatgacatgcctgagtatcagcgagccaccatcagtggagattactgtgcagggatcactatggaagactatgaacaggctgccaagagcctggccaaggccctgatgatccgggagaagtatgcacggcttgcctatcaccgcttcccgcggaccacagcccagtacctggctcatcagggggaaagtgtgcctttggaagagggtctcccagacttccaccctcccccactgccccaggaagacccttattgcctggacgatgcgccccccaacctgggctacctggtccgcatgcagggaggtgttctctttgtgtatgacaatcagacgatgttggaacgccaggaaccccacagcctgccctaccctgacctggagacctacatcgtggacatgagccatattctggcactcatcaccgatggccccacgaaaacctattgtcaccggcgactgaactttctggaatccaagtttagccttcatgagatgttaaatgaaatgtcagagttcaaggaattgaagagtaatccccacagagacttttataatgtgagaaaggtagacacacacatccatgcagcggcctgcatgaatcagaagcacctgctgcgtttcatcaagtacacataccagacagagccggacagaactgtggccgagaagctcggccggaagatcaccctgcggcaggtgtttgacagcctgcacatggacccctacgacctcacagtggactcgctggatgttcatgcgggccggcagacatttcacggcttcgacaagttcaactccaagtacaaccctgtgggggccagtgagcttcgggacctgtatttaaaaactgaaaactacctggggggagagtactttgctcgcatggtcaaggaagtggcccgggaattggaggacagcaagtaccagtactcagaaccccggctgtccatctatggtcgcagtcctaaggaatggtctagcctggcccgctggttcattcagcacaaggtctactcgcccaacatgcgttggatcatccaggtgccgcggatctatgatatatttaggtcaaagaaactactgccaagctttgggaagatgctggagaacatcttcctgccccttttccaggctactatcaaccctcaagaccatcgggagcttcacctcttccttaaatacgtgacagggtttgacagcgtggatgatgagtccaagcacagtgaccacatgttctcagacaagagccccagcccagacctctggaccagcgagcagaacccaccctacagttactacctgtactacatgtatgccaacatcatggtgctgaacaacctccgcagggaacgaggcctgagcacattcttgttccgacctcactgtggggaagccggctccatcactcacctagtgtctgccttcctgactgcagacaacatttcccacgggctgctcctcaagaagagtcctgttttgcagtatctctactaccttgctcagattcctattgccatgtctcctctcagcaacaacagcctgtttctggaatattccaagaacccacttcgggaattcctacacaagggattacacgtctctctctctactgatgaccccatgcagttccactacaccaaggaagcgctcatggaggagtacgccatcgcagcccaagtgtggaagttgagtacgtgtgacctgtgtgagattgccaggaacagcgtgctgcagagcggcctctcacatcaggagaagcagaagtttttgggtcagaattattacaaggagggaccggagggcaatgacatccgaaagacaaatgttgcacagatccggatggctttccgctacgagaccctgtgtaacgagctcagctttctgtccgatgccatgaagtcagaggagatcacagccctggcggactaggccagcgatccacacacactttcatcttttggtttaatgtcaggtctgctggggctaacggtgcccagatctcaaaccggggcttccgtctgtgacgaggacacctctgaagaaatctcaagctcccagttttggttgcactttatgaacatgctcacttcattagcgtttctgagccagaggctggctctcttccatggggctctgggagctggcactgtgtacacctgctccttggttgtccgagtctcctgtgattaccaatgtttatatggttggggctgggactttgcaaggctgaatgccaagtgacacaaggcctgtctggtgtctgccacagtcctcccagcagaccctgtagagcaattctctctttggtatctggctggctggctgcctgaacccccaccaaagccccttttataaagggctacctagagaaaatacaaagctccctgctgacgattgtgcacttttaaaacagtttttttccctgtgagcacccctccttcctgtctaggtaggaagcccaacgcaccctctgaggtcatcacttctgttattttcctcatctaggaatgagtcatctcaaaccatgttctgtgaacccatctcatggtccactcctaggcctggggaagatacagggcgaggttctggggctgttctcacttttttgtttttttaaatgaaggcctttgaaaagcataggacctccgctccttttggctctaatgtcctatgattgtagctgtcaccaccttcccccaggagtcagaccagggactgactcctcaggggagtgaaatgtttcaggacatacaggactagagccaagttcctgatccagtcacacccggtccccgactcccctgcttccacctactattttaggcttcacatattttaatttttttttaaagaatcactgtaacagtgcattttattttaaagcagatttcttcagaagctatcatggtcccagggaccaggtagagttaagtttaatgtggactctagctttatcagactactcatctttgttactagtgcctagaacatagtaggtgctcaataaatacatatggagtaattgaattactttctcttttggcatctgtatgtacagaatactgaacaatgttcaaagatcttcctaactgttcacaaggcaggaagtcctgtaccatacttagatgaacctaattgcacctggaagatgctcatgtaactaattacccccgtcctgtgactctgccagccttccagtgttcacacagcgtatggaaggaaccatgtcatgccttactaggcaaataaacataccaccctacatagctgattatgaaaccgaatgaaacctgtcgttatgagggattatttttgaaaagcctccatttgtatacatttgcccaaacatagcaagtattgtacagtttttcattgtatcaaatacttttttaaagactacaaataaagtctgttaggac

SEQ ID NO: 3809 - DNA, 628 bp, Rattus norvegicus
  Genbank Accession No. NM_031545
gcgagacaagagagagcaggacaccatcgcagctgcctggcccatcacttctgcagcatggatctccagaaggtgctgccccagatgattctgctcctgcttttccttaatctgtcgccgctgggaggtcactcccatcccctgggaagtcctagccagtctccagaacaatccacgatgcagaagctgctggagctgataagagaaaagtcagaggaaatggctcagagacagctctcaaaggaccaaggccctacaaaagaacttctaaaaagagtccttaggtctcaagacagcgccttccggatccaggagagacttcgaaattccaagatggcacatagttcaagctgctttgggcagaagatagaccggatcggcgcagtcagtcgcttgggctgtgacgggctgaggttgttttaggaagacctcctggctgcagactccggcttctgactctgcctgcggctcttctttccccagctctgggaccacctctcaagtgatcctgtttatttatttgtttatttatttatttttatgttgctgattttctacaagactgtttcttatcttccagcacaaacttgccacagtgtaataaacatagcctatttcttgcttttgg

SEQ ID NO: 3810 - DNA, 1605 bp, Rattus norvegicus
  Genbank Accession No. NM_031546
agtcattacaacccaggtgtggatgctggagtgtttcctttgtcttctattttaaagatatcttgaaaaaaacctgtcactgtccttttcctgcgaccatgtcttccatcaagattgaatgtgttttaagggagaactacaggtgtggggagtcccctgtgtgggaggaggcatcaaagtgtctgctgtttgtagacatcccttcaaagactgtctgccgatgggattcgatcagcaatcgagtgcagcgagttggtgtagatgccccagtcagttcagtggcacttcgacagtcaggaggctatgttgccaccattggaaccaagttctgtgctttgaactgggaagatcaatcagtatttatcctagccatggtggatgaagataagaaaaacaatcgattcaatgatgggaaggtggatcctgctgggagatactttgctggtaccatggctgaggaaacggccccagctgttctggagcggcaccaagggtccttgtactccctttttcctgatcacagtgtgaagaaatactttgaccaagtggatatctccaatggtttggattggtccctggaccataaaatcttctactacattgacagcctgtcctacactgtggatgcctttgactatgacctgccaacaggacagatttccaaccgcagaactgtttacaagatggaaaaagatgaacaaatcccagatggaatgtgcattgatgttgaggggaagctttgggtggcctgttacaatggaggaagagtaattcgcctagatcctgagacagggaaaagactgcaaactgtgaagttgcctgttgataaaacaacttcatgctgctttggagggaaggattactctgaaatgtacgtgacatgtgccagggatgggatgagcgccgaaggtcttttgaggcagcctgatgctggtaacattttcaagataacaggtcttggggtcaaaggaattgctccatattcctatgcagggtaaactgcagctcttccttgctgtcagaagaaaaagctttgaagacaactggagaattaagggagagaaatcaatgaactttcaatcttgtttttttaatgaggcagtgatattatagcatggttaaactgctttaatttacacttttgattgggtgctggggaataaacctaaagcatggcatattaatgaagaacatatggtaaccatgaactccatctctggattcctttatttacaattttttaaaggttgaatattcgcaccagagaatgacaagtggttttgacaacatactctaggccttctattaaaaacaatctgtagaaaaggagctcaactatcaatcatcctgatcaattgctctggggcttgaaatgagacaatttccattctttttttttgcattccatacttgctgtacataaggcttccaaaaaatcaacgcatagaaacttagttgtaatttataatgattgtgtgacttttcatgtgttattttacaaactaaaatattaccagatgttattcaaacactggagcacaaactgtggttttaactgccacctagtggctatacaaataaatgcatcacattacaaagaaaaaa

SEQ ID NO: 3811 - DNA, 734 bp, Rattus norvegicus
  Genbank Accession No. NM_031553
aggttaaaattggacaaagatccaccacctttaggacaggtgttcaagaaccctgcagataacacaattctgacagtatttcatgacaatggatggcgacagctctacaacagatgcttctcaactagggatttctgcagactacatcggaggaagtcattatgtgatccagccccacgatgatactgaggacagcatgaatgatcatgaagatacaaatggttcaaaagaaagtttcagagaacaagatatttatcttcccattgcaaatgtggctaggataatgaaaaatgccatacctcaaacaggaaagattgcaaaggatgccaaagaatgcgttcaggagtgtgtgagtgagtttataagcttcataacatctgaagcaagtgagcgctgtcaccaggagaagcggaagaccatcaacggggaggacattctgttcgccatgtccactctcggcttcgacagctacgtggagcctctgaaactgtacctccagaagttcagagaggccatgaagggagagaagggcattggtggggccgtgtctgctacagatggactcagcgaggagctcacggaagaggcattcactaaccagttaccggctgggttaataactgcagatggccaacaacaaaacgttatggtttacacgacgtcctatcaacagatttctggtgtccagcagattcagttttcatgatatgaaggaaggatggagccgggctgtg

SEQ ID NO: 3812 - DNA, 1618 bp, Rattus norvegicus
  Genbank Accession No. NM_031557
ggagccatgtcctgggccgctctgctcggccttctggccgtgttattactgttgctgctgctgctgagccgccggcgcgcgcggcgacccggtgagcctccgttggacctgggcagcatcccctggctgggccatgccttggagtttgggaaggatgccgccagcttccttaccaggatgaaggagaagcacggtgacatatttactgtgctggtggggggcaggtatgtcactgtcctcctggacccacactcttacgacacagtggtgtgggatctgcgtacacggctggacttccacccctacgccatcttcctcatggagaggatttttgatctgcagcttccaaatttcaaccccagcgaggagaaggccaggatgaagccgacgctcatgcacaaagacctgcaggcgctcacggaagccatgtataccaacctgcgcaccgtcctgctgggtgactccacagaaggaggcagtggctggcaggagaaaggtctgcttgagttctcctacagctccctgctcagcgctggctacctgaccctgtatggagtggaggcctcaccacgcacccacgagagtcaggccctcgaccgtgaccactcagccgacgttttccgcaccttccgccagctggatctgatgctccccaaactggctcgaggctccttgtcagtgggggataaagaccatgcatgcagtgtcaaaagccgcctgtggaagctgctgtctccagccggactggcctccagggctgaccggagcagctggttggagagttacctgagacatcttgaggagatgggggtatcagaggacatgcaggcccgggcactggtgctgcagctctgggccacacaagggaatatgggacccacggctttctggctcctcctcttcctcctcaagaacccggaagccctcgatgctgtccatgcagagctgaaacgcatcgtctggcaagcagagaagcctgttttacagatgaccgcactcccgcagaagattctagacagcatgcctgtgctagacagtgtgctcaatgagaccctccggctcacggccgcccccttcatcacccgtgaggtcatggcagacctggccttgcctatggcagacaggagggaattctctcttcgacgcggtgaccgccttctcctctttcctttcctgagcccccagaaggacccagaaatctacacagaacctgaagtctttaaatacaaccggttcttgaacccagatgggtcagaaaagaaagatttttacaaagatgggaaacggctaaagaattacaacatgccttggggcgcagggcacaaccagtgcctggggaagagctatgccatcaacagcatcaaacagtttgtggtcctgctgctgactcatttcgacctggagctggtcagtgaggacacagaggtcccggagtttgaccttagcagatatggctttggcctgatgcagccggaggaagatgtgcccatccggtaccgtaccaggctgtgacctgtggagcagacactacactcatctggggcctcctgacttcctgttgttcctccagaatgctgtgtccagaggaggggacagtgagaacaccgagagcaggaaa

SEQ ID NO: 3813 - DNA, 4377 bp, Rattus norvegicus
  Genbank Accession No. NM_031559
agtcggtcgactccgagctcagtgaggacctaaagcagaggactgtggtgcggaggacagtgcttgctccggggagtgcagagcaataggtccccactcaagatggcagaggctcaccaagctgtggccttccagttcaccgtcacccccgatggcattgacctccgcctgagccacgaagccctcaaacagatctgcctgtcggggctgcactcctggaagaagaagttcatccggttcaagaatggcatcatcactggtgtgttccccgcgaatccgtccagctggcttatcgtggtggtgggtgtgatttcatccatgcatgccaaagtggacccctccctgggcatgatcgcaaagatcagtcggaccctagacaccactggccgcatgtcaagccagacgaagaacattgtgagcggcgtcctctttggtacagggctctgggtggcagtcatcatgaccatgcgctactcgctgaaggtgctgctctcctaccacggctggatgtttgcagaacacggcaaaatgagccgcagcaccaagatctggatggctatggtcaaggtcctctcaggtcggaagcccatgttgtacagcttccagacgtctctgccacgcctgcctgtcccagctgtcaaagatactgtgagcaggtacctggaatctgtaaggccactgatgaaggaagaagacttccagcgcatgacagcactggcccaggattttgctgtcaacctcggacccaaattgcagtggtatttgaagctaaaatcctggtgggccacaaattacgtgagtgactggtgggaagaatatatctacctgcggggccgagggccgctcatggtcaacagcaactactacgccatggagatgctgtacatcaccccaacccatatccaggcagcgagagctggcaacaccatccacgccatactgctgtatcgtcgcacattagaccgtgaggaactcaaacccattcgtcttctgggatccaccattccactctgctcagcccagtgggagcgactcttcaatacttcccggatccctggggaggagacagacaccatccaacatatcaaggacagcaggcacattgttgtgtaccacagagggcggtacttcaaggtctggctctaccacgatgggaggctgctgaggccccgagagctggagcagcagatgcagcagatcctggatgatccctcagagccacagcctggggaggccaagctggccgccctcactgctgcagacagagtgccctgggcaaagtgtcggcagacctattttgcacgagggaaaaataagcagtccctggatgcggtggaaaaggcagcgttcttcgtgacgttggacgaatcggagcagggatacagagaggaggatcctgaggcatccatcgacagctacgccaaatccctgctgcatggaagatgctttgacaggtggtttgacaagtccatcacctttgttgtcttcaaaaacagcaagataggcataaatgcagagcactcctgggcggacgcgcccatcgtgggccatttgtgggagtatgtcatggccaccgacgtcttccagctgggttactcagaggatggacactgtaaaggagacaccaaccccaacatccctaagcccacaaggctacaatgggacattccaggagagtgccaggaggtcatagatgcatccctgagcagcgccagtcttttggcaaatgatgtggacctgcattccttcccatttgactctttcggcaaaggcttgatcaagaagtgccggacgagtcccgatgccttcatccagctggcgctgcagctcgcacattacaaggacatgggcaagttctgcctcacatatgaggcctccatgacccggctcttccgagaagggaggacagagactgtacgctcctgcactatggagtcctgcaactttgtgcaggccatgatggaccccaagtcaacggcagagcagaggctcaagctgttcaagatagcttgtgagaagcaccagcacctgtaccgcctcgccatgacgggcgccggcatcgaccgccatctcttctgcctctatgtggtgtccaagtatcttgcagtcgactcacctttcctgaaggaggtattgtctgagccatggaggttgtctacgagccagactcctcagcagcaggtggagctctttgactttgagaaaaaccctgactatgtgtcctgtggagggggctttgggccggttgccgatgacggctatggtgtctcctacattatagtgggagagaatttcatccacttccatatttcttccaagttctctagccctgagacagactcacaccgctttgggaagcacttgagacaagccatgatggacattatcaccttgtttggcctcaccatcaattctaaaaagtaaacccctgagccacacggaaggaaaacggaccctcgtgatacaaaccaaatgaatagatgttgctcctgaccataggacaggcagaaaattgctcttataaaactcagttttccttccagaaggtttaccgtcagtctccctagaacaacagtaggcttcacgtgtgaattgtgaccctactacatccagagatgccttggctccaggaatattgggcacagtcccctgatgtcttttgaatcggctcctactggataaagggatttaaatgctggtgaattcctggattctgggggttgtttcttcacatgtgttggaggtgacagacttcctcagtggtgaccctgtgaatacttgggcgtctgactccacccaggcagtgtgagcatcaccttgtggaaagagaaagtgtcttcagagccagcagaggcaacagctgtagctaacacatctgtaacacactaatggaatggttaggcctggggattaaggttctgctatgagtgacagccactgtccctttggaagttcacatttccaggaagcagagtaccacctccccagtgccaccttcctcacacatcttcaaaacccagtgccttaaagaaggggcccattggcaagcgggaccatagagaagacttagcatctgtgaagcctttgggtggatatgtgaggatgctgcttccccttactggttcctgcataaagatgtccctaagtaagcacttcccccacccctagaaaatgaggtccttggtgaaggcagggatgctggagtctcattgcctgccagttccattaagccacaaaatagcagacatgtgtccacagagggaggggcttggtagtcaaaggctgcatagctggacaacagcgggagagtgtggcttgctgtatttgacagctgttggcaagaggagtgagaccctggtcaccaagtcagacatactgacacaggcagccaaagctcacggagccaggagatatagatagatactggcttgtattctggcagatacacccctgggcttatcttctaatcccacccagtcagattccaaccagagtcaaattccatagaaggctaggtcattttggcgacagactcagggatctcaagtaatgggtgcttttacccacatgccatccctcagtgggagtgcctttcttgaaagcatccaatgggctaaagcagctctaccaagtctgtttggtatttaatgtaaacattagcattaatggagtggtctctcctacctgtcaccatcctgtcctgacaagcttagctctccgaggtttacatcatgtatttattttccagtgcccctttggccttgtttgattcctgcccctgtgccagaagtggcccagaagtgaggggtggggtgaccagcagtgcagagaggtgctggctgaacagttcatgtgtgtcttatgggtatacatgtataaattttgtaatgtaaaaaaaaaaatcatacctaaaagggccaaagttttttttttttttactaaaaccaagaaaacaaaagacaacataaagacataagcagaaacaaactgttgtaagtcagagcggcctgactctcgctgctgtgaccactcaccaacctgtgttactcagagtagcccggctagtgcccgagtgggacattcctctctcaggtttccagtgtccttgctgctcctgagcagttaccaatgcaatttcgcattccttacaaggcagaagagtgggctctcactgtatgtgttcaaaggaggaggtaagactattgtgtatttaatttaatgtggaacaaaatatagtcttaccgcagccaaggttcaaatttggtgttctaatctgtccattgcatgtaaataccatatctgtttggatataaatcttagaagtgcatgtgtgagcgaatgtagctggccattaataaaacattaatactgtctact

SEQ ID NO: 3814 - DNA, 2436 bp, Rattus norvegicus
  Genbank Accession No. NM_031561
cggcattgtaattgtacctgtgagttggcaagaagcaagtgctcttccttgattctgctgcacgaggaggagaatgggctgcgatcggaactgtgggctcattactggagccgttattggtgctgtcctggctgtgtttggaggcattctcatgccggttggagacctactcattgagaagacaatcaaaagggaagttgtccttgaagaaggaaccattgctttcaaaaactgggtgaaaacgggcaccactgtgtacagacagttttgggtctttgacgtgcaaaacccagaggaagtggcaaagaatagcagcaagatcaaggttatacagagaggtccttacacatacagagttcgctatttagccaaggaaaatataactcaggaccccaaggacagcactgtctcttttgtacaacccaatggagccatctttgagccttcactgtctgttggcacagagaatgacaacttcacagttctcaatctggctgtggcagctgcaccacatatctacacaaactcatttgttcaaggtgtgctcaacagccttatcaaaaagtccaagtcttctatgttccaaacacgaagtttgaaggaactcttgtggggttacaaagatccattcttgagtttggttccatatcctataagtaccacagttggtgtgttttatccttacaataacactgtagatggagtttataaagtttccaatggaaaggataacataagcaaggttgccataattgatacctataaagggaaaaggaatttgtcctattgggaaagttattgcgacatgattaatggcacagatgcagcctcctttccacctcttggtgagaagtctcgaacactgaggttcttttcctctgacatttgcaggtccatctatgctgtgtttgaatctgaagtgaaccttaaaggaatccccgtatacagatttgttcttccagccaacgcctttgcctccccactccagaacccagacaaccactgtttctgcactgaaaaagtaatctcaaataactgtacgtcgtatggtgtgctggacattggcaagtgcaaagaagggaaacctgtgtacaattctcttccacatttcctacatgcaagtcctgatgtctcagaacctatcgaaggcttgaatcctaccgaagatgagcataggacatacttggatgtggaacccataactggattcactctacagttttccaaacgactgcaggtcaacatactggtcaagccagctagaaaaatagaagcactgaagaatctgaagagaccttacattgtacctatactgtggctaaatgagactgggaccatcggcgatgagaaagcagaaatgttcagaaaccaagtgaccgggaaaataaagctcctgggcctggttgagatggtcttacttggtgttggagtagtgatgtttgttgcttttatgatttcatactgtgcttgcagatctaagaatggaaaataagtagtggatgagcctacattatgcactagctacatttttggtaaaaccaatctccaaaacgaagacttaagacatgcttgtttttataaaacacacctatctgtagttgaagaaacggtggtgtgcgcgctctctctcttattgcagatatatattcattcatatattgcaataagccacagcatattttgacaagatcaatatgtcactaagcctatatttttaataaaatcttgtattttgttaagtccatcatctgcaactgagtggacttcaatttctgcagaactaattatcttttttggttctgatttactgatttttttttcctgttgccaaatttcaagaatgtatatattctaagaaacgctttgttcctcatcgaagtaaactgttatcatgtctggggtgaccctttcatttatagcaaatgttccttgtgactgtcagcacatgatatgtcatttattacatcattttaaagatttaaggatgaaaaatgaacaattcacatatgaaccattgctaatatattgtttaagcctctccctctctggtgtccttggcaacaacaaggccaggtatcacagatattttttctttttactttcttaacacagagcttaatatgttctgttcctcgccatgaaatgaactatttttagcacattttagctcttgaattttaagtatgttgtcaagttccaggctgcctagctcttttgaaaactgagtaggtttttctctttctgctcagccacaactaatgtaacttcagagagctgttatagtggtaaaagatgtaatttataataaatggattatgatatagaatcttacaaaagctagaattggctttaaatatgtatttgtggtaatatattctgcttttataatcacccagaaataactggtttctaacattaaagatgttcttaaattcc

SEQ ID NO: 3815 - DNA, 1489 bp, Rattus norvegicus
  Genbank Accession No. NM_031563
gaattccgagagccccaccgccgccgccggcctagtcaccatcacacccgggaggagccgcagccgtcgccgccggccccagtcaccatcaccgcaaccatgagcagcgaggccgagacccagcagccgcccgccgcccccgccgccgccctcagcgccgccgacaccaagcccggctccacgggcagcggcgcgggtagtggcggcccgggcggcctcacatcggcggcgcccgccggcggggacaagaaggtcatcgcaacgaaggttttgggaacagtaaaatggttcaatgtaaggaacggatacggtttcatcaacaggaatgacaccaaggaagacgtatttgtacaccagacggccataaagaagaataaccccaggaagtaccttcgcagtgtaggagatggagagactgtggagtttgatgttgttgaaggagaaaagggtgcggaggcagctaatgttacaggccctggtggagttccagttcaaggcagtaaatacgcagcagaccgtaaccattataggcgctatccacgtcgtaggggtcctccacgcaattaccagcaaaattaccagaatagtgagagtggggaaaagaatgaaggatcggaaagcgctcctgaaggccaggcccaacaacgccggccctatcgcaggcgaaggttcccaccttactacatgcggagaccctatgcgcgtcgaccacagtattccaacccccctgtgcaaggagaagtgatggagggtgctgacaaccagggtgcaggagagcaaggtagaccagtgagacagaatatgtatcggggttacagaccacgattccgcaggggccctcctcgccaaagacagcctagagaggatggcaatgaagaggacaaagaaaatcaaggagatgagacccaaggtcagcagccacctcaacgtcggtatcgccgcaacttcaattaccgacgcagacgcccagagaaccctaaaccacaagatggcaaagagacaaaagcagccgattcaccagctgagaattcgtccgctcccgaggctgagcagggcggggctgagtaaatgccggcttaccatctctaccatcatccggtttggtcatccaacaagaagaaatgaatatgaaattccagcaataagaaatgaacaaagattggagctgaagaccttaagtgcttgctttttgcccgttgaccagatccactagaactgtctgcattatctatgcagcatggggtttttattatttttacctaaagatgtctctttttggtaatgacaaacgtgttttttaagaaaaaaaaaaaaaaggcctggtttttctcaatacacctttaacggtttttaaattgtttcatatctggtcaagttgagatttttaagaacgttcgatttttaatttgtaataaagtttacaacttgattttttcaaaaaagtcaacaaactgcaagcacctgttaataaaggtcttaaatggaattc

SEQ ID NO: 3816 - DNA, 650 bp, Rattus norvegicus
  Genbank Accession No. NM_031570
cactccgtaagacgaagccatgtctagctcgagcgccaagattgtgaagcccaatggcaagaagcgagacgagttcgagtctggcatctctcaggcgctgctcgagctggagatgaactccgaactgaagacgcagctgtgggaactcaacatcaccgcggcaaaggaaatcgaagtcggtggtggtcgaaaagccatcataatttttgtaccagttcctcagctgaaatctttccagaaaatggccaagtccggcaaggttcgcgaattggagaaaaagttcagtgggaaacacgtagtcttcattgctcagaggaggattctgcccaagccaacccgaaaaagccgtacgaaaaataagcaaaaggcccagaagccgaccctgacgagcagtgcagaccgacgcatccttgaggatttggtcttcccaagtgaaattgtgggcaagaggatccgtgtgaaactggtaggcagccggctcataaaagttcatttagacaaagcacagcagaacaacgtggagcacaaggtcgaaactttttctggcgtgtacaagaagccactaggcaaggatgttaactttgaattcccagaagtttcagtttaaagaaaaatgactgaataaaatgtcattcataataaaaaaaaaa

SEQ ID NO: 3817 - DNA, 1714 bp, Rattus norvegicus
  Genbank Accession No. NM_031572
atggatccatttgtggtcttggtgctcagtctgtcctttctgcttctcctgtatctatggagaccaagccctgggagagggaagcttcctcctggccctactcctctcccaatttttggaaattttcttcagatagatatgaaggacatccgtcaatcaatatccaatttttctaaaacctatggccctgtgttcactttgtatttcggctcacagcctactgtggtattgcatggctatgaggcagtgaaagaagccctcattgattatggggaagagttctctggaaggggaagaatgccagtttttgaaaaggctactaaaggactgggcattagttttagccgtggaaatgtatggagagccacaagacatttcacagtcaataccctgaggagtttgggcatggggaaacggaccattgagatcaaagtgcaagaggaagcagagtggctagtgatggaactgaagaaaaccaaaggctcaccctgtgatcccaaattcatcataggatgtgctccctgcaatgtcatctgctccattatcttccagaatcgtttcgattataaagataaggattttcttagcttgatagaaaacgtgaatgagtacattaaaattgtgagcactcctgcatttcaggttttcaacgcattccctattcttctggattattgtccaggaaatcataagacacattcaaaacattttgctgctattaagagttaccttttgaagaaaataaaagaacatgaagaatcgttggatgtttcaaatcctcgggacttcattgattacttcctaattcaaagatgtcaggaaaatggcaatcagcagatgaactatacacaagaacatctggcaatcctggtgactaatttgtttattggtggaacagagacatcaagcttaacgctgagatttgcacttttgctcttgatgaagtacccacacatcacagataaagtccaggaagagattggccaagtgattgggagacaccgcagcccctgtatgttggacaggatccacatgccctacacaaatgccatgattcatgaggttcagagatatattgaccttgccccaaatggtttgttgcatgaagtgacctgtgacactaaattcagagactacttcatacccaagggaacagcagtactaacatcacttacatcagtgctgcatgcacgtaaggaattccccaacccagagatgtttgacccaggtcactttctagatgagaatggaaactttaagaaaagtgactacttcatgcctttctcagcaggaaaacggaaatgtgtgggagagggccttgccagtatggagctgtttttgttcctgaccaccattttacagaatttcaaactgaaatctctgtctgatccaaaggacatcgatataaactcaatacgttctgagttttcatcaattcctccaactttccagctgtgcttcattcctgtctaatgaagacctaaaagcagaaatgaagatgaggaaacattctattgtgatgtcttctgacatcacccacagaaatttctatttacaactgtcctagaaataccactatgtactttcttcttcccacagcttatgtcttctaattgcccaaagataacaattctacattatacagtttctgaagttaatgtaaaagattctgagaaaaaaaagtcaattcaaataaaaaaaagttctaatgtga

SEQ ID NO: 3818 - DNA, 2441 bp, Rattus norvegicus
  Genbank Accession No. NM_031576
gatctggtcggtaccggagagcgcaggttgtatcaccaacatgggggactctcacgaagacaccagtgccaccatgcctgaggccgtggctgaagaagtgtctctattcagcacgacggacatggttctgttttctctcatcgtgggggtcctgacctactggttcatctttagaaagaagaaagaagagataccggagttcagcaagatccaaacaacggccccacccgtcaaagagagcagcttcgtggaaaagatgaagaaaacgggaaggaacattatcgtattctatggctcccagacgggaaccgctgaggagtttgccaaccggctgtccaaggatgcccaccgctacgggatgcggggcatgtccgcagaccctgaagagtatgacttggccgacctgagcagcctgcctgagatcgacaagtccctggtagtcttctgcatggccacatacggagagggcgaccccacggacaatgcgcaggacttctatgactggctgcaggagactgacgtggacctcactggggtcaagtttgctgtatttggtcttgggaacaagacctatgagcacttcaatgccatgggcaagtatgtggaccagcggctggagcagcttggcgcccagcgcatctttgagttgggccttggtgatgatgacgggaacttggaagaggatttcatcacgtggagggagcagttctggccagctgtgtgcgagttctttggggtagaagccactggggaggagtcgagcattcgccagtatgagctcgtggtccacgaagacatggacgtagccaaggtgtacacgggtgagatgggccgtctgaagagctacgagaaccagaaaccccccttcgatgctaagaatccattcctggctgctgtcaccgccaaccggaagctgaaccaaggcactgagcggcatctaatgcacctggagttggacatctcagactccaagatcaggtatgaatctggagatcacgtggctgtgtacccagccaatgactcagccctggtcaaccagattggggagatcctgggagctgacctggatgtcatcatgtctctaaacaatctcgatgaggagtcaaacaagaagcatccgttcccctgccccaccacctaccgcacggccctcacctactacctggacatcactaacccgccacgcaccaatgtgctctacgaactggcacagtacgcctcagagccctcggagcaggagcacctgcacaagatggcgtcatcctcaggcgagggcaaggagctgtacctgagctgggtggtggaagcccggaggcacatcctagccatcctccaagactacccatcactgcggccacccatcgaccacctgtgtgagctgctgccacgcctgcaggcccgatactactccattgcctcatcctccaaggtccaccccaactccgtgcacatctgtgccgtggccgtggagtacgaagcgaagtctggccgagtgaacaagggggtggccactagctggcttcgggccaaggaaccagcaggcgagaatggcggccgcgccctggtacccatgttcgtgcgcaaatctcagttccgcttgcctttcaagtccaccacacctgtcatcatggtgggccccggcactgggattgcccctttcatgggcttcatccaggaacgagcttggcttcgagagcaaggcaaggaggtgggagagacgctgctatactatggctgccggcgctcggatgaggactatctgtaccgtgaagagctagcccgcttccacaaggacggtgccctcacgcagcttaatgtggccttttcccgggagcaggcccacaaggtctatgtccagcaccttctgaagagagacagggaacacctgtggaagctgatccacgagggcggtgcccacatctatgtgtgcggggatgctcgaaatatggccaaagatgtgcaaaacacattctatgacattgtggctgagttcgggcccatggagcacacccaggctgtggactatgttaagaagctgatgaccaagggccgctactcactagatgtgtggagctaggagctaccagcctcccacccctcgctccctgtaatcacctaacttctgccgacctcacctctggtggttcctgcctggcctggacacagggaggcccagggactgactcctcctggcctgagtggtgccctcctgggcccctaggcagagcccggtccattgtatcaggcagcccagccccagggcacatggcaagagggactggacccacctttgggtgatgggtgccttaggtcctctgcagctgtacagaaggggctcttctctccacagagctggggtgcagcccccacacgtgattttgaatgagtgtaaataattttaaataacctggcccttggaataaagttgttttcagtaaatt

SEQ ID NO: 3819 - DNA, 616 bp, Rattus norvegicus
  Genbank Accession No. NM_031577
gtacgtgctctggaacatgcaggcccaggacggagaaggaggcgtcctgctcctgccagccttaagatgggaattttagggtctggacatcactggtgctccaggtcagctttcctggttgcagatctctcctggtcaaggctcccagctcgcctggatcccacaactgcacagtgtcccgcccaggagtgaaggatgccactctgggtgttctttgtgctcctcaccctcaccagtggctcccactgctcactgcccccctcacctcccttcagggtgcggcggcatgcagacgccatcttcaccagcagctaccggagaatcctgggccaattatatgcccgcaaactgctgcacgaaatcatgaacaggcagcaaggggagaggaaccaggaacaaagatccaggttcaaccgccatttggacagagtgtgggcagaggacaagcagatggccctggagagcatcttgcagggattcccaaggatgaagctttcagcggaggcttgagccctcggcccccaaacatagctggaccctgttacttctacttcagttctgatcttctccttcctctgtgaatacaataaagacccatctcatctgcaaaaaaaaa

SEQ ID NO: 3820 - DNA, 2638 bp, Rattus norvegicus
  Genbank Accession No. NM_031579
cacaatcttcaatgagtagacatattcctcagttctgtggtgttctcggtcacacatttatggagtttctgaagggcagtggagactactgccaggcacagcacgacctctatgcagacaagtgaactgtagaaattcattactactccaccaagaagcccccataagagtggatagcctggacacagtcgtgttgaattgaaatctgcagagcattttccaagagctcagacctggatggggtaaacctcagtgcacttcctctgtatcgcctcagtattcctggattgaagagtcactgcttcttgtgaggaggttcatttcattgcccgtttctcccgactcatactcaaagcactgagaatttcaagtggagtatattgaatattgaagtagacttcaggttgttttttggttttgttttggttttttgttttgttttgttttgttttgttttggttttcagtttttgtttggaatcatttctgtattcaattttttaattctttcataaccctattgggtgtttttttaaactaaattaacatggctcgaatgaaccgccctgctcctgtggaagtcacatacaagaacatgagatttcttattacacacaatccaaccaatgcgaccttaaacaaatttatagaggaacttaagaagtatggagttaccacaatagtaagagtatgcgaagcaacttacgacactactcttgtggagaaagaaggcattcatgttcttgactggccttttgatgatggtgcaccaccatccaaccagattgttgatgactggttaagtcttgtgaagattaagtttcgtgaagaacctggttgctgtattgctgtccattgtgtcgcaggccttggcagagctccggtgcttgttgccctagcattaattgaaggtggaatgaaatatgaagatgcagtacaattcataagacaaaagcggcgcggagcttttaacagcaagcaacttctgtacctggagaagtaccgtcctaaaatgcggctccgcttcaaggattccaacggtcatagaaacaactgttgtattcaataaaactggggtgcctgatgccattgccttggaagaggaacttcagatgggacctgatttgttatttacccaatgtgtccacttacctgtggaagctccaggggaatattgaaaaagttttaccaggccacaagcttgacagaattgcaacctctataattgggctatgatcaacacgtttggacacttagcaaaagatttttgctggtcagcatttaaaatgtgcttattatttgtaccaattgacctttcctaaaataaggtattgagtaatgtcattaaatgtactcctgtgccagaatattattagtctataaggaatttagaaggattaggtgccaaaatacccagcacaatacttgtatatttttagcatcatacagaaccaaaattccaagaactaagaactctccagaccttccatggtgtattccttcagtcatttcaaacaccgcagggcttctcttgttatctgcctgctcactctatgtttacatctcccacacttacaccagaacacatcaggtttgcttagctatcttttaagtcttgcaatgattatttaatgtctctgtcttattttgtgctgttttgggaaacctccatttgaaaatcaactttgttacagaagcacatatcttcaataatgtctccagacaaaaagccttatagttaatttaatgtttgcactcgggtgcaacctgacagggagggcctgaacaagaaaggagaggaggctattaaatatttttagtaatatgttgcctttgtcttgtgcagaacatgtagagtatgctctttaatttagtaaatatttttaagacgtagagatacattgttgtagctaaccacttaatcaaaatttctgaaattcttgtgttttccatacctatctgaggttttccaacttgtttgaattatggttttccccttctcttcccaatctcttgcaaaaaagtaaaagtgggatctgctagtgaactgagcagaaatattttatacgccttttgagctatgtaacttaataattggatacttgatcatttgttttattatgtaatcgataaaatggtgatgtgtattaatgttagttcaaccatatatttatactgtctgggaatgtgtggttatagttctgtgggagaaatagtttgtcagtgttcaccagcttgtaaaaacttagtgcgagagcttcaacatctaaataaatgatgaaacgcattcgtcactgaggtcactttgcttaaaattaacttaatttgtagaaaacagtggattcaattattatcatttcagtttatggacaaatttgttagggttaccaagtgcgtttaaaaattgctctttaaaggtctagataattgtgaatcaattgaatgttgggtaccaagggaaaacggtttgtaatagttgatgaccttgatttttaattcaattccaccagtcacttgtagctttatgcagtttccaatccacttttctcatttttaagtttattacttacctgtatatattttgaaattaatttgaacctgcgtatttggcacatgatggcttataaattttaactttc

SEQ ID NO: 3821 - DNA, 4104 bp, Rattus norvegicus
  Genbank Accession No. NM_031583
gaggggccggtctgcgtctctcctgaccctgccgccgcgctgttgcggttctgaggtgaagctttcctcctgcggaggggcgcggagccatgtacatcaagcaggtgattatccagggcttccgaagttaccgagatcaaacaattgtagatcccttcagttcaaaacataatgttattgtgggcagaaatggatctggaaaaagcaactttttttatgcaatccagtttgttctcagtgatgaatttagtcatcttcgtccagagcagcgattggctttgttgcacgagggtacaggtcctcgtgttatttctgcttttgtggaaatcatttttgacaattcagacaaccggttaccaattgataaagaggaagtttcgcttcgaagagttattggtgccaaaaaagatcagtatttcctagataagaagatggtcacgaaaaatgatgtgatgaatctccttgaaagtgctgggttttcgagaagtaatccttattacattgttaaacaaggaaagatcaaccaaatggcaacagcaccggattctcagagattaaagctgttgagagaagtagctggcactcgagtgtatgacgagcgcaaagaggaaagcatctccctgatgaaagaaacagagggcaaacgggaaaagatcaatgagttgttaaaatacattgaagagcgattacatactctagaggaggagaaggaggaactggcccagtatcagaagtgggataaaatgaggcgtgccctggagtacaccatctacaaccaggagctcaacgagactcgcgccaagcttgatgagctttctgctaagcgagaaacaagcggagagaaatccagacaattaagagatgcccagcaggatgcaagagataaaatggaggatattgagcgccaagttagagaactgaaaacaaaaatttcagccatgaaagaagaaaaagaacagctcagtgcggagagacaagagcagattaagcaaaggaccaagctggagcttaaagccaaggacttacaggatgagctggcagggaacagtgagcagcggaaacgtttattaaaagaaagacagaagctgcttgaaaaaatagaagaaaagcagaaagaactggcagaaacagaaccgaaattcaacagcgtaaaggaaaaagaagagcgaggaattgctagattggctcaagctacacaggaaagaactgatctttatgcaaagcagggtcgaggaagccagtttacatcaaaagaagaaagagataagtggattaagaaggaactgaagtctttagatcaggctattaatgataagaaaagacagattgctgctatacacaaggatttggaggataccgaggccaataaagagaaaaatctggagcaatataataaactggatcaggatctcaatgaagtcaaagctcgagttgaagaactggacagaaaatattatgaagtgaaaaataagaaagatgaactacaaagtgaaagaaattacttgtggagagaggagaatgcagaacagcaagcacttgccgctaagagagaagaccttgagaagaagcagcagcttcttagagcggcaacaggaaaggccattttaaatggaatcgacagcattaacaaagtgttagaccatttccggcggaagggtataaaccagcatgtgcaaaatggctaccatggcatcgtgatgaataactttgagtgcgaaccagctttctatacttgtgtggaagtcactgccggtaacaggttattctatcacattgtcgattcagatgaagtcagcacgaagatattaatggagttcaataaaatgaatcttcctggagaggtgactttcctgcctcttaacaagttagatgtgagggacactgcctatcctgaaactaacgatgctattcctatgatcagtaagctgaggtacaatcccagattcgacaaagctttcaaacatgtgtttggaaagacactcatctgtcggagcatggaggtttccactcagctagctcgtgccttcactatggactgcattactctggaaggtgatcaagtcagccatcgaggtgctctgactggaggctattacgacacaagaaagtctcgccttgagttacagaaggatgttaggaaagcagaggaggagctgggtgagctcgaagctaagctcaatgaaaacctgcgcagaaacattgaaaggattaataatgaaattgatcaattgatgaaccaaatgcagcagatagagacccaacagagaaaatttaaagcatccagagatagcaccttatcagagatgaagatgctaaaagagaagagacagcagtcagaaaagaccttcatgccaaagcaacgcagtttgcagagtctggaggccagtctgcacgctatggagtcgaccagagagtcgctgaaggcagagctagggacagatttgccctctcagctcagcctggaagaccagaaaagagtcgacgcactgaatgacgagatccggcagcttcagcagaaaaacagacagctgctgaatgaaagaattaaactagaaggcattattactcgagtagagacttacctcaatgagaatctgaggaaacgtctggaccaagtagagcaggaacttaatgaactgagagagacagaaggtggcactgttcttactgccaccacgtcacaacttgaagctattaataaaagagtgaaagatactatggcaagatcagaagatttggataattccattgacaaaacagaagctggaattaaagagctccagaaaagcatggagcgctggaagaacatggagaaggagcacatggatgccataaatcacgacactaaagagctggagaagatgaccaaccgacagggcatgctgttgaagaagaaagaggagtgcatgaagaagatccgagagctggggtcccttccccaggaagcatttgaaaagtaccagacactgagcctgaagcagttgtttcggaaacttgagcagtgcaacacagagttgaagaagtacagccatgtcaacaagaaggctctggaccagtttgtgaatttctctgagcagaaggagaaactgataaagcgacaggaagaattggacaggggctacaagtcaatcatggagttgatgaatgtactcgaacttagaaaatatgaagctatccagttaaccttcaaacaggtatctaagaactttagtgaagttttccagaagttggtacctggggcaaaagcgaccttggtgatgaagaaaggagacgtggagggcagccagtctcaggacgaaggagaggggagcggcgagagcgagaggggctctgggtcacaaagcagcgttccatcagttgaccagttcacaggagtcgggatcagggtatcatttacaggaaagcaaggcgagatgagagaaatgcagcagctttcaggagggcagaagtctctggtagcccttgctctcatttttgccattcagaagtgtgaccctgctcctttctacctgtttgatgagatcgaccaagctttggatgctcagcacagaaaagctgtgtcagatatgattatggaactagctgtacacgcccagtttatcactaccacttttaggcctgaactgcttgagtctgctgataaatcctccgggaagtcagaataaggtagtcacatcgacgtgatcacagcaagagatggccaaagactttgtagaagacgataccacgcatggttaactgaaagataacgcctgccgtcttggaagatgtgtatagtaatgtggtccgtacctgggaacgtaaattttaaaaataataattggttattactgagtttttggatttagaatacacagtccttttatacttgtctttgtattttataagctcccctgtaatgttacatttctacgtatagtcgaggaattttatttcctacacgacaaaaagtaagtgtcctcctattttaaatcttttgagattctaaatattcccaattattttatagcttctattaaataattggtttgtgcataacttagtgtaaatgtggccttttgtctttgtaattgttagaaacattcggtgggtattttgcataag

SEQ ID NO: 3822 - DNA, 852 bp, Rattus norvegicus
  Genbank Accession No. NM_031587
aattcggcacgagcgcgatggcacctgccgcgtcaaggctgagggtggaatccgagctccggtcgcttcccaagcgagcgctcgcccaatacttgctgtttctaaagttctatccggtggtcaccaaagctgtcagcagtggcattttgtcagcccttggaaaccttctggcccagatgattgagaagaagcagaaaaaagactctcgaagtctagaagtcagtgggcttctcagatatttagtttatgggttgtttgtcacaggtcccctgagtcactacctctacctcttcatggagtactgggtccctcctgaggttccctgggccagagtcaagaggctcctgctggatcgcctgttctttgccccaacctttctgctgctgttcttcttcgtcatgaacttgctggagggaaaaaacatcagtgtctttgttgccaagatgaggagtggcttctggcctgctctgcaaatgaactggaggatgtggacacccttacagttcatcaacatcaactatgtgcccttgcagttccgggtgctctttgccaacatggcagctctgttctggtatgcctacctggcctctctggggaagtgatgtctgatacaccgtggatgaggtgtggggagatccaaccaccagcaggagagagcagaatccatcattaaggacacctcatgactaaattatgtgattcaagatgccttaaaattacagagggaggaacgtgtcagtgtcggaatcatgtgcttcaaagagacagcactagtctcggtggagttaatcttagttgtcactgcaaacaggtaaaggtcaataaacagtgatgcagcctcgtgccgaattc

SEQ ID NO: 3823 - DNA, 3272 bp, Rattus norvegicus
  Genbank Accession No. NM_031588
gcggccgcagctgccgggagatgcgagcgcagaccggattgtgatcacctttccctcttcgggctgtaagagagcgagacaagccaccgaagcgaggccactccagagccggcagcggagggacccgggacactagagcagctccgagccactccagactgagcggacgctccaggtgatcgagtccacgctgcttcctgcaggcgacaggcgacgcctcccgagcagcccggccactggctcttcccctcctgggacaaacttttctgcaagcccttggaccaaacttgtcgcgcgtcaccgtcacccaaccgggtccgcgtagagcgctcatcttcggcgagatgtctgagcgcaaagaaggcagaggcaaggggaagggcaagaagaaggaccggggatcccgcgggaagcccgggcccgccgagggcgacccgagcccagcactgcctcccagattgaaagaaatgaagagccaggagtcagctgcaggctccaagctagtgctccggtgcgaaaccagctccgagtactcctcactcagattcaaatggttcaagaatgggaacgagctgaaccgcaaaaataaaccagaaaacatcaagatacagaagaagccagggaagtcagagcttcgaattaacaaagcatccctggctgactctggagagtatatgtgcaaagtgatcagcaagttaggaaatgacagtgcctctgccaacatcaccattgttgagtcaaacgagttcatcactggcatgccagcctcgactgagacagcctatgtgtcctcagagtctcccattagaatctcagtttcaacagaaggcgcaaacacttcttcatccacatcaacatccacgactgggaccagccatctcataaagtgtgcggagaaggagaaaactttctgtgtgaatgggggcgagtgcttcacggtgaaggacctgtcaaacccgtcaagatacttgtgcaagtgcccaaatgagtttactggtgatcgttgccaaaactacgtaatggccagcttctacaaagcggaggaactctaccagaagagggtgctgacaattactggcatctgtatcgccctgctggtggtcggcatcatgtgtgtggtggcctactgcaaaaccaagaagcagcggcagaagcttcatgatcggcttcggcagagtcttcggtcagaacggagcaacctggtgaacatagcgaatgggcctcaccacccaaacccaccgccagagaacgtgcagctggtgaatcaatacgtatctaaaaacgtcatctccagtgagcatattgttgagagagaagtggagacttccttttccaccagtcattacacttccacagcccatcactccacgactgtcacccagactcctagtcacagctggagtaatgggcacacggagagcgtcatttcagaaagcaactccgtaatcatgatgtcttcggtagagaacagcaggcacagcagtcccgccgggggcccacgaggacgtcttcatggcctgggaggccctcgtgataacagcttcctcaggcatgccagagaaacccctgactcctacagagactctcctcatagcgaaaggtatgtatcagccatgaccaccccggctcgtatgtcacctgtagatttccacacgccaagctcccctaaatcgcccccttcggaaatgtctccacccgtgtccagcatgacggtgtccatgccctctgtggcagtcagcccctttgtggaagaagagaggcctctgctgcttgtgacgccaccaaggctacgggagaagaaatatgatcatcacccccagcaactcaactcctttcatcacaaccctgcacatcagagtaccagcctcccccctagcccactgaggatagtggaggatgaggagtacgagacgacccaggagtatgagtcagttcaagagcccgttaagaaagtcaccaatagccggcgggccaaaagaaccaagcccaatggccacattgccaataggttggaaatggacagcaacacaagttctgtgagcagtaactcagaaagtgagacagaagacgaaagagtaggtgaagacacaccattcctgggcatacagaaccccctggcagccagccttgaggtggcccctgccttccgtctggctgagagcaggactaacccagcaggccgcttctccacacaggaggaattacaggccaggctgtctagtgtaatcgctaaccaagaccctattgctgtataaaacctaaataaacacatagattcacctgtaaaactttattttatataataaagtatttcaccttaaattaaacaatttattttattttagcagttctgcaaatagaaaacaggaagaaaaaaaaacttttataaattaaatatatgtatgtaaaaatgtgttatgtgccatatgtagcaatttttttacagtatttcaaaaacgagaaagatatcaatggtgcctttatgttctgttatgtcgagagcaagttttataaagttatggtgatttctttttcacagtatttcagcaaaacctcccatatattcagtttctgctggctttttgtgcattgcattatgatgttgactggatgtatggtttgcaaggctagcagctcgctcgtgttctctctctctctctctctctctctctctctgtctctctctctgtctctctctctctctctctctctctctctctctctctctctctctctctctctctgtctctctctctgcttcccgtagctcccaaccagtactgtcttggactggcacatccatccaaatacctttctactttgtatgaagttttctttgctttcccaatatgaaatgagttctctctactctgtcagccaaaggtttgcttcactggactctgagataatagtagacccagcagcatgctactattacgtatagcaggaaactgcaccaagtaatgtccaataataggaagaaagtaatactgtgatttaaaaaaaaaaacaaactatattattaatcagaagacagcttgctcttggtaaaaggagctaccattgactctaattttgactttttagttattgttcttgacaaagagtaacagcttcaagtacagcctagaaaaaaaaatgggttctggcctgctatcaggataaatctatcgacgtagatagattcaactcagtttcactttctgtcttgggggaaatgatccagccactcatatgacgaccaaccaaccacaggtgcctctgctccctgt

SEQ ID NO: 3824 - DNA, 1930 bp, Rattus norvegicus
  Genbank Accession No. NM_031589
aaaaacacagctcagcagatccgggcactggagagggagctgcaagcaggagcagtcaagagtgtggtcagaagcaccgtgagtggaccagcagggccggctttttctaccatggcggcccaaggctatggctattaccgcactgtcatattcacagccatgttcggaggctacagcctttactacttcaaccgcaaaaccttctcttttgtcatgccctccttggtggatgagatcgctctggacaaggacgatttggggctcatcacgagcagccagtcggcagcctacgccatcagcaagtttgtgagcggggtgctgtctgatcagatgagtgcccgttggctcttctcctctgggctgctcctggttggtctggtcaacgtagtcttctcgtggagctctacagtaccggcttttgctgctctctggtttcttaatggtctggcacaggggctaggctggcccccctgtgggaagatcctgaggaagtggtttgagccatcccagtttggtacttggtgggctgtgttgtcaaccagcatgaacctggctggaagcctgggacctatcttggcgacaatccttgctcagagctacagctggcgcagcaccctggccctgtctgggtcactgtgtgtggttgtctccttcttctgtctcctgctcatccacaacgaacctgctgatgttggactccgaaatctggaccctcgcccctccaagggcaaaaagggctcgtcaaaggaggagagcaccctacaggacctgctgctgtccccctatctctgggtgctctccactggctacctcgtggtctttggggtaaagacttgctgtacagactggggccagttcttccttatccaggagagagggcagtcggcccttgtgggtagttcctacatcagtgccctagaggttggaggccttgtaggcagcattgcagctggctatctgtcagacagggctatggcaaaggcagggctgtctgtgtatgggaaccctcgccacagcctgttgctgctcatgatggctggcatggcagcatccatgttcctcttccgggtaacagtgaccagcgactctcccaagatctggatcctggtattgggagctgtatttggtttctcttcttatggtcccattgccttgtttggagtcatagctaatgagagtgcacctcccaacttgtgtggtacctctcatgctattgtggggctcatggccaatgtgggtggatttctggctgggttacccttcagtaccatcgccaagcactatagctggagcacagccttctgggtggcagaagtgatctgtatagccagcacagttgtcttcttcttgcttcgaaatatccgcaccaagatgggccgagtatccaagaaggcagagtgaaaagagcactcactatagagcatccccaactgcaacctcattggcaggacacagaaaggaagagaggctgctctggctagaacagagcctttacatatctgtgtctacactgtctctctggacctccgtggtgctgcaagttaccagtggctaatgaggtcctatgctctatttaaatgatgtttggttttaggctccattggcttctgtttctaccttctagcagacagacaactcctaaattcagggtgtctcctatacccctcttcctctcctgagtccccatctcctagtgaggtggttctatctctgcagctgcagaatattaatggcctgtggtttctgctgtaccccaaggcttcttgttaggggtcaacactgttgccaatacctcagtccctaagggaggagaggaggccaccactctcatcagttacctggggacaaaagggaggaatgtagagagcaaactgtcttgtatagactaataaaactagatttgatactaaaaaaaaaaaaaaaaaaaaaa

SEQ ID NO: 3825 - DNA, 2622 bp, Rattus norvegicus
  Genbank Accession No. NM_031593
gcgcgctgcaggaagagtggcagaccgaagcggcctcgggctgcaaacggaggggcgctcgcgcggcgacggctgcagggctgacaccgctcagggcaggggggtcccaggcggctggaacgctctattctgaactgtgagtggatgatgctgttgcagccaagctgctgaacacactccgtggactcttccctgctgtgccttgcccatcggccgagataaaatggaagactcctacaaggataggacttcactgatgaagggcgccaaggacattgccaaagaggtgaagaagcaaacagtgaagaaggtgaaccaggcagtggaccgggcccaggatgaatacacccagcggtcctacagtcgattccaggatgaagatgatgatgatgactactacccacctggagaaacctacagtggggaggccaatgatgatgaaggctcaagtgaagccactgagggtcacgatgaagaagacgagatctatgaaggggaataccagggcatccccagcacgaaccaagggaaggacagcatagtgtctgtaggacaacccaaaggagatgagtacaaggaccgcagagagctggagtcagagaggagggctgatgaggaggagctcgcccagcagtatgagctgataatccaagagtgtggccatggccgtttccagtgggcccttttcttcgtcctgggcatggctctcatggcagacggcgtggaggtgtttgtggtgggctttgtgttacccagtgcagagacagacctatgcataccgaattcaggatctggatggctaggcagcatagtgtacctcgggatgatggtgggggcgttcttctggggaggactggcagacaaagtgggaaggaagcagtctcttctgatttgcatgtccgtcaacggattctttgccttcctttcttcatttgtccaaggttacggcttctttctcctctgtcgtttgctttcaggattcgggattggaggcgccattcccactgtgttctcctactttgctgaagtcctggcccgggagaagcgcggtgagcacctcagttggctctgcatgttctggatgattggcggtatctatgcttcagccatggcctgggccatcatcccccactatgggtggagcttcagcatgggctcagcctaccagttccacagctggcgcgtcttcgtcatcgtctgtgccctcccgtgcgtctcctcggtggtggccctcaccttcatgcccgaaagccctcggttcttgctggaggtaggaaaacatgatgaagcctggatgattctgaagctaattcatgataccaacatgagagcccggggccagccagagaaggtcttcacggtaaataaaatcaagactcccaagcaaatagatgagctgattgagattgagagcgacacaggaacctggtaccggaggtgttttgttcggatccgcacagaactgtacggaatttggttgacttttatgagatgcttcaactacccggtcagggaaaacaccataaagcttacgattgtttggttcaccctgtcctttgggtactatggactgtccgtttggttcccagatgtcattaaacacctccagtctgacgagtacgccctgctgactcggaatgtgcagaaggataaatatgcaaactttagcattaacttcaccatggaaaaccaggtccacaccggaatggaatatgacaatggcaggttcctcggagtcaaattcaaatcggtaaccttcaaggattcagtgtttaagtcctgcacctttgacgatgtgacctcagtcaacacctacttcaagaactgcacgtttattgataccctttttgagaacacagattttgagccctataaattcatagacagcgagtttcaaaactgctcgtttcttcacaataagacgggatgtcagattacttttgacgacgactacagtgcctactggatttactttgtcaactttctcgggacattggcagtgttaccaggaaatatcgtgtctgctctcctgatggacaggatcgggcgcttaacgatgctaggtggctccatggtgctctcggggatcagctgcttcttcctgtggtttggcaccagcgaatccatgatgataggcatgctgtgcttgtacaacggactgaccatctcagcgtggaactctcttgatgtagtcacggtggaactataccccacagaccggagagcaacgggctttggcttcttgaacgcactctgtaaagcagcggccgtcctgggaaacttaatattcggctccttggtcagcatcaccaaagcaatccctatcctgctggcttccaccgtgctcgtgtgtggaggactcgtggggctgcgcctgcccgacacaagaacccaggttctgatgtgacaaaagccattctcttctctcaccatgggtcagccctattgcctgactcaaggcttcagagtttttatgtatagaaaggtggccaagtatcagaactcaaacttttgctgtgacgtaaatgtagctgtgtattgtccccgccagtgtgatttgcagggtcctccccctcccccgcgccttgttatcttttcctaattgtgatgttcctgcttccg

SEQ ID NO: 3826 - DNA, 1997 bp, Rattus norvegicus
  Genbank Accession No. NM_031594
cgcagcgagcctgccggagctggtgggtggagctacgaccgggagccgacggtggcgaggggacccacagtgtccaaggcgcggagcggtcggcggagccatggcgggctgctgctccgtgctcgggtccttcctgttcgagtacgacacgccgcgcatcgtgctcatccgcagccgtaaagtggggctcatgaaccgcgcggtgcagctgctcatcctggcttacgtcatcgggtgggtgttcgtgtgggaaaagggctaccaggaaacggactccgtggtcagctcggtgacaaccaaagccaaaggtgtggctgtgaccaacacctctcagcttggattccggatctgggacgtggcggactatgtgattccagctcaggaggaaaactccctcttcatcatgaccaacatgatcgtcaccgtgaaccagacacagagcacctgtccagagattcctgataagaccagcatttgtaattcagacgccgactgcactcctggctccgtggacacccacagcagtggagttgcgactggaagatgtgttcctttcaatgagtctgtgaagacctgtgaggtggctgcatggtgcccggtggagaacgacgttggcgtgccaacgccggctttcttaaaggctgcagaaaacttcaccctcttggtaaagaacaacatctggtaccccaagtttaacttcagcaagaggaacatcctccccaacatcaccacgtcctacctcaaatcgtgcatttacaatgctcaaacggatcccttctgccccatattccgtcttggcacaatcgtgggggacgcgggacatagcttccaggagatggcagttgagggaggcatcatgggtatccagatcaagtgggactgcaacctggatagagccgcctccctttgcctgcccagatattccttccggcgcctggacacccgggacctggaacacaatgtgtctcctggctacaatttcaggtttgccaagtactacagggacctggccggcaaagagcagcgcacactcaccaaggcgtacggcatccgctttgacatcatcgtgtttggaaaggctgggaagtttgacatcatccctaccatgatcaacgttggctctggcttggcgctcctcggggtggcgacggtgctctgtgacgtcatagtcctctactgcatgaagaagaaatactactaccgggacaagaaatataagtatgtggaagactacgagcagggtctttcgggggagatgaaccagtgacgcctaaagttacatttccaccccgctcagcccgcgaagcagaaagatggggagagatggctactgcgtctgtcactctagagaaagctccagagtttcagctcagttctccactccacaaatactcagggttgccaagcacatcttgttggagcccggctcttgctctgctgctcagatgggcttccagatacaagaatcctcctgcttctgcctctaggaatgctgggatcaaacatgtcacttgcaatgcccatttcccatggggagtttggcattttttacattttaccctttccttttgtatacatctaaggctgccctcagacgcaagacgttcttccaccctatacacccttttaatctcactgtgtgtgggaggggggtcgtttgcacacgacgcacggtggatgtctggtgtgctgttggctgggccacctgtggcttatacagtgtgagcgtatggaggtaggaagggtctgagagcagagacactgctgtggcttacggacaggcccaggctctgtccacgcactttatttctaaggaaggaggctctctcaggtgctgtcagcaggcctgggacaccattcctcttccctataatcagagaagttgtccttgtagcaaaggcagggttagcttttccttttataagggctgtgttgaaatgacctaggaccaaacattaaaagaaataattttttaaaaaaaaaaaaaaaaaaaaaaa

SEQ ID NO: 3827 - DNA, 2532 bp, Rattus norvegicus
  Genbank Accession No. NM_031596
cccattttgcgtcgtctgggttcgggtggcggcccggctccaggcggacgcactaatcatggggtcgtcaaagaagcaccgtggagagaaggaggcagccgggactacggctgcggccggtaccgggggcactaccgagcagccgccacggcatcgagagcacaagaaacacaagcatcggagcagcggcggcggcagcagcggcggcgaacgacggaagcggagccgcgagcgtggggccgagcgcgggagcgggaggcgcggggccgaagccgaggcccgcagcggcgcgcatggtcgtgaacgaagccaagcggaaccctcggagcggcgcgtgaagcgggagaaacgcgatgaaggctatgaggccgctgccagctccaaagccagctctggagatgcctcatcactcagcatcgaggagaccaataaactccgagcaaagttggggttgaagcccttggaagtcaatgctgttaagaaagaggcgggcaccaaggaggagcccgtggcagccgatgttatcaaccccatggccttgcgacagcgtgaagaactacgggagaagctggcagctgccaaggaaaagcgcttgctgaaccaaaaattggggaaaataaagacactgggggaggatgacccctggcttgatgacactgcagcctggatagagaggagccggcagctacagaaagagaaggacttggcggagaagcgggccaagctgctagaagagatggaccaagagtttggtgtgagcactttagtggaggaggagtttgagcagaggcgacaggacctgtacagcgcccgggacttgcaaggcctcaccgtggaacatgcaatcgattcctttcgagaaggggagactgtggtcctcactctcaaggacaaaggggttctgcaggagggggaggatgtgctggtgaatgtgaacatggtggacaaggagcgagcagacaagaacgtggaacttcggaagaagaagcctgactacctgccctatgtggaggacgagagtgtggatgacttggcacagcaaaaacctcgctctatcctggccaaatatgatgaggaactggagggcgagcggccacattccttccgtttagagcagggtggcatggccgatggcctgagagaacgagagctcgaagaaatccggaccaagctacggctgcaggctcagtctctgaacactgtagggccccggcttgcctctgagtacctcagtccggaggagatggtgactttcaaaaagaccaaacggagagtgaagaaaatccgaaagaaggagaaggaggtaataatgcgggcagatgacttgctgccccttggcgaagaccagactcaggacggggactttggatccaggcttcggggccggggtcggcgccgagttcctgaagtggaggaggaggcccttgaggatgaagagaaggaccctgtggcccagccgccaccatcagatgacactcgcgtagagaacatggacatcagtgatgaggaggatgggggggctcttccctcggggcccccagagctggaggaggacgaagcggagctggagctgcagaagcagctggagaaggggcgccggctgcggcagctgcagcaactgcagcagctgcgggacagcggtgagaaggtgctggagattgtgaagaaactggagtctcgccaacgtggctgggaagaggaagaggatcctgagcggaaggggaccatcgtgttcaatgccacttctgagttctgtcgcactctgggggaaatccccacttacggattagctggcaaccgagaggagcaggaggagctcatggactttgaaagggatgaagagcgctcggccaatggtggctctgaatcagatggcgaagagaacattggctggagcaccgtcaacctggatgaggagaagcaacatcaggatttctccgcttcctctaccaccatcctggatgaagagcccattgtgaacagagggctggcggctgccctgctcctgtgtcagaacaaaggactgttggagaccacggtacaaaaggtggcccgagtaaaggctcccaataagtcactgccttcagcagtgtactgcatcgaggataagatggccattgatgacaagtacagccgacgtgaggagtacaggggcttcacccaggacttcaaggagaaggatggctacaagcccgatgttaagattgaatatgtggatgagacgggcaggaaactgactcccaaggaggcattccggcagctgtcccaccgcttccatgggaagggctcagggaagatgaagactgagcggcggatgaagaagctggatgaggaggcgctcctaaagaaaatgagttccagtgacacgcccctgggaaccgtggcactgctccaggagaagcagaaggctcaaaagacaccgtacatcgtgctcagtggcagtggcaagagcatgaatgcgaacaccatcaccaaatgaagcacctccctgtcccagatgtaatgttaaataaagttcccgccttattttta

SEQ ID NO: 3828 - DNA, 4510 bp, Rattus norvegicus
  Genbank Accession No. NM_031599
gcggaaccctcgctcaatgggcgatgtctgtacaaggctgtcactcaggtggcagtggctgagacgtggccgggcagctctgctgctgcggcgtgaagtcgagaggcgtcggggtccgtggtgcgcgctttcggtgctccaaggctcctagcggcgagacgggccggcgccgaccgcagggtctccatgcccgctcgtggggcgggccgctgatggagcgcgccacccagccccgaccgcgcgcgctgctgctgctgttcctgctgctgggctgcgcggcggggatctcagcggtcgcgcgcgcccgcagcttgcttgctcccacatcggatacggcatttggcttgggggcagcagccgcccctacttcagccgcgcgggtgcctgcggtggctacggccgaagtgaccgtggaagacgccgaggcattgcccgctgcctccggcgaacaggagtcacgcgcgaccgagtccgatgacgacgtggaactgcggcctcgcggcaggtccttagtaatcatcagcactttagatggacgaattgccgcactggatgccgagaatcatgggaaaaagcagtgggatttggacgtgggatctggttccttggtttcatctagccttagcaagccagaggtgtttgggaacaagatgatcattccttccctggacggagacctcttccagtgggaccgagaccgagagagcatggaggccgtccctttcactgtggagtcccttctcgaatcttcatacaagtttggagatgatgttgttctggttggaggaaagtctctgaccacatacgggctcagtgcatatagtggaaagctgaggtatatctgttctgccttgggatgtcgccgatgggatagtgatgaaatggaagaagaggaagacatcttgcttctgcaacgcacgcagaagactgtgcgagctgtcgggcctcgaagcggcagtgagaagtggaatttcagtgttggccactttgaacttcggtatattccagacatggaaactagagccggattcattgaaagcacctttaaactgggtggaaacaaagaagactctaaaatcatttcagatgtggaagaacaagatgtggacacagtgataaaagtttccgttgctgattggaaggtcatggcgtttagtaagaagggaggccgcctagaatgggagtaccagttttgtactcccattgcgtctgcctggctggtgagggatggtaaagtcatccccatcagtctgtttgatgacacaagttacacagccaatgaggaagttttggaagatgaagaagacattgtagaggctgctcggggagccacagagaacagcgtgtacttagggatgtacagaggccagctgtacctgcaatcatccgtcagggtctcggaaaagttccctacaaggccgaaggccttggagtctgtaaatggagaaagtgccattattcctctgccgacgatcaaatggaagcccttaatccattctccgtctaggactcctgtcttggttgggtctgatgaatttgacaagtgtctaagtaatgataaatattcccatgaagaatacagtaatggtgcgctttcaatcctacagtatccatatgacaacggttactatctgccttattacaagagagaaaggaataagcggagcacgcagatcacggtcaggttcctggacagcccgcactacagcaagaacatccgcaagaaggaccccatcctcctcctgcactggtggaaggaaatatttggaacgatcttgctttgcattgtggccacgacctttatcgtgcgcaggcttttccatcctcagccccacaggcaacggaaggagtctgaaactcagtgccaaactgaaagtaaatacgactctgtgagtgctgataacagcgacaacagctggaacgacattaaacactcaggatacgtgtcccgatacctaacagattttgagccaattcagtgcatgggtcgaggcggctttggcgttgtctttgaagctaagaacaaagtagatgactgcaattacgccatcaagaggatccgtctcccaaacagggagctggcacgggagaaggtaatgcgggaagtcaaagccttggctaagctggagcacccaggcatcgtgaggtatttcaatgcgtggctggaaacaccaccagagaagtggcaagaggagatggatgaaatctggctgaaggacgaaagcacagactggccactcagctcccctagcccaatggatgccccatctgttaagatccggcagatggatcctttctctacaaaagaacagattgaagtcatagctccttctcctgaaagaagtcggtctttctcagtgggcatttcctgtggccggacaagctcatctgagagccagttctctcccctggagttctcagggacagactgtggagacaacagtgactcagaggacgcagcccacaacctccaggacagctgcctgacagattgcgacatggaagatggtacagtggacggcgatgatgagggacactcctttgaactttgtccttctgaagcttctccctataccaggtcaagggagggaacgtcctcttccatagtgtttgaagactctggctgtgataatgcgtccagtaaggaggaccccagaatgaatcggctgcataatggccaccattacgttaataagctaactgagttcaagcactccagcagcaggtcttcttccgaagccaccttgtctacctctcctaccaggccaaccaccctaagtttagatttcaccaggaacacggtggaccggctccagcccagctcccccaaggtgtacctgtacatccagatgcagctgtgcaggaaggagaaccttaaagactggatgaaccggcgctgcagcatggaggacagggagcacagagtgtgcctgcacatctttctgcagatcgcagaggcagtgcagtttctgcacagcaagggactcatgcacagggacctcaagccttccaacatattcttcacaatggatgatgtggtcaaagttggggactttgggctagtgactgcaatggaccaggatgaagaagagcagacagtactgactccaatgccagcctatgctacacacacgggacaagtcgggaccaagctgtacatgagcccagaacagattcatggaaacaactactcccataaagtggacatcttctctttaggcttgattctgtttgaactcctttacccattcagcactcagatggaacgagttaggactttaactgatgtaagaaatctcaagtttccaccactgttcactcagaaatatccccaagagcatatgatggttcaagacatgctttctccatcccccatggagcggcctgaagccacagacatcattgaaaatgctgtgtttgagaacttggagtttcctgggaaaacggttctgagacagcggtcccgctccttgagttcatccggaactaaacattccagacagcccagcagcacattcagcccactgcctggcaactagtctccagctgtgcctgcggccctcagaggtggcacaggacgggcaccttgaggaatgtggctctccgtggtggcggactcattttatgctttgatcaacttgacttaggaccaatttttctaagtcagactggattatgggcctaacccagtttgatcttaactaaacttcaaggaaagggctatataaatgacaagtggatttgtttcttgttggtgtcccaaaactagctggtcaagctacagaaccttcacttttcaccaggaggcagaagacagcctgaaaccatctgaactggaaatgactttaaagcacaaaggtgtgaaagaccctctcacatgggaactacatgttctagaaacgtgctttctagaaatacaagggtgattatggaagcgactgttataaagctgactccatttttgtccctggtgagcatgtgacccatctgcactattttggaaggcgcagcacaggctgggtggccatttatgtcagtagtgccatagtctgcagcagtgaataacttcactttttaggtggtctagggagcacggtgagctttttgtacttttttatctccagtaatgggaaaatgaagctttttaggtattggtcaaaagatctgattggagggtttaaaaagaagtgtagtaagaaatgggtcacctattacacctaacttattccattatggagtttttgtcctagtagaagtctaccttatgtgtaatactacaagtcagcatatcccccaaactgattataggtaagtttaatcatctcaacttgctaacatgttctcatttttcctgtaaatatctttattttttatttataaaaattctgaaatcaatccatttgggttggtggtgtacaggatgcacataagtgtgttaactattatgacttctttcaagtctaaatgatttaataaaacgtttttaaattataaaaaaaaaaaaaaaaaa

SEQ ID NO: 3829 - DNA, 1771 bp, Rattus norvegicus
  Genbank Accession No. NM_031603
ctaaagcggacgcggagcgagaagctgagagagtcggagacgctatccgcttccatccgtcgtgcagaccctgccggagccgctgccgctatggatgatcgggaggatctggtgtaccaggcgaagctggcagagcaggccgagcgatacgacgaaatggtggaatcaatgaagaaagtagcaggaatggacgtggagctgacagttgaagaacgaaaccttttatctgttgcatataaaaatgtgattggagccagaagagcatcctggagaataatcagcagcattgaacagaaggaagaaaacacgggaggagaggacaaattaaagatgattcgggagtaccggcaaatggttgaaactgagctcaagttaatctgttgtgacattctggatgtactggacaagcacctcattccagcagctaacactggcgagtccaaggtttcctattattacatgaaaggggactaccacaggtatctggctgagtttgccacaggaaacgacaggaaggaggcagcagagaacagccttgtggcttacaaagctgctagtgacattgcgatgacagaacttcctccaacgcaccccattcgtttaggtcttgctctcaacttttccgtattctactatgaaattcttaattcccccgaccgtgcctgcaggttggcaaaagcagcttttgatgacgcaattgcagaactggacacgctgagtgaagaaagctataaggactccacactcatcatgcagctgctacgtgataacctgacgctgtggacctcagacatgcagggcgatggtgaagagcagaataaagaagcgctgcaggatgtggaagatgagaatcagtgagacgtaataaagccaacaagagaaaccatctctgactaccccaccccacccctgcccttggaagttccccattgtcactgagaaccaccaaatttgactttcacatttggtctcagaatttaggttcctgccctgttgttttgctttcgttttcttttttttctcccctccccctttttaaaacaaacagttttcagaagttcttaagccaagagtgaatttctgtggattttactggtcccagctttaggttctttacgacactaacaggactgcatagaggctttttcagcattactgtattgtctccggccacatgtggcaagatcatcattagaaatggaaatgacatttgagagccattagacttctaggtgatgcatctaagaaagattaatcacacaatagaggctattgcgctgtcatttttcctttttttaattgttaaattgaattttataccaatgtttaaacttaaattgggtgttagcttgaggtgttttgggggagtttgcggtaatggttttgctgtaacgtgtgtttggaactctgctgaagggctgctgaaaagcacggtgctggtaacagtccaacagtccgcggctgctcattcttgccgactcctccctctgacgcaggttagcattgaaggtggtatggaagcctgcatgcgtgttcaactcttcctcttccctcctcctcggcctccctcatcccttcctccttcgctcgctcaacctcttttgttcagtatgtgtaacttgaagctaatttgtactactggatatctgactggagccacagatacagatctgtattgttcttactgaaacacagcatggaattaacattaaacttaaataaaacaaacctaaattaaagatgcacaaaaaaaaaaaaaaaaactttagag

SEQ ID NO: 3830 - DNA, 3876 bp, Rattus norvegicus
  Genbank Accession No. NM_031604
ctcagattggagtgaacaaccatcgccaccatgggggagcttttccgaagcgaggagatgaccctggcccagctctttctccagtccgaagctgcttattgttgtgtcagtgaattagaagaacttggaaaggttcagttccgggatttaaatccagatgtgaatgttttccagaggaaatttgtgaatgaagttagaagatgtgaagaaatggatcgaaaactccggtttgttgagaaagagataagaaaagctaacatcccaattatggacactggagagaacccggaggtgccctttcccagggacatgatcgacttggaggccaatttcgagaagatcgaaaacgaactgaaggaaatcaacactaaccaggaagctctaaagcgaaacttcctggaactgactgaattaaaatttatactgcgcaaaactcagcagtttttcgatgagatggcggatccagacctgttggaagagtcctcatcactcttggagccaaacgagatgggaagaggcgcgcctttacgacttggcttcgtagctggtgtgattaaccgggaacggatcccgacctttgagcgcatgctttggcgagtgtgccgagggaatgtgttcctgagacaggctgaaatcgaaaacccgctggaggatcccgtgactggcgactacgtgcacaagtccgtgttcatcatttttttccaaggtgaccagctgaaaaacagggtcaagaaaatctgtgaagggttccgagcctccctctatccctgtcctgagactccacaggagagaaaagaaatggcttccggagtcaataccaggatcgacgatctccaaatggttctgaatcagacagaggaccaccgccagagggttctgcaggcggctgctaagaacatccgggtgtggttcatcaaggtgcggaagatgaaagctatctaccataccctgaacctctgcaacatcgatgtgacgcagaagtgcctgatcgcggaagtctggtgccccgtcactgacctggactccatccagtttgcactgcgaaggggcacggagcacagcggttccactgtcccctccattctgaacaggatgcagacaaaccagacaccccctacgtataacaaaaccaacaagttcacgcacggcttccagaacatagtggatgcttatgggatcggcacttaccgagaaattaacccagctccgtacaccgtcatcaccttcccctttctgtttgctgtgatgtttggagattttgggcacggcattttgatgactctgtttgctgtgtggatggtgttgagggagagccggatcctctcccagaagaacgagaatgagatgtttagcatggtgttcagcggccgatacattatccttctgatgggactgttctccatctacactggactcatctacaatgactgcttttccaagtctctgaatatctttgggtcatcatggagcgtacggccaatgttcaccatagggaactggacggaggagacgctcctggggagttctgtcctccagctgaacccagctatccctggagtctttggtggcccttacccatttggcattgatccgatttggaacatcgcaaccaacaagctgaccttcctcaactccttcaagatgaagatgtcagttattcttgggatcatccacatgctgttcggggtcagcctgagccttttcaaccacatctatttcaagaagcccctgaacatctactttggctttattcccgagataatcttcatgtcctcgctgtttggctacctggtcatcctcatcttttacaagtggacagcctacgatgcccactcgtctagaaatgccccgagcctcctgatccatttcataaacatgttcctcttctcctacccagagtctggtaacgcaatgctgtactctggacagaaaggaattcagtgtttcctcatagtggtggcaatgctctgtgtcccctggatgctgctgtttaagccgttgatccttcgccatcagtacctgaggaagaagcatttgggaactctcaactttggtgggatcagggtgggcaacggaccgacagaggaggatgctgaaattattcagcatgaccagctctccacccattcagaggacgcagaagagcctaccgaggacgaagtgtttgactttggcgacaccatggtccaccaggccatccacaccattgagtactgcttgggctgcatctccaacactgcgtcctacctgcggctctgggccctcagcctggcccatgcacagctctctgaagtactctggaccatggtgatccacatcggcctgcatgtccggagtctggcagggggactggggctgtttttcatcttcgctgcctttgccaccctgaccgtggccatcctgctgatcatggaaggcctctcagccttcctccacgcactgcgattacactgggtggaattccagaacaaattctacactgggactggtttcaagttcctccccttctcctttgagcacattcgggaagggaagtttgatgagtgagtctcaggcagggcgcatgctcagagcagctctcctgcctgcctctacagtgactgtgtctcttgcctgctggttgtgatccctggatactcgggcgtttgtgtcaccctacaacccctgtccccgctgtgactcatttaggttgtgctggccttccctgggtctctttctcccaagccttgggtgttacgtacagactttcgactgagagctggatggctgtgcctgatacccacccatccccatggcaccacttggcctcctggcctccagacagatagccctattccatcccctaatggtgagccaacctgcacagacacataggggcacggagccctcaggatgcaaggggtccctcatcagtccaggagttcttggtcacgccttggaggaagatggcaatgggttctctcctagaaggggatattgcttatggaacatacccgactccgctggcagggacagtcaggaagatgctgctgtcaccctttgtccagcctctccagtgagtattcaggaaactcagttggccctacctgggccatctcaaaggttccaggataacccccaccctcctagcccccaccctcctaaacactctcctcccccagccctgttggcacagcatagctagcatccgtagaatgggagggtcgcactgacttgcagcaccgggcttccggaccttagattcccttctctgtcagtgcgtgaatgggccttgccaacactacaccccaaggcagaagttaaaattggcacactcccggcatatccctgagcccttctgcaccctgatcatgatgtcctgaggctgtggtcagtaaggttggttctgccggcaggcctgccttgatctgcccacttattactccctctccaatccccatgctgaccccaggtttcaggagtggcgtcctggacagggaaggtcagtgtcatttacaatttgctaatcagaggcgactgttgggctaccagagcagatgtgggagcgctgctaagcccttgccgcctacctcatgtactgtggatctcagacccttctaatcatgtgctgactcccgaaattcactcactgccttccctgtggaggtaatactaaatcagcaaggcccctcccctcccccaccctggcgctcttgagccgctcccacggtgaattgttcagagcccctctgtccttttgtgcccagtttacatgatgatctctgctgtttacagagaggcccacagcagaggtctctgtggggaccctgcccaaggccttctgttcagacattcttatccggaataaagtgtgtttgactctgacaaaaaaaaaaa

SEQ ID NO: 3831 - DNA, 1957 bp, Rattus norvegicus
  Genbank Accession No. NM_031605
gggcatgagtggctcggctctgagcttcaccatattcccaggaagtatccttgggttcctccaaatagccactgtgctcactgtgctcctgctgctcctcaagacagcccagttctacctgcacaggcgatggttactcagagctacccagcagttcccatccccaccttctcactggttctttgggcataagatcccaaaggaccaggattttcaagatattctaacacgggtaaagaatttcccaagtgcctgtccacagtggctctgggggagcaatgtgcgaatccaagtgtatgaccctgaatacatgaagctgattctggggagatcagacccaaaagctcatggttcctacagatttctagctccctggattgggtatggtttgcttctgctgaatggacagacatggttccagcaccgacgaatgttgactccagctttccactatgacactctgaaaccttatgtgggcatcatggcagactctgttcgcataatgctggataaatgggaacagattgttggacaggattccaccctggagatcttccaacacatcaccttgatgaccttggacaccatcatgaagtgtgccttcagccaagagggcagtgtccagttggacagaaaatacaagtcctacatcaaggcagttgaggacctgaacaatctcttttttttccgtgtacagaacatgtttcatcagaatgacttcatctatagtctgtcctctaatggccgcaaggcccacaatgcctggcaacttgcccatgattacacagaccaagtgatcaaatcaaggaaggctcaacttcaggacgaggaagagttgcaaaaggttaagcagaaaagacgattggatttcctggacatccttctgtttgccagaatagaaaatggaagcagcttatctgataaggacctgcgtgctgaagtggataccttcatgttcgagggccatgacaccacagctagcggtatctcttggatcttctatgctttggccacaaatcctgaacaccagcagggatgcaggaaggagatccagagtctcctaggagatggagcttctatcacctgggacgacctggacaagatgccctacaccaccatgtgcatcaaggaagctctgaggatctacccacctgtaacagctgtgagcagaatgctcagcacacctgtcaccttcccggatggacgctctttacccaaaggtatcacagtcatgctctccttctatggccttcatcacaacccaactgtgtggccaaatccagaggtgtttgacccttatcgatttgcaccagagtcttcccgacacagccactcattcctgcccttctcaggaggagcaaggaactgcattgggaaacagtttgccatgaatgaactgaaggtggccgtggccctgaccctgctccgctttgagctgctgccagatcccaccaggatcccaatccccataccaagactcgtgttgaagtccaagaatgggatctacctgcgtctcaaaaagctccaataatcttgacagcacaagacagctccaacagcatgctgtctgccatttgtctttctgtcagtcactcttgtccccactccatctgctcacatctcattctttcttctcaccttgttcacctccacccaccttctgctgtgcttctggtctccttgtctgtcagtctttctatctcgacttctggaatttctacctgcttttctctctacctggcccctacctgacttcatgtttgaccttgaccttaatgatctccctaaattacaccctgccttctcttctgcatatttccttctattctactgtttgtctgtgcttaaattgagctttataccaatgtcataattgattacaatagaagtattgccctatgattcgatataccaggtgtttttcatgatttcattagaataaagctcaggtcattgc

SEQ ID NO: 3832 - DNA, 1212 bp, Rattus norvegicus
  Genbank Accession No. NM_031606
atgacagccatcatcaaagagatcgttagcagaaacaaaaggagatatcaagaggatggattcgacttagacttgacctatatttatccaaatattattgctatgggatttcctgcagaaagacttgaaggtgtatacaggaacaatattgatgatgtagtaaggtttttggattcaaagcataaaaaccattacaagatatacaatctatgtgctgagagacattatgacaccgccaaatttaactgcagagttgcacagtatccttttgaagaccataacccaccacagctagaacttatcaaacccttttgtgaagatcttgaccaatggctaagtgaagacgacaatcatgttgcagcaattcactgtaaagctgggaaaggacggactggtgtaatgatttgtgcatatttattgcatcggggcaagtttttaaaggcacaagaggccctggatttttatggggaagtaaggaccagagataaaaagggagtaactattcccagtcagaggcgctatgtatattattatagctacctgttaaagaatcacctggattacagaccagtggcactgttgtttcacaagatgatgtttgaaactattccaatgttcagtggcggaacttgcaatccccagtttgtggtctgccagctaaaggtgaagatctactcctccaactcaggacccacgcggcgggaggacaagctcatgtactttgagttccctcagccattgcctgtgtgtggtgacatcaaagtagagttcttccacaaacagaacaagatgctcaaaaaggacaaaatgtttcacttttgggtaaatacgttcttcataccaggaccagaggaaacctcagaaaaagtggaaaatggaagtctttgtgatcaggaaatcgatagcatttgtagtatagagcgtgcggataatgacaaggagtatcttgtgctcaccctgacaaaaaatgatcttgacaaagcaaacaaagacaaggccaaccgatacttctctccaaattttaaggtgaagttatacttcacaaaaacagtagaggagccatcaaatccagaggctagcagttcaacttctgtgactccagacgttagtgacaatgaacctgatcattatagatattctgacaccactgactctgatccagagaatgaaccttttgatgaagatcagcattcacaaattacaaaagtctga

SEQ ID NO: 3833 - DNA, 1788 bp, Rattus norvegicus
  Genbank Accession No. NM_031609
gcgcctcgccccgcccggggccgcagacggccagcagcgacagacagccgagcctcgcggggccgtcccagcccgaggaccccgggcctgcgacccccgcggctcgcatcccactttctaagacctctaagaggacgcgccggcctcttcgcggccaccgcgcgcgttccagggctccggaggtgacaggcacaatgctttgggtcctggtggggactgttctccctgtcatgttgctggctgccccaccacccatcaacaagctggccctgtttccggacaagagtgcctggtgcgaagccaagaacatcacgcagattgtgggccacagcggctgtgaggccaagtctatccagaacagggcgtgcctaggacaatgcttcagttacagcgtccccaacaccttcccgcagtccacagagtccctggtgcactgtgactcctgcatgccggcccagtccatgtgggagattgtgaccttggagtgccccggccacgaggaggtgcccagggtggacaagctggttgagaagattgtacactgcagctgccaagcctgcggcaaggaacccagtcatgagggcctgaacgtctacatgcagggtgaagatgggccaggctcccagccaggatcgcactcccactcccatccccaccctgggtgccagacccctgaacctgaagaacctcctggagcccctcaagttgaggaagagggggctgaggactgagggcccccaactcttcctcccctcttgtcccctgtggaatgtctggtcccaccctccagggaagagggaggggagaggcagaggcccccctccccctctggcactagatggacttggaatgttgcctggttgccatggagatctgaagggaggggctggagccaagctgcacgatttaatatatgcaagatgaggggaggaagcagacatctttgggacttttcttttggaaggtgaagtgtggtctttcctttcagccttctggagaggagccctctggatagagaggaagcaggttgagctgctgaggatgactgagatcctcagatagggcaggcccaggtcaggacccagacaacggatggggcaggatccccagtgacgggcagagggtgggtatcatgtcagcatcccctttgcaggaggatctaggtaggaagacagctggcagaagtcggaaactccagccccataggtttccctaaaggcctcccctcatgtaaccccttcaatggagtggcttaggagtcaggctggggcaggaccctgctgactcaggtgccagagtgtcactgaagaagaaagaagatccctctcccccacaccctgtccctccctccagagatcttagctctttgctctccccaagttctggactcttctgaaaacagctgcaaccggtcctgccgtccttggggctggtctttctgaaagaggtgacagtttatccccatcacctgggaccgtagtggacaggaggcccctgcctagggcccctgctgacctcagctttctctagctccttattctatccactccttcttcccagctgcactttaaccttagggcagggcaggtggcgaggaagggccctctgtctccttatctgctggcaccattgtgtccagggggttgccagctcaccccctccctgggggtgccccagcccatggctgtttgacgagagccttagagcttgtaactagtagccatctcccctgaacctgagtgtttccatgaataaaatgccttcaacgcctctacaaaaaaaaaaaaa

SEQ ID NO: 3834 - DNA, 1285 bp, Rattus norvegicus
  Genbank Accession No. NM_031612
gcagagcacagctaaccacttggagagtttttgctgctgactggagccaccaaggccagcttcgcgccgctgccctgcggcggcagaggaggctgcaccagagcagaggcagcgagcaggcttggggccggtagccagcggtgcggctggggcgctcactctctccagccagcggtccgggagccacgcgagctccgtgcccgcacgcgctacccggctcgcgcctttctttgcgtcagggtgcccggcctctccgcccactcgccggctcattagggctgccacggaccgagttgcagcatgaatctgagtttctgcgtgcaggcgctgctgctgctctggctctccttgactgccgtgtgtggagtgccactgatgctgcctccagatgggaaagggctagaagaaggcaacatgcgctacctggtgaagcccagaacttcgaggactggaccaggggcctggcagggaggcaggaggaaatttcgcagacagcggccccgtctctcccataagggacccatgcctttctaaagcaggattgaagggctctccaagtgccctcccggtgccagtctctttactccacagatgagttctcttctctggaaccctcacatctatttggctctcatcttgcacctgttatcgctgctgatggtcccagctcttcttctcacccaccaagttcctctaatggcgtggtctcacccctcatttggatgattccatttctcttgcaaggatccctttggcccatcttcctggccactccttggactgcccttggagacccagcttctcctggcctgctccaggcgctagttcctatcttttggctttagcctgctcttggtccctcccttttctcatttgccttgggcactggacaagaacactcccttcttcaatggattcctgcacatccatactttcttatcaattggacctctcgcctggaagggagtacagggatgtacaatgagactttggttgagagggattgggtgttggggtccagagaaggtgcactggggaaacagtgggcataaggaaggggtgaggagaaatagctgtcatggcctcttccttagctctctctggccctgttaaaggaagatgcaaaggagaggaacccatgaagtgctatgtcactgtgtctcctaacatctttgctctctctgttctattgccgctggttcactccccaggtcaaaaggggaaagtgctgatcctgacatggttctatactcttctgggagtaattttgccaaaaaaaaaaaaa

SEQ ID NO: 3835 - DNA, 3360 bp, Rattus norvegicus
  Genbank Accession No. NM_031614
gccttgcagcggcgcgggcaaacggagaggccgcgggaggcgcgaagccggcagaaggcgagggagagcggagggcggccatggtccagccctgaagccaaacaaaaaaggcctacttcgaaagctgtcaacaatgaatgactctaaagatgcccctaagtcctatgacttcgacctgatcatcattggaggaggctcgggaggcctggcggcagctaaggaggcagccaaatttgacaagaaggtgatggtcttggacttcgtcacaccaactcctctcggaacgaatgggggtctcgggggaacgtgtgtgaacgtgggctgcatacctaaaaaactgatgcaccaggcggctctgttaggacaagctctgaaagactcacgcaactatggctggaaactcgaggacacagttaagcatgactgggagaaaatgacagaatctgtgcagaatcatatcggctcgctgaactggggctaccgagtagctctccgggagaagaaggtcgtctatgagaatgcttacgggaaattcattggtcctcacaaaattatggcaacaaataacaaaggtaaagaaaaagtttactcagcagagcggttcctcattgccaccggtgaaaggccacgctacctgggcatccctggagacaaagagtactgcatcagcagtgacgatcttttctccttgccttactgcccggggaagaccctagtggttggcgcgtcctatgtcgccttggaatgtgcaggattcctggctggtatcggcctcgacgtcactgtaatggtgcggtccattctccttagaggatttgaccaggacatggccaacaaaattggtgaacacatggaagagcatggtatcaagtttatcaggcagttcgtgccgacgaaaattgaacagattgaagcagggacaccaggccgactcaaggtgaccgctaaatccacaaacagtgaggagaccatagaagacgaatttaacacagtgttgcttgcagtaggaagagattcttgtacaagaactattggcttagagaccgtgggcgtgaagatcaatgaaaagaccgggaagatacctgtcacggatgaggagcagaccaatgtgccttacatctacgccattggtgacattctggaggggaagctggagctgacccccgtggccatccaggcggggagattgctggctcagaggctgtatggcggctccactgtcaaatgtgactatgacaatgtcccaacgactgtgtttactcctttggagtatggctgctgtggcctctctgaagaaaaagctgtagagaaatttggggaagaaaatattgaagtttatcacagtttcttctggccattggaatggacagttccatcccgggataacaacaaatgttatgcaaaagtcatctgtaaccttaaagacaacgaacgtgtcgtgggcttccacgtactgggtccaaatgctggagaggtgacgcaggctttgcagccactcaagtgcgggctgaccaagcagcagctggacagcaccattggcatccacccggtctgtgcagagatatttacaacgctgtcggtgactaagcgttctgggggagacatcctccagtctggctgctgaggttaagccccagtgtggatgctgttgccaagactacagaccattgcttgcttccttgtccacacccaggtgaagttcaggaaggctcttgggttcttggcaccaattcaaggtgctatcctaaggccaccaggtccctgggatcttgtgggtaggaggtggcaggtagaagaaggctgcagcatcgcactggggtcaccatgacggactcagactgacattcggcagagcatcacggtgcgtccatgaagtcactagcctcaagcccaagtggtgggcagtgacagaaagctgtcgatctgttgggttcaacctttccctgtagactgttttagtctcgccttcaagctatgtaatgtcaattctgttttttcttttctccatggggttaatgatactagaggtagggaatgttagcaatcagtttttgtcatggctggactatccacagcacggtcgttactgtgtggaagggggtcagatggcttatgagagccaaaccagtttatcctgagaaagacgaattaccctgtggctaaaatacactgtttttactaacctgtgtagcattgtcccctttaataagtttaggtcttctgtccaaactgagaaaaaccatggtcactttggcaaatttccggcagtgtgtgtccctgccgctgcttagcaagggcggcggtgacttggctaatctactcagactcattgcatggctcttgggtatcatggagtattccagcatagagcctgaccagcagtaaatgtctctcctggtacagttactgtctgctggactaagtgcgctgagatggttctcaatggagaatgcttaatttgcttttaacctcttgtttttgtgaggtgggtttagttttaagcttatgtcccataagaactccattcacaggcaagcagctctttccgcacacagcatatgcatcttctgaggtaatggctttataaggaagctgttcataacataagttattattattattgaacacaggtggatgtgaaggattttttttcattgaagaaccaaatggtttttcttttttctgttcagtgagcccacagagaccctggcaggaacagcattgctggcagcattgctgctgggcttttccagtgtagttcttgctcctaggtcacgtgacagcgaacacgatgcctgaggaccgcgcagacaggtttcccaccgcacagccgcccaaggtcccgccatggtccggtagctccttttcttgtcctcccctctgcccatctccacctgcagtactgagtggcgtttcccagtaccctttggggccacctcagggaacgggtttgcctggtattcagccagcggcacccaccctgccccacgaggctccctcagatccgccccacatccgtgtgttgaagaggagaaaggaccagggaaccaaaggagtggactgttgagttttatttatttattttttgtttttttttctcctaagtctgccagtctctgagatcagaacgacagtgtagggtagccgcctaatcatgttgtgattctattggtgggatgaaatgttccgcccccatggaaggagtacactcgtcgtttatgttctgtaatcgcacaatgtactgtaacccaaattccaattccatgtatttttattacagtttctctgggaaaaaaaaatgtgaaacaataaaaaggtgttgattcacgaaaaaaaaaaaaaaaaaaaaaaaaaaaaaaa

SEQ ID NO: 3836 - DNA, 2599 bp, Rattus norvegicus
  Genbank Accession No. NM_031616
tgctgctggcgtccaagatgtcgaccaagaatttccgagttagtgacggggactggatctgccctgacaagaagtgtggaaatgtaaacttcgccagaagaaccagctgtaacagatgtggtcgagagaagacaactgaggccaagatgatgaaagctgggggaacagaaataggaaagacactggcagagaagagccggggcttatttagtgccaatgattggcagtgcaaaacttgcagtaatgtgaattgggctagaagatcagagtgtaacatgtgtaatactccaaagtatgctaaattagaagaaagaacaggatatggaggtggttttaatgaaagagagaatgttgaatacatagaaagagaagaatctgatggggaatatgatgagtttggacgtaaaaagaaaaaatacagggggaaggcagttggtcctgcatctatattaaaggaagtcgaagataaagaatcagagggagaagaagaggatgaggatgaagatctctctaaatataagctagatgaggacgaggatgaagatgatgctgatctctcaaaatataatcttgatgccagtgaagaggaagatagtaacaaaaagaaaagcaataggcggagccgctcaaagtctcgatcgtctcactcaaggtcttcatcacgctcatcctccccctcaagttcaaggtccaggtccaggtcccgttcaagaagctcttccagctcgcagtccaggtctcactccggttccagagaacattccagatcccgtggttcgaaatcaagatccagctccaggtccacaggggctcttcttccccaagaaaaagatcttactcgagttcttcatcatctcctgaaagagacaggaagaggagtcgctctagaccttcttcaccagctgttcgcaaaaaaagacgaacgagatcacggtcacccgaaaggcaccacaggtcgtctccggatcaacccattctggttcccgttcaagttcaaaaaagaaataatgtattaaaatttacatctttaaaaaacattgagtacagtgcatgaagcatattttttaggaagttgatgtctcatttggtcagaagtactacatctgctagtagaggtgcatgcctttattgcttttcaaaacaataaaactgttcatttgtgaaactgaaagtaaattgcattttaagccatactgttccccagataaatgctctgtccattatttacaaccatttacttcgtttaaaaccatcctagcgataacggagtacttttgtttcctactttaaatcctgtccttttcatttctaaatgttctattggcagagacggttgcctgggcttgcctggacttcagacacataggcaaagctagtaagctagttggagtaaccagttcctgttcatgtgggaatagtagtcaacctggttatgttctttacctatgccagtaatttcttaccagaggtaaagtacattgcaaagctgacaactgggaacaagctgagggtgccttagaatcattgtctcttaccagctttacacctcttaatgcaagaggattatagaaattacagaaggaaagggaaggttaaccacatattacttcaaaatgtctttctcaaagtttaagaaatgtggatatcctttaaataaatctagttaccaaatgttgtacttgattgataaaagatttttaaaaaggctaaatcatagttaatgagccaattgatgagagcttttgaaacttgtttctcagtgacaggctaacaaagacatgaatttaagtgaacatttgccttgtgatgtctgatttttaacattgtagatatctaagtaacagaagaattcttacttccccacaatttaagcaaaatcatttttctcacctggaaaaaaaaacatatggcttaaaatgctttcagagttttatttctcaaattaaaatctggtcacttgagatccattttgttctctggtttaaaagttataaggtttctcttaacagtcttttcagcagcaaaagcaaggtaagtatataagggacaacagttatgctggggctccttgtgagggaattacttcctgtttctcctttagtatttgtctgctgcagtttaaatataagtaaagccttctgagatgtttagtagacagatcaaacgaaatgtttttattttaaagtgagtgtttttcttctcaactgatctaaagatgaaaacaaaatatcgtacgtagaaatattttggtaatatttttacaagctttcctgtgttttttgtcttattttccttgctgcatttactgtaggttgcacacgaactcttactctcttgtaattgtgcctcagacttctcgaaagtcgactttctgagttgcccagatcttctagatccgacgtgttagccttggtttgtttttgtgctttctgtatttaaaacttgagctgtactaggcaaatgcaagattataaatttagctaataggagtttacaaacagttcagatgattatgatttgatttggtttaattgagctgtactagttcatttcataaggaaatgatactgtagacaaatgtaaataaaatctgtgagtc

SEQ ID NO: 3837 - DNA, 1803 bp, Rattus norvegicus
  Genbank Accession No. NM_031620
agtcagcgtaaattgtgcgtgttaaagctcaccaggtacaggccttcagtttcctgtactaagtgcttctgcccaccagagcaaccgattctaaggcctggctctagcaatggccttcgcaaatctgcgcaaaatactcatcagtgatagcctcgacccctgctgccggaagatcctgcaagatggagggctgcaggtggtggagaagcagaacttgagcaaggaggagctgatagccgaactccaggactgtgaaggccttatcgtccggtcagctactaaggtcactgctgatgtcatcaatgcagcagagaagctccaggtggtgggcagggctggtacaggcgtggacaatgtggatctggaggctgccacaaggaagggcgtcctcgtcatgaacacccccaatggaaatagcctcagtgctgcggaactcacctgtgggatgctcatgtgcctggccaggcagatcccccaggcgacggcttcgatgaaagatggcaaatgggaccggaagaagttcatggggacagagctgaacgggaagacactgggaattcttggcctgggcagaattggaagagaggtggccgcccgaatgcaggcctttggaatgaagactgtaggctatgaccccatcatttctccagaagtcgctgcctcctttggtgttcagcagctgccgctagaggagatctggcctctctgtgatttcatcactgtccataccccgctcctgccctccactacaggcttgctcaatgacagcacctttgcccagtgcaagaaaggcgtgcgggtggtgaactgtgctcgaggaggcattgtggatgaaggtgccctgctccgtgccctgcagtctggtcagtgtgctggtgctgcactggatgtgtttacagaagagccaccacgggaccgggccttagtggaccacgagaacgtcatcagctgtccccacctgggcgccagcaccaaggaggcccagagccgctgtggggaggaaatcgcagtccagtttgtggacatggtgaaggggaaatctctaacaggggttgtaaacgcccaggctcttaccagtgccttctctccacacaccaagccttggattggtctggcagaagcattgggcacactgatgcacgcctgggctggctcccctaaagggaccatccaggtggtgacacaaggaacatctctgaagaatgctgggacctgcctgagccctgcggtcattgtcggccttctgagagaagcatcaaaacaggcagatgtgaacttggtgaacgctaagctactggtgaaagaggctggcctcaatgtcaccacctcccacagtcctggtgtcccaggagagcagggcatcggggaatgcctcctgactgtggccttggcaggtgctccctaccaagctgtgggcttggtccagggcaccacaccaatgttgcagatgctcaacggagctgtcttcaggccagaggtgcctctacgcaggggccagcccctgctcctgttccgggctcagccctccgaccctgtcatgctgcccactatgatcggcctactggcagaggcgggggtacagctgctgtcctaccagacctccaaggtgtctgacggagacacttggcacgtcatgggcctctcctccctactgcccagcctggacgcatggaagcagcatgtttctgaggctttccagttctgcttctgacccaggggctcagcggtcccagcccctcaggctcttctgaggaaacccgctcactgtgacctgaactaatatctagtaaagaatctaactcc

SEQ ID NO: 3838 - DNA, 3680 bp, Rattus norvegicus
  Genbank Accession No. NM_031621
tcctagagctcaaagcccaagctccaagaggcctgctccagcatccaggaggtccgaccctgcacacgcctggagatgccggacaacctctacacctttgtgttgaaggtgagcgccagggctgtggctccttggggagacactgctgtctcctcaggtgcagagctatatgcctcctttctgcaggtgcagggccagacagacatcatctttgaggtgggagatgaacagcagctgaactcatggctggcagaactcagggcaagcacaggcctagggtgaggacctgcccatccctggttccctttgataacccctgctggcccccttctcaccagcctcttcccctacaggttggagcacctggacacagagttacctctttccttagtggcagagcctggcccagctatatccccaaggggaagcacggactccctggaccaaggtatgtgccagatccttggtctctgggtgtccttggacatgtggcccctctgcgggtcaccaccaccatctttctgccaggtgcttcacctggggtgatgttggacccagcctgccagaaaacagatcacttcctgtcctgctacccctggttccacggccccatctccagggtgagggctgcacagctggttcagctgcagggccctgatgcccacggtgtgttcctggtgcggcagagtgagtcccggagaggggaatatgtactcacattcaacttacaggggagagccaagcacctccgcctggtgctcacagagcgtggacagtgccgggtgcaacacctgcacttcccctcggtggtggatatgctccgccacttccagcgctcccccatcccacttgaatgtggagcagcctgtgatgtccgactctctggctatgtggtagtcgtctctcaggcaccaggtaggaagcccaaagttgtgtcaaggggtggtgtcacagcaagtacagcacgtacaaaacttccttcctggttacgccttcttcatggagtcatccatgttatctctccaggttcctccaacaccgttctcttccccttttcccttcctcactgggactcagagctgggccatccccacctcagctctgctggctgtccccctggccatggtgcagaggctctccgtggccaagtgacacctcctgagcagatcttccacctggtgccttctcctgaggaactggccaacagtctgcggcagctggagcttgagtctgtgagcagtgcccgggactcagactatgaaatggactcctcctcacggagccaccttcgggccattgacaaccagtacacccctctctcacagctgtgcagagaggcaaacttgtgaatgtaaccattttccttccctccagagaactacaggctgctgctgtcagccttccccagctcagatgtgcctgcttccaccacacacaaggctgtcacaggcttctgtcagccacagctagcctggcttcttcccactgtctgtagatgtagttcttgtgcacaggtgccactagctggcaccaaggcctcgttcccaacccagaggaggcggggctgcaggcccagagctggcagtggaaactgacagagctgatgacagacttcttaccaggtagggtcatcgggaagcacaaaacactaacagtccctggattctcacatggtgtccttccctgtagcttcattctgtggcaagtctaagtcccatgtcacaggcgtaggacacttcataatcctgcttctactcttagctttggacagaagctctgccagaggggcaagcttaaagatcaaaaatgatttaaacattttacctcagagtaattatttttaaagggttcaggtttccacttgatattatagcttacttcactgcactgccctgctaccccctgccactgtaaagttggggggagctgagtccccctgctttgcttaccttgagccaggctagcatgctagtgtccttgtctgctcaccctcaggacagttgcctgctacggggtagacactgtcctccctaatgtagagaatgaagtgtgtcaccctctcagggaaatccaggcagcttgcagagagaggagggtggcaggggacattccaccccagtgccttatgcattaaaaacaaaatcaggactgtggtttacagcagcgttagaggatgagatgaatgggtgggggaagacaaacacagatggaaggcctctaggcttctttagtgaacccacattttactccccccaaccccctcccagcatctaggggcttagtgagtttggcccatgctatgaagaaactcctgtaaccgctcctaggtgttcttatccatacaatctttccatctagacagagccaaaaactgtcatctttcctaagggatgcagttcacagggactggagcaggctgttcatggcacaaacagtgcttacagcagtggctttgggaaaccacaacttaattccttgaacattgagaggcagccatgctgctgccctgctgcagacagcagtgctgactccccctctgctcaccttgcactcgggaagcctgcgtgggctttggtgatggaagcagctgcacctcagcttcgacacccaccacaggtgtggacctgtgctcatcttaggacagcgccttccttcactgcacatcaggtatgaaccagagacgtgagcagtaacagccagtgggccaggccggctctaatccacacaggatgcgtggacggctgtgccctgcacctggccaggagctaaacccacttcaaacttggggcactcatttctcctgggccttcaaagagagacttgctaggtgctgtaagccagcaccttggccccttagtgctgggattcactcactgtggacagctttgtttcaaaaaatgtccaagatatcagaaaacaaggtaaaaaagtctcatgactctgtgacagagtgacaacactaagccagcaccttttctttaagctaaagtaggtcagttggctgacggggacagacgggtaccgggtatgagaactcctgggccagataccctgtgtcaaagccaggccccactcccaccctcagcagtgtcttctggccacacaaggcaggatgggtcagtggccactagagacagagcagctcaacagtcctgaacccctgctcccttctcccgagtactcaactcagactaacaagcaccagcaccaaagagttaggtcaactaacctgccttgtctttaccagcatccacatggctttatctgtataaatcttctgcctttgatcatttctggatggtgtaggaaaaaaggaatagtgaccattacagtcttgggccagacaacactatttttacctaagtctcttaacctaaattacgtcgcctcttcctgaggctcagtctcttgtttaaatgttaccttggtgcaaataaaagtgataaactgtcccccactgcctcctgacgagacacatctgtctaatggccagcgtgtggctggaataagcagcattgtgaccacaggatcaggggacttcatcttctatcattagagcagaaggtatttggcaaatctttgttttatgtactgtacgagtaacttattcttgaataatgcaaattttcctacaatgtacaaattgctgtatgtgaattaaaaaggttttcagaattaca

SEQ ID NO: 3839 - DNA, 3662 bp, Rattus norvegicus
  Genbank Accession No. NM_031622
agacctgccgggcgcatatttattcacagttttgtcccatgttaagtcggttagcatagtgaatctgagtgcatagtatgtcatttcattccgttgagtttctcgagtgttttctttaaatgtctgcagagtcgctacccttccttgaactatgaagcactgcaatcttcttaattctcagtatgaagagagatttttgagctttaagtctgaggggaactcagcaggcctggttggcgtctgcaatgaacatcaagaaaccatcgtgctgtgggaatgtgatcgtttttctccctttttgagagatctttccttttgatgccagttttcttccttgtttacacaagttcaacaatttgaaaggaaaaggcaattgtaagggttttaaaatggcagagaaatttgaaagtctcatgaacattcatggctttgatctgggttccaggtacatggacttaaaaccattgggctgtggaggcaatggcttggttttttctgctgtagacaatgactgtgacaaaagagtagccatcaagaaaattgtcctcaccgatccccagagtgtcaaacatgccctccgtgaaatcaaaattattagaagacttgaccacgataacattgtgaaagtgtttgaaattcttggtcccagtggaagccagctgacagacgatgtgggctctctaacagagctgaatagcgtctacattgttcaggagtacatggagacagacttggcgaacgtgctggagcagggccctttactggaggagcatgccaggctcttcatgtaccagctgctgcgtgggctcaagtacatccactctgcaaacgtgctgcacagggatctcaagccggccaaccttttcattaacactgaagacttggtgctgaagattggtgactttggcctggcccggatcatggatcctcattattcccataagggtcatctttctgaaggattggttaccaaatggtacagatctccacggcttttactttctcctaataactatactaaagccattgacatgtgggctgcaggctgcatctttgctgaaatgctgactggtaaaaccctctttgcaggtgcacatgaacttgaacagatgcagctgatcttggagtctatccctgttgtgcacgaggaagatcggcaggagcttctcagcgtgattccagtttacattagaaacgacatgactgagccacacaaaccgctgactcagctgcttccggggattagtcgggaagcactggatttcctggaacagattctgacgttcagtcccatggaccggctgacagccgaggaagcactttcccatccttacatgagcatctactctttcccaacggacgagcctatttccagccatcctttccacatagaagacgaagtggacgacattttgctaatggatgaaacacacagtcacatttataactgggaaaggtaccacgattgtcagttctcggagcatgactggcctattcataacaactttgatatcgatgaggttcagcttgacccgagagctctgtctgatgtcaccgatgaagaagaagttcaagttgatcctcgaaagtacttggatggagaccgagagaagtatctggaggatcccgccttcgacaccagctactctgctgagccttgctggcagtacccagatcaccacgagaacaagtactgtgatctggagtgtagccacacctgtaactacaaaacaaggtcgccatcatacttagataacctggtgtggagggagagcgaggttaaccattactatgagcccaagcttattatagatctttccaactggaaagagcaaagtaaggacaaatccgacaagagaggcaagtccaagtgtgagaggaacgggttggtcaagcgcagattgcgcttgaggaagcgtcccagcagctggctgagagggagaggggccaaggctttgactttgatgccttcatcgcaggcaccgttcagctcagtgcccagcgtgagtctgctgacgtagttgacaagttaaacgacttgaatagctcagtgtcccagctagaaatgaaaagcctgatatccaagtcagtcagccgagaaaagcaagaaaagggaagggctaacctggcccagctgggagccttgtaccagccctcctgggagagccagtttgtgagtggcggggaggagtgcttccttatcagtcagttttgttgtgaggtcaggaaggacgaacacgtggagaaggagaacacttacaccagctatttggacaagttttttagcaggaaggaggattctgaaatgctagaaactgagccagtggaagaagggaagcgtggggagagaggccgtgaggcagggcttctgagcagcggtggggagtttctcctgagcaggcagctagagtccataggcaccccgcagttccacagtccagggggatccccactcaagtccatccaggccacgttaacaccttccgctatgaaatcttcccctcaaatccctcacaagacatacagcaacattctgaaacatctgaactaaacactcagcagacacttcttttgttcttcatgaaatgtgttgtgtcttttttatcactaatgttttaagtcattttttttttacttgaatcagaaggtgtcattaatttgcaaggatttttcttggttctcagtttgtaaaacacagagttttttctacatgtgagttagttttcatttgaactggcatgtcgtttgcacacacacaaagaatagagcaaaacaatgcagtgcaggaggagacaagatgcgctaggatggacagacattctcacagaccagtgacctgcttacaggaaacaaaaccttgccttgaaacttacacagtgagactgtacataattgcatgaaaagatctatttttttcctgaaacatttttcattcattagtattttcaagtttttcatactgtacacatttcttaagacacatgataccagcagcaactgaaaacgaatgccgaatttggtacacatgtgttatctacctcaaggtaacaaaagtatgcgggcgaaacctaacccacccatagtcgtccgcggcatatgcacttgtatctagccagcgttggccgcagtaaccaatgagactcgtccgccatttatcaatgtcctggtgttcatcctttacagtgaagtgttagatacatcacatcttatttatttttagcaaatcagtatattttctgtatttaattataaaaggtaacttagtttaagtttatttgcaactgcccttcttcccgtttggcactatggtttgttgcctgccgagctgatctgagaagtcagcttgtcccgaggctgtccatgtacgttaagtaaagtgctcactgtgtataggaatctgtattttggaggtgcttgatctatctacaaagaaaaaaattaggaatttattataaaatgctcctagaagtcttaatggtgtttattttttaaaaccttgtaatgttagacttgtgtgcatggaagtgattaaggtacatcattattgtagtttgaacattgtacatgataagccttcccccacccccgtttttactgtatgtttttattgaatgatctattccccatccctaggcaagcatgaataaaattaggttaaatgt

SEQ ID NO: 3840 - DNA, 1950 bp, Rattus norvegicus
  Genbank Accession No. NM_031623
gctggaccccagcctttcttcgctttcgcctcgcggtcgatgactccctagaccccctggcctacgatcatgaccacgtccctgcaagatgggcagagcgccgcgggccgggcgggcgcccaggactccccgctggcagtgcaggtgtgccgcgttgcccagggcaagggagacgcccaggacccggctcaggtccccggactgcacgcgctgtccccggcctcagatgcgacccgccgcggtgccatggacaggagaaaagcgaaagatctggaagttcaggaaacgccttccattcctaaccccttccctgagctctgctgttctccacttacatcggtgctgtcagcaggcctcttccccagatcaaattcaaggaagaaacaggtgattaaagtttacagcgaggatgagaccagcagagcgttagaggtgcccagtgacgtcacagcccgtgatgtctgccagctgttgatcctgaagaaccactatgtcgacgacaatagctggaccctttttgagcacctgtctcacacaggcgtagaaaggacagtggaggaccatgagctgctgactgaagtgctgtctcattgggtgatggaagaagataataagctgtatcttagaaagaattatgccaaatatgaattttttaagaacccaatgtatttctttccagagcacatggtgtcttttgcaactgaaatgaacggtgacagatcccttacacagatcccgcaggtgtttttaagctcaaacacatatcctgaaatccatggcttcctgcatgcaaaggaacaggggaagaagtcttggaaaaaagcttacttttttctcagaagatctggtttatatttttctactaaaggcacatccaaggaaccacggcacttgcagtttttcagtgaattcagcactagtaatgtttacatgtcactggcaggcaaaaaaaagcatggagcgccgactccctatggattctgctttaagcctaccaaagcaggagggccccgggacctgaaaatgctgtgtgcagaagaagaccaaagcaggatgtgctgggtgaccgccattagattgctcaagtatggcatgcagctctaccagaattatatgcatccatcccaagctagaagcgcctgcagttctcagagcgtatcacccatgagaagcgtatcagagaattccctagtagcaatggacttctcaggtcagaagaccagagtcatagacaaccccactgaagccctttcggttgccgttgaggaaggactcgcttggaggaaaaaaggatgtttacgcctggggaatcatgggagtcccactgcgccctctcagagctctgctgtgaacatggctctccaccggtcccagccatggtttcaccacagaatttctagagatgaagctcagcagttgattacccggcaggggcctgtggatggagttttcttggtacgggatagtcagagtaaccccagaacttttgtactgtcaatgagtcacggacaaaagataaaacactttcaaattatacccgtggaagatgatggtgaggtgttccacaccctggatgatggccatacgaagttcacagatctcatccagctcgtggagttctaccagctcaacaagggggtccttccttgcaagctgaagcattactgtgctaggatggctgtttagccaaactgtctgtgactcgttaaactatggaagatggaggatgcaaagaagaatgattagagagagagagagagagagagagagagagagagagagagagagagagagaggagatcacaaggctggaaacaaatcatggtgaaaagaagattcacctgtgggttacaaaaaaataggtcacgtattgcaaattagtgaagacttggattcgtattactctcgttactttaaatttattagttaaaattaaaccttattaaaaaa

SEQ ID NO: 3841 - DNA, 1723 bp, Rattus norvegicus
  Genbank Accession No. NM_031627
taatgtccagggctccaggaagagatgtccttgtggctggaggccgcagtgcctgatgtttctcctgactctgcaacggagttgtggaagacagaacctcaagatgcaggagaccagggaggcaacacttgcatccttagggaggaagccaggatgccccaatcaactgggggtgctttaaggatagggttggagtcatccgagcctacagccctgctccccagggcagagaccctcccagagcctacagaacttcgtccacagaagcggaaaaaggggccagcccccaaaatgctggggaacgagctatgcagtgtatgtggggacaaggcctctgcgttccattacaatgtgctgagctgcgagggctgcaagggattcttccgccgcagtgtcatcaagggagcacgctacatttgccatagcggtggccactgccccatggacacctacatgcggcggaaatgccaggagtgtcgccttcgcaaatgccgccacgcaggcatgagggaggagtgtgtcttatcagaagaacagatccgcttgaagaaactgaagcgtcaagaagaggagcaggctcaagccacatcggtgtccccaagggtttcctcaccgccccaggtcctgccacagctcagcccagaacaactgggcatgattgagaagttggtggctgcccagcaacagtgtaacaggcgctccttctctgaccgacttcgagtcacgccttggcccattgcacccgaccctcagagccgggaagcccgccaacagcgctttgcccactttactgagctggccatcgtgtccgtgcaggagattgttgactttgccaaacagctccctggcttcctacagctgagcagggaggaccagatcgccttgctgaagacctctgcgatcgaggtgatgcttctggagacatcgcggaggtacaaccctgggagtgagagcatcaccttcctcaaggatttcagttacaaccgggaagactttgccaaagcagggctgcaggtggagttcattaaccccatctttgagttctccagatccatgaatgaactgcaactcaatgatgctgaatttgctctgctcatagccatcagcatcttctctgcagaccggcccaacgtgcaggaccagctccaagtagagagactgcaacacacatatgtggaggccctgcatgcctatgtctccatcaaccacccccacgaccgactgatgttcccacggatgctaatgaagctggtgagcctccggactttgagcagcgtccattcagagcaagtgtttgcacttcgcctgcaggacaaaaaacttccccctctgctctccgagatctgggatgtccacgaatgactgtttctccgtgtcctctgtgttggccacgcagctgaagcttactgactgcttcctagaggtggagcagactgaggagggcaaacattcctgggcgctgggtgaaagagacccttgcatggcactaaagagagtcaaagggttgggtgttttgtggctgctgggcagttggggacctactaacgttgtatgccatctgaaggccttgttgacccaaccaaataaactagccaggagagccactttgtgcagggttcttcaggccctgcccaaaaaaaaaaaaaaaaaacgactaacgttgtatgccatctgaaggccttgttgacccaaccaaataaactagccaggagagccactttgt

SEQ ID NO: 3842 - DNA, 831 bp, Rattus norvegicus
  Genbank Accession No. NM_031629
ggcacgagtgactaagatggaagcgttttgggagtcacggactggccactgggcggaggtccggggcagttttaccggcgtcccgtcacccccagctgcctcatggatccgatgtctgcgcctgcgaggtccatcactcggacccagaatccgatgctgactgggacatccgtactaggggtgaagttcgactgcggagtggtgattgctgcagacatgctgggctcctacggctccctggctcgtttccgcattatctctcgtattatgcgagtcaacgacagcactatgctaggtgcttcaggagactatgctgatttccagtatttgaagcaagttctcggccagatggtgattgatgaggagctgttcggagatggacatagctatagtcctagagctatccattcatggttgacaagggccatgtacagtcgccgctccaagatgaaccctctgtggaacaccaaggtcattggaggctatgctggtggagaaagctttcttggttatgtggacatgcttggtgtagcttatgaagccccttcactagccactggttatggtgcatacttggctcagcctctgcttcgagaagttctagagaagcaaccggtgctgagtcagacagaggcccgagagcttgtggagcgctgcatgcgagtgctgtactaccgagacgctcgttcgtataaccggtttcaagttgctactgtaactgaaaaaggtgtggagatagaaggaccactgtcagcacagaccaactgggacattgctcacatgatcagtggctttgaatgaaatccagatgaagtgtccagagttaagctt

SEQ ID NO: 3843 - DNA, 3435 bp, Rattus norvegicus
  Genbank Accession No. NM_031633
gcctggctcggccccgcgtggagcagcggtggcctgtgagggtcaaagcttgtgattctcgatggagagtgaaagcacagcttcatgatgagaaccagcccccggcggccactgattctcaagagacggaggctgccccttcctattcaaaatgccccgagtgaaacctcagaggaagaagcaaagagatcccctggacagcaggagcctactcaagcacaggcctcccaagatgtggcagagtccagctcttgcaaatttccagctggaatcaagattatcaaccacccaaccgtgcccaacacacaagtggtggctatccccaacaacgcggacatccagagcatcatcacagcgctgactgccaaagggaaagagagtggcagcagtgggcccaacaagttcatcctcatcagctctggaggggcctcatctcatcctcctgatcctcaatctcaagcccaaaccagcactgattccaagagaacagaactgatcaccgagacgttgggaccaaagccaggggctaagggtgtgcctgttcccaagccacctggagctcttccaaggcaaagacaggagagctgtggtggtgaagcggccggctgcacactggacaacagcttaaccaatatccagtggcttggaaagatgagttctgatgggctgggccgctgcagcattaagcaggaactggaagagaaggagaattgtcacctggagcagaatcgggttaaggttgaggcgccctcaagagcatcagtgtcttggcaggactctgtgtctgagaggccaccctactcctatatggccatgatacagttcgcgatcaacagcactgagaggaagcgtatgaccttgaaggatatctacacttggatcgaggaccacttcccttattttaagcacattgccaagccaggctggaagtgttggcaccaggcctaccacaagctcgggccacagaactctattcgtcacaacctttctctccatgacatgtttgttcgagaaacatctgccaatggcaaggtctccttctggaccattcacccaagtgctaatcgctacttgacattggaccaagtgtttaagccactggaaccagggtctccacaatcgcccgagcacttggaatcacagcagaaacgacccaatcctgagctccgtagaaatgtgaccatcaaaactgaactcccactaggcgcacggcgaaagatgaagccactgctcccacgggttagctcatacctggtgcccatccagttcccggtgaaccagtccctggtgttacagccctcggtgaaggttcccttgcctctggcagcatctcttatgagctcagagcttgcccgtcatagcaagcgagtccgcattgcacccaaggtgctgctatccaacgaagggatagccccacttcctgccacagaacccatgaaggaggagaaacccctgcttggagaagggctattgcctttgcttcctattcagtccattaaggaagaagtaattcagcctggggaggacataccacacttagagaggcctatcaaagtggagagccctcccttggaagagtggccctctccgtgtgcatcagtgaaagaggaactgtccaactcctgggaagattcttcctgctctcctaccccaaagcccaagaagtcctattgtgggcttaagtccccaacacggtgtgtctcagaaatgctggtgacaaagcggagagagaagagagaggtgagccgatctcggaggaagcagcaccttcagccaccctgtctagatgagcctgaactcttcttctcagaggactccagcacatttcggccagccatggagatcctggcagagtcttcagagcctgcaccacagctcagctgccctcaggaggagggagggcccttcaagacccccatcaaggagacattgcctgtctcctccactcctagcaagtctgtgctctctagagaccctgagtcctggaggctcacacccccagccaaagttggggggttagatttcagcccagtacgaaccccccagggtgcctttggccctctgcctgactcgctggggcttatggagctgaataccacacctctgaaaagtgttcccctcttcgactcaccccgggagctccttaactcagaagcctttgaccttgcctctgatccctttagcagttctccaccaccacatttggaagccaagccaggctcccccgagctgcaggtccccagcctttcagccaaccgttctctcacagaaggccttgtcctggacacaatgaatgatagcctcagcaagatccttctagacatcagtttccctggcctggaggaggaccctctgggccctgacaacatcaactggtctcagttcatccctgagctgcgatagaggcagggtcttacccttgccactcaagccaccagttatcctggcacttgtgtggctggatagtgcaaggctcagtgtaccccaaaccgtctgagggagctagcaggcaagggctgagcggtgccctttgacctaattatgccaaggtaaaagccacgtctaagccactgctgggacctatgcaagcaataggatctcccagagtcctccactccctgctggcaagtgaagtgggtgtgacagagccgtgaggaccaggaaatgcccacccattagtcacctgctgctcctggcaggataacccttgtaaatggtgtcagttccccaagttgtcctgtaattataaatgtagccatattcccttagctctcattatccagagactgccaggatgggtagggtgacaaggggttgcattagcttctgcttgtggcctttgggggcaggacctgcagttcagcctcttcacactgtgggttctgctgtaggcttctagacacacaggtgtccttgccaggaccccacttactgccctttcctcacagctccccctggttctaagccagtggtactgcatgaagaaatcctgcggcaaagcctattgtctctgggtgtgtggggacgggtgtgcctgaagcaaaagcatgggtactcacgtgagtcctttaggtgtttctctgatcgtgttcccaatcatgccagggagtctagcattgagaactcaggctgaggcctgaggaggaggaggaagtgaccactgacttgcctggcttccttagcttgcacctgagttttgcaaaaagccaccctagaccccactctacaagctagcacaagaacactactgtaactacctactgaataaagcccaggtggcctgatctcggaattgagtgaggggtgatggagcccggagatgatgggcaggcctgcacctgctgcatgggccttgcacaggttgtctctccacatccttctttgactctgaaaaaaaaaaaaaaaaaaaaaaaaaaaaaaaaaaaaaaaaaaaaa

SEQ ID NO: 3844 - DNA, 1778 bp, Rattus norvegicus
  Genbank Accession No. NM_031640
gagttgcggttgctgctctgcagaacctcgtgaccaggtattccgatttggagtccttgaattaaaaacaaccatggagcatgtcattggagacagcaagaagaaaagaaactagggacaatgaggttccttttcttcctgttcgttgctgttgttcaccttttctccttgggctctggaaaagctatatacaagagtggtgtttctcagcgaacatttcaagaaataaaagaagaaatagccaactatgaagatgttgctaaagcaattatcaaccttgctgtttatggaaaataccagaaccggtcgtatgagcgtttgggacttctagttgatactgttggacccagactgagtggctctaagaacctagagaaagctatccaaatcatgtaccaaaacctgcaacaagatgggctggaaaacgtccacctggagcaggtcagaatacctcactgggggaggggcgaagaatctgcagtgatggtggtgcctcgaattcacaagttggctattttaggccttggcggcagcattgggactcctcctgaaggtatcacagcagaagtactcgtggtggcctcttttgttgaacttcaaagaagggcatcagaggcaagagggaagattgttgtttataaccagccttacactgactatgggaaaactgtgcagtaccgggagcgcggagctgtggaagctgccaaggtgggggccgtggcatccctcatccgatcagtagcttctttttccatctacagtcctcacacaggtcatcaaggatatcaagatggtgtgcccaagattccaacagcctgtatcacaatagaagatgcagaaatgatgtctcgaatggcttctcgtggggacaaaattgtcattcatctgaaaatgggagcaaagacctatccagatacagattccttcaacactgttgcagagatcactgggagcaagtatccagaggaagttgtcctggtcagtggacatctggacagctgggacgtcgggcagggtgcactggatgatggcggtggagccttcatatcatgggaagcactctcacttgttaaagatcttgggctgcgtccaaagaggactctgcgcttggtgctctggaccgcagaagaacaaggaggggttggtgcctcccagtattatgagctacataaggcaaatatttccaagtacagtttggtgatggaggctgactcaggaaccttcttacccactgggctgcagttcaccggcagtgacaaggccagggctatcatgaaggaagtcatgagtctcctgcaacccctcaatatcaccaaggtctttaatgatgcagaaggaactgacattaacttctggatccaagctggagtgcctggagccagtctgcgagatgacttgtacaagtatttctttttccatcattcccatggagacaccatgactgccatggatccaaagcagatgaatgttgctgctgctgtttgggctgttgtcgcttacgttgtggcagacatggaggaaatgctgcccaggtcctaaggaaaacaagaaggaagaaccttgttctctgcagctgggaatccccattcgggattttcacagcagccatcttcacagcaccttgttatacactcaatccccgtggcacagtttctttataccttctgttaaccatctttccttgatacgcttttacctgttctagaataagtaatcatcactactgtaccaccttgaaaatactgtttccagtttaaaaataaacaataaatatatga

SEQ ID NO: 3845 - DNA, 1356 bp, Rattus norvegicus
  Genbank Accession No. NM_031642
ggagactgtcttttccaacccgacatggatgtgctcccaatgtgtagcatcttccaggaactacagattgtgcacgaaacgggctacttctcggctctgccgtccctggaggaatattggcaacagacctgcctggagttggaacgctatcttcagagtgagccctgctacgtgtcagcctctgagataaaatttgacaaccaggaagacctgtggaccaaaatcattctagcacgggagaggaaggaggaatcagaactgaagatttcttctagtcccccagaggactctctgatcagctccggctttaattataacttagagaccaatagcctgaactctgatgtcagcagcgaatcttcagacagttcggaggaactttcgcccacgaccaagtttacctctgaccccattggtgaagtcttagtcaattcaggaaatctgagttcctcggtcatttccacacctccttcttctcccgaagtaaatagggaatcttctcaactatggggctgtgggccaggagacctgccctcacctgggaaggttcgaagtgggacctcggggaagtctggcgacaagggtagtggcgacgcctccccagatggcagaagaagggtacatcggtgccattttaacggctgcaggaaagtttacactaaaagctcccacttgaaagcacatcagcgcactcacacaggagaaaagccttacagatgctcttgggaaggttgtgagtggcgttttgcaagaagtgatgagttgaccagacacttccgaaagcatactggtgccaagccctttaaatgctctcactgtgacaggtgtttctccaggtctgaccacctggccctgcacatgaagaggcatctctgagggagcagaggatgaatcctgtaggctaaaagaggcttccaggctaagaggcggccatggaaggagggatacctgtaccagccaaagcatgccattgcttcctacccagttacctccagaggcctctctttggaaggtcttttgagggctacaaaagtcatgtcagaagcggcatagcacccacggtgcatggtgtttgggtgaccccggactcaccactggtttctaaccttctgagaggctctaagcttttcgccgtgagcatgcgcactgagaatgttaatgggtgggaatgactgactgtatgttgaggatctattactgactgtatggcgaggcagactttttttttccccccttgtggtagcaaatacctgcaagagacagaaaaaaaaagcagtttgaatgttttgtgtgtgaggagtattccaagggatgagttgaccaccaatcatttcctgaagggtgtctgcaccttag

SEQ ID NO: 3846 - DNA, 2136 bp, Rattus norvegicus
  Genbank Accession No. NM_031643
gaattccgcggaattccgcccggctgcaagatgcccaagaagaagccgacgcccatccagctgaacccggcccccgatggctccgcggttaacgggaccagctcggccgagaccaacctggaggccttgcagaagaagctggaggagctggagctggacgagcagcagcggaagcgccttgaggcctttctgacgcagaagcagaaggtgggagagttgaaggatgatgactttgagaagatcagtgaactgggggctggcaatggtggagtggtgttcaaggtctcccacaagccatctggcctggttatggctaggaagctaattcacctggagatcaaacccgcaatccggaaccagatcatccgggagctgcaggtgctgcatgagtgcaactccccgtacatagtgggcttctacggggccttctacagtgacggcgagatcagcatctgcatggagcacatggatggtgggtccttggatcaagtgctgaagaaagctggaagaattcctgagcaaattttaggaaaagtcagcatcgctgtgataaaaggcctgacatatctacgagagaagcacaagattatgcacagagatgtcaagccttccaacattctagtgaactcacgtggggagatcaaactctgcgattttggggtcagcgggcagctaattgactccatggccaactccttcgtgggaacaaggtcctacatgtcgcctgagagactccaggggactcactactctgtgcagtcggacatctggagcatggggctctctctggtggagatggcagttggaagataccccattcctcctcctgatgccaaggagctggagctgctgtttggatgccaggtggaaggagacgcggccgaaacgccacccaggccaaggacccctgggaggcccctcagctcatatggaatggatagccgacctcccatggcaatttttgagttgttggattacatcgtcaatgagcctcctccaaaactgcccagtggagtattcagtctggaatttcaggattttgtgaataagtgcttaataaagaaccctgcagagagagcagatctgaagcagctcatggtacatgctttcatcaagagatctgatgccgaggaggtagacttcgcaggctggctctgctccaccattgggcttaaccagcccagcacaccaacccacgctgccagcatctgagcctttgggaagcagcagagaggaatcctctgcccagtggcatgccatgttgctttcaggcctctcccatgcttgtctatgttcagatgtgcatctcatctgtgacaaaggatgaagaacacagcatgtgccaaatcgtacttgtgtcatttttaatattgtctttatcgctatggttactcccctaagtggattggctttgtgcttggggctatttgtctgttcatcaaatacatgccaggttgaactacagtgaaaccctggtgacctgggtggtcttcttactgatgtttgcgctgctgttcatcgtgactcactagctggctgcctgtattgtcaggattctcggacccttggtacttcactcttgctggtgacctctcagtctgaggagagggggccttctgagacccttcacaggcagtgcatgcatgaaaagcatgctttgctgctactgaaatgagcaccagaacgtgtacatcatggtattttatttttgcttttggtatagaactcagcagttcccatttaaaaaaaaaatctaaccagagcccatcactgccatgatagctggggcttcagtctgtctactgtggtgattttagacttctggttgtatttctatatttatttttaaatatactgtgtgggatacttagtggtatatgtctctgagtttggattagtgtttctaaattggtagttattttgaatgtcacaaatggattaaggaatcaacgtatcaagagttctatctttcttccagtctaagtaccaatgctattgtaaacgtgtatagtgcctacaaattgtatgaaaacccttttaaccactttactcaagatgtttatcaaatctaatctcttattctaataaaaatactatcaagttaaagtaaaaaaaaaaaaaaaaaaaacggaattc

SEQ ID NO: 3847 - DNA, 279 bp, Rattus norvegicus
  Genbank Accession No. NM_031648
atggcacctctccaccacatcttgattgtctgtgtgtgtctcctctccatggccagtgcagaagctccgcaggaaccagatccattcacctacgattaccacaccctgcggatcggcggcctcactgctgggatcctcctcttcatcttgggcatccttatcatccttagcaaaagatgccggtgcaaattcaaccaacagcagagaactggggaacccgacgaagaggagggaactttccgcagctccatccgccgtctgtccacccgcaggcggtaa

SEQ ID NO: 3848 - DNA, 859 bp, Rattus norvegicus
  Genbank Accession No. NM_031656
gcacgagctgcaggcggagactgcaccatggccccagacccctggttctccacgtacgattctacttgtcagattgcccaagaaatcgctgagaagattcaagaacgaaatcagtgtgaaagaagaggtgagaagacacctaagcttaccctgacaatcagaactttgttgaagaatctgaaggtaaagatcgacctcttgaaggacttacttctaagagctgtgtcgacgcgccagataacacaactggagggggatcgaagacagaaccttctggatgatcttgtcacccgagagagactgctcctggcatcgtttaagaatgagggttccgagccggatttgatcaggtccagcctgatgagtgaagaagcaaagcgaggaactcccaacccttggctctgtgaggagccggaggagaccagaggcttgggtttcgatgagatccggcaacagcagcagaaaattattcaagaacaggacgcaggtcttgatgccctttcctctatcataagtcgccaaaagcaaatgggccaggagattgggaatgaactggacgaacagaacgagatcatcgatgaccttgccaacctggtggagaacacagatgagaagcttcgcactgaagccaggcgagtgaccctggtggacagaaagtcagcttcctgtgggatgataatggtgatcttattgctgctcgtggctattgtggtggttgcagtgtggccaaccaactgatggcaataaggggaccacccgcagtgacacagccaacaatgagtgaaagcccagcacccttttggtacacaacacctcctctcaataaattctccacgctcccggcaaaaaaaaaaaaaaa

SEQ ID NO: 3849 - DNA, 2541 bp, Rattus norvegicus
  Genbank Accession No. NM_031657
tgcagcccatggagctcgagaacatcgtagcgaacacggtgctactcaaggcccgggaaggtggtggcgggaatcgtaaaggcaagagcaagaaatggcgccagatgctgcagttcccccacatcagccagtgtgaagagctccggctcagccttgaacgtgactaccacagcctgtgtgagcgtcacgccattgggcgcctgttatttcgtgagttctgcgctacgaggcctgagctgacccgctgtactgccttcctggatggggtggctgagtatgaggtgaccccagatgagaaacggaaggcatgtgggcgtcggctaatgcagaattttctgagccacacgggtcctgacctcatccctgaagttccccggcagctggtgagtaactgtgcccagcggctagagcagggaccctgcaaagacctcttccaggagctgacccggctgacccatgagtacctaagcatggccccttttgccgactacctcgacagcatctacttcaaccgtttcctgcagtggaagtggctggaaaggcagccagtgaccaaaaacacctttaggcagtaccgagtcctgggcaaaggtggctttggggaggtgtgtgcctgccaggtgcgggcaacaggcaagatgtatgcgtgcaaaaaactggaaaagaaacgaataaagaagcggaagggggaggccatggctctcaacgagaagcagatcctggagaaagtgaacagtaggtttgtagtgagcttagcctacgcatatgagaccaaggatgcactgtgcctggtgctgacattgatgaatggaggcgacctcaagttccacatctaccacatgggccaggctggctttcccgaagcacgtgctgtcttctatgctgccgagatctgctgtggtctggaggacttacaccgggaacgcatcgtgtacagggacctaaagccagagaatatccttctggatgaccatggccacattcgaatctccgacctgggcctggctgtgcatgttcctgagggccagaccatcaaaggccgtgtgggcactgtgggctacatggctccagaggtggtgaagaatgagcgctacacattcagtcctgactggtgggcgctaggctgcctcctgtacgagatgattgcgggacagtcgcccttccagcagaggaagaagaagatcaagcgggaggaggtggagcggctggtcaaggaggtggctgaggagtacaccgaccgcttctccccacaggcacgctcactctgttctcagcttctcaacaaggaccctgctgagcgcctggggtgtcgtggaggtggtgcccgtgaggtaaaggagcacccccttttcaagaaactgaatttcaagcggctgggagctggaatgctagaaccaccttttaaacctgacccccaggccatttactgcaaggacgtgctggacattgaacagttctccacagttaaaggtgtggatctggagcccacagaccaagacttctaccagaagtttgccacgggtagtgtgtccatcccctggcagaacgagatggtggagactgagtgcttccaggaactaaatgtctttgggctggatgggtctgttcccccagacctggactggaagggccagcccactgcaccccccaagaagggattgctacagagactcttcagtagacaaaggattgctgtgggaactgcagcgacagtgaagaagagctccccacccgcctctagcccccaggccgaggcccccaccggcggctggcggtagcagctactcagtgactgacgttgacagttttgcacagtgctgtttccagttgtccacgccagtcgtggtctgtggaacacagccggaactgtccccagtgtcctccgttcctcagccactggcccagctgagtttgacgaggcctgggccatcttgggacaaaggtgcgtcccttcagctcttctctgtggagctcggggctttatgtgtttatgtatttgtacgaatgtatatagctaccagagcgttcttaactccaccctgggtctggcaccccagggcaactagccctggccaggagagccaggagctggcaagaggaaccagtgccaacctccaggctaatggggcccagtccagatgagcaagcagagtgtgggccaggtcagacctctgaccacagcattgctccggccaccatcagactcaagtgagactcgtgcctgtctgttgtggactgaggccaccatgctccagttgcccaatgctttcattccgtctcagtgtttgtcagagctggagacgggggctttgtgttctccgggcctgggtcacagtgtgactgcaaactgagctgacggggacctatcacaccactgccccagatgggttgctttttgccttccagctcccagagcacattggtccttattctgggtcatatccaggccataagaggggttagaattagccctccaacattccagaatccctcataaaagtagacatgtgcccagcaataatccaaccttcctgtgtgtgc

SEQ ID NO: 3850 - DNA, 3411 bp, Rattus norvegicus
  Genbank Accession No. NM_031662
aagcgggcagggcggggcgcgcccagcgggagcgagcccggcgcccaccgcagagactgtcgcctggtgcctaggttcccaacaggaatatccacggactgaagtgatggagcgcagtccagccgtctgctgccaagaccctcgagcggaactggtagagcgggtggcagccatcagtgtggcccacctagaagaggcagaggagggcccagagcctgccagcaatggtgtggaccccccaccccgggccagagctgcctctgtgatccctggcagtgcttcaagacccacaccagtgcgtcccagcctctctgctagaaagttctccctgcaggaaagaccagcgggaagctgtctagaggctcaggttgggccttactctacaggacctgccagtcacatgtctcctcgggcttggcggagacccaccatcgagtcccaccatgtggccatctcagacacagaggactgtgtgcaactgaaccagtacaagctgcagagtgagattggcaagggtgcctatggtgtggtgaggctggcctacaatgaaagggaagacagacactatgcaatgaaagttctttccaaaaagaagttactgaagcagtatggctttcctcgccgtcctcccccgagagggtcccaagctcctcagggagggccagccaaacagctgctgcccctggagcgtgtataccaggagattgccattttaaagaaactggaccacgtgaatgtagtcaagttgatcgaggtcctggatgatcctgctgaagacaatctctatttggtgtttgacctcctgagaaagggaccagtcatggaagtgccctgcgacaagcccttcccagaggagcaagctcgcctctacctccgggacatcatcctgggcctcgagtacttgcactgccagaagattgtgcacagggacatcaagccgtccaatctgctccttggggacgatgggcacgtgaagatcgccgactttggtgtcagcaaccagtttgaggggaatgatgctcagctgtccagtacggcagggaccccagcattcatggccccggaggccatctctgacaccggccagagcttcagtgggaaggccttggatgtatgggccactggggttacactgtattgttttgtctacgggaagtgcccattcattgatgagtacatcctggccctgcacagaaagatcaagaatgaggccgtggtgttccctgaggagccggaggtcagcgaggaactcaaagacctgatcctgaagatgctagacaagaatcctgaaacaagaattggggtgtctgatatcaagttacacccttgggtgaccaagcatggagaggagcccctcccttcagaggaggaacactgcagtgtggtagaggtgactgaggaggaggtgaagaactcagtcaagctcatccccagctggaccactgtgatcctggtcaagtctatgctgagaaagcgttcctttggaaacccatttgagccccaagcacgcagggaagaaagatctatgtctgcgccaggaaacttactgttgaaagaaggatgtggagaagggggcaaaagcccagagcttcccggagtccaggaagatgaggctgcatcctgagtccctgcatgtgcccagggccatcggcagcatgctcattccgctcctccagaggcccaccgccctcatgcaatcatcgcccctgcaggcagggggctggggactgcagcccctctcctggcccccctcacccattgtgctgcatgacctgcgcacaggcatatccagggacaggattggaatgtgtatcatttggggctcgggggtcccggttggttctctctgttctgatctatcttgtggggaatattagaaaccctacctgactggctggtgaggcccagggcagaaggcaagagaccaaaatagcaggtggagacctggtgggctgcttctcagagaactcccatagtgatcggtggcctgcccagctgctgcacacgaggagtgattgtgtcacttctgtgtggaaggtgctgagtgctggagtcctcagatctctagtgtggatgctacaagtaatgaggcgtgcctgggagaagactgatcttggagaatccagattcctctcattgtcttttacctgagggcttgggtgggagcggctgttatggagagcatcttctggctttgggtagtccgtggtacactgtacggcagtcacgaggatctgacattcatagactgtgttttacacttggcactcgctggagaaaggaccaaagtgaatccagcttagagcatagacctgagcctggagcagtgtacttctcctgccaacctcccttcctctctcacggatctccagaatgaaggttacagaacaccaggagtgacaaggagggccacggactctcagcactgtggccctgcagatgtggaagtaactgggatctaggcgctgagccgacactggcttactcactacatgctctgatggaggaggctcagccagatgagggaccgtacaagacgcactcctgtcaggctggtggcccttctgtcagttgcttcagtacaggacatcagacagtcagcccacacaggtcagagctgcacagttgggacacacgtggacactgccctttcagaacagatgtcagctctctggattctgtggtcgtctggctattctaatgtttactgataatgctcatagggattggtccccaaagggagatgagcaggactcaggtagccctctctgaaagcctcccataagagatcctggctgcccacatgggtttcaagaatgcaggagggctaggctagaaaagagagaggctgtgcgggagcgctggttcccactcttatctctgtgcccatgggtgtacattgctccttcatgtgcacatgcgtgtgtgtgcccatctgctgtatacagcacacttgcatgtctcatactggcacatgcatctgtaatatagtttctatgtcaacttatgcctaggagcagaaggtagcccattgtcaaagggctcccatttcaacccaactcctctgcactaaggcagccagtgtaacccagggcttgaaaacaaataatctaatcctatctctaagaatacttttatagagtgaataggaggcaagttatgccaaccaataaatagcaaagagtcagggagcttcaccgatgggacccacacaggaaaagctcggagttgggtggctggctcattgtccccagcagagccaggaaggcatgctcactgtcacctgttgttgagagctttggttggctttggttttgaatgtagcacaagtgaacaaactccataagagtgtttataaaaattaacttcttaggaagtgaattaaaaacaataaaagccctttgttgagtt

SEQ ID NO: 3851 - DNA, 2858 bp, Rattus norvegicus
  Genbank Accession No. NM_031663
ggcagcgcggctcacctcgggggctccgtgcccgctgtgcgccgaagtccaggctgaggaggaggtctagagcccccggctctcccgtctcccaccaggctgcggggaactggctgccgcacccctcctccaagtgggggtagaacggagtctcacccccataggtcccagaactaaggggaacatagggccggttcctcccactgctcagccatccccaggggcttgtctaggactatagctctccaaatcccccttcccctggcttccatcctgggcgcatctcagaagcggacccctgcccggacgcgccccgcccccggcccccgccccgacgacgtcctattagcatgagcgacgccagtggccggggcaccactcgggggccgagactcaccgcgtcatagccccaagtggagggagaaagaaaaaaaaagaggcggcggtggaggaagaggcaagagcggacgcgcggggagggctggagagacggcgggcggcggcagcatgcccctgggcgggtgcacacggcctctctgcaccgcaggggctgcttctgctctctctgggcaccacgcgtccagtctcccgcctcagcccctcggcttgccggcctttgcggttgcgctcgaaacatcgtccactggtccccgaagcatctaagagcagcggcgccgcgcgggacaatccttgcttttttctgagctcggggatatgagccccacagccacctgaagcgcagggggcgctacgcggctaggaccgcgcccccgaagtaccttatcctagcctctgcactgcgggacgccgacacccgactccggtggaggcatcttagggaaagcagccggtaggggcatggaacccaccgcgccaaccggtcaggcccgggcggcggccaccaaactgtcggaagcggtgggagccgcgctacaagagccccagaggcagcggcgcctggtgctggtcatcgtgtgcgttgcactgttactggacaacatgttgtacatggtcatcgtgcccattgttcccgactatatcgcccacatgcgcgggggcagcgagggcccgaccctggtctctgaggtgtgggaacccactctgccgccgcccactctggctaatgccagtgcctacttggccaacacgtcggcgtccccgacggctgccgggtcggctcggtcaatcctgcgacctcgctaccccacagaaagcgaagatgtgaagataggtgtgctgtttgcctccaaggctatcctgcagcttctggtgaaccccttaagcgggcctttcattgatcgcatgagctacgacgtgccgctgcttataggcctgggcgtcatgttcgcctccacagtcatgtttgcctttgcagaagactatgccacgctcttcgctgcgcgcagtctacaaggcctgggctcggccttcgcggacacgtctggcattgccatgatcgccgacaagtatcccgaggagcctgagcgcagtcgtgccctgggcgtggcgctagcctttattagctttggaagcctagtggcgccaccgtttgggggcatcctctacgagttcgcgggcaagcgtgtaccctttctagtgctcgccgctgtgtcccttttcgacgcgctcctgctcctggcggtggctaagcccttctcggctgcggctcgggcgcgagccaacctgccggtgggcacacctatccatcgcctcatgctagacccttacatcgctgtggtagccggcgcgctcaccacttgtaacattccccttgcgttcctcgagcccaccatagccacgtggatgaagcacacaatggccgcatccgagtgggagatgggcatggtttggctgccggctttcgtgccacacgtgttaggcgtctacctcaccgtgcgcctggcggcgcgttatccacacctgcagtggctgtacggcgctctcgggctagcggtaattggagtgagctcttgcgtcgtacctgcctgtcgctcattcgcgccgttagtggtctcgctctgcggactctgcttcggcatcgcgttagtggacacagcgctcctacccacgctcgcctttctggtggacgtgcgccacgtatccgtctatggcagtgtctatgccatagctgacatctcctattctgtggcctacgcgctcgggcccatagtggcaggccacatcgttcactctcttggctttgagcagctcagcctgggcatgggcctggccaacctgctctacgcaccagtccttcttcttttgcgcaatgtaggcctccttacacgctcgcgttcggagcgcgatgtgttgcttgatgaaccgccgcagggtctgtacgacgcggtgcgcctgcgtgaggtgcagggcaaggatggcggcgaaccttgtagcccacctggcccttttgacgggtgcgaggacgactacaactattactcccgcagctagcagacccgcttctcctccaggccacctacccgccccatttaggtcaagatggtcattctgcaagagcactgtccaactttggcttggggcccacctcctctaatgaataccctagcccctcgcccgtcctgaattcctttgctggaatcccttctccatgacccctcccagtctaggcccctccccaaacacactcgtattcattggggaaatggagcagggaggcagaagaagctgttgggctcttggcagaggtgaagaggtgtgcgggtgatcgccaatcacctactgagagcccccaaatagagtcatgcatctgtttgtccttcctgcggatctttccagtgccaaacttggtctctgcactccggtgcctccggcctgaattaataaaccatatctatctg

SEQ ID NO: 3852 - DNA, 2372 bp, Rattus norvegicus
  Genbank Accession No. NM_031673
aaggggagcccagggcgccgaagatgcgggcggtccgggccgagacgcgggcgcgggagctcttccgggacgccgcattccccgcctcggactcctcgctcttttacaacttgtccacgcctctggcccagtttcgggaggacatcacttggagacggccccaggacatttgtgccacacctcaactgtttccagataacccatgggaaggacaggtgaagcaagggctgctgggggattgctggttcctgtgtgcctgtgccgcccttcagaagagtcgacacctcctggaccaggtcttccctccaggacagccaggctggtctgaccaggaataccaaggcttcttcacctgtcggatttggcagtttggacactgggaggaagtgaccatagatgaccgtctgccttgtcttgccgggagactctgcttttctcgatgccagagagaggatgtgttctggcttcccttactggaaaaggcctacgctaaggttcatggatcctatgagcacctgtgggcagggcaggtggcagatgccctggtggatctcactggcagcctggcagagaggtggagcctgaaggacataaggaaagccagcggccagcaggacagacccagtggtggagagcacagagcctgtcagcagctactccgtctcaaggaccagtgtctgctcagctgctctgtgctgagcccgagagcaggtgctagggagctcggggagttccatgccttcattatctcagatctgcaggagctcaggagtcagactggtcagggtatcctcctgctgaggattcacaacccttggggccggcgttgttggcagggcctctggagagaaggcggtgaagggtggaaccaggtagagccagctaaggagtctgagctgctggcacaactccaggaaggagagttctgggtagaggaagaggagttcctcagggagtttgatgaggtcaccatcggctacccagtcacagaggccggccacctgcaaagtctctacacagagaaggtgctgtgccatacgcgggcactgcctggtgcctgggtgacagggcaatcagctggaggctgccggaacaacagttgctttccctgcaaccccaagttctggttacggctcttggaacccagtgaggtgtgtgtggctgtccttcagagaccccggaggcgcttagtgggccagacccgggcactggcgggcgccagccctgcaccagtgaacctcccaggcaaagactaccaggctgtgggcctgcacatctggaaggtagagaaacggaagatcagcctgcccagagtcctgtctgcacccccggtggctggcactgcatgccatgcgtatgatcgtgagatccacttgcgttgtgagctctcaccaggctactacctggctgtccctagcacctttttgaaggatgtgccagggcagttcctgctccgagtcttctccaccgggaaaatctccctcagtgccgtcaggctggccaccaagggtgcatcacctggagcagccctgcctgcaggcgagtgggagactgtgcagttgcagggcagctggagagctggccagacagccgggggcagtagaaactttgcctcttacccctgcaatccctgcctccccttctctgttcctgagggtgctggtccccgctacatccgtatcaccctacagcaacactgccggctcagtgacagccagctccaccccattggtttccatgtctttcaggttccagcagacggtgaaaaacaggatgcgtgttccctgctgctccaggagccactgctaagctgtgtaccacattgctatgcccaggaagtaagccgcctctgcctcctttctgcggggaactacaggattgtgccctccacctacctgccagatacagagggtaccttcacagtgaccatagcaaccagaatagacagacagtccattcacagccaggagatgctgggccagctactccaggaggtctccttcatggcagtgatgaaagcctgacacaagaacctgtgtgctggctgtggccagagtggctgtttctcctgcacccagcatccaggcacatcttcaaccagtcatgagccaagcttctcctcagccctgaggcctagtgtggatcttagggctaaaatagggtgctttgtcctggattgaagacatcttggggtccaatgggtactgcagggcggggttaggactcccaagtggtatcttcattcctcagtgaaggccaagaaggtccctggggcccaggtttgctggggaaagctttgcagaatccacattcccttcttgattttggaagccttattacaccaggcaggcagattgtgacaaaagctaaaa

SEQ ID NO: 3853 - DNA, 2996 bp, Rattus norvegicus
  Genbank Accession No. NM_031675
gtggggcgggctgaaagcagctgaagcggcggccgagtcgtaggctccgacataggggcggcagctgagcggtagcggaccggctggcgggctacgaaaagacgagggatggtggactatcacgccgcgaaccaggcgtaccagtacggcccaagcagcggcggcaatggacacgggcggcggcggaggcatgggcgactacatgcgcccaggaggagactgggaccgggacctgctgttggacccggcctgggagaagcagcagcgcaagaccttcacagcctggtgcaactcccatctgcggaaggctggcactcagatcgagaacatcgatgaggacttccgggatggcttaaacttcatgcttctgctggaggtcatttcaggggagcggttgcctaagccagagcgggggaagatgcgagtgcacaagatcaacaatgtaaacaaagccctggacttcatcgccagcaagggagtcaagctggtgtccattggggcagaagagatcgtggatggcaatgcaaagatgaccctgggaatgatctggaccatcatcctcaggttcgccatccaagacatctctgtggaagagacctctgccaaggaaggactcctcctctggtgccagagaaagacagccccgtataaaaacgtcaacgtccagaacttccatatcagctggaaggatggtctggccttcaacgcgctcatccaccggcacagacctgagctgattgagtatgacaaactgaggaaggatgatccagtcaccaacctaaacaatgcatttgaagtggctgagaaataccttgatatccccaagatgttggatgctgaagacatcgtgaacacaggccggcccgacgagaaggccataatgacatatgtgtccagcttttaccatgccttttcaggagcgcagaaggcgagactggtgccaaccggcatcttgaaggtgctggttgtgaaccaggaaaatgcgcacctgatggaagattacgagcggctggcagtggatcttctagagtggatccggcgcaccatcccctggctggaagaccgtgtgcctcagaagaccatccaggagatgcagcagaagctggaggacttccgagactataggcgtgtgcacaagccccccaaggtacaggagaagtgtcagctggagatcaacttcaacaccctgcagaccaagctgcgggtgagcaaccggcctgccttcatgccctccgagggcaggatggtctcggacatcaacaatgggtggcaacatctggagcaggctgagaagggctatgaagaatggctcttgaatgaaatcccgaggctggaacgactgatcaacctggcagagaaatcccggcagaaggcttccatccatgaaggctggaccgatgggaaggaggccattctgcagcaccgggactatgagacagccaccctgtcagacatcaaagctctgatcccaaaacatgaggcctttgagagtgacctggcggcgcaccaggaccgcgtggagcagatcgcggctattgcccaggagctcaacgaactggactactatgactcccacaacgtcaacacacggtgccagaagatctgtgaccagtgggataacctgggctctctgacccacagtcgcagggaagccttggagaaaacagagaaacagctggagaccatcgaccagctacacttggagtatgctaagcgggccgcgcccttcaacaactggatggagagtgccatggaggacctgcaggacatgttcatcgtccacaccatcgaggagatcgagggcctgatctcagcccacgaccagttcaagtccaccctgccagatgccgacagggagcgtgaggccatcctggccatccacaaagaggcccaaaggatcgctgagagcaatcacatcaagctgtcgggcagcaacccctacaccagcgttacaccccagatcatcaactccaaatgggagaaggtgcagcagctggtgccgaagcgggaccacgcactcctggaagagcagagcaagcagcaatccaatgagcaccttcgccgacagtttgccagccaagccaatatggtggggccctggatccagaccaagatggaggagattgggcgcatctccatcgagatgaacgggactctggaagaccagctgagtcacttgaagcagtacgagcgcagcattgtggactacaagcccaacctggacttgctggagcagcagcaccagctcatccaggaggccctcatcttcgacaacaagcacaccaactacacaatggagcacctccgtgtgggctgggagcagctgctcaccaccattgcccgcaccatcaacgaggtagagaatcagatcctcacccgagatgccaagggcatcagccaggagcaaatgcaggagttcagagcctccttcaaccactttgacaaggaccatggcggggcactggggcctgaggagttcaagggctgcctcatcagcctgggctacgacgtggagaatgaccggcagggtgatgctgagttcaaccggatcatgagtgtggtcgaccccaaccatagtggcctcgtgaccttccaagccttcattgacttcatgtcaaaggagaccacagacacagacaccgccgatcaggtcatcggctccttcaaggtcctggccggggacaagaacttcatcactgctgaggaacttcggagagagctgccccctgaccaggctgagtattgcatcgcccgcatggccgcctaccagggccctgatgctgctccaggcgcccttgactacaagtccttctctacagccctctatggggagagcgacctgtgagccctcagccaccctgaacagactcccttggcctccggagggctgaggagccctgccccaccctgactcagtatctatgctaagagctctttgtggtctctagggtcagaggcagggaggggctaggcaggcctcttttctcagtctggta

SEQ ID NO: 3854 - DNA, 840 bp, Rattus norvegicus
  Genbank Accession No. NM_031677
atgactgaacgctttgactgccaccactgcaatgagtctctctatggcaagaagtacattctaaaggaggagaacccgcactgtgtggcctgcttcgaggagctctatgccaacacctgtgaggagtgtggaacacccatcggctgtgactgcaaggacttgtcctacaaggatcgccactggcatgaaggctgcttccactgctcccggtgcgggagctcgctggtggacaagccctttgcggccaaggaggagcagctgctgtgcaccgactgctattccaacgagtactcgtccaagtgccaggagtgtaagaagaccatcatgccaggtacccgcaagatggaatacaagggcagcagctggcacgagacctgcttcacctgtcagcgctgccagcagcccatcggaaccaagagcttcatacctaaggagaatcagaacttctgcgtgccctgctatgagaagcagtatgccctgcagtgtgtgcagtgcaaaaagccaattaccacaggaggtgttacttaccgggatcagccctggcacagggagtgctttgtgtgcacagcctgcaagaagcagctatctgggcaacgcttcacagcccgggatgagtttccatactgcctgacctgcttctgtgacctgtatgctaagaagtgtgctgggtgcaccaaccccatcagtggtctgggtggcacaaagtacatctcttttgaggaacgccagtggcacaacgactgctttaactgtaagaagtgctccctgtccttggtggggcgaggcttcctcacagagagagacgacatcctctgtcctgactgtggaaaggacatctga

SEQ ID NO: 3855 - DNA, 1177 bp, Rattus norvegicus
  Genbank Accession No. NM_031680
aagctctgtctgatgccatcagtccctgggctggactaaggaagctagggggccatgaccagtgcagaatccttgctattcacatcactaggtcccagcccaagttctggagatggtgattgtaggtttaatgaggagttcaagttcatcctgttgcctatgagctatgcagttgtgtttgtgctgggcctggccctcaatgctccaaccctctggctgttcctcttccgccttcgaccctgggatgcaacagccacctacatgttccacctggcattgtcagacaccttgtatgtgctgtcactgcccaccctcgtctactactatgctgccagaaaccactggccctttggcactggcctttgcaagtttgtccgctttctcttctattggaacctctactgtagtgtccttttcctcacctgcatcagtgtgcaccgatacctgggtatctgccacccactgcgggcaatccgctggggccgccctcgatttgcaagccttctctgcctgggtgtttggttggtagtagctggctgcctcgtgcccaatcttttctttgtgacaaccaatgccaatggaactaccatcctgtgccatgacactactctgccagaggagtttgaccactacgtctacttcagttcggcagtcatggtgctgctctttggtttgcccttcttgatcaccctggtctgctatggactcatggcccggcgactgtatcgacctttgccaggagctggacagtcatcttctcggctccgttccctccgtaccattgctgtggtgctgactgtctttgctgtctgcttcgtgcccttccacatcacccgcacaatttattaccaggcaagactgttgcaagctgactgtcatgtgctgaacattgtcaatgtggtttacaaggtgactcgacccctggccagtgctaatagctgtcttgatccagtgctctatctcttcacgggggacaagtatcgaaaccagctccagcagctatgccgaggcagcaaacccaagccccgaacagctgcctcctccctggccttggtgactctacatgaggaaagcatcagcaggtgggcggacacccaccaagacagcaccttctctgcttatgagggagatcgattgtaaccctgctgctggatatgaagggaactaactgcagggc

SEQ ID NO: 3856 - DNA, 3933 bp, Rattus norvegicus
  Genbank Accession No. NM_031683
gaattcggcctaggagtaaggcacggcctcttctacgctagcccctttgccatgggtttcctgaaactgattgagattgagaactttaaatcgtacaagggtcgacaaattatcggaccatttcagaggttcaccgccatcattggacccaatggctctggtaagtcaaatctcatggatgccatcagctttgtgcttggtgaaaaaaccagcaacctgagggtaaagaccctgagggacctgatacacggagctcctgtgggcaagccggctgccaaccgagcctttgtcagcatggtctactccgaggagggtgctgaggaccgcacctttgcccgagtcattgtagggggctcttctgagtacaagatcaataacaaagttgtccagctacatgaatacagtgaagagttagagaagttgggcattctcatcaaagctcgtaacttcctcgtcttccagggtgcagtggaatctattgccatgaagaaccccaaggagaggacagctttatttgaagaaattagtcgctctggggaacttgcacaggagtatgacaagcgaaagaaagaaatggtgaaggctgaagaagacacacagtttaattatcatcgcaagaaaaatattgcagctgaacgcaaggaggccaaacaagaaaaggaagaggctgaccgctaccaggccctgaaggatgaggtagtacgcgcacaggtacaattgcagctttttaaactctaccacaacgaagtggagattgagaagctcaacaaggaactggcctcgaagaacaaggaaattgagaaggacaaaaagcggatggacaaggtagaggatgaactgaaggagaagaagaaagagctgggcaaaatgatgcgggaacagcagcagattgagaaggagatcaaggaaaaggactcagaattgaatcagaagaggcctcagtacatcaaagcaaaagagaatacatcccacaaaatcaagaagcttgaagcagccaagaaatctctgcagaatcgtcagaaacattataagaaacgtaaaggtgacatggatgagctggagaaagagatgctgtcagtggagaaggcccgacaggagtttgaagagcggatggaggaagagagtcagagtcaaggcagagacttgaccctggaggagaaccaggtaaagaaataccaccgattaaaagaggaagctagcaagagagcagccactttggctcaggagctggagaagtttaatcgagaccagaaagctgaccaggaccgtctagatctagaagagcggaagaaagtagagacagaggccaagatcaagcaaaaactgcgggagattgaagagaatcagaaacggattgagaagctagaggaatatattaccactagcaagcagtctctagaggaacagaagaagctagagggagaattgacagaagaagtagagatggccaagcgtcgtattgatgagatcaataaggagctgaaccaggtgatggagcaattgggggatgcgcgcattgaccggcaggagagcagccgccagcagaggaaggcagaaataatggaaagcatcaagcgtctctaccctggttctgtgtatggccgcctcattgacctctgccagcctacacaaaagaagtatcagattgctgtgaccaaggttttaggaaagaacatggatgctattattgtagactccgagaagacaggtcgggattgtattcagtatatcaaggagcaacgtggagagcctgagaccttcttgcctcttgactacctggaggtgaaacctactgatgagaaactccgagaactgaagggggccaagctagtgattgatgtgattcgctatgagccacctcacatcaaaaaagctctgcagtatgcttgtggcaatgcccttgtttgtgacaatgtggaggatgcgcgacgaattgcctttggaggtcaccaacgccacaagacagtggcattggatggcaccctgttccagaagtcaggagttatctctggtggagccagtgatctcaaggcaaaggcacgacgctgggatgagaaggcagtagacaaactaaaagaaaaaaaagaacgtttgacggaggagctaaaagagcagatgaaggcaaaacgaaaagaggcagagctgcgtcaggtgcagtctcaggcccatgggctacaaatgcggctgaagtactcacagagtgacctagaacagactaagacaaggcatcttgccctgaatctccaggaaaaatctaagctggagagtgaactagccaacttcgggcctcgaattaatgatatcaagagaatcatacagagccgagagagggaaatgaaagacttgaaggagaagatgaaccaggtggaagatgaggtgtttgaagagttttgtcgggagattggtgtgcgtaacatccgcgaatttgaggaagaaaaggtgaagcggcagaatgaaattgccaagaaacgcttggaatttgagaatcagaagactcgcttgggcatccagttggattttgaaaagaatcagttgaaggaggaccaggataaagtacacatgtgggagcagacagtaaaaaaggatgaaaatgagatagaaaagcttaagaaggaggagcaaagacacatgaagataatagatgaaaccatggctcagctccaagaccttaagaatcagcacctggccaaaaagtcagaagtgaatgacaagaatcatgagatggaagaaattcgcaagaagcttgggggtgccaataaggaaatgactcacttacagaaggaagtgacagccattgagaccaagcttgaacagaagcgcagtgaccgccacaacctgctacaggcctgtaagatgcaggacatcaaattgccactgtcaaagggcaccatggatgatattagtcaggaagaaggtggctcccagggagaagagtcagtgagtggttcccagagaacatctagtatctatgcacgagaggccctcattgagattgactacggtgacctgtgtgaagatctgaaggatgcacaggcggaagaagaaatcaagcaagagatgaacacactccagcaaaagctgaatgagcagcagagtgtgcttcagaggattgctgcccctaacatgaaggccatggaaaagctggaaagtgtccgagacaagttccaggagacctcagatgaatttgaggcagcacgaaagcgagcaaagaaagccaagcaggcatttgaacagataaagaaggagcgctttgaccgattcaatgcttgttttgaatctgtggctaccaatattgatgagatctacaaggctctgtcccgtaacagcagtgcccaggcattcttgggccccgagaatcctgaagagccctatttggatggtatcaactacaactgtgtagctcctggcaaacgtttccggcctatggacaatttgtcaggcggggagaagacagttgccgcactggccttgctttttgccattcacagctacaagccagcccccttcttcgtcctggatgagattgatgctgccttggataacaccaacattggcaaggtggcaaattacatcaaggagcagtcaacttgcaacttccaggccattgttatctctctcaaggaggaattctacaccaaggctgagagcctcattggagtctatcctgagcaaggagactgtgtgatcagcaaagtcctgaccttcgacctcaccaagtatccagatgccaaccctaaccccaatgaacaatagcaggaattctgtcttcttgtctggatccctgaactgcccttctatccatcttctctcctggatctcatcacccactatcatggatcgcctggcaccatacccccttatgtttgtgtgcatgtgtgattgattgtgtgcatgttaatttgtttgcaaaaataaatactggagactggtttt

SEQ ID NO: 3857 - DNA, 1766 bp, Rattus norvegicus
  Genbank Accession No. NM_031684
caccatgacaaccagtcaccagcctcaggacaggtataaggctgtctggctcatcttctttgtcctgggtctggggacactgctcccctggaatttttttataacagcaacccagtatttcacaagccgcctgaacacgtcccagaatatatccttggtcaccaaccaatcatgcgaaagcaccgaggccttggctgacccctcagtgtccttgccagcccggagttctctcagtgccatcttcaacaatgtcatgaccctgtgtgccatgttgcccttgctgatcttcacctgcctcaactctttcctgcatcagaaggtgtctcagtcccttcggatcttgggcagcctgctggctatcctgttggtgttcctcgtcactgccaccctggtgaaggtgcagatggatgccctgtccttcttcatcatcaccatgatcaagattgtgctcattaactcatttggtgccattttgcaagccagccttttcggtctggcaggcgtcctgccggccaactacacagcccccatcatgagtggccagggcctggctggcttcttcacctctgttgccatgatctgtgccgtcgccagtggctctaagctgtcagaaagtgcttttggttacttcatcacggcctgtgcagttgtcattctggccatactgtgttacctggccctgccttggatggaattctaccgacattacctgcagctcaaccttgcggggcctgcagagcaggagaccaagttggatctcatcagtgaaggagaggagccaagaggaggaagagaggaatctggggtgccaggccccaactctctacccgccaacagaaaccaatccatcaaagccatactgaagagtatctgggtcctggctctgtctgtctgtttcatcttcacagtcaccattgggttgttccctgctgtgactgctgaggtggaatccagcatcgcaggcacaagtccctggaaaaactgctacttcatccctgtggcctgcttcctgaatttcaatgtctttgactggctaggccggagcctcacagctatttgcatgtggcctggtcaggacagccgctggttgccggtcctggtcgcctgcagggttgtgtttatccccctgctgatgctctgcaatgtgaagcagcaccactacctgccctccctctttaagcatgatgtctggttcatcaccttcatggccgcctttgccttctccaatggctacctcgccagcctctgcatgtgcttcgggcccaagaaagtcaaaccggctgaggcagagactgccggaaacatcatgtccttctttctgtgtctgggcctggctctgggagctgtgttgtccttcttgttaagggcacttgtgtgagcgaccctgtgtggacagaggaactacactgcctgcttcctgctcacttccttcgctgttagggacgagcaggggtccagagggctgctcttctgctttcctccggtgctgggcccagatgtccaggaacaaaggagggagcctctgaggatggacttgggattgggggtcagagtggtagggggacaatggtctctgacggacagctctgactgatccctgcctaagccaagcacaagagactccacaaggatggggtggagacagatggctgactgtgtatcatgatctgatgtcccttgcccttctttcttctgtgcctgttccaggtccccgatccttgtcattttactgccttttttatactgacagaaaccaggtgccttca

SEQ ID NO: 3858 - DNA, 683 bp, Rattus norvegicus
  Genbank Accession No. NM_031685
taggccggcatcatggagccactataccaacaaacgcacaagcaggtccacgagatccagtctcacatgggacgcctggagacggcagacaagcagtctgtgcacttagtggaaaatgaaatccaagcaagcatagaccagatattcagccacctggagcgtctggagattctgtcaagcaaggagccccccaatagaaggcagaacgccaaacttcgtgtcgaccagctaaagtacgacgtccagcacttgcagactgccctcaggaactttcagcaccggcgccaagccaaggagcagcaggagagacagcgagatgagcttctgtctcgcaccttcaccactaacgactctgacaccaccattcccatggatgaatcactgcagtttaactcctccctccagaacattcaccacggcatggatgacctcattggaggcgggcacagtattctggagggactgagggcccagagactgaccttgaaggggactcagaaaaagatcctcgacattgccaacatgctcggcttgtccaacaccgtgatgaggctgattgagaagcgggccttccaggacaagtacttcatgatcggtgggatgctgctcacttgtgcagttatgtttctcgtggtgcagtacctgacatgagccagctgtacccagcactggacagccttccc

SEQ ID NO: 3859 - DNA, 467 bp, Rattus norvegicus
  Genbank Accession No. NM_031687
  misc_feature (1)..(467): n = a or c or g or t
cggcagccaacatgcagatcttcgtgaagaccctgacgggcaagaccatcactcttgaggtcgagcccagtgacaccatcgagaatgtcaaggccaagatccaagacaaggaaggcatcccccctgaccagcagagactgatctttgctggcaaacagctggaggatggccgcaccctgtccgactacaacatccagaaagagtccaccttgcacctggtgctgcgtcttcgcggtggcatcatcgagccgtcccttcgtcagcttgcccagaagtacaactgtgacaagatgatctgccgcaagtgctacgcacgcctgcacccccgtgcagtcaactgccgcaagaagaagtgcggccacaccaacaacctgcgccccaagaagaaggtcaaatagagctgggcctatacctggcctgtgaccccgggaccaaataaagtccccttccatcgactggagcagtan

SEQ ID NO: 3860 - DNA, 2725 bp, Rattus norvegicus
  Genbank Accession No. NM_031695
aagcaggctgcgccgtggctggccccacagtgggctgggaaaggattggccacggtgacagccgccccgtggccagcacaatgaagtgctcccttcgagtgtggttcctctctatggccttcctgctggtgttcattatgtctctgctcttcacgtactcacaccacagcatggctaccttgccctacctggactcggggactctgggcggaacacaccgagtgaagctggtaccgggctatactgggcaacagcgccttgtcaaggaggggctttcggggaaaagttgtacctgcagtcgctgcatgggtgatgccggcacctctgagtggtttgacagccactttgacagtaacatctcacctgtctggacgagagataacatgaacctcaccccggatgtccagcggtggtggatgatgctgcaaccccaattcaagtcacacaacaccaatgaagtgctggagaagctcttccagatcgtgcccggtgagaacccctaccgcttccgggacccccagcagtgccggcgctgtgctgtggtcgggaactcaggcaaccttcggggctctggctatgggcaagaagtggacagccacaactttatcatgaggatgaatcaggcaccgactgtaggctttgagaaggatgttggcagccgaacaactcaccatttcatgtacccggagagtgccaagaacctgcctgccaacgtgagctttgtgctggtgcccttcaaggccctggacctgatgtggattgccagcgccctctccacaggacagatccgattcacctatgctccagtgaagtccttccttcgagtggacaaagagaaggtccagatttacaacccagccttcttcaagtacatccatgacaggtggaccgagcaccatggccgctacccctccacaggaatgctggtgctcttctttgcactacacgtgtgtgatgaggtgaacgtgtatgggttcggggccgacagccgtggcaactggcaccactactgggagaacaaccggtacgcgggcgagttccggaagacaggcgtgcatgatgccgacttcgaagcccacatcattgacattctggccaaggccagcaagattgaagtctaccgagggaactgagcagcctcaggcgccttcagaaccagtcacttcagggtctggcaagcgccggttgccgcccaccaatcagactgcgccgtccccagcaaccaatcagtgctgcagttgggaggagcttctttcttagccaatcacacaactcaaggagaacttccggcgccgccgtctccaccaatcatggccttgggaggcggcgggcctggaccccctcccccaacccccaacccccaaccccgctttggatgagaatttttctgctttttaagaggccggtctgggtctgggagggagcaccttgaactgctcatttccagcttagtcccgatgggtgagtgaagcccgccaaagaaatgtggtcccggcgagatactttccagggcattctgtggctcaccagctagtagggggttgtattcactccctagttgggttaactcattaagaatgggaaattattatgtggacactgaagggaagtgttttctggggcctgaggcattcactgaagccctttctcccaaatgaacctcaactttgacctaggtcaagtcatgcaaatagcttccagttgtaacccgattcttgactcaccagccctttaggagctggaaagtaggttagaacaggcgagtaagcatggtaaaggggcggacaggaggagccatgcatggcagataccaatctgctcctccccagcaaagctccgagccatctgcaaggcctgcaaacaactgtcaagcgatcttggttggatagccatccctggcagctggagggtaactaaagtatgaatccaaagcaaatccaacacccaagcaagaggctgcctgctcctctttggggtgacaatgaaagaaaaagatacatgcacagggcactcctttccagcctactgtccaaccctgctgctctcgccttagggctaaagacttgggccgcgtgtgtgagagcacaagcagcggagtcccggtggtctcattttgtctccaaatcaacaggtgagctggagaggagacccaggacctaaggacagacgctgagaaggtggtggggaacaggagtgagggcacacgtgagagaagcaccttgcatgtgacccggtggagcttcctacccgttcctgacactaatgaggccctagggaggtcgacattaacaagcagcttcctggttgggggacagtcacacgtaaggagtgtgttaaagtttggtatgaggcaagtacccctaaaaactaatatatgaagaactttgcttgaatttgttccttccaagtttcaaaagcaggggtagagaaaaagggagtataccgagaagggctgtagcggaacctctcagggctctaatcatcgtgcagtcactgtaccagtggccgttcttgcctgtctccgctctcccaagaagctgctgtgatgagaagtgggaaagtactgcgattacgacaaacagtattgagaagaagaatttatttttcctccttttgttttgcttaaaccatgagtcaccattctagaaaaggtaggtcccagcacccacatcctttttcttctacagttatttaaacattcaatttttccctctgtttcttttcc

SEQ ID NO: 3861 - DNA, 2234 bp, Rattus norvegicus
  Genbank Accession No. NM_031698
ctcggaggaatggcgccgccgggttcaagtgctgtcttcctgttggccctgacaatcacagccagcacccaggctctgacccccacccactacctcaccaagcatgatgtggaaagactgaaagcctcactggatcgccctttcacgagcttggagtctgccttctactccattgtgggactcaacagccttggggcacaggtgccagatgtcaagaaagcgtgtgccttcatcaagtcaaaccttgatcccagcaacgtggattctctcttctatgctgcccaatccagccaagtcctctcaggttgtgagatatctgtttcgaatgagaccagagatctgcttctggcagcagtcagcgaggactcctccgttgcccaaatctaccatgcagttgccgccctcagtggctttggtcttcccttggcatcccatgaagcccttggtgcccttaccgctcgcctcagcaaggaggagactgtgctggcaaccgtccaggctctgcacacagcatcccacctatcccagcaggctgacctgaggaacattgtagaagagatcgaggaccttgttgctcgcctggacgaactagggggtgtgtatctccagtttgaggaaggcctggaacttacagcattgtttgttgctgccacctacaagctcatggaccatgtggggactgaaccgtccatcaaggaggatcaggtcatccagctcatgaacacaatcttcagcaagaagaactttgagtccctctcagaagccttcagtgtggcctctgctgctgctgcattgtcccagaatcgctatcacgtaccagtggtggttgttcctgagggctctgcttctgacactcaagaacaggctatcctgcggttgcaagtcagcagtgttttgtctcacgctctggctcaagccgcagttaagctggaacatgctaagtccgtggcttccagagctactgtcctgcagaagatgcccttttcacttgtaggggatgtttttgagctaaacttcaagaatgttaaacttcccagtggctactatgacttctctgtcagagttgaaggtgacaaccgttacattgcaaacactgtagagcttagagtcaagatctccactgaagttggcatcaccaatgctgatctttccactgtggacaaggatcagagcatcccacccaaaactacccgggtgacctacccagccaaagccaagggcacattcatcgcagacagccatcagaacttcgccctgtttttccagctggtagatgtgaacaccggtgcggagctcacccctcaccagacatttgttcgacttcataaccagaagactggccaggaagtggtgtttgttgctgagccggataacaagaatgtgcataagtttgaactggacacctctgaaaggaagattgagttcgactctgcctctggcacttacacactctacctaatcatcggggacgccactttgaagaaccccatcctctggaacgtggctgatgtggttatcaagttccctgaagaagaagctccctccactgtgctgtcccagaacctttttaccccaaaacaggaaattcagcacctgttccgagagcctgagaagaggccccccactgtggtgtccaatacattcacggccctcatcctctcgcccttgctcctgctctttgcactgtggatccggattggagccaatgtctccaacttcacctttgctcctaccacgattatctttcacctgggacatgctgcaatgctggggctcatgtatgtctactggactcagctcaacatgttccagaccctgaagtacctggccgtcctgggcactgtgacatttctggctggcaaccgaatgctggcccagcaggcagttaagagaacagcacattagttccagaagaagtttgaagaccctgaactcggaaatgaccgtttaacaaagagtggagacagttcagagtgtggaaagaatcgggggacagaataggagaagaggaaatacctgttatttaaagagagaaaagtcgagctatgcttacacgtttacttgtttctcactttttgcttcactgaacagatatgtttggacccagattgtctgtccctttgttgtgatgcctggccagattctgtgaatatcccaggttacccagaggttgtatttgaaaagttgaaatctgtaattcatcagctttggaataaagagaatggtggactccc

SEQ ID NO: 3862 - DNA, 893 bp, Rattus norvegicus
  Genbank Accession No. NM_031699
cagagagcaggggtatcagcgctaacctcctggctgagactccatcaccttcggggagcccaagcgcgcactttgcaaactccgctttctgcacctgccactgagcctcagaaaagagccatggccaacgcggggttgcagcttctgggtttcatcctggcttcgctgggatggatcggctctatcgacagcactgccctgccccaatggaagatttactcctatgctggggacaacatcgtgactgctcaggccatctacgagggactgtggatgtcctgcgtttcgcaaagcaccgggcagatacagtgcaaagtcttcgactccttgctgaatctgaatagtactttgcaggcaaccagagccttgatggtaattggcatcctgctggggctgatcgcaatctttgtgtccaccattggcatgaagtgcatgaggtgcttagaagatgatgaagtgcaaaagatgtggatggctgtcatcgggggcataatatttgtaatttcaggtctggcgatattagtggccacagcatggtatggaaatagaattgttcaagaattctatgaccccatgacccctgtcaatgccaggtatgaatttggccaggctctctttactggctgggctgctgcctccctctgcctcctgggaggtgccctactttcctgctcctgtccccggaaaacaacctcttacccaacaccacggccttatcccaagccaacaccttctagtgggaaagactacgtgtgacagcggcgaaggaagagatcctcctggagcgaatacgaaatggacattgagactagcattgacattaaggcctcaaactgttgacaatggtaatctaaactgtggtagaacaaaagcaagcatatttttatacgtcc

SEQ ID NO: 3863 - DNA, 1192 bp, Rattus norvegicus
  Genbank Accession No. NM_031700
ggaaaggagccgttagcgtgctccgtccattgccatccaccggtcgttcccggcgacagacctccgtcaacttttgaaggggagttggttctcaggtccagcggccgcgatccctggtctcccagcctacggagttacccggcggagttcaagtccagcagccatgtccatgagcctggagatcaccggcacgtcgctggccgtgctgggctggctgtgcaccatcgtgtgctgcgcccttcccatgtggcgcgtttcggcattcatcggcagcagcatcatcacggcgcagatcacctgggaaggcctgtggatgaactgcgtgcagagcaccggccagatgcagtgcaagatgtacgactcgctgctggccctgccgcaggacctccaggccgcccgagctctcatcgtggtgtctatcctactggcagccttcgggctcctcgtggcgctcgtgggggcccagtgtaccaactgcgtacaagatgagacggccaaggccaagatcaccatcgtggcgggagtgcttttcctgttggcggctgtgctcaccttagtgccggtgtcctggtccgccaacaccatcatccgggatttttataacccgctggtacctgaggcccagaagcgagagatgggaactgggttgtacgtgggctgggctgccgccgcgctgcaattgctagggggcgccttgctgtgttgctcctgcccaccacgcgagaagtacgcacccaccaagatcctctattccgcgccgcgatccaccggccctggcaccggtaccggcaccgcctatgaccgtaagactacgtctgagaggccgggtgcgcgcacaccgcaccatcaccactaccaaccgtcgatgtaccccacccgtccagcgtgcagcctcgcctcagagaccaccccaccttccagacggttacagacgccacgcagtctgcttgctaggctggaagaggacagacagcctggcgtccccttttctccggttgccacctgattacctggcctaggaactgtccaagtcgaatggacaaagacacctcgcccttcccaagtacagggttggggtggccatcgcagctacttgccagccccgcagccagaaggctcatagtgggcagagacaggcaaactataaaaagggccgtttcgtatttttcaataaaagcctttcgtttttgca

SEQ ID NO: 3864 - DNA, 1608 bp, Rattus norvegicus
  Genbank Accession No. NM_031704
acggatcagggtgtctacctgggtctctcaaagacacaggttctgtcccctgcaactgctatcaatagcagcagtgacatcgctcctttgcccaccccggtggccctggtcccctcccctcccgacactatgtcctgccgggatcggacccaggagttcctgtctgcctgcaagtcgctgcagagccgtcagaatggaatccaaacaaataaaccagctctgcacgctacccggcagtgcagcgagtttaccctcatggccaggcgcattgggaaagatctcagcaatacatttgccaagctggagaagctaacaatcctggcaaagcgcaagtccctctttgatgataaagcagtagaaattgaggaactaacatacatcatcaaacaggacatcaatagcctcaacaaacaaattgctcagcttcaagattttgtgagggccaagggcagccagagtggccggcatctgcagacccattccaacaccattgtagtttcattgcagtcaaaactggcttccatgtccaatgacttcaagtctgttttggaagtgaggactgaaaatctgaaacagcagaggaaccgtcgggaacagttctccagggcgccagtgtcggcactgcctctggcccccaacaaccttggaggtggtcccatagttctgggaggagagtcccgagcctccagggacgtggccatcgacatgatggaccctagaacaagccagcagcttcagctcattgatgagcaggattcctacatccagagtcgggcagacaccatgcagaacattgagtctacaattgttgagctgggctccatttttcaacaattggcacacatggttaaagaacaggaggaaacaattcagaggattgacgagaatgtgcttggagcccagctggatgttgaggccgcccattcagagatcctcaagtacttccagtcagtcacctccaatcggtggctcatggtcaaaatcttcctcatcctcattgtcttcttcatcatctttgtggtcttccttgcctgaaccctcctccctcattctgagccactccatggagggcctggaacccttctggaaggacaggtggccactattgccactgagcctgtgcagggtagttgggagaaaggccatttccttggaactgctaagaatggccagtgtccctgattccccacccttgtctctggccactctgtcctaccctcaggcccatgaaacacactggttctggatttggcctctgctgtgaagtggcagggaacagaagccagctagggccagtggggaggttgtctctaccatgagatttttataaacccagaccagcctcccctaaaggtaactggcagcaagaggaaacaatgccctccttgccttctggagagtgaggtgaggaagtaaaactatcccagggaccaacttaatcatctgggtcatctagaacttgactgccaccttctcctcaccatgtgaggtgggggggctctgagccctacagttgcacaaacctgactttggctactggtgactctcaatctgccaaacatgctgcagcctgtttcctcccaattacagcaagactgtcagccttca

SEQ ID NO: 3865 - DNA, 2091 bp, Rattus norvegicus
  Genbank Accession No. NM_031705
attttcaagggccagcgagagagggagtttggcacagtttgtggagaactcaaagaaaaaccaactctgttcgcagtccccagctcctccagccatggcaccacaagaacgacttctcatccgcgggggtcgcgtggtcaatgatgacttctcacaggtggccgacgtgctagtggaggacggcgtggtgcgggcgctgggacgggacttgctgcctcccggggacacatcccgggggctgcggatcctagatgcagcgggcaagctcgtcctgccgggaggcatcgacacacacacgcacatgcagttcccgttcatgggctcgcagtcagtcgacgacttccaccagggcaccaaggctgctttggcaggaggcaccaccatgatcattgattttgcgattcctcagaaaggcagctccctcattgaagcttttgagacctggcgcaactgggcagaccccaaagtctgctgtgactatagcctgcacgtggcagtgacatggtggagtgacaaggtaaaagaagaaatgaaaacccttgcccaagataaaggcgttaactctttcaagatgtttatggcctacaaagacctgtacatggtgcaagaccagcaaatgtacgctgccttttctcagtgcaaggagataggggccattgctcaggtgcatgccgagaatggagatttgattgcagagggggccaagaagatgctggcactggggataacgggccccgaggggcacgagctgtgccgcccggaagcagtggaggcagaggccaccttgagagccatcaccattgctagcgctgtgaactgccctctatacatcgtgcacgtgatgagcaaatccgcagcgaaggtgatagctgatgcgaagagagaaggaaaggtggtctatggagaaccaattgcagcaggtctgggcacggatggcactcagtactggaataaagaatggcgccatgcagcccaccatgtcatgggtcccccactgagacctgatccatcaacgcctggctttctcatgaatctgttggctaatggcgatctgaccacaacagggagtgacaactgcactttcaacacctgccaaaaagctctagggaaggatgacttcactaagattcccaatggggtgaatggtgtcgaggacaggatgtcggtgatatgggaaaagggcgtgcacagtggcaaaatggatgaaaatagatttgtggcagttaccagcacaaatgcagccaaaatctttaatctttatccgaaaaaaggaagaatagctgtaggctcagatgctgacatggtgatctgggacccagaagccaccaggacgatctcagccaaaacacatcatcaggccgttaacttcaacattttcgagggcatggtttgccatggggtgcccctggtgactatttcaagaggcagagtggtgtatgaagcaggcgttttcgacgtcacagcaggacacgggaagtttattccgcgacaacctttcgctgagttcatttacaaacgagtcaagcagcgagaccagacctgcacacctataccggtgaagcgtgcgccctacaagggagaagtcatcacattgaaacccagagagacaaaagaagacgacacagctgggaccaggatgcagggccattcctgatttggatgctggggttaagcaagtgcaaacagagtgaaggctcccaggctcccctccccaccatgctgccaagccctggagaagcacctgccatttcaactctccaagatcctttaggaaaaattcatcgctctaggcctctttgatttttctctcagaagcaatagcagcctgcctcaccctgcctttgttgctgtggaagattgaggatataaatgaacattattgggatgaaacgtctgcatgaagattcattgaagattcctttttcaaatgccatctctccttaccctagatttctttctttgggtttttaaagatttccttctggtgtaaaggttttgtttgtttgttttgttttaatgtttatgtttgttttaaaaatcagtgattttacatttcattgcaactaataaacatctggagcttcattctgc

SEQ ID NO: 3866 - DNA, 696 bp, Rattus norvegicus
  Genbank Accession No. NM_031706
ctctttccagccagcgccgagcgatgggcatctctcgggacaactggcacaagcgccgcaagaccgggggtaagagaaaaccctaccacaagaagcggaagtatgagctgggacggccggccgccaacactaagattggccctcgccgcatacatacagtccgagttcgaggaggcaataagaagtatcgtgctctgagattggatgtggggaacttttcctggggctcagagtgttgtactcgcaaaacaaggatcattgatgttgtctacaatgcatccaataacgagcttgtccgcaccaagaccctggtgaagaactgcattgtgcttattgacagcacaccgtaccgacagtggtacgagtcccactatgcactgcccctgggccgcaagaagggggccaagctgactcctgaggaggaagagattttaaacaaaaaacgatcaaagaaaattcagaagaaatatgatgaaaggaaaaagaatgccaaaatcagcagtcttctggaggagcagttccagcagggcaagcttctcgcctgtattgcctcaagaccaggccagtgtggcagagcagatggctatgtgctcgaaggcaaggagctggagttctatctgcggaagatcaaagcccggaaaggcaaataaactgtcatagctcgtgtaataaaggtgtttgctgttctgtatatgt

SEQ ID NO: 3867 - DNA, 4050 bp, Rattus norvegicus
  Genbank Accession No. NM_031707
ctgaagctggcttttgcgtttttctacacgtacactaattttatggaatagttaaagtgctatattctccgcgcaaccttttcaaattccaaatgtttgaacgttttggtgtcagcgcgagtgaaatcattttaccgacaagaactaactgaattgtctgcctcgttgagttgcctccggaaaagatctcgggggtggaaaagcaactgcaaaataacagacggagaaaattccttggaagttatttctgtagcataagagcagaaacttaagagcaagttttcattgggcaaaatgggggaacaacctatcttcagcactcgagctcatgtcttccagatcgacccaaacacaaagaagaactgggtacccaccagcaagcatgcagttactgtgtcttatttctatgacagcacaaggaatgtgtataggataatcagtctagacggctcaaaggcaataataaatagcaccatcactccaaacatgacatttactaaaacatctcaaaagtttggccaatgggctgatagccgggcaaacactgtttatggactgggattctcctctgagcatcatctctcaaaatttgcagaaaagtttcaggaatttaaagaagctgctcggctggcaaaggagaagtcgcaggagaagatggaactgaccagtaccccttcacaggaatcagcaggaggagatcttcagtctcctttaacaccagaaagtatcaatgggacagatgatgagagaacacccgatgtgacacagaactcagagccaagggctgagccagctcagaatgcattgccattttcacatagtgccggggatcgaacccagggcctctctcatgctagttcagccatcagcaaacactgggaggctgaactagccacgctcaaggggaacaatgccaagctcaccgcagcgctgctggagtccactgccaacgtgaagcagtggaagcaacagctggctgcctaccaggaggaggcagagcggctgcacaagcgggtcacggagctggaatgtgttagtagtcaagcaaacgcggtgcacagccacaagacagagctgagtcagacagtgcaggagctggaagagaccctaaaagtaaaggaagaggaaatagaaagattaaaacaagaaattgataacgccagagaacttcaagaacagagggactctttgactcagaaactacaggaagttgagattcgaaataaagacctggaggggcagctgtcggagctggagcagcgcctggagaagagccagagcgagcaggacgctttccgcagtaacctgaagactctcctagagattctggacgggaaaatatttgaactaacagaattgcgggataatttggccaagctactagaatgcagctaaagaaagtgaaatttcagtgccaatagatgaagagatactgtctgtcttcgtaggactgtttgggctctgtaccaagattgcacaaaattttttgaatatcattcctccagaaggagggtgttttgaaaattggaattgtatatttcagtataaattttagaatttagcttatagctagttgggggaaaaaagacatgaaaaacttgaaccacaaattacctccatgtacattggccatagttaaccagaaagttataagtagacacttaatgcaatcttttcccctgatagtagccaatgggagaattaacaatgtctgggtcccttctcctttttctgttcaacacagtgaagattatctgctttttaaatttatttacgatatctacagctgtgttttgtgtaaaaacttagtaatggaagccctgtctttgttgttatctgaataatttctcaggatatttttttgctgctgagaaagggccattaccaattaatccttgccaggagttggggagctatgtctctaattggaatcactataactgggtgtctggagttcttcccttttcgtactgagagtgttctcactctagtgactcctctggtacactccgtgttctccaatcttgtctgttgtactttacttttccatattgactccatgtatttatgagaagatattatctcccattttattatacattttgaagccaactaaacaaaggcagctgagtccttcagatatttttctttttaaatttatagtaaatttgacacagaactgaaattcagcagtccgtctttgacggtttagtctagcaatgttaaggatatttagagaaaatatgcagttacgtttatttatatatttggcaagaaattttttctggatgatcaatgcttttcaatttatgataaataatggttagggggcgctgtttattatagataattttaaggtatatagctgttttcaaggaggtccacttccgtctagcagccaagcagaggactgtatctaaatcgtgatcgtggcagatgggtcttcatagaaaccatgtctttattcaaacttcatagggcaatattttgaactgttacctaggcatttcaaaacaggaaataccgtcaacagactcttctccaagagcaggttttactgttgttttgatgtaattttaagacatttagcaaacatgcatttctttatatgatacatttctttcacaaaacaatttaaaagtaagccacgtgctgtctgctctgcccgggtaggaattgcatcagaatacatatatcttgctgtacaatgcctgtgatattgaagagggttcttttcatgtatgcttgagtatctaactctggagtcaatgaatgcactgacttttttttttgttcgtaccccaaatgattgaattgttaagtacaaattaagcagattaactcattttttcactcataaacagattcttagtactagttttgttttatatttatgtgtatgtatgtaaatacatacatattaatttatattagagtgaaaaataaattgtttgtttctaacattagtttctacagtaaggtgtctctgaaacatgtgtgtcagacacttagccaccatgcattctatgtgctaccccatcatgccagtcacctccatcgacgttagggtattttccttacctgtctattataaagagaataacttaggtacacatgctcagagccgagatatttctctgataaatcaggtaataaaatctatttgatgggtagaattttgaaaacagacatgattttatctatgagtttctgaatatcaaagaacaccaggttttcatttaaatagaggtctaacactagggatcagggaatttagttatgaagagtttaaaaaaaaaatctaaaaaagtaaaaaaaaaacagtataagctgttgataaggtaagcaaattattttaatgatgtaataaaatatttttaaattttggcatagtgatcatttaatgggaaaatactcaccaaaatgtctccacttgaattgtactgataatgtgaggcatatgtgtaactcaatatatacatatacctatatgtatatacagaaattatttttaatattttcctactgctgtgaaatttaaaattggaaaattttgtgagtgttttccatgtccaatagagcctaactgtttcttttttagtaacttaacaatctcttgagggctgcacctataaagtcccagcttgtcagtagacatgtacagtgtttgggataaggtggacacagtgcacatatgagtaagaccttcctgactattttaaacatcactcacatgaggagagcctctatgctataggttgtgtgcctactgtagcttttccatcgctgtattatatagacatttgcatattaaaatttgattttcccagagataaatattatatagtgtatctatatttagatcaaactgtggtaacatgttgatgagatcatagcgttggggaatgtagcctgaacgtgtggactcgcagagaccccgagggagagcaggggtcaatcccatctgtgtataagttattataactatgaaatcttgtacaaaagcaaaaactggaaaaaaaaacaaaaatacagtttttattttgaaat

SEQ ID NO: 3868 - DNA, 499 bp, Rattus norvegicus
  Genbank Accession No. NM_031709
tgttttcccctgccgccgccaagttccgcggagaagctccggggtgcgttcaagattcggcgtcacccgtaatccaccgccatggccgaggaaggcatagctgctggaggtgtaatggacgtcaacactgctctacaagaggtgctgaagaccgccctcatccacgatggcctagcacgtggcatacgcgaagctgccaaagccttagacaagcgccaagcccatctctgcgtgcttgcatccaactgtgatgagcccatgtatgtcaagctggtggaggcgctcttggccgagcaccagatcaacctgataaaggttgatgacaacaagaaactaggggaatgggtaggcctctgtaaaatcgatcgagaggggaagccacggaaagtggttggttgcagttgcgttgtagttaaggactatggcaaagaatctcaggccaaggatgtcatcgaggagtacttcaaatgctagaaatgaataaataaaattttggctc

SEQ ID NO: 3869 - DNA, 917 bp, Rattus norvegicus
  Genbank Accession No. NM_031714
cacgaggttgttactgccgtttcttctctggaggatcttcaagagggaaggattagcatgtcgtcaataatcagaaaagtgatcagcacttcaaaagccccggcggccattggtgcctacagccaagctgtgctagtggacaggaccatttacgtttctggacagataggcatggatccttccagtggacaacttgtgccaggaggggtagcagaagaagctaatcaagctcttaaaaacctgggtgagattctgaaggctgcaggctgtgacttcactaatgtggtgaagacaactgttttactggctgacataaatgactttggcactgtcaatgagatctacaaaacatatttccagggtaaccttcctgccagggctgcttaccaagtcgccgctttacccaaaggaagtcgaattgaaatcgaagccatcgctgtccaggggcctttcaccacagcaggactgtaaggagccatgctgatgctgactctggagtctttacaatgtctctcacactttaaatttaacaaatgattgctgggaagtgcacacatgaccgtgtgaagtgatcgtgggaatgatcatacatgtggagatttgacattaattggggattattcagtacagtggctagtgctgtaatttcacttatgtggctgggtgtgagagaaaggcacatagctgctaacatgcagagcagaatcatagacgaaacagtaaagagcacacctaattaaatcatatcaatttgcttgtgtggaatacttagttctcatgttagatatcagaaactaaattaaaatattcaaactttaatagtaccaggagaaaaaagtggacccaaatcttataagataatactgccttaatggaataaaaaacagatgtgtaaaaaaaaaaaaaaaaaactcgag

SEQ ID NO: 3870 - DNA, 2757 bp, Rattus norvegicus
  Genbank Accession No. NM_031715
gccagcgaggagagctaaaactacaagagtggatcatgacccatgaagagcatcatgaagccaaaaccctggggatcggcaaggccatcgccgtgttgacctctggtggagatgcccaaggtatgaatgctacggtcagggctgtggtacgagttggcatcttcaccgggctccgcgtcttctttgtccatgagggttaccaaggcctggtggatggtggagagcacatcagggaggccacctgggagagcgtgtccatgatgctccagctgggaggcacggtgattggaagtgcccgatgcaaggacttccgggagcgagaaggacgactccgagctgcccacaacctggtgaagcgggggatcaccaatctgtgtgtcatcggaggcgatggcagcctcactggggctgacacttttcgttcagagtggagtgacttattgaatgacctccagaaagatgggaagatcacagccgaggagcgtacaaagtccagctacctgaacatcgttttcctggttggctcaatcgacaatgacttctgtggcactgatatgaccattggtactgactctgccctgcaccgcattgtagagatcgtggacgccatcaccaccaccgctcagagccaccagaggacatttgtgttagaagtgatgggccgccactgtggatacctggcccttgtcacctctctgtcgtgtggggccgactgggttttcattcccgagtgtccgccagatgacgactgggaagaacacctttgtcgccgtctcagtgagacaagaacccgtggttctcgtctcaacatcatcattgttgctgagggtgcaatcgacaaaaacgggaagccaatcacctcagaagacatcaagaacctggtggtaaagcgtcttggatatgataccagggtcactgttctgggacatgtacagaggggtgggacaccatcagcctttgaccggatcctgggcagcaggatgggtgtggaagcagtgatggcacttttggaggggaccccagacaccccagcctgtgtggtgagcctctctggtaatacggctgtgcgcctgcccctcatggagtgtgtccaggtgaccaaagacgtgaccaaggctatggatgagaagagatttgatgaagccattaagctgagaggccggagcttcatgaacaactgggaggtatacaagcttctagctcatgtcagacccccagtctctaagggcgggttgcacacggtggctgtgatgaacgtgggggccccagctgctggaatgaatgctgcagttcgctctactgtgaggattggccttatccaaggcaaccgagtgctggtcgtgcatgatggctttgagggtctggccaaaggtcagattgaggaagctggctggagctatgttggaggctggactggtcaaggtggttccaaacttggtactaaaaggactctacccaagaagaacctggaacagatcagtgccaacataaccaagtataacatccagggcctggttatcattgggggctttgaggcttacacagggggcttggagctgatggagggcaggaagcagtttgatgagctctgcatcccatttgtggtcattcccgccacggtttccaataatgtcccagggtcagacttcagcatcggggctgacacagcactgaacaccatctgcacgacctgtgaccgaatcaagcagtctgcagcaggcaccaagcggcgagtgtttatcatcgagacgatgggtggttactgtggctatctggccaccatggcaggactggcggctggggctgatgctgcctacatttttgaggagcccttcaccatccgagatctccaggttaatgttgaacatctggtgcagaagatgaaaacaactgtgaagagaggcctggtgctgaggaatgagaagtgcaacgagaactacactactgatttcattttcaacctgtactctgaggaggggaagggcatcttcgacagcaggaagaacgtgcttggccacatgcagcagggtggaaacccaactccctttgacaggaattttgccaccaagatgggtgctaaggctacgaattggatgtctgggaaaatcaaagagagttaccgtaatggacggatctttgccaacactcccgactcaggttgtgttctggggatgcgtaagagggccctggtctttcagccagtgactgagctgaaggaccagacagattttgagcaccgaatccccaaagaacagtggtggctgaagctgaggccaatcctcaaaatcctggccaagtacgagattgatctggacacctctgaccacgcccacctggagcacatttccaggaagcggtctggagaagctgctgtctagaccactttggagtgaggggaaaatcacctgatcatggtcagctcacaccctggtagacctcagcccatggcttctcagtgttgtagcccagcccctacccttctaggtttccctgtactctgtacctgcaaccaggatcactgtggccaggtgttgggggaggggtggtgagtgcctctcctaggtagctgtccttccttgcaccctggcttcatctgtcacacaggctggatgtctctagtgctactgctagatttcagcttctcaagagtaaaagtgagctttatttatttctttgtgataacaaagagtcctaggtcctttccttgtaccacagtgaagtgtaactacactaataaaagccagctggccactgtga

SEQ ID NO: 3871 - DNA, 1399 bp, Rattus norvegicus
  Genbank Accession No. NM_031719
ctgctttcttggttcctgtggagcaatgctttcgcccgcaatgagcttcctcaaaagcttcccgccccctgggtccgcagatggactccggctgcagcagccagacaccgaagctgtgctgaacgggaaggggctcggcaccggcacgctttacattgcggagagccgcctgtcttggctagatggttctggattaggattctcactggagtaccccaccattagtttacatgcggtatccagggacccaaatgcttatcctcaagaacatctgtatgtcatggtgaatgccagatttggagaagaatcaaaagaacctttctctgatgaagatgaggacgacaatgatgatgttgaacccatttctgagtttagatttgtgcccagtgataagtcagcattggaggcgatgttcacagcaatgtgtgagtgccaggccctgcatccagaccctgaggatgaagactcggatgactatgatggagaagagtatgatgtggaagcacatgagcaaggacagggggacatccctacattttacacctatgaagaaggactatcccatttaacagcagaagggcaagccacgctggagagattagaaggaatgctttctcagtctgtgagcagccagtataatatggcaggcgtccgaacagaagattcagtaagaacttacgaagatggcatggaggtagagaccacaccaactgttgccggacagttcgaggatgcagacgttgaccactgaggatgactcgtgtgacttacaattctgctcataactataggcaagaacttgatgcctcttcactccagaatggagctggtgaaaggctttttttcttctccaaaactcatttctcaagacaaactataatgagacagcaagctgtcaccagcagaaaagactttgacctctattaacaaaggtgaattaactgaacgggtttttgtagtttctcatttacccctaagcttcctgtgtctagttatcttctgagagcctctaattcctgctttgctgtgtgcaatctgtcagctacgaggctgtgtgtcgtgtgcacagtctcacgctggcaaaagtgaggtgggagcttagatgtctctgggacttaggaggactctctgatccctgagataaaaagcaaaggcctctgagggcacagctttagcattctccacggacgcatgggccctctactggggctcaaccacatctcgtcatgacaaatgcttgtgtgctacttctgttcctccgcatttaccatcagctctgttacattctcctagcttaggtccttgactgtcacagagtaaatcatctgaaatgaagtctgcaaagtactctcaatgatattttgtctttgtaatagttaaataaatctgggttttctat

SEQ ID NO: 3872 - DNA, 643 bp, Rattus norvegicus
  Genbank Accession No. NM_031723
aaagggcagcggttcctcttggtgattgtatcgcgccctcttgctgctaattaccgcgttctccattcctccacatgctgtctctagactttctagatgatgtacggcgaatgaacaagaggcagctgtactaccaagtcctaaattttggaatgattgtctcctcggcactaatgatctggaaggggctgatgttgataaccggaagtgagagtccaattgtagtggtgctcagtggcagcatggagcctgcgtttcacagaggggatctccttttcctcacgaaccgagttgaagatcctatacgtgtgggggaaatcgttgttttcaggatagaaggaagagagattcccatagtgcatcgagtcttgaagatccatgaaaagcaagatgggcatatcaagtttttaaccaaaggagataataatgccgttgatgaccgaggcctctataaacaaggacaacactggctggagaagaaagatgttgtagggagagcaagagggtttgttccgtacattggaatcgtgacgatcctcatgaatgactatcctaaatttagttatgcagtactgtttctgctgggtttatttgtgctggtccatcgtgagtaagaagccggcctcgctggtcctgggaggct

SEQ ID NO: 3873 - DNA, 2977 bp, Rattus norvegicus
  Genbank Accession No. NM_031731
gaattcggcggatggaagccagctgtcccgagaagcagtgaactgtggcgtcatcccgagcagtgccttaccggtattgtgctgcttcacctgcctcgctcggcgttctcctcaggccccgccatggagcgacaggtccaacgacttcgccagacgttccggtccggccgatcgcggccgctgcgtttccgactgcagcagctcgaggccctccggaggatggtgcaagagcgagagaaggacatcttggcagccatcgcagcagacctgagcaaaagtgaactcaatgcatacagtcatgaagtcattaccatccttggggagattgacttcatgctggggaatcttcctgaattggcctctgctcggccagcgaagaagaacctgcttaccatgatggacgaggcctatgttcagccagagcctctgggagtcgtgctgattattggagcttggaactatccttttgttctgaccctgcagccactggtgggagccattgctgcaggaaatgctgccattgttaagccctcggaactcagtgaaaacacggctaagatcttggctgaactcctccctcagtatttagaccaggacctgtacatgattgttaatggcggcgttgaagaaaccacagagcttctgaggcagcggtttgatcacattctctacacaggaaacaccgcagttggaaaaattgtcatggaggctgctgccaagcacctgacccctgtgaccctggagctcgggggcaaaagcccatgctacattgacagagactgtgacctggacgttgcttgcagacggataacctggggaaagtacatgaattgtggtcagacctgtattgctcctgactatatcctgtgtgaagcctcctcccaggatcaaatcgtacagaagattaaggatacggtgaaggacttttatggggaaaatgtaaaagcttctcctgattatgaaaggatcatcaaccttcgtcactttaagaggataaaaagtttgcttgaaggacagaaaatagcttttggtggggagactgatgaagctacacgctacatagccccaaccatactcactgatgttgaccctaactccaaggtgatgcaagaagaaatttttggaccaattctcccaatagtgtctgtgaaaaatgtggaggaagccataaatttcataaatgatcgcgaaaagcccctggcactctacatattttctcacaacaataagctcatcaaacgggtgattgatgagacatccagtggtggagtcacaggcaatgatgtcatcatgcacttcactgttaattctttgccctttggaggtgtgggtgccagtggaatgggggcttatcatggcaaatacagtttcgataccttttctcatcagcgcccctgcttgttaaaagggttaaagggagagagtgttaacaaactcaggtaccctcccaacagcgagtccaaggtcagctggtcgaaattcttcctgctgaaacagttcaacaaaggaaggctgcagctgctgcttctcgtgtgcttggttgcggttgcagctgtgatcgtcaaggatcagctgtgatgacttccttgtagcctctactgaagtacccctcggccaaatggttaacacaccaatgcttttaaaattgtacccaaaccaggaaatgaaattcacaggtgaactgcagtcaaacctaagttgttgccacaaaccactgatgaaactcagtgcttcagccaaatcccagcatttgtcagccgtgcaggtgctgagagggtggagactgggaggggcgacacctagtccatggcagcgggatgtcagggagactcgacaactgctcccgcactctttgctccaggacatagctctcccacccggtgtcaacaccctccaggctttccagctgtcctctgattgctgaggttcctgttagggacccaggtactaaacctgggcgggtggatttgtcggcctcatccattgtggctcgagaccggccttcgggagtcggctctcagtctaaacatcctttctcattcatagtgtgtcacccgaagatgcttgtttgtgacattgtgacagtctgtcatgactgtcccggtgcctttgtgatgacttaaactacactgaggagcttgccaacttgtgaatgcccttcagagggtctggcagtcacagctgttccagagcccgagggacgaagattccggagcccggagtttgaggccaacctaggcaacataatgggaccctctcattattattcctccataacaatcccctcgagaccctcgatttgaatgttatataggtcttcaggataaatctgcttattttcacagcacaacacaaaaaaaatttacttttgaaatcttagagagattcctacagatcttagcatggagctgttcctgtagtgaaaggggggttattagacatgaggcttcagaactcatggggcagggttgttggagactaccgtgagctgagggggcacactgaagcgatgggatggccagaagcgcacctgagcaagcggggcagcattctctgtcagaccctaacatggctacacggggatgtggcagagagatctgtgccgttggctgccagcgctggttaggcctgaagctccaagctgcagaggtctcattgccttcccaggatccaaattaagactgcccactcaatgagaatgtcacttgcgtatgtacaaccatgtttgctgagtaacctgttccaccgttgaggctgtctgaagtgtattgtatgaggtatcaagaacgagtcattggcccatttggcaaatagttgcttatgtagcaattgtcatggactaatcataaaatattttgcacaaaatttcaatgttgaacttgcactcactgttgttaaattataaatcacagcttctagttaggccaaaatatttacatactctactaatcttcaaaataaatgtatcccggaattc

SEQ ID NO: 3874 - DNA, 2963 bp, Rattus norvegicus
  Genbank Accession No. NM_031736
gacacagtactgccgatgttggacagaggatcgcttaacagaacgaaatctcaaaacaaattaacaggacccggttgcttgatttcccaaatcagaaaaggctcgaaatgtctagaggggctgactgatgcagcggtgacccggactggagacagttggacgcgatcatctctggtgcttttgttcaaccttgaaaccttcgccacaggagacttgcctgagcagagaagcaaacgtggagaaacaaagagagatctagcgaaaagcctctgggaccaaggaggggaggtgggactctgggttggcggtggcacctgctgccggctattaataatagggtcgcgatgcgtttataaggtgtttgattaaacaaagactctatgagagaagaataactagcaacagccccacgtctgagtcgtcgcctccgacctttttcaacgtgggttctttgggccgagcgtcgtttgccgagaactagatctcacctgaccccagacgctgaaaacaagcgctgtggcatcctgggccacccaagctgacaagggcgcgccccctgagcacacgaggtgccccacgagggggagggacccacagccgtcccgcccgcaccgcggtgtccgctgcgggcacctgcagccgagccgccacccgcagtcgcagcgcgtccggcggccgaacccggtcgtcagctcgtcagcacctgctctgcttctctcccgcccgccgccgcgctgcacgcctcgagcgctccctcggccccggcggggaccggggaccccgcagccaccgccatgctgcctgtgctctacaccggcctggcggggctgctgctgctgcctctgctgctcacctgctgctgcccctacctcctccaggacgtgcggttcttcctgcaactggccaacatggcccggcaggtgcgcagctaccggcagcggcgacccgtgcgcaccatcctgcatgtcttcttggagcaagcgcgcaagaccccgcacaagcccttcctgctgtttcgcgacgagacgcttacctacgcccaggtagaccggcgcagcaaccaagtagcgcgagcgctgcatgatcacctgggcctgcggcagggggattgcgtggccctcttcatgggcaatgagccggcctacgtgtggctctggctgggactgctcaaactgggctgtcccatggcgtgcctcaactacaacatccgtgccaagtctctgctacactgctttcagtgctgcggggcgaaggtgctgctggcctccccagagctacacgaagctgtcgaggaggttcttccaaccctgaaaaaggagggcgtgtccgtcttctacgtaagcagaacttctaacactaatggcgtggacacagtactggacaaagtagacggggtgtcggcggaccccatcccggagtcgtggaggtctgaagtcacgttcaccacacccgcagtctacatatatacttcgggcaccacaggtcttccaaaggctgcaaccattaatcaccatcgcctctggtatgggaccagccttgccctgaggtccggaattaaggctcatgacgtcatctacaccaccatgcccctgtaccacagcgcggcgctcatgattggcctccacggatgcattgtggttggggctacatttgctttgcggagcaaattttcagccagccagttttgggacgactgcaggaaatacaacgccactgtcattcagtacatcggtgaactgcttcggtacctctgcaacacgccccagaaaccaaatgaccgggaccacaaagtgaaaatagcactaggaaatggcttacgaggagatgtgtggagagagttcatcaagagatttggggacattcacatttatgagttctacgcttccactgaaggcaacattggatttatgaactatccaagaaaaatcggagctgttggaagagaaaattacctacaaaaaaaagttgtaaggcacgagctgatcaagtatgacgtggagaaggatgagcctgtccgtgatgcaaatggatattgcatcaaagtccccaaaggagaggttggactcttgatttgcaaaatcacagagctcacaccattttttggctatgctggaggaaagacccagacagagaagaaaaagctcagagatgtttttaagaaaggagacgtctacttcaacagtggcgatctcctgatgatcgaccgtgaaaatttcatctattttcacgacagagttggagacaccttccggtggaaaggagagaatgtagctaccacggaagtcgctgacattgtgggactggtagattttgttgaagaagtgaatgtttacggtgtgcccgtgccaggtcatgaaggtcgcatcgggatggcctcgatcaagatgaaagaaaactacgagttcaatggaaagaaactctttcagcacatctcggagtacctgcccagttactcgaggcctcggttcctgagaatacaagataccattgagatcaccgggacttttaaacaccgcaaagtgaccctgatggaagagggctttaacccctcagtcatcaaagataccttgtatttcatggatgacacagaaaaaacatacgtgcccatgactgaggacatttataatgccataattgataagactctgaagctctgaatgttgcctggctcctaacacttccagaaagaaacacaataggcctagcatagccccttcacatgtgtaatccaactttaacttgattaaaggttataggtgtgatttttcctaggaaattattcatttaaaggacaattgtttgtttgtttgtttgttttttattaattacaccagaacgtttgcaagtaaaaagatttaaagtcacttatttttcaatgtgcacctgccatttgtccttgcaaacttagcttcttggagagagggccttatttttttaaagacataataaactatgtaaacact

SEQ ID NO: 3875 - DNA, 1678 bp, Rattus norvegicus
  Genbank Accession No. NM_031738
ttacccaacctgcaccctctcactggctacagcactccctccgaccttgggattcccagacaccggccagcgttgctgcccttcggcttcctagccctgcgtaggcgcaggtgcaacctccctgcagtgggcctggtgcaataggactgcggacatcatggcgcacggaaacgcccctcgggacagctaccacctggtcgggatcagcttcttcattttgggtctgggcaccctcctcccctggaacttcttcattaccgccatcccgtacttccaggggcggttggcagggaccaacagcagcgctgagaccccgagcaccaaccacaccagtcccacagacaccttcaacttcaacaactgggtgacactgctgtcccagctgcctctactgctcttcacgctcctcaactccttcttgtatcagtgcatccctgagtcggtgcgtattctgggcagcctgctggccatactactgctctttgccctgacagcagcgctggtgaaggtggatttgagccccgggctgttcttttccatcaccatggcatccgtctggttcatcaattccttctgtgcagtgcttcaaggcagcctctttgggcagctgggtaccatgccttctacctacagcaccctcttcctcagtggccagggcctggctgggatcttcgctgcccttgctatgctcacgtccttagccagtggcgtggacccccagacctctgcccttgggtacttcatcacaccctgtgtgggcatcctcctctccatcatatgttacctcagtctgccccatctgaagtttgcccgttactacctgaccaagaagcctcaggccccagttcaggagctggagaccaaagctgagctcctcggagctgatgagaagaatgggattcctgtcagcccccagcaggcaggcccaactctggatcttgacccagagaaggagctggagctggggctggaggaaccacagaagccaggaaaaccttcggtctttgtcgtcttccggaagatctggctgacggcgctgtgccttgtgttggtcttcacagtcaccctgtcggtctttcctgctatcacagccatggtgaccaccagctccaatagccccgggaagtggagtcagttcttcaaccctatctgttgcttcctgctcttcaacgtcatggattggctgggccggagcctgacttcctacttcctgtggccagatgaggacagccagctgctgcccctgctggtgtgcctgcgcttcctgttcgtgcccctcttcatgctgtgtcatgtgccccagcgtgcccggctgcccatcatcttctggcaggatgcctacttcatcacattcatgctgctcttcgccatttccaacggctacttcgtgtctctcaccatgtgtctggcacccaggcaggtgctgccgcatgagagggaggtggccggagccctcatgaccttcttcctggccctgggactctcctgcggagcctctctctccttcctctttaaggctttactctgaggaccaccgcactccacagtcctccctcactgctgcttctggagctggacattcccggggaaggacctctgctataccgggtctcttggtctgtgggtgccaggagggggcagaaactaccttggctggtagccacattgcatatggtga

SEQ ID NO: 3876 - DNA, 2169 bp, Rattus norvegicus
  Genbank Accession No. NM_031741
tgaggaggtgagccagctgcaggctacccttgcagagcaacgatggagaaagaggatcaagagaagacagggaagctgaccctggtccttgccctggcaactttcctagctgcctttggctcctccttccagtatgggtacaacgtggctgctgtcaactcgccctcagagttcatgcagcagttctacaatgacacctactacgacagaaacaaggagaacattgagtccttcaccctgacgctgctgtggtccctgactgtctccatgttcccctttggaggttttataggatctctcatggttggattcttggtgaataacttgggcagaaaaggggccttactgttcaacaacatattctccatcctgccggccatcttgatggggtgcagcaaaattgccaaatcctttgagataataattgcttccagacttctggttggaatatgtgcaggtatatcttccaacgtggtccccatgtacttaggggagctagcccccaaaaacctgcgaggggctcttggagtggttcctcagctcttcatcactgtgggcatccttgtggcccagctgtttggccttcggagtgtcttggcaagcgaggaaggctggccaatcctcctgggtctgactggagtccctgccggcctgcagctcctcttgctgcccttctttcctgagagcccccgctacctgctgattcagaagaaaaatgaatcagctgctgagaaagcccttcagacccttcgaggttggaaagatgtggacatggagatggaggaaatccggaaggaggatgaggctgagaaggcggcaggcttcatctctgtgtggaagctgttccgcatgcagtccctccgctggcaactcatctccacgatcgtcctcatgaccggccagcagctgtcaggagtgaacgcgatttactactacgctgaccagatctacctcagcgcaggggtgaaaagcaacgacgtccaatatgtgacggctgggactggggccgtcaacgtgttcatgaccatggtcacggtttttgtggtagagctttggggacgtcggaatcttctcctcatcggcttctccacctgcctcacagcttgcatagtgctgacggtcgcactggcactgcagaacaccatctcctggatgccctatgtcagcatcgtctgtgtcattgtctacgtcataggacacgccgtggggcccagtcccatccctgccctgttcatcaccgagatcttcctgcaatcctctcgaccatccgcctacatgatcggaggcagcgtccactggctctctaacttcatcgtgggcctcatcttcccgttcattcaagtgggccttggtccttacagcttcatcatctttgcgattatatgtctcctcacctccatctacatcttcatggtcgtcccagagaccaagggcaggacgtttgtcgagatcaaccagatttttgccaagaagaacaaggtatcggacgtatatccggagaaggaggaaaaggagcttaatgacctcccacctgctacccgggagcagtagcagagccaggccaccaggcagtatggccagtctgcatgggcctcctgtctagactttggttctgggttcttagtgtctgtgacactgggagggacacgagcctggcggggaatggcagccctccactcagtggggacacctgacgggctttcgtgcttccgtgctgtccctaaccatagaggccagtcacgggctcttggtcacacacaaagccatacctggcctttgctgggttgactgtggcgagggtcttgtaacattgcttttctaacaaaaacagttgccgagagacaagacgtgacggtcctattttttttttaactttttttttctattcttttttttttttttttttcggagctggggattgaacccagggccttgcgcttgctaggcaagcgctctaccactgagccaaatcccttgtgtggctcctcccatgggcgtggagagaccactggcatctgctggtgattgatgtggtcctctttttctgacccagccatgtcacaaagctgaggaacaggccacttggggagacacacggagcgtgaattatcaactgtcaacgacagtattctgtttagccaataaaacagatctgatcacttcttaaaa

SEQ ID NO: 3877 - DNA, 2703 bp, Rattus norvegicus
  Genbank Accession No. NM_031749
cgcccgcatggcccggggcgagaggcgacggcgcgctgcggccgcagagggggcgcgcccgctggagagggcgcggggtgcgggccggcgggatggcagagccggcggggcgcgcggctcggcgggcggcgcggccctggccgtggtggttttggcgctggccttcggcctgtcggggcgctgggtgctggcgtggctgggtgtgcgccgcgcgctcacactgcaccccgctccgtcagcgctaccgccggactcctccagtcctgccgtggccccggaatttttttggggtacctatcgcccacacgtctatttcggcatgaagactcgcagccccaaaccactgctcacgggactgatgtgggcgcagcaaggcgccaccccggggacccctcctaagctcaggcacacatgcgaacaaggagacggcgtgggtccctatggctgggagttccatgatggactctcctttggtcggcaacatatctatgatggggccttaaggctcaccactgagttcgtcaagagatctgggggtcatcacggaggggattggagctggagagttaccgtagagcctcaggcctcaggtacaccttccttccctttggtctccctgttcttctacgtggtaacagatgggcaagaggtcctactaccagaggttggagccaaaggacagttgaagttcatcagtgggcacaccagtgaacttggtgacttccgcctcacacttctgccaccaaccactccaggagacactgtccctaagcatggcagctacaatgtcttctggtcctccaacccagggctgcctctgctcacagacatggtaaagagccacctaaacagctggtttcatcaccggcccccaggagcctctccggaacgataccttggcttgcctggatctcttaagtgggaagagagaggccctagtgggcaagggcagttcttggtccagcaggtgacactgaaagcccctttctctgtggagtttgtgtttgaatctggcagtgccaggacaggaagagaccaagcctctgagcagctggtaggtggccaactgacccgggccctggagagccatgctgcagcattcaaggagcgttttgagaggaccttccagctaaaggagaagggcctgagccctgaggagcaggctctgggtcaggttgccctcagtggcctacttggtgggattggttacttctatggacagggtttggtgttgccagacactggcatggaagggtctgaacagaaaatggacccttccctatttccgcctgtcccccttttctctggggtcccttcccggtcattcttcccacgaggcttcctctgggatgaaggctttcaccagctagtggtccagcgatgggatccccacctcacccgggaggccctaggacactggctggggctgctcaatgctgacggttggattgggcgagagcagattctgggggatgaggccagagcccgagtgcccccggaattcctagtgcaacgtgcagcccatgccaaccctccaaccctgctcctgccagtcatacacatgctagaaggccgggcccctgaggacttggccttcctgcgcagggctttcccccgcttgcatgcctggttctcttggctccatcaaagtcaggcagggccagtgccactttcctaccgctggcggggcagggatctagctttgcctaccctacttaaccccaagacactgccctcgggcctggatgactaccccagggcctcacatccttctgcagcagagcggcacctggacctgcggtgctgggtgacattgggtgcccgggtgctgtcacagcttgcagaagagcttggggagactgaagctgctgcagagttgggcccattggctgcctctctagaagcagctggaagtctcgatgagctgcactgggctcctgagctgggtgtctttgccgactttgggaaccacacaaaagcagtacagctcaagtctaggcccccacaggggctggttagggtggtaggcaggcctccagctcgactgcagtatgtggatgccctgggctatgtctctctttttcctttgctgctacaactgctggagcccagctcaccccgcttgggacccctgctggacgttctagctgatagccgccatctctggagcccctttgggttgcgctccctttcagcctccagtctcttttataaacagcgaaatacggaacacgatccaccttactggcgaggtgcggtgtggctgaatatcaactacctggctttgggggcactacaccactatgggcgtgtggagggtcctcacaaggttcaggctgccaaactctaccgtgaacttcgggccaatgtagtaagcaacgtacggcagcaataccaggctacagggtttctgtgggaacagtacagtgaccaggatgggcggggcatgggctgccgccccttccaaggatggaccagtcttgttttactgatcatggctgaagagtactagtgggacagaaggaaagctaggcctttgtgtcacttggaatatgcagacaagggcttgggtttctggtctcagtgtttcagatcccgtaagctcatctcaggtgtctccttattgtcatcccatacagctctggggtgaacgtgaactcaaagagtctatttttctaaataaactggaaaacaacggaattc

SEQ ID NO: 3878 - DNA, 7087 bp, Rattus norvegicus
  Genbank Accession No. NM_031751
  misc_feature (1)..(7087): n = a or c or g or t
ggccccacgatgacccacagccccgcgacaagcgaggacgaggaacgccacagtgccagcgagtgtcccgaggggggctcagaatcggacagctccccagacggaccaggaagaggcccccagggtactcggggccggggcagcggagcacctggtaacctggcctctacccgaggcctccagggacgctccatgtctgtccctgacgacgcccacttcagcatgatggttttcaggattggcatccctgacttgcaccagacgaaatgcctacgcttcaacccggatgctaccatctggacagccaaacagcaagtactctgtgccctgagcgagagtctacaggatgtgctaaactatggactgttccagccagccacctcaggccgggatgccaacttcctggaggaagagaggcttctaagagagtaccctcagtcctttgagaaaggggtaccctacctggagttccgctacaagacccgagtctacaaacagaccaacctggatgagaaacagctggccaaactgcacacgaagacggggttgaagaagttccttgaatatgtgcagctcgggacgtctgacaaggtggcgaggctgctggacaaggggctggaccccaattaccacgactcagattcaggagagacacctttgaccctggcggcccagactgaaggctcagtagaggtgattcggacgctgtgcctgggcggggcgcacatagacttcagggcccgggatggcatgacagcgctgcacaaagctgcatgtgctaggcactgcctggcactcacggcacttctggaccttgggggctcccccaactacaaggatcgacgagggctgacccccctgttccacacagctatggttgggggagacccccgctgttgtgagctacttctgtacaacagggcccagctgggcattgcagatgagaacggctggcaggaaatccaccaggcctgccaacgagggcactctcagcacctggaacacctgctcttctatggggctgagcctggagcccagaatgcctcaggaaacacggccctgcacatctgtgctctctacaacaaggagacctgtgccaggatcctcctttatcgcggagcaaacaaggatgtgaaaaataacaacggacagacacccttccaggtggctgtgattgctgggaattttgagctgggggaactgattcgtaaccatcgggaacaggatgtggtacccttccaggagtcccccaagtatgcagcccggcgtcggggacccccaggcgcagggctgactgtacccccagcgctgctgcgggctaacagcgacacgagcatggcgctgcctgattggatggtgttttcggccccaggggcctcatcctctgggacccctggccctacctcaggaccccagggccagtcacagccctcggcccccagcaccaagctcagtagtgggaccctcagaagtgccagcagcccccgaggtgcccgggcacgctccccatcccgggggagacatcctgaagatgccaagagacaacctcgaggccgacccagctccagcgggacaccccgagatgggccggctgggggaactgggggctcagggggccctgggggctccctgggtagcagaggcagacgtaggaagctctattcagcggtacctggacgctccttcatggcggtgaagtcataccaggcgcaaggcgagggggagatctctctgagtaaaggcgaaaagatcaaagtgctcagcatcggggaaggaggcttctgggaaggccaggtcaaaggtcgagttggctggttcccttctgactgcctagaagaggtggcaaaccgttcccaggagggaagacaagaaagccgaagtgacaaggcaaagagactcttcaggcattacacagtgggctcttacgacagcttcgatgccccaagtctgatcgatgggattgactcagggagtgattacatcatcaaggagaagacagtcttactgcagaagaaggacagtgaggggttcgggttcgtgctccggggggccaaggcgcagacccccatcgaggaattcacccccaccccggccttcccggcgctgcagtacctcgagtctgtggacgagggtggcgtggcatggcgggctggactacggatgggagacttcctcatcgaggtgaatggacagaatgtagtgaaggttggccaccgccaggtggtcaacatgatccgacagggaggcaacacactgatggtcaaggtggtgatggtgaccagacacccagacatggacgaggctgtccacaagaaagcatcccagcaggctaagcggctcccgcccccagccatctccctgcgttccaagtctatgacctcagagctggaggaaatggaatacgagcaacagcccgcggcagtgcccagcatggagaaaaagaggactgtgtatcagatggcactcaacaaactggatgagatcttggccgctgctcagcagaccatcagcgcaagtgagagtcctgggcctggtggcctggcatccctgggcaagcaccgacccaaaggattctttgccactgagtcgagctttgatcctcaccaccgctcccagccaagttatgaccggccttctttcctgcctcctggacccggccttatgctccggcagaaatctatcggggctgcggaagacgacagaccctacctagcacccccagccatgaaattcagtcgtagcctgtcagtccccggttcagaggacatacccccaccacccactacatcaccaccagagccgccctatagcacacctccggccccctcctcctccggccgcctcactccctcgcctcggggagggccctttaaccccagttctgggggtccccttcccgcctcctccccttcatctttcgatgggccatctcctcctgacacccgtggtgggggccgagaaaagagcctatatcacagcgcagccctgccccctgcccaccaccatccacctcatcaccaccatcatcacgcgccacctccccagccccaccatcaccatgcacatcctcctcacccaccggagatggagacaggaggttcccccgacgatcccccacctcgattggccctgggaccccagcccagccttcgaggctggcgaggtggaggacccagcccgacctcgggggccccatcaccttcccaccacagtagcagcggaggcagcagcggccctactcaggctcccgccctgcgntacttccaactgcccccgagggcggccagtgcggctatgtatgtaccagcacgttccggccgcggtcgcaagggcccactggtcaagcagaccaaagtggaaggcgagccccaaaagggcagcatcccttccgcgtcctctccaacatccccggcgttgcctcggtctgaaccacctccggccgggccgtcggagaaaaattccatccctatcccgaccatcatcatcaaagccccatctaccagtaacagcggccgcagcagtcagggaagcagcacagaggctgagccccccacccagcccgatggcgcgggcggcggcggatcctcgcctagccctgcacctgccacgtcccctgtgccgccatccccgtcgcccgtgcccactcccgcgtcacccagcggcccggccaccctggatttcactagccagtttggagcagccctagtaggcgcggcgcggagggagggaggctggcagaacgaagcccggcggcggtccacgctgttcctgtccaccgacgcaggagatgaggatggaggcgacagcgggctgggcccgggggggcccccgggtccccggctgcgccattccaaatccattgacgaaggcatgttttccgcagagccgtacctccggctggagtcagggggcagcagtgggggctacggggcctacgcagcgggcagccgagcctacgggggcagcgggagcagcagcgccttcaccagcttcctccccccgcggcccctggtgcatccgctgaccggcaaagccttggatcccgcctctccgctggggttggccttggccgcccgggagcgggccttgaaggagtcctcggagggtgggggcacccctcagccgcccccgagacctccatcaccacgctacgacgccccaccgcctacccttcaccaccactcgccccattcaccccattcgccacatgcgcgtcacgagccagtgttgcgcctctggggggaccccgcgcgccgggagctggggtaccgggcaggcctagggagtcaggagaaggcccttaccgccagtccacctgcagctcgccgctccctactgcaccgtctgcccccgacggctcccggggtcgggccgctcctgctgcagctggggccggagcccccaactccccatcctggggtgagcaaggcctggcgcacagcagccccggaggagccggagcggctgccgctgcacgtgcgattccttgagaattgccaagcccggcctcccccagctggcacgagagggtcctctactgaagatgggcctggggtcccgcctcccagccctcgcagagtcttgccaacctctcccacctccccacgaggcaacgaggagaacggccttccgctactggtcctgccaccgccagccccttcggtggatgtggacgacggcgagttcttgtttgcggagccgctgcctccacccctggagttttccaatagtttcgaaaagccagagtcgcctctcacacccgggcctcctcacccactacctgaccctccctccccggctacccctctacccgcagccccacctcccgctgtagccgcagcccctcccaccttggactccacagcatccagcctgacctcttacgacagcgaagtggccacactgacccagggggctcccgcggctcctggggatcctccagctccaggcccgccggccccggcagccccagctcccccagcaccgcagccaggccctgatcctccacctggcacagattctggaattgaggaggtggacagtcggagtagcagtgatcacccgctggagaccatcagcagcgcatccacactcagcagcttgtccgccgaaggaggaggcaatacagggggcgtggctgggggcggggccggggtggccaatgggacggagctcctggacacctacgttgcctacctggatggccaggccttcgggggcagtggaactcctggcccaccatatcctccccagctcatgactccttctaagctccggggcagggcgcttgggactagtggaaatttaagacctggtcccagtgggggactccgagatcctgtcacccccaccagccccactgtctctgtgaccggagctggaacagatgggctactggccttgagtgcttgccctggaccctcaacggcaggtgtggcagggggtcccgtggcagttgagccagaagtcccgcctgtacctttgcccgctgcctcatccctgcctcggaagctattaccgtgggaggagggtccgggaccaccaccaccacccctgccagggcccctgtcccagcctcaggcctctgccttggccacggtcaaagccagcatcatcagcgaactcagctccaagctccagcagtttggtgggtcctctaccgcaggaggagctctgccttgggctcggggaggcagcgggggcagcacagacagccaccacggaggagccagttacatcccagagaggacgtcctccctgcagcggcagaggctctctgaagactcccagacctctctcctctccaaacccagcagcagcatctttcagaactggcctaaaccccctctgccaccactccccactgggtctggggtctcctcttcaacagctgcagccccgggagctacatccccttcagcctcatctgcctcagcttccaccagacacctgcagggtgtggaatttgagatgcggcctccgctgctccgccgggcacccagcccctcgctgctgcctgcctcggatcacaaggtcagcccagcgcccaggccttcctctttgcccatcctgccttcaggacccatctacccgggcctcttcgacatccgtagctctccaaccggaggggcgggaggctcgactgaccccttcgctcccgtctttgtgccaccacaccccgggatatctgggggtcttggaggagccttgtctggggcctctcgctccctatcacccacccgcctgctctcgctgcccccggacaagccgttcggcgccaagcctctagggttctggaccaagtttgacgtcgccgattggctagagtggctgggcttgtcggagcaccgagcccagttcctggaccacgagattgatggctcccatctgcctgccttgaccaaggaggactatgtggacctgggtgtaaccagggtgggccaccgtatgaacattgaccgggctctcaaatttttcctggagaggtgatggctggcctggacggaccagcccgtccataggacccttgagcccgctgacctctgacctctgacccctctgaccatcattccccctctcccctcagggggccagggactctgctaaaactgtgtcctgccccgtctccccaagcctgactgaggtccccaggtggaccggatgcaggccagacaatggcacctcgcaagaggtgggcagctgacacaagactgcaagtggagtagatgggggattagaaaaaaatgacaaaggggtactgaagaaagagggaaaaaggctgactaggggtgggggaacagacagagccatagtgggtcagtccagagcctgacctgatggggtcctgggaaggtgtgccctccgattccatcatttgcgcctctcaaataacccttttcacctctctaggcccctcagccttcccactctccttggctcactcagctgcccagccccctgcctcttgcacgcctgttcccctccctggctgcagtttttgcacaagcttgccccctggctgtcttgcacacctccggcctgtaaggccctctcagcttcccaacacgctgcattcggtttaaaaaaa

SEQ ID NO: 3879 - DNA, 2866 bp, Rattus norvegicus
  Genbank Accession No. NM_031753
gtggaggaaagttgcgtgtggcacagacccgacggcgcagcgccacagcgaccgggggatcgtgtgtcttggaaaaaaaagtcgctgtccccctaagcgagacccacaagcgagcgggccccgtgggcccggggacgacgccccctctgcggcgtggactttgtcggtggccttctaggaggaggaatatggcatctaaagggtccccttcttgccgtctggttttctgcctcttgatctccgccgcggtcctcagaccaggcctcggatggtacactgtcaactcagcatacggagataccattgtcatgccttgcagactggatgtacctcagaacctcatgtttggcaaatggaaatatgaaaagcctgatgggtccccagtatttattgcattcagatcttctacaaagaaaagtgtgcagtatgatgatgtaccagagtacaaggacagactgagcctctcagaaaactacactctgtctatcaacaatgcaaagatcagtgacgaaaagagatttgtgtgcatgctagtgaccgaggacaacgtgtttgaggcacctaccctggtcaaggtgttcaagcaaccatctaaacctgaaattgtaaacagagcagcgtttcttgaaacagagcagctaaaaaagttaggtgactgcatttcaagagacagttacccagacggcaacatcacgtggtataggaatgggaaagtgctacagcctgttgatggagaggtgtccatactttttaaaaaggaaattgatccaggtactcagttgtataccatgacttcctccttggagtacaagacaaccaagtctgacatacaaatgccattcacctgttctgtgacatattatggaccttcgggccagaaaacaatttattctgaacaagcaatctttgatatttactatcctacagagcaggtgacaatacaagtactgccaccaaaaaatgccatcaaagaaggggacaacatcacccttcagtgcttggggaatggcaacccacctcctgaggagttcatgttttacttaccagggcaggctgaaggcataagaagctcaaacacttacacactgacagacgtgagacgcaatgccaccggggactacaaatgttctctcatcgaccaaagaaacatggcagcttcaacaaccatcactgttcactacttggatttatccttaaacccaagtggggaagtgaccaagcagatcggtgataccctgcctgtgtcttgcacaatatctgcaagtaggaatgcaactgtggtgtggatgaaggataacatcaggctccgatctagtccatccttttctagtcttcattatcaggatgctgggaactatgtctgtgaaactgctcttcaggaggttgagggactgaagaaaagggagtcgctgaccctcatcgtagaaggaaaacctcaaatcaaaatgacaaagaaaactgatcccagtggactgtctaagactataatctgccatgtggaagggtttccaaagccagctatacagtggaccattaccggcagtggaagcgtcataaaccaaacagaggagtctccttatattaatggcaggtattatagtaaaattatcatttcccctgaggagaatgttacattaacttgcacagcagaaaaccaactggagagaacagtaaactccctgaatgtctctgcgataagtattccagaacacgatgaggcagacgatataagtgatgaaaacagagaaaaggtgaatgaccaggccaaactaattgtgggcattgtggttggtctcctcctcgccgccctcgtcgccggtgtcgtctactggctgtacatgaagaaatcgaaaactgcatcaaaacatgtaaacaaggaccttggtaatatggaggagaataaaaagctagaagaaaacaatcacaaaacagaagcctaagagaggagttgtttagatgtcctgagaaaaaaacatataaagaaattgaagcatgaacgtgattgtatttaagacatatacaaagacaatgacagcaattcatggttcaagtattaagatgttcatcctactaagctgtcctgggatcttagagaattatctcaagtaaaacaatgaaataaagttataaaattacaacaagatttggcagccatgataataggtcatatgttgtatttcgtttgattttccttttctgtaaatgtctgcactgaggatttctttcagtttgccttttatgtaaattttttacgtagctatttttatacactgtaagctttgttctgggagtggctgttaattggatgtacaatgtaatgtttatttcaattgtttatatggatagtctgagcaggtgcggttctgattctgattgctatcagtaatgccccaaactttcttgtgaggatctgaaacccaaaggtggcagttatgagattgggacatggatcttgcccaatcagaagctggttttttttttaaaaaaaaaaacctggagagtcaggagcaccataagatatgatggtctctatgtgccaacgggttccccgaagcgggtcacaaacacatacggcaacaccacatgtgaatgatacttttaaactgacaatttcgtcttctctgaaaaaagacatacacagagtttgtataacactttacttaacgacacttgctagaaaattacattctgtttttaaaaaaaataaggaaaatgtaaagaagaatatctaatatgtcagagaaagttggaaacaaatcacagctcgcatccccatagtcgcagatcacgatgtaaatcactgtaattaaaattggtgttaaatcctttgggttatccactgccttaaaatgacacttatttcctt

SEQ ID NO: 3880 - DNA, 1481 bp, Rattus norvegicus
  Genbank Accession No. NM_031755
ctagcaggcagcagagactatggagctagcctcggctcgtctcctcagagggcagattccctggaggggactactgctcacagcctcacttttaacctactggagccctctcaccactgcccaagtcaccgtagacgctgtgccacccaacgttgttgaggagaagagcgttcttttactcgctcacaatctgccgcaggagttccaagtcttttactggtacaagggaaccactttgaatccagacagtgaaattgcacgatatataagatccgataatatgagtaaaacaggacctgcatacagcggcagagagacaatatacagcaatggatccttgttcttccaaaatgtcaacaagactgacgagagagcctacacactatctgtgtttgatcaacaatttaatcctatacaaacgtctgtgcaatttcgtgtataccccgcattacaaaagcccaacgtcacaggtaacaactccaatcccatggagggtgagcccttcgtatcattaatgtgtgaaccgtacactaacaataccagctacctgtggagcagaaatggtgaaagcctctcagaaggtgacagggtgacgttctctgagggcaacaggactctcactttactcaacgtcaggaggactgacaaaggatactatgagtgtgaagcccggaacccagcgactttcaatcgaagtgacccattcaacctggacgttatctatggtccggacgccccagttatatcccctccagatatttatttgcatcaagggtcaaacctcaacctctcctgccatgcagactctaaccctcccgcacagtacttttggcttatcaatgagaagctccagacatcctcccaagagctctttatctccaacatcactactaacaatagcggaacctatgcctgcttcgtcaataacactgtcactggcctcagtcgcaccacagtcaagaacattacagtctttgagccagtgactcagccctccatccaaatcaccaacaccacagtcaaagaactaggctctgtgaccctgacctgcttctcaaaggacactggagtctccgtccgatggcttttcaatagccagagtctgcagctcacagacaggatgacgctctcccaggacaacagcaccctcagaatagaccctattaagagagaagatgccggggactatcagtgtgagatctccaacccggtcagtttcaggataagtcacccaatcaagctggacgtaatacgggaagtgaccatcgagatctcacagagcacaaaccctcaacctccagccacaatctgggtccttctgacgactctcctaacaaggtggatgacgtctcatactctgtcctgaacttcaatgcccagcaatccaaacgaccaacttcagcctcttcaagccccacagaaacagtttattcggtagtcaaaaagaagtgacattgtctgtcctgctgactgcaccagtg

SEQ ID NO: 3881 - DNA, 2754 bp, Rattus norvegicus
  Genbank Accession No. NM_031756
agacagcaagtctaagtctggaggttccactgattcggacctggctgcagagaggttcacctattccctgcagtcatggctgtccaccgtggctctgcacgagctgctcccgcctcagataaagtacagaaaaacaagcctgcacagacatcggggctggaacagggcagccgaatggcgagaatttttgggtttgaatgggcagatttatccagctggcagagtgtcgtgaccctacttaaccgaccaacggaccctgcaaacctggctgtcttccgttttctctttgcattcttgatgctgctggacatcccccaggaacggggccttagctccctggaccgaaaatacttggatgggctggatgtgtgccgcttccccttgctggatgccttgcgcccactgccacttgactggatgtatctcgtctacaccatcatgtttctgggggcactgggcatgatgctgggcctgtggtaccggctaagctgtatgttattcctgctaccatactggtacgtgtttctcctggacaagacatcgtggaacaatcactcctatctgtatggtttgttggcctttcagttgacattcatggatgcaaaccactactggtctgtggatggcctgctgagtgcccaaaagaagaatgctcacgtgcccctttggaactacacagtcctgcgtggccagatcttcattgtgtatttcattgcgggtgtgaaaaagctggatgctgactgggttgagggctactccatggagcatttgtcccggcactggctttttagtcccttcaagctagtgttgtcggaggagctgacaagcctgctggtggtacactggtgtgggcttctccttgacctctcggctggcttcctgctcttcttcgatgcctccagacccattggcctcgtcttcgtgtcctactttcactgcatgaactcgcagctcttcagtataggtatgttcccctatgtcatgctggccagcagccctctcttctgctcagctgaatggcctcggaagctggtagcccgatgcccgaaaaggctgcaagagctgctgcctgccaaagctgctcctcggcctagtgcttcctgtgtgtataagagggcccgggcgaaagctggtcaaaagccaggcctacgccaccatctgggaactgtcttcaccctgctctaccttctggagcagctcttcctgccctattcccatttcctcacgcagggttacaacaactggacgaatgggctgtatggctattcctgggacatgatggtgcactcccgctcccaccagcatgtaaagatcacctaccgtgatggcctcactggagagctgggctaccttaaccctggggtattcacacagagccggcgctggaaggaccatgcagacatgctgaagcaatatgccacttgcctgagcctcctgcttcccaagtacaatgtcactgagccccagatctactttgatatctgggtctccatcaatgaccgcttccagcagaggctttttgaccctcgcgtggacatcgtgcaggccgtgtggtcccccttccggcgcacgccttgggtgcagccactcttgatggacttatctccctggaggaccaagttacaagacattaagagcagtctggacaaccacactgaggtggtcttcattgcagatttccctgggcttcacttggagaattttgtgagtgaagacctgggcaacaccagcatccagctgctgcagggagaagtcactgtggaattggtggcagaacagaaaaaccagactcttcgagaaggagagaaaatgcagttgcctgctggagagtaccataaagtctatactgtatcatctagtccttcctgctacatgtacatctatgtcaacactacagaggtcgcactggagcaagacctagcatatctgcaagaattaaaggagaaggtggagaacggaagtgaaacagggcccctgcctccagaacttcagcctcttttggaaggggaagtaaaagggggccctgagccaacacctctggtccaaacctttctgagacggcagaggaagctccaagaaattgaacgaaggcgaaatagccctttgcatgagcgcttcctccgctttgtgctgcggaagctgtatgtctttcgacgcagcttcctgatgactcgaatttcacttcgaaacctgctatttggccgcccttccctagagcaattagcccaagaggtgacatatgcaaacttgcgaccatttgaaccagttgatgagtcaagtgcttcaaacacagattcttccgatcctcatccttcagagccagattctgagcatgttcactctgagctctgaggagtccagatgctgtgcagctacgggggaaggctgttacaggcttattgtctgtgcaaaggacagtttttgggagagaaatgattttgagagaggctttcacagtacagcccaggctggcctcaagctcatggtggtccctgtttcagcctgttttgtcattacatatatatctccagacttagttgtttttccctttacattttacccccttttaagttctttaaaattatagcttacaggatccaaggtaaaagagaagaatttgaatcccaagatttgaggtgcttttagtttttatacaggatttctctgtgtagacaagactggccttgctgacagatttaccagcctctgcctcctgggattaaaggaatgggacatcaaaaaaaaaaaaaaaaa

SEQ ID NO: 3882 - DNA, 4245 bp, Rattus norvegicus
  Genbank Accession No. NM_031757
ctcggcggctccgcagcggctgcagcgggaggacccggccggagccgccgccgccgccgccgccgccatcgcagccgggcggccgggcccccgccgccgggatgccaaggagccggggcggccgcgctgcgccgggccaggccgcgcgctggagcggctggcgggccccggggcggctgctgccgctgctgcccgcgctctgctgcctcgcggcggcggcgggggccgggaagccggccggggcggacgcgcccttcgccgggcagaactggttaaaatcctatggctatctgcttccctatgagtcgcgggcgtctgcgttgcattcagggaaggccttgcagtcagcagtctccactatgcaacagttttacgggatcccagtcaccggtgtgttggaccagacgacaatcgagtggatgaagaaacctcgatgtggcgttcctgatcatccccatttgagcaggaggaggagaaataaacgctatgccctaactggacagaagtggaggcagaaacatatcacctacagcattcacaattataccccaaaggtgggtgagctggacacacggaaggctattcgtcaggctttcgatgtgtggcagaaagtgaccccgttgacctttgaagaggtgccataccatgagatcaaaagtgaccggaaggaggcagacatcatgatcttctttgcttctggtttccatggtgacagctctccttttgatggggaagggggcttcctagcccatgcctactttcctggcccaggaatcggaggagacactcactttgattcagatgagccctggacactaggaaatgccaaccatgatggcaatgacctcttcctggtggccgtgcatgaactgggccatgccctggggctggaacactctaatgaccccagtgctatcatggcacccttctatcaatacatggagacgcacaacttcaagctgccccaggatgatctccagggcatccagaagatttacggacccccagctgagcctctggagcccacaagaccccttcctacactcccggtccgcaggatccattcaccgtctgagagaaaacatgagcggcagcccaggcctcctcggccacctctgggggaccggccatccactccaggtgccaagcccaacatctgcgatggcaacttcaacacagtggccctcttccgaggggagatgtttgtgtttaaggatcgctggttctggcgtctgcgcaataatcgggtacaggagggctaccccatgcagattgaacaattctggaagggcctgcccgcccgcatagacgcagcctatgaaagagcggacggaagattcgtcttcttcaaaggtgacaagtactgggtattcaaagaagtgacggtggagcctgggtacccccacagcttgggggagctgggaagctgcctgccccgtgaaggaattgacacagctctgcgctgggaacctgtgggcaaaacctactttttcaaaggcgaacggtactggcgttacagcgaggagcggcgagccacagaccctggctaccccaagcccatcaccgtgtggaagggcatcccgcaggctccacaaggggccttcatcagcaaggaaggatattacacctacttctacaaaggtcgggactactggaagtttgacaaccagaaactgagtgtggagccaggctacccacgcaacatcctgcgtgactggatgggctgcaagcagaaggaggtagagcggcggaaggagcgcaggttgccccaggatgatgtggacatcatggtgaccatcgatgacgtgccaggctctgtgaatgctgtggctgtggtcgtcccctgcacactgtccctgtgcctcctggtgctgctttacactatcttccagttcaagaacaagacgggtccccaacccgtcacctactataagcggccagtccaggagtgggtatgagcagcccagagccctctctgtctacccagtctggccagccaggcccttcctcaccagggtctgaggggcagctctagccactgcccactggggccagcagggccctaggccaggttcgtgtgtagctgaagtggtgggtacattggtctaggctgagtgtggggcagggagtgatggtggctatgccccaggttgggtagctggtacccagctgccagccttctgtcctgggtagacccctctctactcaagggaataggccaggccctgtcaggaggcaaggatcatgccaggaggtgcccctgaggtctctgcatcctgtggtgtctgcaagatgccgcagttccagtcccggctgggacccagccctctgaggcaagccagcactagctctcacccccaccccaagatgccaccaatcccagtcccctctgccaacacctgctggtcagatgtcccctcacccctaccctactatcctccaaggctgcagtgcccctgatgccaacacagtgggcaaaggcctgggtttcccctgctagctaacagcagattcctcaggaaacctgctccacctgtcaggtctcctctgagactcagaatttagggtcacatgctgcaggcaaggctgtggcccgctggatctcacaaggacccagctgtcatgtcgtgaatatttaaatgtcctgtcactactgtttaaagtcccattttgcaaaggctacttgaggctttaggtcagctagaggtgactgtcttggtgatgaggccagagtggtggcccttccccaggcactaaggactatggtgctgcaagggccactcgggcatcctgttcaggagactcaacagccagggcaggagctgaccctggttctgggggcggatccaagtttgtgactattctctactccccttccttaatgttgtcccctgccttgctccagcctgtcctctgtggcctgggggctcagtctgactataggtaaagcagagatgattctagagccaccattgtcataaggaccagggcaatctttaaagtactccatccacatccccatctgccctgaggcaactcagtttcagactggaggcatgtttgtgctccaatcttgaccctggaagcccagctcactgggcccatcttcctgcactgctcttacgaaaagggtactcacagccggtagcagccccaggctttgggacttcccctcgctccctaccccaacctacctttcttttgttttaacctgaggcccttcacatctgacagaatccctaagccttggcttgacttgctccaaaaccactgggtgcagtgttgttcgctggctctctgctaagcccaacagtggtaggaggcggccatcagggtgctagtgggtcacagataccaactctgacctctgagcctgcatgggctttgcccctgccctgtggtctctgggatttgggtcagctcgtcctgtagcagatagggactctcgctgggttgggagctaagtgaaatctcttgtcccagaagcacctatgtgggtccatcgtgtcccatctcaccatcgtgttctttctcattttggccaagggcaggctccccagggcaggcggggaacaactgcagagatttcgtgattcataggtttgtagtgttttatactttgcaaagcactttattagctcacacctgtccactcacacggaactcctgtaggctctgagaggctgagggtaattctcctcttaccctcagatgaagcacaaggaggtcttatctgcccctgccatccagtgaccctggctgggtctgtgtccccatctgtgggtccttccagggcctgagatcaatgtctcttctagtcctctcttctgggcctccctcccctagtttcctggtccctctcctcagcttggtgctctcacttcttgaaagctctaggccccgcaggctccctgttgactcctggcattccaaggccagctgagaaagagcaggaggtggaagcaggcagcccaggctgcagatgtgaggggtgcagggccgggcccagagagggctcagcctagaggcttccaatcttggattcttctgcctgtggtcatctgtctgtccatcagcccaggtcagagcagtcagaggggcaaagtactggagcccccccagagctcagcttcccctcagcctgggtgacatcacagcatttcagtgtcggtcacattttaaactgatcagcctttgtacaatgttttttaaatcatttctaaataaaacagaaatacagtgaaa

SEQ ID NO: 3883 - DNA, 1214 bp, Rattus norvegicus
  Genbank Accession No. NM_031758
gcaggcgacctgcaccggctgcatggatctgcaaacctcgttgctgtccactggccccaatgccagcaacatctccgatggccaggataatctcacattgccggggtcacctcctcgcacagggagtgtctcctacatcaacatcattatgccttccgtgtttggtaccatctgtctcctgggcatcgtgggaaactccacggtcatctttgctgtggtgaagaagtccaagctacactggtgcagcaacgtccccgacatcttcatcatcaacctctctgtggtggatctgctcttcctgctgggcatgcctttcatgatccaccagctcatggggaacggcgtctggcactttggggaaaccatgtgcaccctcatcacagccatggacgccaacagtcagttcactagcacctacatcctgactgccatgaccattgaccgctacttggccaccgtccaccccatctcctccaccaagttccggaagccctccatggccaccctggtgatctgcctcctgtgggcgctctccttcatcagtatcacccctgtgtggctctacgccaggctcattcccttcccagggggtgctgtgggctgtggcatccgcctgccaaacccggacactgacctctactggttcactctgtaccagtttttcctggcctttgcccttccgtttgtggtcattaccgccgcatacgtgaaaatactacagcgcatgacgtcttcggtggccccagcctcccaacgcagcatccggcttcggacaaagagggtgacccgcacggccattgccatctgtctggtcttctttgtgtgctgggcaccctactatgtgctgcagctgacccagctgtccatcagccgcccgaccctcacgtttgtctacttgtacaacgcggccatcagcttgggctatgctaacagctgcctgaacccctttgtgtacatagtgctctgtgagacctttcgaaaacgcttggtgttgtcagtgaagcctgcagcccaggggcagctccgcacggtcagcaacgctcagacagctgatgaggagaggacagaaagcaaaggcacctgacaattccccagtcgcctccaagtcaggccaccccatcaaaccgtggggagagatactgagattaaacccaaggctaccctgggagaatgcagaggctggaggctgggggcttgtagcaaccacattccac

SEQ ID NO: 3884 - DNA, 5036 bp, Rattus norvegicus
  Genbank Accession No. NM_031760
tgaacttgaaaactggtgtacaatcctgactttccacagtggggtctctctcttctcctggctccgtcaagttcacatctgtagggtccaacttggatggcatggtgtaggctgctggtacctgatgaacctgaatttggaagactgaagaaagttgtactgtagcctcctctgagccaaaagctgaaaagcaagtaaaccgttctcaactgggctaagtttttgaaaagctggcaaagggttgttgagtgcagattctgcaatgtctgactcagtgattcttcgcagcgtgaagaaatttggagaggagaatcatgctttcgaatcagatggatcacataacaatgataagaaatcaaggttacaagataagatgaaggagggagacattcgagttggcttctttgaactgtttcgattttcttcatcaaaagacatctggctgatgcttatgggaggcgtatgcgcattgctacatggaatggcccagccaggcatacttattatttttggtataatgacagatatttttattaaatatgacattgaaaggcaagaactcgagataccaggaaaagcgtgtgtgaataacaccattgtatggatcaacagctccttccaccagaacatgacaaacggaacagtctgtgggttggtggacattgaaagtgaaatgatcaaattctctggcatctacgcaggagtcggcatgaccgtacttatccttggatactttcaaataaggttatgggtcatcactggggctcgtcagataaggagaatgaggaaaatttacttccggagaataatgagaatggaaattgggtggttcgactgcacttctgtgggagagctgaattcaaggtttgctgatgatattgaaaaaatcaatgacgccattgccgaccagttggctcatttcctccagcgcatgtcgacggctatgtgtgggttacttttagggttctacaggggttggaaactaaccttggtgattcttgctgtcagccctctcattggcattggggcagccgtcataggtctgagtatagccaagttcacggagcttgagttgaaggcttatgccaaagcggggtctattgctgatgaagtcctctcatctattcgaacagtggccgcttttggtggtgagaacaaagaggttgaaaggtatgagaaaaatcttgtgtttgcccagcgctggggaatttggaaaggaatggtgatgggcttcttcactgggtacatgtggtgtctcattttcttctgttatgcactggccttctggtatggttccacacttgtcctagatgaagaagagtatacaccagggacactggtccagattttcctctgtgtcatattagcagctatgaatattggccatgcatcttcttgcttggaaatcttctccactgggtgttcagcagctaccaatatttttcaaacaatagacaggcaacctgtcattgactgcatgtcaggagacggctacaagctagaccgaatcaagggtgaaattgagttccacaatgtgaccttccattatccttctagaccggacgtgaagattttagataacctcagcatggtcataaagccaggggaaacgacggctctggtgggatccagtggggctgggaagagtacagcattacagctcattcagagattctatgacccctgtgaaggcatggtgactctggacggccatgacattcgctctcttaacatccggtggctgagagatcaaatcgggatcgtggaacaggagcccgttctgttctccaccactatcgcagaaaacatccgttttggcagagaagatgcaacaatggaagacatagtccaagctgccaaggatgctaatgcatacaacttcattatggccctgccgcagcaatttgacacccttgttggagaaggaggaggccagatgagtggtggtcagaagcaaagagtagccattgcccgagccctcatacggaatcccaagatcttgcttctggatatggctacctcagcactggacaatgagagtgaagctagagtacaagaagcattgaataagatccaacatgggcatacaatcatctcagttgcccatcgcctgtcaacagtcagagctgcagatgtgatcattgggtttgagcatggagtagctgtggaaagaggcacccatgaagagctgctagaaagaaaaggtgtctacttcatgcttgtgaccctgcaaagccaaggagataatgctcacaaagaaacgagcataatggggaaagatgcgacggaaggtggcacccttgagaggaccttttccagaggcagctatcgggatagtttaagagcttcgatccggcaacgctccaagtctcagctgtctcttctgacacatgaccctccactggctgttgctgatcacaaatcctcttacaaagacagcaaggacaatgacgtgcttgtggaagaagttgaacctgccccagttaggaggattctaaaatacaacattccagaatggcactacattctggtaggatctttgagtgcagccattaatggggcagtcacacccatctactcccttttattcagccagctccttgggactttttcactcctcgataaagaacaacaaaggtcagagattcacagcatgtgtctgttctttgtcatcctgggctgtgtatccattttcacacaatttctgcagggttacacttttgccaaatccggagagctcctcacaaagaggctgcggaaatttggtttcaaggcaatgttaggacaagatatcggctggttcgatgacctcagaaataatcctggagtactgacgactaggcttgctacagatgcttcccaagttcaaggggctactggctctcaagttggaatgatggtcaattccttcactaacatcattgcggccttgctgattgccttcttctttagctggaagctcagtctgattataacgatcttcttcccctttctggctttatcgggagctgtacagacaaaaatgttgacgggattcgcttctcaagacaagcaagctctggagaaggctggtcagatcaccagcgaagccctcagcaatatccgcacagttgctgggattggagtggagggaagatttattaaagcatttgaggttgagctccagacatcatacaagactgctgtcaggaaggcgaatatctatggactctgctttgccttttcccaggggatagcatttcttgcaaattccgctgcctatagatatggaggttacttaatagcctacgaaggtctgggcttcagccacgttttcagggtggtctcttcagttgcattgagtgcaacagccgttggaagaacattctcttatactccgagctatgccaaagctaaaatatcagctgcacgcttttttcaactgctagatcggaaacctccaattaatgtgtacagtgaagcaggtgaaaaatgggacaacttccaagggaagattgattttattgactgtaaatttacgtatccttctcgacccgatattcaagttctgaatggtctctcagtatctgttaatcctgggcagacgctggcatttgttggaagcagtgggtgtggcaaaagcaccagcattcagctgttggaacggttctatgatcccgatcagggaactgtgatgatagatggtcatgacagcaaaaaagtcaacattcagttcctccgttccaacatcgggattgtctcccaggagccagtgctgtttgactgtagcataatggacaacatcaagtacggggacaacactaaagagatctccgtggagagagccatagctgctgcaaagcaggctcagctgcatgacttcgtcatgtcgctcccagagaaatatgaaactaatgttgggatccagggctctcagctctctcgtggagagaaacaacgcattgctattgctcgggccattgtgcgagatcctaaaatcttactactggatgaagctacgtctgccctagacacagaaagtgaaaagacagtgcagactgctctggacaaagccagagagggtcggacctgcattgtcattgctcatcgtttgtccaccatccagaactcagatatcattgctgtcgtgtcacaaggagtggtgattgaaaaagggacccatgagaaactgatggcccagaagggagcctactacaagctggtcatcactggagcccccatcagttgacctgactggagacttcacacagataatgatgtgctgagtacaggagggctgtgggtttttgtagtcatatagagaattattaatgctttacagacagaagtatccactgggatccaaagtaattttgagtgactttcagtaataatttcagtttgaaatgtctatgtagaaaggagagagcccagagtcagcatgagtcaaagttcaaagtccaaggtcaagtagctgcttatctgccggccagtgctgctctgggtagaaactggtcactgtctccatcgaggacgccgcggtgagagcaaggagtcctccttcaggacagagggttatctcttgcatctgggaaagctccctgcgcactgagcctgctctgtaatctgcactcaactgtttgagccagttcaaggccaagagctaaggacccaaggctactggtatttcttaactaagtttagtttgtttactataaggaagcaaatttatttacctttaactcctgtgagtagggtggggagccctttcctattctggcatctcccaggctcagggaggccaaggtgacaaaaggagaagtagaggtcgctggtcaggtgtgttgattgtaccgaaggctcagggtattggtgtcactgtacactacagtggatctgccagtgtgaagcaggggctctctaccaggacttcgacttttcattccctgccaccatgtcacctgatgtcccttactcttaggaaattctatgcatggaatggaaatgcatccgaatcttaagttgttacataaaaaaatctagtaaaacatagtagg

SEQ ID NO: 3885 - DNA, 1872 bp, Rattus norvegicus
  Genbank Accession No. NM_031763
gggcccagcgcgccatcctccccctccctccctccctccctccttcctcccttccctctccctccccctcccccgctggtggatgggagtgaaggacggaagaggccctgcggaggcggtggtgcagcgctccggtggaatgaaccttacttgttgactggttgctgattggattcacttgaaaaaaagaatcatttttccctctgtggaagccacatagtggcatatttaattcaaatccaggaatcacaacttttgatttttctggagggacataccactatatcaaataagcttgacattacagccaaaatggtgctgtcccagagacaacgagatgaactaaatcgagctatagcagattatcttcgttcaaatggctatgaagaggcatattccgtttttaaaaaggaagctgaactagatatgaatgaagaattagataagaagtatgctggtcttttggaaaaaaaatggacatctgttattagattacaaaaaaaggtaatggaattagaatcaaaactaaatgaagcaaaagaagaatttacgtcaggtggtcctcttggtcagaaacgagacccaaaagaatggattccccgtccacctgagaaatatgcattgagtggtcataggagtccagttactcgagtcattttccatcctgtgttcagtgttatggtctctgcttcagaggatgctacaattaaggtgtgggattatgagactggagattttgagcgaactctcaaggggcatacagactctgtacaggacatttcctttgaccacagtggcaagcttctggcttcctgttctgcagatatgacgattaaattatgggattttcagggttttgaatgcatcagaaccatgcacggccacgaccacaatgtctcttcagtagccatcatgcctaatggagatcatatagtgtctgcctcaagggataaaactataaaaatgtgggaagtgcaaactggctactgtgtgaagacattcacaggacacagagaatgggtacgtatggtgcggccaaatcaggacggcactctgatagccagctgttccaatgaccagactgtgcgtgtatgggttgtagcaacaaaggaatgcaaagctgagctccgagaacacgaacatgtggtagaatgcatttcctgggctccagaaagttcatattcttccatctctgaagcaacaggatctgagactaaaaaaagtggcaagcctggacccttcttgctatctggttccagagacaaaactattaagatgtgggacgtcagtactggcatgtgccttatgactctggtgggtcatgataattgggtacgtggagttctgttccattctggggggaagtttattttgagttgtgctgatgacaagaccctccgtgtatgggattacaagaacaagcgatgcatgaagaccctcaatgcgcatgaacactttgttacctccttggatttccataagacggcaccctatgtggttactggcagtgtagatcaaacagtaaaggtgtgggagtgccgttgattgagtcacatttggttcttcctcccttttttcctctggatgcactctgatgataccatggttaccccatttgagctctgtttaaataaatattgtcctttcatgtaaattattctggatgtagattgagcttattaaatgttacacacaaagtattcatgcatggtgaatccaaattgtatactgtaaatttacatatgttgtctagaagtaccataggggttaaaaacctgggctggcattggtcacaccaggcctacaagggcagaagttgaataaattgaactagggcactaaaaaaaaaaaaaaaaaaaaaaaaaaaaaaaa

SEQ ID NO: 3886 - DNA, 3769 bp, Rattus norvegicus
  Genbank Accession No. NM_031773
tgaattggtccacgagtggagtcgtagctccggtttcccgtccggggctcgcagaagcatggatgtcgacagccggtggcggaacctgcccagcgggcccagcctaaagcatttaaccgacccctcgtacgcggttcctccggagcagcaaaaggcggcgttgcaggacctgacgcgggcgcacgtggactccttcaactacgcagtgctggaggggctgagccacgcggtgcaggccatacctcccttcgaatttgctttcaaagatgagcgcatatctcttactattgtggacgctgccatcagtccaccggcagtgcccaaagggaccatctgcaaagagctcaacatttatccagctgagtgccgtggccggaggagcacgtaccgagggaagctgacggctgatatcagctgggccgtgaatggagtccccaaaggcatcattaaacaatttcttggcwatgttcccatcatggtgaagtccaagctttgcaacttatacaaccttcctcctcaagtcctcattgagcaccacgaggaggcagaggaaatgggcggttattttataatcaacggcattgagaaagtcatccgcatgttgattatgcctcggagaaattttcccatcgcaatgataagaccgaaatggaaaagcagagggctcggctacactcagttcggggtttccattcactgtgtgagagaggagcactctgctgtcaatatgaaccttcactatgtggagaacggcacggtcatgttaaactttatttaccgcaaagagctgtttttccttcctttgggatttgcacttaaggcacttgtgagcttttctgactatcagattttccaggagctcatcaaaggcaaagaggaggactctttctttaagaattctgtttctcagatgctgaggattgtaatggaggagggttgtcacacacagaagcaggtcctcgactatctgggcgaacgcttcagagtaaagctcagtcttcccgattggtaccctaatgcggaagctgccgagttcctgtttaaccagtgtatctgcatccacttgaaatccaacactgacaagttttacctgctctgtctcatgacccggaagctctttgctttagccagaggagagtgcatggaggacaatcctgacagtttagtgaatcaagaagtccttacccctgggcagctcttcctgatgtttctgaaggaaaagatggagaattggctactgtctattaaaatagctttagataaaagggctcagaagaccaatgtttccataaacaatgaaaatttgatgaagatttttagtatgggaacagagctaacaagaccatttgaatatcttcttgctactggaaatctgcgttctaaaacaggtcttggcttcatgcaggattctggcctgtgtgttgtggctgacaagctgaacttcattcgctatctctcccatttccgctgtgtgcacagaggggctgactttgccaagatgaggaccaccaccgtgcgcaagctgctgccagaatcctggggcttcctctgccctgtgcacaccccagacggggcaccgtgtgggctgctgaaccacctgactgctgtgtgtgaggttgttaccaagtttgtgtacacagcatctattccagccttgctctgtggcttaggagtcactcctgttgatgcagcaccatgtcgaccgtatagtgactgctaccctgtcctgctggatggcgtcatggtgggctgggtggataaggagctggctcctgaagtggcagacactctccgtcgatttaaggtgttgagagaaaggagatgttcctccctggatggaggtggccctgattcccatgacaggaaagccaagcctgtacccagggctgttcctcttcaccactccctgcaggctggtgaggcctgtgcagaacctggagctgggcaaagaagagctcgttggaactatggagcagctcttcatgaacattgccatcttcgaggacgaggtttttggtggagtttccacacaccaggagctcttccctcacagcctgctgaggtgatcgccaacttcatccccttctctgatcacaaccagagtcctcggaacatgtaccagtgccagatgggtaagcagaccatgggcttcccgctgctcacctaccaagaccgatcagataataaactctatcgtctccagacaccccagagccctctagtgagaccgtgcatgtatgatcattatgacatggacaactatcccatcgggacaaacgccattgtggctgtgatctcctacactggctatgatatggaggacgccatgattgtaaacaaggcctcctgggaacgaggctttgctcatggaagtgtctacaagtctgagttcatagacctctctgagaaatttaagcaaggggatgatagtctggtatttggggtcaaacctggtgacccacgggttatgcagaagctggacaatgatggcttgccattcataggagcaaagctggagtttggtgatccttactacggctacctaaaccttaacaccggagaaggcttcgtggtttactataagagtaaagaaaactgtgttgtggacaacatcaaagtgtgcagtaatgacacaggaagtgggaagttcaagtgcgtctgcgtcaccgtccgagtcccccggaacccaactattggagataagtttgccagccgtcacggacagaagggcattttgagcagattgtggccagctgaggacatgcctttcacagagagtgggatgatgccggacattctgtttaatcctcatgggtttccctcccgtatgaccataggtatgttaatcgagagtatggctgggaagtcagcagctttgcatggtctctgccatgatgctacacccttcatcttctccgaggagaactctgccctagagtactttggtgagatgttaaaggctgccggctacaacttctatggcacggagagattgtacagcggcatcagcgggatggagctggaggctgacattttcattggtgtggtttattaccagcgcctacgacacatggtgtcagacaaatttcaagtcagaacaactggagccagggacaaagtcaccaaccagcccattggaggcaggaacgtccagggtgggatccgatttggggagatggagcgggatgctctgttggcgcacggcacatctttccttctgcatgaccgcctcttcaactgctccgaccgctctgtggcccacgtatgcgtgaagtgtggcagtttgctttctccgctgctcgagaagcctcccccatcttggtctgcgatgcgtaacagaaaatacaactgcaccgtctgcggccgcagtgactccatcgacactgtctctgtgccgtatgttttccggtactttgtagctgagctggctgccatgaacatcaaagtgaaactggacgtcatttaacttgatcacggccatctgcgctaggagaagagaacaaaaggtgtctttaatccagtgaggatactatgggtttgctctgggtctatataagaatttcagtacagaaatgtctcagtaacctactgaagttggttttggtacattcatttttaaaaaaaaattatgtgccttctttaaaaaatgacttaattgataataggtcatacagggcccttctgggcccaggttcactcgctgttccctgctttgagtagtagagtgtgtccgccgtctagagcagggcagtacaataaacagaaaatg

SEQ ID NO: 3887 - DNA, 1446 bp, Rattus norvegicus
  Genbank Accession No. NM_031775
ttccggcaggaaacgggacctggagagcggaggcctcaggacgagcgcggacacccggagctcgtgggcagcctgaaaagtggggagaagtggcagaccagagctcggggcacaggcctgcaggagcccagctcaagacccctaaccaaggccagaccaaggccagacctgggcaggcacctccatcacagcgccttctgcagtcagaacttgttgctgtccacaggggaaagtaaaacatgacggagacagatggcttctacagaagtagggaagtgttggatccagccgagcagtacaagatggaccacaagaggagaggaactgccctaatcttcaatcacgagaggttcttctggcacctagcactcccagagaggcggggcaccaacgcagacagggacaacccgactcgaaggttctcagagctaggatttgaagtgaaatgctttaacgacctccgggcagaagaactactgctcaagattcacgaggtgtcgacttccagccacgtagatgccgattgcttcctgtgtgtcttcctgagccacggggaaggcaaccacatttacgcatacgatgccaaaattgaaattcagaccttgactggcttgttcaaaggagacaagtgtcagagcctggttggaaaacccaagatattcatcatccaggcctgtcggggcagccagcatgacgtgcccttggttcctctggacgtggtggatcatcagacagacaagctggacgacaacgtgacccaggtggatgctgcctcggtgtacactctgcctgcgggggcggacttcctcatgtgttactctgttgcagaagggtattactctcaccgagagactgtgaacggctcctggtacattcaggatttgtccgagatgctggccaggcacggcagttccctggagttcaccgagctgctcacgctggtgaacaggaaggtctctcagcgccgtgtggatttctgcaaagacccaggtgcaattggcaagaagcaggttccctgctttgcctcaatgctgaccaaaaagctgcatttctgtcccaaacctagtaagtagggccgtccgacttgctacaaatgtttcacacacatttcccttctacacagaggccagctggccaaagactccgcccaccaacggacactgtttgaatttttaaggtgctacagaaaagtaatgttttgcctttgttattattttcaatcatgttggggatggggaaggctaaagaaatctaggaaattactgtgcgcaaatgcccaatacatttattatgtttctggtaaatggcaagattactaagaataccaactactttgccttaccttttgtgacactatttatataggctcattgtataatgtttttaaagatctttgaaactcaagaatgagatcgttttctcctaataaaaatgtctaaaacccgg

SEQ ID NO: 3888 - DNA, 1568 bp, Rattus norvegicus
  Genbank Accession No. NM_031776
aagagccagcagctccccgctctgcagccacagggaccgaccgctctgcgcccgcccggtgcaccctctttggtcagtgaacttgcgctgccccgctgctgccatgtgtgcggctcggaggcgcgagctggcgctcatcttccgagggactttcgtccactccacctggacctgccccatggaggtgcttcgcgatcaccttcttggcgtgagcgacagcggcaaaatagtgtttctagaagaatcatctcagcaagaaaagctggccaaagaatggtgcttcaaaccgtgtgagatcagagagctgagccaccatgagttcttcatgccaggccttgttgatacacacatccatgcccctcagtatgcctttgctggaagcaacgtcgacctgccacttttggattggctgaacaagtatacatttcctacagaaaaaaggttccagagcaccgatgtggctgaagaagtctacactagagtcgttaggagaacactaaagaacggcaccaccacggcatgctactttggaacaattcacactgactcatccctgatccttgcggaaattacagataaatttgggcagcgagcatttgtgggcaaagtatgcatggatttaaataacactgttccagaatacaaggagaccaccgaggagtcagtcaaggagacagagagatttgtgtcagaaatgcttcaaaagaattattcaagggtgaaacccatagtgaccccgcgattttctctttcttgcacggagactctgatgagtgaacttggcaacatcgccaagactcatgatctgtacatccagagccatataagtgaaaatcgtgaagaaattgaagctgtgaaaagcttataccctggctacaaaaactacacagatgtctatgataaaaacaatcttctgacaaacaaaacagtgatggctcatggctgctacctttctgaagaagagctgaacgtcttcagtgaacgaggagcatccattgcacattgtcccaactctaatctgtcgctgagcagtggcttactgaacgtgctcgatgtcctgaagcataaagtgaagatagggcttgggacagatgtggctggtggttactcctattccatgcttgacgccatccgaagagcagtgatggtttccaacgtcctcttaattaataaggtgaatgagaaaagcctcaccctcaaagaagtcttcagactagccactcttggaggaagccaagccctggggcttgatcgtgaaattggaaactttgaggtcggcaaggattttgatgccctcttgatcaaccccagagcatcggactctcccattgatctgttttgtggggatttcgttggtgatatttctgaggctgttatccagaagttcctctatctaggagatgaccgaaacattgaggaggtttatgtgggtggaaagcaggtcgttccattctccagctccgtgtaaggcccttggacatccatgacgctctcctgggaggacatgagtctgctatcttccttgtacccagggaccgatcagaaagtatattcaaaaaaaaaaaaaa

SEQ ID NO: 3889 - DNA, 2044 bp, Rattus norvegicus
  Genbank Accession No. NM_031778
gcaggttcagcgtgatcttctgtgtctcccttctgggccagcactctgccttctcagtccatcatggtgtttggtgagtttttccatcgccctggacaagatgaggaacttgtcaacttgaacgtggggggttttaaacagtctgtggatcagagtacactcctgcggttcccccacacacgactggggaagctgcttacctgccactctgaggaggccattctggagctgtgtgatgactacagcgtggcagataaagagtactacttcgatcggaacccctccctgttcagatacgttttgaacttttattacacagggaagctgcacgtcatggaggaactgtgtgtcttctccttttgccaggagattgagtactggggcatcaacgagctcttctttgactcctgctgtagcagtcggtaccaggagcgcaaggaggagagccacgagaaggactgggaccagaaaagcaatgatgtgagcacagactcctcctttgaggaatcgtctctgtttgagaaagagctggagaagtttgatgagctgagatttggtcagctccgaaagaagatctggatccgaatggaaaacccagcttattgcctgtcagccaagctcatcgccatctcctccttgagtgtggtgctggcttccatcgtggccatgtgtgtacacagcatgtcagaattccagaacgaggatggagaagtggatgaccctgtgctggaaggtgtggagattgcctgcattgcatggttcaccggtgagctggccatccggctggttgctgctccatcacaaaagaagttctggaaaaaccctctgaacatcattgactttgtctccatcattcccttctatgccacgttggctgtggacaccaaggaagaagagagtgaggacattgagaacatgggcaaggtggtccagatcctccggctcatgaggattttccgcatcctgaagctcgcccggcattccgtagggcttcgttctcttggggccacgctgaggcacagttaccacgaagtggggctactgcttctcttcctctctgtgggtatctccattttctctgtgcttatttactctgtggagaaagatgaactcgcgtccagtctcactagcatccccatctgctggtggtgggccactatcagtatgaccacagtgggctatggagacacccacccagtcaccttagctgggaaaatcattgcgagcacctgcattatctgtggcatcttagtggtagcccttcccatcaccatcatcttcaacaagttttccaagtactaccagaagcagaaggacatggatgtggaccagtgcagcgaggacccaccggagaagtgccacgagctaccttactttaacattagggacgtttatgcacagcaagtacacgccttcatcaccagtctgtcttccattggcatcgtggtcagcgatcctgactccacagatgcctcaagtgtcgaagacaacgaggatgcttacaacaccgcatccctggagaactgtactgcaaaatgagcaggggcatttgcacggacagctcatgtcccttcctcacgttaggttaacacagctttataaacctcaatgggtttgttcaaatcaatcatttaattctcagggtgtaccttttagccatagttggacattcattgccgaattctgaaatgatagaattatctttatttttctcagtgagatcaattaaaatgccttgttctgaaatttattttttaacaagagagagttgtaatacggttttttggggggaaaatgtaaatgatattgggaaggatttattgctacggcttacgcatcattctgtatctgccattcactcacattgagctaactataaattactgatgttagagcagaggcccagccgaccgaagacgacatgcatgtaagatctacaacatgagacaatgcatgtaaatccatgttcatgttccagacacgggaattaggagcccaataaacttctaattcggtatggaaaaaaaaaaaaaaaaaaaaaaaa

SEQ ID NO: 3890 - DNA, 1939 bp, Rattus norvegicus
  Genbank Accession No. NM_031781
accatggcttgtctacgagttccgcactcagagccctcgtcttccagcttggtgacaatgccggcctgaacctggatcccagacatggagttcctgccagaaccccagcatcccccagggcccccgaccatggacttggaggagcccaaaggccccgaggttccctctgaggaccatccctctaacacgcagggggccttagggcccagaggccccgataccctgagcgagatggagctggacacatccagtgtgcgggcgctggttcagcagttggaagctttgcccagcgacctgggtggccagttcccagatggagccccctgtcccctgcacattgccactggccaaggcctagccacccaggagaatttggatgctggtgggctcctgtcagccgaggcaggtggggacaaccttctgggtctgctgaggtgtgaggcctctttgcctgctcaatccgttcccccagatcctgcacaggctgcaccccgccttctgcagccaccagaggaccccggtggggaccctggatggatggaagggacagagccagcagacaacaggagttccagcagctccccggagctgtggctagagacagcacccctggtgacacatcgagatccacccgtgggtacccagagccaggagaccctggcttcgtgccctgccgtctccgaggttccaggtccctgtggacaggaggagctcatggacggagtcctcttcggggcgaaatacctgggctccacccagctgctgtctgagcgcaacccgccgcccagcacacgcatggggcaggcgcaggaggccatggatcgggtcaaggcccctgaaggtgagagccagcccatgaccgaggtagacatctttatctccactaagcgcgtgaaagtgctggctgctgactcccaggatgccctgatggaccatgccctgcagaccatctcctacatcgcggacattgggcctgtgctggtcttgatggcgcgcaggcggctggccaagaggacaacttctcaggaccgccagcggcagctctacaagatgctatgccatgtcttccattcagaggatgcccagctcattgcgcaagccatcggtcaggccttcagtatcgcctacagccagttcctgcaggagaacggaatcgaccccagccaggtgggcatgcagccttcagcctctgccagtcacccacacaatggcgacctggaccacttctgcaacagccagaactgcagggaggtttgcatccagaagcggcctggggagggcctgggtgtcgcgctggttgagtcaggctggggctcgctgctgcccaccgcggtcattgccaacctcctccacgggggccctgccgagcgctgcggggccctgagcataggggaccgtgtcactgccatcaacggaaccagcctggtggggctgtcgctggccgcctgccaggccgctgtgcgcgaggtacggcgacactcatccgtgacgctgagtatcatccattgcccaccagtcaccacggccgtcatccaccggccccacgtgcgcgagcagctgggcttctgtgtggagaacggcattatttgcagcctgctgcgtgggagtgcggctgagcgtggtggagtccgcgttggacaccgcatcattgaggtcaatgggcagagtgtggtggccatgccccacgcgcgcattatccagctgctcacagagacaagagaaatccacatcaagaccatgccagctgccacctaccgactgctcacgggacaggaacagccagtatacctgtgatcgccccgcccacatgtgccttcgccccgcccacgtgtgccttcgccccgccaccgtcacccctcggccggcggggaccaaagaatcctcagtcttgtgctattttctaatgtaaaaaatacttttaaagatttattaaatggtc

SEQ ID NO: 3891 - DNA, 2927 bp, Rattus norvegicus
  Genbank Accession No. NM_031784
cgggccggtccctgggcctgagctccggctccggctggggcgcctgcgatgtctcaagatggcggagctgggcgaattaaagcacatggtgatgagtttccgggtgtctgagctccaggtgctccttggcttcgctggcaggaacaagagtgggcggaagcacgaattgctggccaaggccctgcacctcctcaagtctagctgcgcccccagcgtccagatgaagatcaaagaactttaccgcaggcgctttccccggaagaccctggggccttccgatctctctttgctctctttgccccctggcacctctcctgtaggctcccccagcccccttgcttccattcctcccaccctcctgacccctggcaccttgctgggccctaagcgtgaggtggacatgcaccctcctctgccccagcctgtgcaccctgacgtcaccatgaaaccactgcccttctacgaagtctacggagagctcatccggccgaccacccttgcgtccacctccagtcagaggtttgaggaagcccactttacctttgcactcactccccagcagctgcagcagattctcacatccagggaggttctgccaggagccaagtgcgattataccatacaagtgcagctcaggttctgtctctgtgagaccagctgcccccaggaggactatttcccccctaacctctttgtcaaggttaatgggaaactctgccccctgccgggttacctccctccaaccaagaatggagctgagcccaagaggcctagtcgtccaatcaacatcacacccctggctcgtctctcagccactgttcccaacaccatagtggttaactggtcatctgagtttggacggaattactccttgtctgtgtacctggtgaggcagttgactgcagggaccctgctacaaaagctcagagccaagggtatccggaatccagaccattcccgagcactgatcaaggagaaattgactgctgaccccgacagtgaagtggctactacaagtctccgggtgtcactcatgtgcccgctggggaagatgcgcctgactgtcccatgccgcgctctcacctgtgcccacctgcagagtttcgatgctgccctttatctacagatgaatgagaaaaagccaacatggacgtgccctgtgtgtgacaagaaggctccctatgagtcactgattattgatggtttattcatggaaattcttaattcctgttcggattgtgatgagatccagttcatggaagatggatcctggtgtccaatgaaacccaagaaggaggcatccgaggtttgccccccaccagggtatgggctggatggtctccagtatagcccagtccaggagggaaatcagtcagagaataagaagagggttgaagtcattgacttgacaatcgaaagctcatcagatgaggaagatctgccccccaccaagaagcactgccctgttacctcggctgccattccagcccttcctggaagcaaaggagccctgacctctggtcaccagccgtcttcggtgctgcggagccctgcaatgggtacactgggcagtgatttcctgtctagtctcccactacatgagtacccacctgccttcccgctgggggctgacatccaaggtttagatttattttctttccttcagactgagagtcagcactacagcccttcagttatcacttcactagatgagcaggacacccttggccacttcttccaattccggggaacccctccccacttcctgggcccactggcccccacattggggagctctcaccgcagcgccactccagcacccgctcctggccgtgtcagcagcattgtggctcctgggagttccttgagggaagggcatggaggacccctgccttccggtccctctttgactggctgtcggtcagacgtcatttccttggactgagttatttggattgcaaaatcaatttctactggccctagcactgagcagatacattgtgggttcccaacccctggctgctctgatccctcaggggtcattggtcaaaggccaggccagatcttcatggacacctgcttttggccttatcactgcctaacaaggccagtactcaaagggttaacatttaaccttttgaaaaaggacattggggtctgtttttggaagtgttctttgatgtagcacattcctttgggtagggtaacctaggcagtgggaggcagatggaagggtaggggttcctcacccttcaccagatcttcagcctcttggggaaagggcagtttcctgcccctcccccaggactcctttccgtacccaaacccaaacatctgttctttttcgtccattcccttctctttggccatactgtcaggtggcaggtcagagatggacagacaactctattttgggttgcagatttcttttttgtacataaataagaaaactccaaattatccaaagatgacttcccttgccttttacttcccagtgtgactcgaggaggaaacaaggccttagttgtgatccccaggggctcgggaacagggcgtggcctgcctactgcctgggtctctctatttatatatttaagttcacaatgtttttatgctaaacagtcaagggcctaagcttctagtgacctgtgctcaggcctagattgttcttgcaccttttatgggacatgggggctctgttctccttcccaatactcagcgccccttcagggccaaagccctgtgatgtgatttcactttttatccccagagctgtagcagagttctcgcctacaataaaggttgtgaatgttctgtgagcgtcatggaggggagagatgttgtaccttgttttccagacccatggtttgtggggcagagggtccatgttctatcctttcacttagaaaaaaaaaaaaaaaaaaaaa

SEQ ID NO: 3892 - DNA, 2089 bp, Rattus norvegicus
  Genbank Accession No. NM_031785
ctatgatggcggcaacagtggtatctcggatacgaaccgggacacggtgggctccagtcctgtggctgcttctgtcgttggtggcagtggcggcagcagtggctgcggagcagcaggtgccactggtactgtggtcgagtgaccgggacctctgggctcctgtggccgacacacatgagggtcatattaccagcgatatgcagctttctacctacttagaccctgccctggagctgggcccccgcaatgtattgctgttcctgcaggacaagctgagcattgaggatttcacagcatacggtggtgtgtttggaaataaacaggacagtgccttttctaacctggagaatgccctggacttggccccctcctcactggtacttcctgctgtggactggtatgcaatcagcactctgaccacctacctacaggagaagcttggagctagtcccttgcatgtggatctagctaccctaaaggagctgaagctcaatgccagccttcctgccctgctgctcatccgtctgccctacacagccagctccggtctgatggcgcccagggaggtccttacaggtaatgatgaggtcatcggacaggtactgagcacacttgagtctgaagatgttccttacaccgcggctcttactgcagtccgcccttctagagtggcccgtgatgtagccatggtggctgggggtctaggtcgccagctgcttcagactcaggtggcatcacctgcgatccatcctcctgtgagttacaatgacactgccccaaggatcctgttttgggcacaaaacttctctgtggcatacaaagacgaatggaaagacttgacctccctcacctttggtgtggagaatcttaacttgaccggctccttctggaatgactcctttgccatgctttcactgacctatgaaccactctttggtgcaacagtgacattcaagttcattctggctagtcgcttctacccagtatctgcccgatattggtttaccatggaacgacttgaaatccacagcaatggctcggttgcccatttcaatgtttcccaagtcacaggacctagtatctattctttccactgtgagtacgtcagcagtctgagcaagaaaggcagtctccttgtgaccaacgtgccctccctctggcagatgactcttcataacttccagatccaagccttcaatgtgactggtgaacagttctcctatgctagcgactgtgctggcttcttctctccgggcatctggatggggctgctcaccaccctcttcatgcttttcatattcacctatggtctgcacatgatactcagcctaaagaccatggatcgctttgatgaccgcaagggccccaccatcactttgacccagattgtgtgacatataccagagagggattgagggagtattggtgtctaggtttccattttgtgacacagtggatggaaaggtttgtcctcttcctactatagcatgaaccctacatacaccaccctcagcctgtcttgcttcctctttcctggacagggacttccctgaggctatcccccacttctaccaacaaagtgtattattcttcatagataaatcttccaggcttcatcaagaggggaagggaccttaattctagggtgcccccctttccctttctccttatttattcttgcccctctgctattatttcgtgctgtttatagtgcttttgtgtagtaaatactcactccccaagctttatggagctttccagcaatagccatgaacttgaggtcccttgaatttgagaggtgtggaaaggctagttaactgtccagcttagcctttatgggttttttttttttggcgggtgggggttaagaatgagcggtacactggggtttatttctgtgacctgagaaggaagaaatcaccacgagaactggagaaacaaagtgtactcattgggtttctggtttgttctcacaaggattgcctgtcaagaagccagaagtatgtgtgtgtgtgtgtggggggggtgtgctctgttgtttcattcctaataaaataaagacgtgttgccatgaaaaaaaaaaaaaaaa

SEQ ID NO: 3893 - DNA, 2307 bp, Rattus norvegicus
  Genbank Accession No. NM_031789
gccgccgcctcacctctgctgccagtagcctcgccgtcggggagccctagcgcagcgtccgccctcagcatgatggacttggaattgccaccgccaggactacagtcccagcaggacatggatttgattgacatcctttggaggcaagacatagatcttggggtaagtcgagaagtgtttgactttagtcagcgacagaaggattatgagctggaaaaacagaaaaaactcgaaaaggagagacaagagcaactccagaaggaacaggagaaggcctttttcgctcagttacaactggatgaagagaccggagaattcctcccaattcagccagcccagcacatccagacagacaccagtggatctgtcagctactcccaggttgcccacattcccaaacaagatgccttgtactttgaagactgtatgcagcttttggcagagacattcccatttgtagatgaccatgagtcgcttgccctggatattcccagccacgttgagagctcagtcttcaccacccctgatcaggctcagtcactcgatagctctctggagacggccatgactgatttaagcagcatacagcaggacatggagcaagtttggcaggagctattttccattcccgagttacagtgtcttaatacggaaaacaagcagcaggctgagactaccactgtccccagcccagaggccacactgacagagatggacagcaattaccatttttactcatcgatcccctcactggaaaaagaagtggacagctgtagtccacatttccttcatggttttgaggattcttttagcagcatcctctccacggatgatgccagccagctgaactccttagactcaaatcccaccttgaacacagatttcggtgatgaattttactctgctttcctagcagagcccagtggcggtggcagcatgccttcctctgctgccattagtcagtcgctctctgaacttctgggcgggcccattgagggctgtgatctgtccctgtgtaaagctttcaaccagaagcacactgaaggcacggtggagttcaatgactctgactccggcatttcactgaacacaagtcccagccgagcatccccagagcactctgtggagtcttccatttacggagacccaccgcctgggttcagtgactcggaaatggaagagctagacagtgcccctggaagtgtcaaacagaatggacctaaagcacagccaacacattcttctggggatacagtacagcctctgtcgccagctcaagggcacagtgctgctgtgcacgaatcccagtgtgaaaatacaacaaaaaaagaagtacctgtgagtcctggtcatcaaaaagtcccattcacaaaagacaaacattcaagccgattagaggctcatctcacaagagatgagcttagggcaaaagctctccatattccattccctgttgaaaaaatcattaatctccctgttgatgacttcaatgaaatgatgtccaaggagcaattcaacgaagctcagcttgcattaattcgagatatacgcaggagagggaagaataaagttgccgctcagaactgtaggaaaaggaagctggaaaacattgtagagctggagcaagacttgggccacttaaaagacgagagagaaaaactactcagagaaaagggagaaaacgacagaaacctccatcttctgaaaagaaaactcagcactttgtatctggaagtcttcagcatgttacgtgatgaggatgggaaaccttactctcccagtgagtactctctgcagcagaccagagatggcaacgtgttccttgttcccaagagcaagaagccagatacaaagaaaaactaggttcgggaggatggagccttttctgagctagtgtttgttttgtacggctaaaacttcctactgtgatgtgaaatgcagaaacactttataagtaactatgcagaattatagccaaagctagtgtagaaataatatgaaactttacaaagcattaaagtctcaatgttgaatcagtttcattttaactctcaagttaatttcttgggcaccatttgggctagtttctgtgtaagtgtaaatactacagaacttatttatactgttctcatttgttacagtcatagacttatatgacatctggctaaaagcaaactattgaaaactaaccaaaccactatacttttttatatactgtatgaacaagaaatgacatttttatattaaattgtttagctctgataaaaattaaaaggagctagcactaataaaggaatatcatgactt

SEQ ID NO: 3894 - DNA, 3512 bp, Rattus norvegicus
  Genbank Accession No. NM_031796
aagagaggggccttgctcctgctgctgctactgctgctgttactgttgctacctcaactctctctccactccaggtaagcagagggcaagctgcaaggcaagcctttgtacgatgaacaagatccgaaagtttttccgaggaagtgggcgagtcttggcatttatatttgtagcttctgtcatctggctgctctttgatatggcagctctccgcctctcattcagtgagatcaacacagggatactcaaagaagatatcatgaggagggaacagacaggattcagagttgaggcagaccaaatgacgatcctttcccccagcagcagagggatgaggccgccccggaatggagcgggaggcaaggagagctttagaaaggctgagaaccgtgtactcaaggttgaggagaatgtggaccaagtccagaggaaagggaaaatgcagttcctcctgggaagggggaaggctgtgtctttgtggcatcgtacacatgtgcaaaccctcccagtgacactccccatgcagaagacccaggggagagacagcaagcctgaagtctcctccttgcacatgatgtccaagcagacaacagtgttagggtctgagaaggactctttcacagtgtcaagaggagttccattgaacaaaacagcagaacatacagaaaccttagataaaaaacaagaggccccagagaattataatctcagcagtgatacatcaaagcaagcctcccaaagggccctgaatgtgaccatcagtgtcaggactgacagatcaaagcagcaatcacagacagtaacaaaatcaagcatacaatttgccagcctaccaatcctgaaacctgaggaagtcacggtcacaaagaaaactgaggctcagggcaaagacctaaaatatgaagcccataaagcgcgccctcttcttaagttcactgctgatgtgggtcatttaaagaaacaatctacaaatgagacaggattgggagtattgccagaagccgatggggccaaagtggcgccagggaagaaactaaatttctctgaaagtcagattgtgattataactaaagaggaaggccagaagacagacaccaaagaggtacctaattctaaaatccaaactgtcttccctaaattactgggtgaaagccaaggaaaacatatccccaggagtcagagccagaccttgtcctctccattagctccaaagagagctgtgtctcagtccaagcccaccttagctgaggaactccatacagcaagaagcaacttgactgccaaggccacaactgtaggacaccagcaaagccatgcaaatatctctgaaaaccctggaaagcatcacgtgctcagaatcgatgtgaccctctctccaagagatctcaatgctccaggtcagttcgggcgccctgtcgtggttccccctggaaagaagaaggaggctgaacagagatggaaagaaggaaacttcaatgtctaccttagcgatttgattccagtggacagagccattgaagacacaaggcctgctgggtgtgcagagcaactagttcacaacgacctcccaaccaccagcatcatcatgtgcttcgtggatgaggtgtggtctgctctcctgaggtctgtgcacagtgtcctcaaccgctcccctccacacctcatcaaggagattctgctggtggatgatttcagcaccaaagactacctgaaagctaatttggataaatacatgtctcagtttccaaaagttcggattcttcgcctcaaggagagacatggcttgatcagagcaaggctggctggggcgcagaatgcaacaggtgatgtgctgacattcctagactcccatgtggaatgtaatgtgggctggctggaaccccttctggagagagtttatttaaatagaaagaaagtagcctgtccagtaattgaagtcatcaatgacaaggacatgagttacatgacagtggacaacttccaaagaggtgtcttcacctggcccatgaactttggctggagaacaatccctccagatgttattgcaaaaaatggaattaaagaaacagatataataaggtgcccagtcatggcaggtggattattttccattgacaaaagttacttttatgaacttggaacttatgaccctggtcttgatgtttggggtggagaaaatatggagctatcattcaaggtctggatgtgtggtggtgaaatcgagatcattccctgttccagagtgggccacatattcagaaatgacaatccctactccttccccaaggaccgcatgaagacggtggaacggaatctggtgcgggttgctgaggtctggctcgatgagtacaaggaactcttctatggccacggggatcacctcatagaccaagggctggatgtgggcaacctcacccagcaaagggagttgcgaaagaagctgaagtgccaaagtttcaagtggtacttggacaatgtctttcccgacttgaaggcgcctgttgtaagagctagtggtgtgtttattaatctggccttgggcaagtgtgtttccatcaaaaatatcacagttgtcctggaggactgcgatgggagcagtgagcttcaacaatttaattatacctgggtaagacttattaagcatggagagtggtgtgtggcgcccatccctgataaaggatccctgacgctgtacccgtgtgacaacagaaacaacaggcttaaatggctgcacagatcagcatctgcctttcatccagaactggtggaccacattgtttttgaaagctatcagcagttattatgtatggaagggaatttctctcagaagaccctgaaactggctgcttgtaacccgacggaaccacaacaaaagtggaaatttgaaaaatactacgatgtctaatgagaaatactttatctagttaaaccactagattctgtgaaaataacacaaaaacttggtgactgtatttctctccatagtagtttaaattccattttaatagcatttgaatggaaggcttttgaaaatgactacatttgaatcatcaaacaataactcagggaaagaagttgccattgggctgctgttcttcagctctgggtggcctttggaagtgtcttgtgtcccaccctgcattggggtgcatactgcaagtcttccttccggactctcacaggtaaccagaattggaaacaaagaatgatgtcatgcccgtgactgctgtcatggcccatgaatggcgctaaacccaaccacattctgatttcaccaaattcatctgcatggattcccacacctggaagacatagctagctgcacagagacaccaccttgttgaaagagctccatgtttacctggcagtgtagagcagtctgctcaggtctccatgactcctccttttttttccatgacccctcctaatagggggtcttgatctgaatgttttcttaatttgaagctattggggggggatttaatcaaaaaggaagaagccttaatgtactt

SEQ ID NO: 3895 - DNA, 1740 bp, Rattus norvegicus
  Genbank Accession No. NM_031797
tggaacacgggttggggcggcagctgaagacgccaacttaaaagcgccgtagccagaacccaggcagcagtgtgtccattgtccagaactcatctgagaaactgccacaggaagtgctgctctgctccagtctggtcactgaaaagggagctccaggacctgcaggatgggggcaggctgtgtcaaagtcaccaagtacttcctcttcctcttcaatctgctgttctttatcctgggtgctgtgatcctgggctttggggtgtggattcttgcagacaagagcagcttcatttccgtcctacaaacctcatccagctcgctgcaggtgggggcatacgtcttcattggtgtgggcgccatcaccatgctgatgggcttcctgggctgtattggtgctgtaaacgaggtccgctgcctgctgggtctgtacttcgtctttcttctgctgattcttatagcacaggtgactgtagaggtcctcttctacttcaatgctaacaagctgaagcaggagatggggaacacagtgatggacattattcagaactacagcgtcaatgccagcagcagccgcgaggaggcttgggactatgtgcaggcgcaggtgaagtgctgtggctgggtcagcccctccaactggacacgtaacccggtgctcaagaactctaccaagaccacttacccatgctcctgtgagaagacgaaggaggaggacaaccagctcattgtgaagaaagggttctgtgagtctgacaacagcaccgcaagtgaaaacagtcctgaggactggcctgtgcacccggaggggtgcatggagaaggctcaggcgtggctacaggagaacttcggcatccttctgggcgtgtgtgctggtgttgctgtcattgagctgctggggttgttcctgtccatatgtttgtgccggtacattcattctgaagattacagcaaggtccccaagtactgaggctgctgatgtccccactgtcctgtgtttctccaccctcagtctcccacagggcctctagagctttcccacatgagccgtgctccatctactactgaggcctctggcccaccctgggaaggttgtaggaactttctgggcctgggcccttctccctgcctttctgccaccaatatggggcccttactgtcctgtagctcttcctcctactgcctggaatatttttaacagcttgaaatggctcccagtattactgtacacaggatagctgggtccccaccctgaagtcatattataacaatataatattaaaaaccagggagggctagcacccatggctgcccagggaaaggccacaggaaaggttagtggtttccccactgtgacactttctttatgggttttcaatgtttctgtgggagacagggtaggcagttcttgtacacacttggaatactccccccaagctcagttcagcagggaactgaacggagaggctgcctgggggactggcccaggtagcccccagtgagcttttccttggtgagggacctgacagcttaggggcatgggtccctcaggtctggcataagaccctgagttgtctggacaagagaaggaggatctggactggtatttcttggcagctgtcccctgtcccctgggctaagggtgggtgaggctgtgccttgcagggtgggggagggtttccatatgctcatctctgaaatcaactattaaaggaggatttgtaacaaaaaaaaaaaaaaaaa

SEQ ID NO: 3896 - DNA, 6402 bp, Rattus norvegicus
  Genbank Accession No. NM_031798
tgtgaggcagcggcgctgcgactctctctcccccggctccttagtgggagcgccggccagggacccgagccgcgctgtacgcagcgtccacccgcccgctccgcaggtccccgagcgtcgggcggcgatggagcccgggcccgcggcgccctcgtctggcgccccgcggcccgcccgggatggggacgcgccgctgactgccgccggggtggacctgcccggcacggccgtactctccggtcgagaggatgctaccgctgggagccaggccggcggcggggtgcgcggagagggaaccccggccgctggcgatgggctgggcaaacctctggggcccacccccagccagagccgcttccaggtggacccggtttccgagaacgccgggcgggccgcggctgctgcagctgcagcggcggctgcggcggctgccggggcagcgggcaaggagacccccgcggctgggaaagccggcactgagagcggcgtggccaagggcagcgaggaagccaagggccgcttccgcgtgaacttcgtggacccggctgcctcctcgtcggcggacgacagcctgtcggatgcggcgggagtcggtggcgacgggcccaacgtgagctcccagaacggcggggacacggtgctgagcgagggcagcagcctgcactcgggtggtggcagtggacaccaccagcagtactactatgacacccacaccaacacttactacctgcgcaccttcggccacaacaccatggacgcggtgcccaggatcgaccactaccggcacacggccgcgcagctgggcgagaagctgctccggcccagcctgggagagttccacgatgagctggaaaaggaaccttttgaggatggttttgcgaatggagaagaaagtactccaaccagagatgctgtggtcacatacactgccgaaagtaaaggagttgtaaagtttggctggatcaagggtgttttagtacgatgtatgttgaatatttggggtgtgatgctctttattcgattgtcatggattgtgggtcaggctggaataggtctctccgttcttgtaatagcaatggccactgttgtgacaaccatcacaggattgtctacttcagcaatagctaccaatggattcgtgagaggaggaggagcatactatttaatctctagaagtctagggccagaatttggcggtgcgattggcttgatcttcgcttttcccaatgcagtggcagttgctatgtatgttgttggattcgcagagactgtagtggagctgcttaaggaacattccatacttatgatagatgaaatcaatgacatccgaattattggagccattacagtggtggttcttctgggcatctcagtggccggaatggagtgggaagcaaaggctcagatcgtccttctggtgattcttcttctggccatcgctgacttcgtcataggaacatttatctcactggacagcaagaagcccaagggtttctttggctataaatctgaaatatttagtgagaactttggaccggattttcgagaagaagagactttcttttctgtattcgccatcttttttcctgctgcaactggtattctagctggggcgaacatctcgggtgaccttgcagatcctcagtcagccatacccaaaggaacgctcttagccattttgattacgacagtggtttacataggaatcgcagtgtctgtaggttcttgtgttgtccgggatgccactgggaacgttaatgacaccattacaacagagctaactaactgtacttctgcagcctgcaaattaaactttgacttttcctactgtgaaagcaacacctgttcttatgggctaatgaacaactttcaggtgatgagcatggtgtcaggatttgcacccctgatctctgcgggtatcttttcagccacactctcatcagcactggcatctcttgtgagtgctcccaaaatatttcaggctctatgtaaggacaatatctacccagctttccagatgtttgcgaaaggttatggaaaaaataatgaacctcttcgtggttacatcttaacattcttaattgcacttggattcatcttaattgctgaattgaatgtcattgctccaattatctctaatttctttctcgcatcatacgccttaatcaacttttctgtattccatgcgtcacttgcaaagtctccagggtggcgtcctgcgttcaagtactacaacatgtggatctcccttactggagcgattctctgctgcatagtgatgttcgtcattaactggtgggctgcactgctcacatatgtgatagttcttggactgtacatttatgtcacttacaaaaagccagatgtgaactggggatcctccacacaagcgctgacttacctcagcgcactgcagcattcaatccgtctttccggggtggaggaccatgtgaaaaacttcaggccacagtgtcttgtaatgacaggttctccaaactcacggcctgctttactgcatcttgttcatgacttcacgaaaaatgttggtttaatgatctgtggccatgtgcatatgggtccccgaagacaagctatgaaagagatgtccattgatcaagccaaatatcagcgatggctcattaaaaacaaaatgaaggctttctacgctccggttcacgcagatgacttgcgggaaggtgcacagtacctgatgcaggctgctggacttggtcgtatgaaaccaaacacacttgtcctcggatttaagaaagattggttacaagcagatatgagggatgtggatatgtatataaacttatttcatgatgcttttgacatacagtatggagttgtggtcattcgcctaaaggaaggactggatatatcacacctccaaggacaagaagaattattgtcatcacaagaaaagtcacctggtaccaaggatgtggtagtaaatgtggactacagtaagaagtcagatcaagatgctttcaaagcatctggtgaaaaacctattacacagaaagatgaggaagaggatggcaagacttcaactcagccactgttgaaaaaagaatccaagggccccgtggcacctttaaatgtagctgaccaaaagcttcttgaagctagcacacagtttcagaaaaaacaagggaagaatactatagatgtctggtggctttttgatgatggaggtttgaccttgttgataccctatcttctgacaaccaagaaaaagtggaaagattgtaagatccgagtattcattggtggaaagataaacagaatagaccatgaccggagagcgatggctactttactcagtaaattccgaatagacttctccgatatcatggtcctaggagacatcaacaccaaaccaaaaaaggaaaacatcgtcgcttttgatgacatgattgagccatacagacttcacgaggatgataaagagcaggatattgcagacaaaatgaaagaggatgagccctggcgcatcacagacaacgagctggagctctacaagaccaagacatatcggcagatcaggttaaatgaattattaaaggagcattcaagcacagctaatattattgtcatgagtcttccagttgcccggaagggtgctgtgtccagcgcgctgtacatggcttggttagaagctctgtctaaggacctgccaccaatcctgctggttcgtgggaatcatcagagcgtccttaccttctactcttaattgtcctgccccatggactccctctaagaatggtacttcagtgcctagtcagagtgactggatcgtcagcaacaccgcagcatcacagtggcgaactgggtctttgtttcactacttcattctttgaaagcacatggacacgttgctccactgatagatctgtggagacttcggttttagtctactccagatctcagtcttatgactgctgattcttccttgttggactgaagttcttgagagtaaagttttcctttgctacttgacagcaataagagtgagttatttttgattgctgaaaggagtacataagcctttagccttgaggtgccttctgaaattaaccaaatttcatccatagatctatcgtcttttgtacatttatagaatgttaaactctgccttcagacattatttttacttctaatctctgtcatcctaagtggacactgcttgtctcctcccattgaccagttagtgttgagagctgtgtgtttcgtattacttttgtaaaagcgtttgttggatactgaagagggtaggacaagctaataaaatatgtggagaaagtatccaaaaatggagcccaaggttaggtttatatgaatagatacttagagctagggaagagaggcccgaacaccgtttctatctctcaattagagttatctattatttcttttaaatcatagagatgactgacgatctacccagtacttcatttataacataaaaaaaaaaaatcacatttttttaaagcaaaaccttgaggtcatttgtattgtttttaaaagatctcttttaatttagaatttcctctcaaatgggagggacttttaagacatgctaactggtatttttcgaggaaatttagacaaagcattgccatttactagagcatttcaataaaaactatggggatttcactatcctatcgcatcctttatttaaaaagaaagatgacaatgttatcaatggttaaatggaccactgttttcttagtgaaatggttttaggcttaatttattcaagtatcaagaacatttagtcttaatacactcaggtttgaacagattattccgaacattgaaatttaatccattcttaatactttaaaacttgcgttaaagaaaactgccagtttgtgcatttgaccttgtcgtctgcaagtgcacttgacagtgagcgtgcacacctgcgctgtcctgaacgctttatacacagtcgttaatgtgaagtgtctaagttcaaggaaggatcttctaaacatttcaagggattcatgtccacatgtctgtctgtgtgtatgttttgcatacacaggtgcatatgtgtatatgtaatgaaatttatgttgccagtgtttcagattttaaagcgatcatgatttggtaggttacagattttgttgttgttgttgttttagttttttcttttcttttttaagtaagcattcaagtcagatcaagacattacagatttcatggaggacaaagacaattgaaagaacatcgtgtagctttgtacagttatccagttatgtaaagtagatgatctgtaagtttcagtggagaacatagcgcagactttcatcatcttaagggaaatgtcagaaaagcatttcagtagtgtagtacttgtgctccatgaaaacagactgcgttaataccagctggatatcttctcgtttccactcagaatattaaagaaaacaaggttaagtgattttttccaagttcttcttacattataatataatattgttccatttattgtaaattttgcagagtttagggcagtatagaagaatcatattagcaaaccatatcatgtgtggatcttctgaatggatactagggcatgggctgaatgctgctatcttgaaatgtacacagctagacttgccttttatttttaaaggttttccctcattcaggaaacttcattgtgatctgtactacagaaactaaatgtcatacatcatacgtgtgtgttcaaagtacataaaatggatctcaacgcacctaacagggagggtggcgacactgtgaagtgatgccagcagcagctctctactcttgaaaaccgccttccgtcgtcagctaacacgagctgccaggccagacgttctcaaggttgcagtagtactctaaaacgaaacttctcaatggttaattcttagacatctagctagtattagagctgttttcattttacgctgtttggattatttggatgccaaattatgttttagtcctaatcattgataataacttaaaaatacgcagtggcatttgagctcattcttgggataagttaaaaacttgagtgcgttcaaagagaacgtcgttgatgattaacggttcactaaatcagatattcatttgtctcatcttttccttcctgctttgttttccttcactcttctcatatggctctcctgacgtgtgtgtggtttgttttgttttgtttttttaagactatggaaataatttaatgagttgagctccggtgatgatctgctaagtttgaaaatgtaatattttgataatactgtactgtacctgtcccaaatgcttttgtaatgttttaaccccgagtattgcagttgctgctccgtacagaggttactgcaataaaggaagtggaatcattaaaacttt

SEQ ID NO: 3897 - DNA, 4238 bp, Rattus norvegicus
  Genbank Accession No. NM_031809
gctggggcattgagaagacaattcctggctagccgctgacatctgaacaggtgtcaggatgttgggctgggtccaaagggtgctgcctcagcctccggggaccccccagaagactgaagagggagcaggaccacagccagaaacagagtcaaagcctgaggcaaatccacaacccgagccagaggttcagccggaaccagagccggaaccggaaccagagccggaaccggaaccagcacctgaagaggctgcaccagaggtccagaccctgccaccagaggaaccagtggaaggagaggatgtggctgaggctggccctagccttcaagagacccaggaagctgaccctcctcagcccacctcccaggcccaggttgctgttgtcaaggtgaacaggcccagctcctggatgttgagctggttctggaagggcatggagaaggtcgtgccacagcctgtctacagcagcagtgggggccagaacctggctgccggagagggaggcccagatcaggatggagcacagaccctggagccctgtggcactggagacccagggtctgaagatggctcagataaaacttccaagactcaagacactgagcccagcctgtggctactcaggtggcttgagctgaatctggagaaggtgctacctcagccccctacgccttcccaggcctggaaagttgaacctgagggtgctgtcttggaaccagatcctccaggaacccctatggaagtggagcccacagagaacccctcccagcctaatcctggacccgtggagcctgaggaggagccagccgcagagccccagcctggctttcaagcctcttccctgccaccacctggggaccctgtcaggctgatcgagtggctcctacacaggctggagatggccctgcctcagcctgtgctccatgggaaggctgcagagcaggagcccagctgccctgggacgtgtgacgtacagaccatcagcatcctccctgtggaacaggcggaacatgatcttgtcctcgaggatgtggactcttgctgggaggacacccagcaggaagatggtgccagcctgcaggagacagagttggctcccatttatgaagacgagagtgaggccatggtggagatgcccagggagctgccacagattcaagagcagcaggaagaggagaatgaagagaaagaagaagaggaagaagagaaggaagagaaggaagagaaggaagaggaggaagagaaggaagaggaggagaagagggaggaagagaagaagaaagagaaggaagaggagaagaaagagaaggaagaagaggagaacggggaggaagaagagaaggaagagaaggaagaaaaggaagaggaggaggggaaggaagagaaggaagagaaggaagagaaggaagaaaaagaagaggaggagaaggaagaaaaagaagaggaggagaaggaagaaaaagaagaggaggaagaggaagaggaggaagaggaggaagaggagcctattgtcctgctggatagctgtttggtggtgcaggctgatgtggaccagtgccagctagaaagggcacagccagagacagcatcgatccaggagttaccagaagaagaagaggagaaggaggaagagaagaaggaggaggaagaggagaaggaggaggaggaagagaaggaagaggaagaggagaaggaggaggagggggaggccacaaactcaacagtaccagccacgaaagagcacccggagctccaggtggaagacacagatgccgaagctggccccctcatcccagaggagacgatcccgccacctgagagaccaccagtgtctcccgccaagtctgacaccctcgcggttcccagcgcagcaacccacaggaagaagctaccttctcaggatgatgaggctgaagaactcaaggccctgtcaccggctgagtccccagtggttgcctggtcagaccccaccaccccacaggaggctgatggcgaggaccgtgcggcctccacagccagccagaacagtgccatcatcaacgaccggctccaggagctggtgaagatgttcaaggagcggacagagaaggtgaaggagaagctcattgaccctgacgtcacctccgatgaggagagccccaagccctccccagccaagaaggccccagactcagccccagcccagaagccggcggaggcagaggcggcagaggaggagcactactgtgacatgctctgctgcaaatttaagcgcaggccctggaagatgtaccagttcccccagagcatcgacccactgaccaacctcatgtacatcctgtggctgttcttcgtggtgctggcctggaactggaactgctggctgattcctgtgcgctgggccttcccgtaccagcgggcagacaacatccacctctggctgctcatggactacttgtgcgacttcatctacctcctggacatcaccgtgttccagatgcgtctccagtttgtcaaaggcggggacatcattacagataagaaggagatgcgtaataattacctgaagtctcaacgatttaagatggacttgctctgccttttgcctttggattttctctacttgaaacttggcgtgaacccccttcttcgcctgccccgctgcctgaagtacatggccttctttgagtttaataaccgtctggaagccatcctcagcaaagcctacgtttacagggttatcaggaccaccgcctacctgctgtatagcttgcatctcaactcctgtctttactactgggcgtcggccttccagggcatcggttccactcactgggtttatgacggcgtggggaacagctacattcgatgctactactgggctgtgaaaactctcatcaccatcggaggactgcccgacccccagacgctctttgagatcgtcttccagctgctgaattattttacaggtgtcttcgctttctctgtgatgattggacagatgagagatgtggtgggggccgccacggcagggcagacgtactaccgcagctgcatggacagcacggtgaagtacatgaacttctacaagatccccaggtctgtgcagaaccgcgtcaagacctggtacgaatacacctggcactcacaaggcatgctggatgagtcagagctgatggttcagcttccggacaagatgcgtctggacctggccattgacgtaaactacaacattgtcagcaaagtggcgctcttccagggctgcgaccggcagatgatcttcgacatgctcaagcgacttcgctcagtcgtctacctacccaatgactatgtgtgcaagaagggggagattggccgagagatgtatattatccaggcggggcaggtgcaggtgctgggcggcccagatggaaaggctgtcctggtgacactcaaagccggatcggtgtttggagagataagcttgctggctgtcgggggcggtaacaggcgcacggccaatgtggtggcccacggcttcaccaatctcttcattctggataagaaggacttgaatgagattttggtgcattaccctgaatctcagaagctgctccggaagaaggccaggcgcatgctcagaaacaacaacaaacccaaggaggagaagagtgtgctcatcctgcccccacgtgcgggcaccccgaagctcttcaatgctgccctggctgcagcaggaaagatgggccccaggggagccaagggcggcaagctcgcccacctgagagccaggctcaaagaactggctgcactggaggcagccgcacgacagcagcagctgctggaacaggccaagagctcgcaagaagccgggggagaggagggctctggagccacagaccaacctgcaccccaggagccgtcagagcccaaggagcccccggagcccccagccccgagttctccaccgccagcctcagcaaagcccgagggaagcacggaggaggccgcagggccgccggagccttcagtgaggatccgtgtgagtccaggccctgatcccggggaacagacactatcggtggagatgctggaagagaagaaggaggaggtggagtgaggtgcattcagcaccctgatcccatccctaggtgcggaccagacctttgaaccacctgcctcaccaagcatcttagcctaaagcgctcttcgtcaccggcttatagaaactctcaaatttcatccaagtagtggtggtgacctctcgagctcctaacatt

SEQ ID NO: 3898 - DNA, 416 bp, Rattus norvegicus
  Genbank Accession No. NM_031810
atctgtcagctcaactacctgggagtctcacgtcctctctgcactctggaccctgacttcaccgacatgaaaactcattactttctcctggtgatgttattttttctcttctcccagatggagctgggtgctggcattctcacaagtcttggacgcagaacagatcaataccgatgcctccaaaatggaggattctgtctccgctccagctgcccatctcataccaaactacaaggaacatgtaaaccagataagcccaactgttgcaggagttgacagtggtttgaagaatggacataaaggacagcaagggattgtaaaattagtgttttaataaatgaaatgtttttgaagtttatttacatcatctcaaaataaattttatgcctcagtttaaaaaaaaaaaaaaaaaaaaa

SEQ ID NO: 3899 - DNA, 1057 bp, Rattus norvegicus
  Genbank Accession No. NM_031811
atgtcggggtccccggtaaagcgccagaggatggagtccgccttggaccagctcaagcagttcaccaccgtggtggctgacacgggtgatttcaacgccatcgatgagtacaagccccaggatgccaccaccaacccatccctgatcctggctgcagcacagatgcctgcctaccaagagctggtggaggaggccattgcctacggcaagaagctgggtgggccacaagaggagcagattaaaaatgccattgataaactttttgtgctgtttggggcagaaatactaaagaagattctaggccgtgtatccacagaagtcgatgcaaggctttcctttgataaggatgccatggtggcccgagccaggcgcatcatagagctttacaaagaagctgggatcagcaaggacagaattctcatcaagttatcatcaacctgggagggaatccaggccggaaaggagctggaggagcagcatggcatccactgtaacatgacactgcttttctccttcgcccaggccgtggcctgcgctgaagcgggcgtgacgctcatctctccctttgtggggcgcatccttgactggcatgtggcaaacacagacaagaaatcctacgaaccccaggaggaccctggggtgaagagtgtcacaaaaatctacaactactacaaaaagtttggctacaagaccattgtcatgggtgcttccttccgtaacacgggtgagatcaaagcgctggcaggctgtgatttcctcaccatctcacccaagcttctgggggagctgctcaaggacagcagcaagctggcacccacgctttccgtcaaagcagcccagaccagtgacttggagaagatacatctggacgagaaggccttccgttggctgcacaatgaggaccaaatggctgtggagaagctctctgatgggatccgcaagtttgctgctgatgccataaagttggagcggatgctcacagaacgaatgttcagcgctgagaatgggaaatagtgcagcacctgagactggaccgcagtcctgcaccgaggctgac

SEQ ID NO: 3900 - DNA, 2600 bp, Rattus norvegicus
  Genbank Accession No. NM_031815
  misc_feature (1)..(2600): n = a or c or g or t
gcgatctactctcagtcttcctgagtcacaggctaccaaggacaagtagctctgtctgccctttgttgaggggagctgtgacactggtttgctgctgctgctgctgctgctgctgcatcttctttgggaaatcagactcaataaactgccatccatctgaggttctcaactcagagccatctacctggagcatgggactttcaaatgtccagctctggacaatactgctgtgggcattggcatgggtgcagagtacaagatctgcgtgcccgtcctgtggggccccaactctgacaccccaaggagaacgcgctctggtcctagagctagccaagcagcaaatcctggagggactgcacctaaccagccgtcccagaataactcgtcctctgccccaggcagcactgaccagagccctccggagactgcagcccaggagcatggtccctggcaaccgagagaaagtcatcagctttgctaccagcatagacaaatccacttcaacctaccgctccgtgctcaccttccaactgtcccctctttggtcccaccacctgtaccatgcccgcctctggctgcacgtgcctccctcttttccggccactctgtatctgaggatcttcggttgcggtaccacgaggtgcagaggatcccgcacgttcctagctgagcaccaaaccacttcctccggctggcacgccctgactctgccctctagcggcttgcggagtgaggaatctggagtcacaaaactccaactggaattcagacctctggaccttaacagcactactgccagactgccacggctgctgttggacacagcgggacagcagcgtcccttcttggaacttaagatccgagctaatgaacccggagcaggccgggccaggaggaggactcccacctgtgagtctgagacccccttatgttgtagacgagaccactatgtcgatttccaggagctggggtggagagactggatcctgcagccggagggataccagctgaattactgcagtgggcagtgcccgccccacctggctggcagccctggcattgctgcttccttccattctgctgtctttagcctcctcaaagccaacaacccttggcctgcgggttcttcctgctgtgtccccaccgcgcgaaggcctctctccctcctctaccttgaccataatggcaatgtggtcaagaccgatgtgccagacatggttgtagaggcctgtggctgcagctagcaagaggacctgaaggttttgagtgaagttcaaggttcaagttgggggttcccaagcaaaagggtcctgtgtctggaagcacaagttccggatccatactgacacccaacaagctgtgtagcagtatgcctgagtttgacccctgtggaactcaaatgggcatttttcttgtcccagattctggcctatttcaggctgtttcaaatgtggacagatgggtaaaacgtttcctttcgagaaactgcctggccagcaccatttcctacatcaagccctgttccaggacagcaggggatgccgtgggagggaaggaagaatgcagggaaaactacttagtctctcccgaaaaagaattcctcaagtaataaaggaggaattagaaggttaggcagattggggaaaggtatacaggctaagaacagggactgttgcctgctttgagcaaggtcaagaggaatatgagcaggcantgaggtgggagagcagttaggaggccctggaattgacagtcagtaaaaaggggtgctgaacccataagttctctagcttccccttggggagaggacccatgtaaatgacatacgtttatattttcttaataaaaaggagaaagaaaagcaacagtgtgtaaggggttgttaaaatgagccagaaacaaagtgtggtctggggacctctgtgcttcggggccttttcaaggggttttcaaactatttgcataatcacatagagaagttatttgtcatttactatcattattttttcattgttctgtgggaacagggtttacacttataactacagccctcaggaggctgagacaggaggatcgccgtgagttcaagaccagccttcatagtgaatgctgggctagcctgagctatggagtgagatcctgtctcaaagcaaaagaaacaaacaaaacaacaaagactaagtagtgagtctttccagagtgtattatatgatacagccgatgacattgtggcttatatattctcctttctctcctttaaacaattttatttatttttattgtatgtgtatgatgagtcttaggcctgcaccggcttgcagtgcccatagaggtcagaagaggacgctggatccttggaactaaagttagagcagtgtgagctgcctgtgtctgttaacagaactcaggtccacagtaagagaaacaaacaattaaaggctgagctacctctccacctgagacatgtgcacacacagtcacacattgttttgttttgtttggaaacagcccacgctatcttggaactctcaatcctcctgcctcagaccctcctgccctggaattaaaggcataaaccaccaaaaaaaaaaaaaaaaaaa

SEQ ID NO: 3901 - DNA, 762 bp, Rattus norvegicus
  Genbank Accession No. NM_031818
atggcgctgtcgatgcccctgaacggactgaaggaggaggacaaagagcccctcatcgagctcttcgtcaaggccggcagtgatggtgagagcataggaaactgccccttttcacagaggctcttcatgattttgtggctcaaaggagtcgtgttcagtgtcaccaccgttgacctgaaaaggaagcctgcacatctgcagaacttggctcctgggacccacccaccatttataaccttcaacagcgaagtcaaaacggatgtaaataagattgaggaatttcttgaagaagtcttgtgcccacccaagtacttaaagctctcaccaaaacacccagagtcaaacactgctgggatggacatctttgccaagttctctgcgtacatcaagaactcaagaccagaggctaatgaagcactggagagggggctcttgaaaacgctgcagaagctggatgagtacctgaattctcccctccctggcgaaatcgatgagaacagcatggaggacatcaaatcgtccacacgcaggtttctggacggcgacgagatgacattagcagactgcaacctgctgcccaagcttcacattgtcaaggtggtggccaaaaaataccgcaactttgacattcccaaaggcatgacgggcatctggagatacctgacaaacgcctacagtagggatgagttcaccaacacctgtcccagcgacaaggaggtggaaatcgcgtacagtgacgtcgccaagagacttaccaagtag

SEQ ID NO: 3902 - DNA, 2781 bp, Rattus norvegicus
  Genbank Accession No. NM_031821
ccacgcgtccgggagccggacgtcggactagagagtagggagagcgattggggctcgagggacagggctagaccggacgcgtgtccgcgcctcggaggtggcagtaggtagtgtcgggtagcgaggcaacgatggagctcctgcggactatcacctaccagccggccgccggcaccaagatgtgcgagcaggcgctgggcaaagcttgcggcggggactcaaagaagaagcgaccgcagcagccttctgaagacgggcagtcccaagcccaggtgaccccggcggccccacaccaccatcatcaccattctcactccggacccgagatctcgcggattatagtcgaccccacgacggggaagcgctactgccggggcaaagtgctgggcaagggtggatttgcaaagtgttacgaaatgacagatctgacaaacaacaaagtctacgctgcaaaaattatccctcacagcagagtagctaaacctcatcaaagggaaaagatcgacaaagaaattgagcttcacagaatcctgcaccataagcatgtagtgcagttttaccactactttgaagacaaagaaaacatttacatcctcttggagtactgcagtagaaggtccatggctcatatcttgaaagcaagaaaggtgttgacagagccagaagtccgatactacctcaggcagattgtgtcgggactcaagtatcttcacgaacaagaaatcttgcatagggatctcaagctagggaacttttttattaatgaggccatggagctgaaggttggagacttcggcttggctgccagactggaacctttggaacacagaaggagaacaatatgtggaaccccaaattatctctcccctgaagtcctcaacaaacaaggacatggctgtgaatcagacatctgggccttaggctgtgtaatgtatacaatgctgctaggaagacctccattcgaaacaacaaatctgaaagaaacgtacaggtgcataagagaagcaagatatacaatgccgtcttcattactggcccccgccaagcacttgatagccagcatgctgtccaaaaacccagaggaccgccccagtttggatgacatcattcggcatgacttctttctgcagggcttcactccagacagactctcttctagctgttgccacacagttccagacttccacttgtcaagcccagctaagaatttctttaagaaagctgctgccgctctttttggtggcaaaaaggacaaagcaagatataatgacacacacaataaagtgtctaaggaagatgaagacatctacaagcttcggcatgatttgaagaaaacatcgataacccagcaacccagcaaacacagaacagatgaggagctccagcctcctccaactacctttgccaaatctgggacatccgcagtggaaaacaaacagcagattggagatgcaatccggatgatagttagagggacgctgggcagctgcagcagcagcagtgaatgccttgaggatagcaccatgggaagtgttgcagacacagtggcaagagtccttcgagggtgtctagaaaacatgcctgaagctgactgtattcccaaagagcagttgagcacgtcctttcagtgggtcaccaaatgggtcgactactccaacaaatacggctttggataccagctctcagaccacactgttggagtccttttcaacaacggcgctcacatgagcctccttccagacaaaaagacagttcactattatgcggaacttggccaatgctctgttttcccagcaacagatgcccccgaacaatttattagtcaagtgacggtgctgaaatacttttcccactacatggaggagaacctcatggatggtggcgatctccctagtgttactgacattcgaagacctcggctctacctccttcagtggttaaagtctgataaagccttaatgatgctcttcaatgacggcacatttcaggtgaatttctaccacgatcatacaaagataattatctgtaaccaaaatgaagaataccttctcacatacatcaacgaagacaggatatctacaactttcagactgacgaccctgttgatgtctggctgttcgctagaattgaaacatcgaatggaatacgccctgaacatgctcttgcagagatgtaactgaaaaacctcttttagagcggacctcgtgggggctcttttccactgtgagatcaacagggaagccagtggagggataacggagcatgttagagaaatcggacaggtgctggtacgaatacgagtcgtctgtggcctgctggactgctggaaccagaccagcctaaggtggacagttgactttgggcaatcttaagtgtggagccaagtacagttttccttgagatacctgtctttacaaagtttatcggacaattttgcagacagacgctttgactctgaagttctctctgtggagagtgttttcagttggaagacttggaactgtgaataaacttcctgaaggggagggagaagggaggaagctccctcgctgttgaaaggctacaatcagagcagcttttgtttggctgcttaactgtgaactatggccatacatatttttttttttggttatttttgaatacacttgtggctggaaaagtgcattccttgttaataaactttttatttattacagccccaagagcagtatttattatcaagatgtcttttttttttatgttgaccattttgaactcttggcaataaagagtatgaaatag

SEQ ID NO: 3903 - DNA, 948 bp, Rattus norvegicus
  Genbank Accession No. NM_031832
aacagctagcggagcggcaggaggagcactaaccaggaaaatggcagacggcttctcacttaatgatgccttagctggctctggaaacccaaaccctcgaggatggcctggtgcatgggggaaccagcctggggcaggaggctacccaggggcctcctatcctggggcctacccaggacaggctcctccagggggttatcctggacaggctcctcctagtgcctatccgggcccaactggccctagtgcttatcctggcccaactgcccctggagcttatcctggcccaactgcccccggagccttcccagggcaacctgggggacctggagcctaccccagtgctcctggggcctaccccagtgctcctggggcctatcctgctactggcccctttggtgccccgactggaccactgacagtgccctacgatatgcccttgcctggaggagtcatgcctcgcatgctgatcacaatcataggcacagtgaagcccaacgcaaacagtatcactctgaatttcaagaaagggaacgacatcgccttccactttaacccccgcttcaatgagaacaacagaagagtcatcgtgtgcaacacgaagcaggacaataactggggaagggaagaaagacagtcagctttcccctttgagagcggcaaaccattcaaaatacaggtcctggttgaagccgaccacttcaaggttgcggtcaatgatgttcatctgttgcagtataaccatcggatgaagaacctcagggaaatcagccaactggggatcattggtgacataaccctcaccagcgcttcccacgccatgatctaagccagaaggggtgggccggcaccagaactgccctgtgtgttatgagcgggaaactttgcatttctctctccttatacttcttgtaagacatccatttaataaagtctcgtgctgagaga

SEQ ID NO: 3904 - DNA, 1227 bp, Rattus norvegicus
  Genbank Accession No. NM_031834
ggaattcgcaacgcctacacaaagatccctatcactgagcacccggaggcaaggctcagaaccccaggatcagcaacatggagttctcccgtccaccgctagtgcatgtgaagggtatcccactcatcaaatactttgcagagacaattgggccattgcagaacttcacagcctggcctgatgacttgctgatcagcacatacccaaagtctggtactacctggatgagtgagatcctggatatgatctatcagggtggcaagctagagaagtgtggccgcgcccccatctatgcccgggtacccttccttgagttcaaatgtccaggggttccctcaggtcttgaaactttggaagagacaccagccccacggctccttaagacacatctgcccctgtccttgctccctcagagtctgctggatcagaaggtcaaggtgatctacattgcccgaaatgcaaaggatgtggttgtctcctattataacttctacaacatggccaagctgcaccctgatccaggcacctgggacagcttcttggagaacttcatggatggggaagtgtcctatgggtcgtggtaccagcacgtgaaggagtggtgggagctgagacacactcaccctgttctctatctcttctatgaagacataaaggagaaccccaaaagggagatcaagaagattctagagtttttggggcgctctctacccgaggagactgtggattccattgttcaccacacatctttcaagaaaatgaaagagaactgcatgactaactacacaaccatccccactgagattatggaccacaatgtttctcccttcatgaggaaaggtactactggggactggaaaaataccttcactgtagcccagaatgagcgctttgatgcccactatgctaagacaatgacagattgtgacttcaagtttcgttgtgaactatgagtggattatggctatactgggaaccaaggcaaactgacacagcccatcatgatctcaagtaaaatgtgatgtgttcaatctacttgttgtatgcctagaggaaatctgagctaagagaataggattggggatgtggctgaggcagagggttttatcaacgcatgtcaggaaagcaatcagtcccaacacctaaaaagaacctaaagtacaaacatgcaaaaaatagtaagataaactatattttacctgaaagaataaatgccactgggaaatg

SEQ ID NO: 3905 - DNA, 2151 bp, Rattus norvegicus
  Genbank Accession No. NM_031835
ccgaaaagatgtctctagcctggagaacattgcagaaagctttctacctggagacctctctgagaatcctccagatgcgtccatccctgagctgtgcttctcggatatatgtacccaagctcactcttcatacaaagcacaacatgccaccatgtgacttctcacctgagaaataccagtctctggcctacaaccatgtcctggagattcataagcagcacctttctcctgtgaatacagcctatttccagaagcctttgctgctccaccagggacacatggaatggctctttgattcggaaggaaacagatacctggacttcttctctgggattgtaactgttggtgttggtcactgccacccgaaggtaactgccgtggcaaaaaagcagatggaccgcctgtggcatacaagttctgtcttcttccactctccgatgcatgaatatgcagagaggctgtcagcactccttcctgagcctcttaaggtcattttcttggtaaacagtggatcagaagccaatgacctggccatggtgatggccagggcatactcgaaccacacagacatcatttctttcagaggagcctatcatggatgtagtccctacacacttggtctgacgaatgtaggaatttacaagatgaaagtccccagtacgatagcctgccaatcgacaatgtgcccagatgttttccgtgggccttggggaggaagccactgtcgggattctccggtgcaaacagtcaggaaatgcagctgtgctccagatggctgccaagctaaagaacggtacattgaacagttcaaagacacactgaacacttctgtggccacgtcaattgctggattttttgcagagccaattcaaggtgtgaatggtgttgtccagtacccaaaggagtttctgaaggaagcctttgcactggttcgagagaggggaggtgtatgcattgcagatgaagtgcagacaggctttggaaggctgggctctcacttctggggtttccaaacacatgatacaatgcctgacattgtcaccatggctaaagggattggaaatggcttccccatggcagcagttgtgaccactccagaaattgcgagctctttggctaaacacttacatcacttcagcacatttggaggaagtcccctggcctgcgccattggatctgctgtgcttgaggtgattgaagaagaaaatctccagagaaacagtcaagaagttggcacctacatgctgctaaagtttgctaagcttcgggatgaatttgacatcgttggggatgtgcgaggcaaaggccttatggtggggatagagatggttcaagacaagataagccgccagcctcttcctaaaacagaagtcaatcaaatccatgaggactgcaaagacatggggctcctagtgggtagaggtggtaatttttctcagactttccgcattgcgcccccgatgcgtgtcacaaagctggaagtggattttgcatttgaagtatttcgttctgccttaactcaacacatggagagaagagctaagtaagaagagccccaagcctcaagaacttctcaactatgctcagagttggattggagagatgctgaaaccacaagtattagatagaaaaaaaccctgcagccctctgaagtaattgtaaaagactcgatggactatctactggctacatttgtcaactgagtccccattctcctgataattccatccttcaggagaagtatctgtcactggctcacagaataagtcttagtttgtgtagattagtctgggctaatgttatttcccgttgcattaactggtttgtaaatgaatacacagtatatgtgtcgccgatgagtcctgaagtaaatcctttccgtgacactacctctgggcaaacattttttcatgcttcagctcagatgcctctcgtcacactggaaacttcggcctctcatgatgcggtttctcaattcacaccaggcacctggaagccctgtagggataaagcctggtcactgtactacgctgggaatgtggttggaagctaagaggttggtaatgtcaatgaatcactgaccatgaatcctggaaccaccctatctcagggtttcttgatttatgaaacaataaattcgtggtgctgctt

SEQ ID NO: 3906 - DNA, 645 bp, Rattus norvegicus
  Genbank Accession No. NM_031836
atgaactttctgctctcttgggtgcactggaccctggctttactgctgtacctccaccatgccaagtggtcccaggctgcacccacgacagaaggggagcagaaagcccatgaagtggtgaagttcatggacgtctaccagcgcagctattgccgtccaattgagaccctggtggacatcttccaggagtaccccgatgagatagagtatatcttcaagccgtcctgtgtgcccctaatgcggtgtgcgggctgctgcaatgatgaagccctggagtgcgtgcccacgtcggagagcaacgtcactatgcagatcatgcggatcaaacctcaccaaagccagcacataggagagatgagcttcctgcagcatagcagatgtgaatgcagaccaaagaaagatagaacaaagccagaaaaaaaatcagttcgaggaaagggaaagggtcaaaaacgaaagcgcaagaaatcccggtttaaatcctggagcgttcactgtgagccttgttcagagcggagaaagcatttgtttgtccaagatccgcagacgtgtaaatgttcctgcaaaaacacagactcgcgttgcaaggcgaggcagcttgagttaaacgaacgtacttgcagatgtgacaagccaaggcggtga

SEQ ID NO: 3907 - DNA, 3061 bp, Rattus norvegicus
  Genbank Accession No. NM_031837
gtcaggctcgaggtagagacccctgcctccaaggctcccgaggctctgccatgcctgtcaccgatgcagcccccaagagggtagagatccaggtgcccaagccagcggaggcacccaactgcccgctcccaccccagaccctggagaactccgaggccccgatgtctcagctgcagagcaggctggagcccaggccccctgtgactgaggtcccatatcggaaccaggaagactccgaggtggctcccagctgtgttggcgacatggctgacaaccctagagatgccatgctcaagcaagcgcccgtgtcgaggaatgagaaggcccccgtggactttggctatgtggggatcgactccatcctggagcagatgcgcaggaaggctatgaaacagggcttcgagttcaacatcatggtggttgggcagagtggcctcgggaagtccaccttaatcaacaccctcttcaagtccaaaatcagccggaagtcggtgcaacccatctcggaggagcgtatccccaagacgattgaaatcaagtccatcactcacgatattgaagagaagggggtccgaatgaagttgacagtgattgacactccaggcttcggggaccacatcaacaatgagaactgctggcagcctatcatgaagtttatcaatgaccagtatgagaagtacctccaggaggaagtcaatatcaaccggaagaaacgcatccctgacacccgcgtccactgctgcctctacttcatcccagccaccggccactcactcaggcccctggacattgagttcatgaagcgcctaagcaaggtggtgaacatagtccccgtcattgccaaggctgacacgctgaccctggaggagagggtctacttcaaacagcggatcacctcagacctgctgtccaacggtattgacgtgtacccccagaaggagtttgatgaggacgcagaggaccgactggtgaacgagaagtttcgggagatgatcccatttgccgtggtgggcagcgaccatgagtatcaagtcaatggcaagaggattctgggaaggaagaccaagtggggcaccattgaagttgagaataccactcactgtgaatttgcctacctgcgggatctccttatcaggacgcacatgcagaacatcaaagacatcaccagcaacatccactttgaagcctaccgtgtgaaacgcctcaacgagggcaacagtgccatggccaacgggatcgagaaggagccggaaacccaggagatgtagatgcgtcccgcccctggaccccacccccagatcttttcatcatccctggcccacccacctaccctgtcttattttatataattatctccatttgtcacctgcctccatctctttccacactttgccaggtaacaagagagggtttacctcccaagtgtgttcttattggctgcagcatcagggtgggcggggctacagcctgggcttgcccctgtgctctacttcctccccaagttgtgaaggctcgacctggctcagcccctgaggagttagaagagctatgtgtccgtgcccgctctgagttcttagctgaatcctgtgggggccaggtcctaggacgtgcagagaacccattaagccacaagaccccatggccagcctcaagcaggttagaggctgtaccagagaggatggggcttggccaagtagtcctggttccccacgtacccctccaggaggcattgctcacagcaccctcagctgcctgcccctcaaggaactagagacgtcacagccaaagttgccaatcacttagacaaagtgacaaccatgtccctcgaacttgtcccagagcagaaagtgccttgacccataagaactagtcgcctcttcccaaatgtcccaaaggtgaaaagcagggacgtgctggagagggggaaatgtcttttctccctcacccttcgattctctctcccctgtgctgtagatagcgctactacactgggctttaattaaaagagacggagcatgaaaaaggcatcccagccccgctcccaatattaggaaggtcaaagcaagaagatttgtggaagccatgagggaggaaacctcctgagggaggaaagctgtggaaggaaagcacaagggtgcatgggagctctcctgcccaggtgcctcgtttctgtctggtcctcagtttggcccaagatgctctggttacattggcgctccgttgccccaccctacacaccccaccctaagccttgatccagtgactgtactgggtgggagccagaaacctgaccattttgttatctacacgagcctagacccctgtgccccaaacccatcaagaataccttgcaaagagggagagatgaagggggtcagagagggatagtcgggcttacttatctttttttaaagggaaccattagggaccagccatgcacagctgaccaaagccatgtccttcctgcctgcctaccatgcttgattgcctctggggaggagtttggtgaggttagttaggtcggatttgcttggggaaggtgcctctacagaccccgggctagctctctgcagcctagaagtgtagtgggaggggtaggtgtgcagacagatgtgaggagagcattgttccctgcgttgggcgcctactcaccacccaagcgtggaaggcccctccctcgtcacgctctacggccgaacagcttcgcttgctagcttgccaagttcttttgccaaaatcaggactttgaaggaaatctccagcacgtcggacccagggcaccccggtcttctctgatcccagtgtccctggggatttatcagtgaccggtgtcatcaggatgactttgtgcctctgtaaccaggtattgaaactgttcgtctcaccaggccattccacgtggccctttgctgggggcttcctggtgggggtggaaaagtctctttttttgtataaataacaaagtgttgaaatgtatttcctgaaataaatgtttcaaatccaaaaaaaaaaaaaaaaaaaaaaaaaaaaaaaaaaaaaaaaaaaaaaaaaaaaaaaaaaa

SEQ ID NO: 3908 - DNA, 817 bp, Rattus norvegicus
  Genbank Accession No. NM_031838
aacaccaaatggcggatgacgccggtgcagcgggagggcccggaggacccgggggcccaggattaggaggccgcggggctcgtggaggtaaagctgaagacaaggagtggatccccgtcaccaagctgggccgcctggttaaggacatgaagatcaagtccttggaggagatctacctgttctccctgcccattaaggagtctgaggttattgactttttcctgggtgcatctctaaaggatgaagttctgaaaatcatgccagtgcagaagcagactcgggctggccagcggaccaggttcaaggcctttgtcgctattggggactacaatggccacgttggtcttggtgttaagtgctccaaggaggtagccactgccatccgaggggccatcatcctggccaagctttcgaccgtcccagtgtggagaggctactgggggaacaagattggcaagccccacactgtgccatgcaaggtgacaggccgctgtggctctgtgctggttcgtctcatccctgcccccagaggcactggcattgtctctgctcctgtgcccaagaagctactgatgatggctggtatagatgactgctacacttcagccaggggctgcactgccaccctgggcaactttgccaaggccacctttgatgccatctccaagacctacagctacctgacccctgacctctggaaagagactgtgttcaccaagtctccttatcaggaattcactgaccatcttgtgaaaacccacaccagagtctctgttcagaggacccaggctccagctgtggctaccacataagggtt

SEQ ID NO: 3909 - DNA, 2153 bp, Rattus norvegicus
  Genbank Accession No. NM_031839
gagggctaaaatggagctgctgggattcactacgcttgctcttgtggtttcggtgacttgcctcagcctcctttcagtgtggacaaaactgcgcactagggggaggctgcccccggggccccaccccccttcccattattgggaatctactgcaactgaacctcaaggacatcctgcatcgctttccaagctggccaaagagtacgggcctgtttacacgctgtactttggaacctctcctactgtggtcctgcatggctatgatgtggtgaaggaggcgcttctccagcaaggggatgagttcctcgggagaggacctctgcccatcatcgaagatacccataagggatatggactcattttcagtaatggagagaggtggaaagtcatgcgacgcttctccctcatgactctgaggaacttcggaatggggaagagaagcctagaggagagggtgcaggaggaagcctggtgccttgtggaggaattacaaaaaacaaaagctcagccctttgaccccaccttcatcctggcctgtgctccctgcaacgtgatctgctccattcttttcaacgatcgattccagtacaacgacaagacgttcctcaaccttatggatcttttaaataaaaattttcaacaagtgaactccgtgtggtgccagatgtacaacctttggccaacgatcataaagtatctccctggaaagcatatagaatttgcaaaaagaattgatgatgttaaaaacttcattcttgaaaaagtgaaggaacaccagaagtccctggatcctgccaaccctcgggactacattgactgttttctcagcaagattgaggaggagaaggacaacctgaagtctgagttccatctggagaacttggctgtctgtgggtctaacttgtttacggcaggcaccgagacaaccagcaccaccctgagattcgggctcctgctccttatgaagtatccagaggtgcaagccaaagttcatgaggaacttgaccgtgtgattggacgccaccaaccccccagcatgaaggacaagatgaagctgccttataccgatgctgtattgcatgagattcaaagatacatcactctggttggttccagtctgccccatgctgtggtccaggacacaaaattcagagactatgtcatccccaagggtactactgtactcccgatgctgtcttccgtcatgctggatcaaaaggagtttgccaacccagagaagtttgatccaggacactttctggataaaaatggctgcttcaagaagacagactactttgttcccttctcccttggaaagcgggcctgtgttggtgagagtttggcccggatggagctcttcctgttcttcaccacccttctgcaaaagttttccctgaagactctggtggagcccaaggaccttgacatcaagcctattactaccgggattatcaatttgccgccaccttacaagctgtgccttgttcctagataagggtttatccttttaatcattcaaatcaaagtaattgtttcctttttctataaatattctttttatgctaagcactgcctaggccagaaacatcatgcatgaaaaccacatggacatttatttcgatttaaaaatctaggtcttaaaagcttccaggacacaggcagtgtgtctgtgtccctcaactgctctagaaaccaggccccaagcacaactgacaccagatatgcaagaccctcatcagacgccacctacaagtagcactgtgtgctcttctgtagctttggaaatagaattgttttctgtcattgtttcaatagagaaattaatgtaatggcctacgttcattttcctgttcacacttaaaaacatttacatgatttgtgccacattcacaaaataaattctcaccctgacaataaaaaaaaaggaattcctgttggccgagttgtcagtcagcgtgaactctgccaccagctccctaagaaggggcattgaaggacccttcataggtttttggaggtaataaagccaggatatcatagagccttaagcggaccattgcagcactagctttcaggtgggggaattccaaaaaaaaaaaaaaaaaaaaaaaaaaaaaaaaaaaaaaaaaaaaaaaaaaaaaaaaaaaggaatt

SEQ ID NO: 3910 - DNA, 1271 bp, Rattus norvegicus
  Genbank Accession No. NM_031840
ttatatttgggttctgcctactgagccgggagtctgggaactacaactcccagagtgctgagcggatgcacgctctgcttttaggtgtaagccgcaaacatcttggaccccgggagaatccgcgttgaagcacagagcatttagctcctctgtcagaatgaatggggaccagaaactggatgttcataaccaagaaaagcagaatttcatccagcacttctcccagattgtcaaggtgctgactgaggatgaactgggacacccagagaagggagatgctattacccggatcaaagaggtcctggagtacaacactgtaggaggcaagtacaatcggggtctgacggtggtacagaccttccaggaactggtggaaccaaggaaacaggatgctgagagcctacagcgggccctgacggtgggctggtgtgtagaactgctccaggctttcttcctcgtgttagatgacatcatggactcttcccacactcgccgggggcagatctgctggtatcagaagccgggcataggcttggatgccatcaacgatgctctgcttctggaagccgctatctaccgcctgcttaagttctactgcagggagcagccctactacctcaacctgctggagctctttctacagagttcctatcagactgagatcgggcagactctcgacctcatcacagcaccccagggccaagtggatcttggtagatacactgaaaagaggtacaaatctatcgtcaagtacaagacagctttctactctttctacctgcctatcgcggctgccatgtacatggctggaattgatggggagaaggaacacgctaatgccctgaagatcctgctggagatgggcgagttcttccagatccaggacgactaccttgatctctttggagaccccagtgtgaccggaaaggtcggcactgacatccaggacaacaaatgcagctggctggtggttcagtgtctgctacgagccactcctcagcagcgccagatcttagaggagaattatgggcagaaggacccagaaaaagtggcgcgggtgaaagcactgtacgaggagctggatctgcggagtgtgttcttcaagtacgaggaagacagttacaaccgcctcaagagtctcatagagcagtgctccgcgcccctgcccccatccatcttcctggaactagcaaacaagatctacaagcggagaaagtaacctcgaattgtagaggctgcgagggaggggtctcaataaattattgttcaac

SEQ ID NO: 3911 - DNA, 5055 bp, Rattus norvegicus
  Genbank Accession No. NM_031841
ctgggctagggatgggcacaatgcggtgttggtgtctgcagtattctactcctggacaccggtggcctgcaagtgcgcttttggcgtcctctcatttttctatccttatctccgtccgcggctgccttggccagccagtttttgattttttatctgttccttgatcgatacaaagaacctaaggacatacaggacattaatacccaactgccagctctggcccagggcttgtactgtgcagcgggctggctgcagaaacttaagtcataacactctttgtcgctgaggtctgaagctctctgcacgttctcatccctgggaacgtgaccccagcatccgacgccaagatgccggctcacatactgcaagagatctctggctcttactcggccaccaccacaatcacagcgccaccttctgggggacagcagaatggaggagagaagtttgaaaagaatcctcaccactggggagcagatgttcgccctgaaattaaagatgacctatacgaccccagctaccaggatgaggaggggcccccgcccaagctggagtacgtctggaggaacatcatcctcatggccctgctgcacattggagccctgtacgggatcacactggtcccctcctgcaaggtctacacctgcctctttgcatatttgtactacgtaatcagcgccctgggcatcacagccggggctcatcgcctgtggagccacaggacttacaaggctcggctgcccctgaggctctttctcatcatcgccaacaccatggcattccagaacgatgtgtacgaatgggcccgggatcaccgcgcccaccacaagttctcagagacacacgccgaccctcacaactcccgccgtggctttttcttctctcacgtgggttggctgcttgtgcgcaaacacccggctgtcaaagagaagggcggaaagctggacatgtctgacctgaaagctgagaagctggtgatgttccagaggaggtattacaagcccggcctcctgctcatgtgcttcatcctgcccacgctggtgccctggtactgctggggtgagacgtttgtaaacagcctgtgcgtcagcactttcttacggtacgctgtggtgctcaacgccacctggctggtgaacagcgccgcccacctctatggatatcgcccctacgacaagaacatcagctctcgggagaacatcctggtgtcgatgggagctgtgggcgagggcttccacaactaccatcacgccttcccctatgactactctgccagtgagtaccgctggcacatcaacttcaccacgttcttcatcgactgcatggccctcctgggcctggcttatgaccggaagagggtgtccaaggccgctgtcttagccaggattaagagaactggggaggagagctgcaagagtggctgagttcggggtcttccagttcctgttccaagagccggcttggcagaggcttactgttctgttaattaactactgagtattgctacccagatgctaaaatgatgaagttaacccattctggtacagtattgtaaaacggacaaatatcggaagtcaacagctctaccttttgatgctaagctgttctccccttctatcttcttttcccgttgtctttttcttcgctttgtccccaatgacctcacccctcatcgcctcccctaagccagcagccactccgctgtagttcagagttcaccttccagagcgtaccagcttttcaagggtctacagtaaaggttcacgccccagccccaacttaacgttgctccaagttacagatagaagaaaaatcttgagaaatttctcctgttattttagtccagactttgccagatggaatgggagaaaaaatagttttatttggcagagagcttgcgaagtgggtaaatcttaaggggccaaattcaacactcgggctgtgattcatcaaaattgtgggagagggggatctcctgtgatcaggctccgctccgtctggccgaggtgctggcgtctcttgacacagcgtgcctcctctcctaattctgattgggtgacagccgtggaactttgtgacactaaaatatggcaacacatcggtatctcagtgtactttaggctaaagatttaaaaaaatagagaagtgaaaaacaatttgtaggaaaagtggtctttcctaaaataagattttcttttcctttcataacaaggacctggggccaggcgtcgtggcacccgcctcaaaacagttgagaggagaggggcaggtgggtctctgagtttgaagccagccagggctagatagtgaggccttgtctcaaatagaaaagccaacaattagcaggacacacggagccgggggtcctcttgcgaggcgtgtctggaatccatgagggcggtcgctcgtggtttttgagcttcctgtgagctgcacccccagacacttgtaattcctgttcttccgtctttcggatgcaggttgctcccacaaattcaggatagctatggcgtttccatgcatcccacaatggaaggagtgtaagacttgagcttgagtcacagctaaaacccagaagacacaaagtcagtctgtcctggatcctacaaacactcaacgagtgcctccctctggaaaagatggtgaacaccttccttccactgttgggcagtggacagggaagttggaggtcgctgtaggcagctccaaggtttctaggggcaccttgccaggggacctcacaactttggcggtctctagtggagcaggttaggttttagctccctttggttcccgctgtgctttgtggtaaggcttttccctgggctgttgcctcattcctcactagctctgtgaccaggtaggactctgggatacatggctgaaagctcttttgctctaccacatctgcctctctttccctacccatttttttgtgtttcggggtggtatttttgtggtggttgttttgttttatttcttctttcctctttgacgtttagtcttgctctaggcagaaacgtcctggatatttacggtcagtaaagatgtccggtcccagcagagatacaacctctatctgcagtaggtagagaaggctgtccctttccggtggctttcagattctccacctctatccctcccaggcctctgatattctttaaactttaaaggaaaagtttggccgactttctagaaacatccctggctcagagaggctctctgtctcctcggttgttctaaaacaaatggtccgggtggtgtgggtgctggcccaagactcgattcctctgagttagggcagagcatgctccctgcactcagcaaagcctctcgggctgatcagtgctcctgggtgatgctgtggtgcttttaggaggaagacagtgttggctggctggaaagcatgacagttaaggttgtgttcttaagtgcctcagtttgaaagctttggctagggtaggagatctgagatgccgtggactttgcagaagagattttgtgcagcaacgcagaagcctggctgtgttaagattggctgtacaggatagcgaatgctgtggttggagggcacagtcttcccgtgttagttaaatagagaggctttaggacgtctctgcgcccacttgaaggtagccttatcctttagctgttcgctaaaatagaatccttgagagattgacaatatatttgctggcctgtcgccctattccttggagaggccttttgaatggttttaattccactggttatccggtgcccacttaatcaaatgtgaaaaataaaaagcagctctcttcttagcctgcccccgtggatctgaggaccctgttagatacagctgtcggtaagggtgtaccagctcactaagaaacactactgtcaagattttaaagctcagaccaagtgacacgttaataagaaactaagatctgattgaattttctaacagtccttgcctcgtggacacgctaaaattcgacttgggtgccttacctcttttctaactagtgttactcatgggcctgcgctcccttcctctgcggattccttagaaccggagagcctgtaagtgtgacaggctcaaaactggcctggctggagggttaggtggactttgatctgcagtgttccctctggggtcttcgtttggggaatatttcttggggctgttttgctgaagtgcccgtagctgatggatggtggaagtaatttgaacgtacgcgatttgtaggttttgttatttgttttaagatttaaaggctggttgtagcatttaaaagtgaaagctttttcttcctggtttgctagtgttctgcgtgtcttctttagttgaaataggttagtggagaagttaagaaagcggtggccgtgttacgctggtggtgaaggccagggccgcctacaaactctcagttttgttttgttttgtttttttataacagtcccactctgacaataatgagttcactccttggataaggttgttaatgagggaagagcccttcagacctaatcagctcttactggacccagctgtcaacactgttgcattggggattaagtttccaaccccgtgaatcatgggacagactcaaaccgtagcactgggcatgtcgcctaacaatataatgtgactcagtattctgtgagacatgggataatattcctgacctacctccacgggtaggtgcgagcatgagcaaatgctctttataaaacatttggggatcctcagcagaggagtatttaagtcctgcacatttttatagtaaccgtccaccatggacttgacacgtgcctatgtcccagacgacattgttaatctacatcattcttctcagaggttgaatggatgcattagataatgtatactcattgctatggaaacctgcaggactccttttccttccttgggtgggatttttttttcctttattatgtgcaacagtagctatttgtaatctaataattttcattaataccaactctgaaagtatttctactcatctgaggttgtgtttgttcataataaaatgaaatggatctgactgc

SEQ ID NO: 3912 - DNA, 512 bp, Rattus norvegicus
  Genbank Accession No. NM_031853
acttgattgcttccctcttctgagcttgctcccgcgctttcagcatccaggtcacctcgccagtatgtctcaggctgattttgacaaagccgctgaggaggtgaagcgcctcaagactcagccaactgatgaagagatgctgttcatctacagccacttcaaacaagctactgtgggcgatgtaaacacagatcggccggggctgttggacctcaagggcaaagccaagtgggactcgtggaacaagctgaaaggaacttccaaggaaaatgccatgaagacctatgtggaaaaggtagaagagctaaagaagaaatatggaatataaacgaccagatttggtggccagccacatgtgtgacataatacctgtgaggacataatgccttggtgtttttttttttttctaatgtagatgacatggctctgatatgttagggccagagttaattactgctcctccttcctttggagtttttacctgaaatcaattaaaagtacatttgttactc

SEQ ID NO: 3913 - DNA, 1342 bp, Rattus norvegicus
  Genbank Accession No. NM_031855
gcagccagacgccaggctggatgaaatgaagaaggcaatggcaggcagtggtgccagcctctgaggtgtcgagctgctacctcccaccgctcatctctcacacaatgccatcaaacccctgcaagccacacttcttgccagccacctggcacccgaatctcagggcctcctgcatgctgtttcccttggagaggctgaagagacagagtctagcaggaatcccctccgcttgcgggtaggaagcttggggagcagcctcatggaagagaagcagatcctgtgcgtggggctggtggtgctggacatcatcaatgtggtggacaaatacccagaggaagacacggatcgcaggtgcctatcccagagatggcagcgtggaggcaacgcgtccaactcctgcactgtgctttccttgctcggagcccgctgtgccttcatgggctcgctggcccatggccatgttgccgacttcctggtggccgacttcaggcggaggggtgtggatgtgtctcaagtggcctggcagagccagggagataccccttgctcctgctgcatcgtcaacaactccaatggctcccgtaccattattctctacgacacgaacctgccagatgtgtctgctaaggactttgagaaggtcgatctgacccggttcaagtggatccacattgagggccggaatgcatcggaacaggtaaagatgctacagcggatagaacagtacaatgccacgcagcctctgcagcagaaggtccgggtgtccgtggagatagagaagccccgagaggaactcttccagctgttcggctatggagaggtggtgtttgtcagcaaagatgtggccaagcacctggggttccggtcagcaggggaggccctgaagggcttgtacagtcgtgtgaagaaaggggctacgctcatctgtgcctgggctgaggagggagccgatgccctgggccccgacggccagctgctccactcagatgccttcccaccaccccgagtagtagacactctcggggctggagacaccttcaatgcctctgtcatcttcagcctctccaagggaaacagcatgcaggaggccctgagattcgggtgccaggtggctggcaagaagtgtggcttgcaggggtttgatggcattgtgtgagagatgagcggtgggaggtagcagctcgacacctcagaggctggcaccactgcctgccattgccttcttcatttcatccagcctggcgtctggctgcccagttccctgggccagtgtaggctgtggaacgggtctttctgtctcttctctgcagacacctggagcaaataaatcttcccctgagcc

SEQ ID NO: 3914 - DNA, 2718 bp, Rattus norvegicus
  Genbank Accession No. NM_031967
gaccgagtgactcaggcttttgtttgccccttctggttcagcaaattcccttctcggcaagatgccggagtgctgggatggggaacatgacattgagacgccttatggcctcctgcatgtggtgatccggggctctcccaaagggaaccgcccagccatccttacctaccacgatgtgggtctcaatcacaagctgtgcttcaacaccctgttcaacttggaggacatgcaggagatcaccaaacacttcgtggtgtgccatgtggacgcccctgggcagcaggtgggagcgtcacagttccctcagggataccagttcccctccatggagcagctggcgaccatgctcccgaatgtggtacagcactttggattcaagtacgtgattggcatcggagtgggggccggagcgtatgtgctcgccaagtttgcactcatcttccctgatttggtggaggggctggtgttgatgaacattgaccccaatggcaaaggctggattgattgggctgccacgaagctctccggcttgaccagcactttgccagatactgtactctcccatctcttcagccaggaggagctggtgaacaacacggagctggtgcagagctaccggcagcagatctcgagcgtggtgaaccaggccaaccttcagctcttctggaacatgtacaatagccgcagagatcttgacattaaccggcctgggacagtgcccaatgccaagacactccgctgcccagtgatgctggtggtcggtgacaatgcacctgctgaggacggggtggttgagtgtaactccaaactggacccaaccactacaaccttcctgaagatggcagactctggtggtcttcctcaggtgacccagccagggaagctgactgaggccttcaaatacttcctgcagggcatgggctacattgcacacttgaaggaccgaaggctcagtggaggagcagtgccctcagccagcatgacccgccttgcgcgctctcgtaccgcgtccctcaccagcgccagttctgtggatggtagccgccctcagccctgcacccactcagacagcagtgaggggatgggccaggtcaaccacaccatggaggtgtcctgctgaagtcctcgtcctgcccaagacacccgcttacctgcccccaggtcccactgccatcttcgcaccggctcatcttccctctggtttatttttgtgagagtgaaggggaggaaatggggttacttctcttttacttaaaacgaagggatccaccttaggacggcgcagaacaacagtcttagaggatgtgaagggctcaccttatacactcgcatctcaccggccaccggttgatacggcccccttcgtctgcccgtctggggtgtggccaggatgtaggacatagtacgaaagaaagcacagcccaccccctggagctggcagatagggagtttgaagatggcaggtgctgagccaaggctctgttgtgagtgggagtcagaccagtggggagccgtcccttttctgtaacccttgtaccaagcacacctaacagtagaggtgacagtcatgaggacagtagccacaagagagcgctctgagcagtcagccattttcctggtgctctctgggcaggacatgatagaaggctagccaggctgaagacagaatatggagaaccctgacatgggggcaggaaccccatactctgccaccacagggccatgtcccaccctgaggcaaaggtcacctggtctctcttgtccccgttggtagaggtgaaatgttgatggctttgtatgctgtgtacagcccctgagaacttcatggttgcccctttgggagctggcaggtactgtaggtccctcctatcccaggtttcaaacagcgagtgtttgtcacagtgccctggtcgacctgggccggcgtgtcacagacattattacttgagaagtgagcattaggaagatacaagacagaaagatacaatgacctctgcttgctgaaggggctggaaatggcctgctccttgtgtgggagatgggttattctccagatgaacaaaggctccgtacctcctacagcccgcaactatgtctgccacctgaccatgtagactctcacagcccagagctattgtgtcagccatccccagagaagagagagcacttaagtgtgaatatggggtgggcgtgatgtatgtggtgttgtgtgggtgttctgaggcaggaggacacctacatccgtgtgtctgtggcatatgccaccccttctttctgtaactgtaagccatttccagactgctctgaagtccagtggagtgtatcctatccctggttctgttcactcacgtgcttccgtgaataccgagtgtgactgtttaaagctggcagaattaatcccttactgtagatagcacttcaagtattggacatctttttgctgtgttcttaagatatctataaatacctatacattatatatatatgtatgtatatcgggtccttctgtatgtggtttcccattgatggttgtcttctctttggtcaggatgaacttttaatggagttcattacttccctctctgtacaaagttaagagcctaattttgtgtattctggtggctgataagagactttgagattacaaaatgcaaaacaaaaatccttattgatatagaaagatatctgtgcagaaaaactaataaagaaattaagcgt

SEQ ID NO: 3915 - DNA, 3513 bp, Rattus norvegicus
  Genbank Accession No. NM_031969
gtgcagccaccctcgcctgcctcgctcttccttccttcgctcgcaccatggctgatcagctgactgaagaacagattgctgaattcaaggaagctttctccctatttgataaagatggggacggcaccatcacaacaaaggagctggggactgtcatgcggtcactgggtcagaacccaacagaggctgaactgcaggatatgatcaacgaggtggatgccgacgggaatggcaccattgacttcccagagttcttgactatgatggctagaaaaatgaaagacacagatagcgaagaagaaatccgtgaggcattccgagtctttgacaaggatggcaatggctacatcagtgcggcagaactgcgccacgtcatgacaaacctcggggaaaagctaacagatgaagaagtagacgaaatgatcagagaagcagatattgatggagacggacaggtcaactatgaagaattcgtacagatgatgactgcaaaatgaagacctactttcaactactttccccctctagaagaatcaaattgaaatcttttacttacctcttacaaaaaaaaaaaagaaaaaagaaaaaagttcatttcttcattctgtttgtatctagcaaaactgaatgtcaaaagtaccttctgtccacacacaaaatctgcatgtattggttggtggtcctgccccctaaagatcaagccccctacatgagttttacagtataaatactcgtactaccttataaggaagcacttagtggactccttcaagttccatttgctaatgattaacacactgtctgggctggccagtttctcatgcatgcagcttggtgattgagcacagtcaggcctttgtattaaaactgaaaaatggaaaaaacaaattcaaactctcagatggcttctagttcaatctgttcagataaatgtcagcagccagtttaccgcaaacaaacatttaaaattggtttacctcaggatgatgtgcaggaaacgggtgaaggctaaactttgagacacagccctagatgtaggacagtcctcttcaagtgccccaatcccatggtgacagtgacaccctggtggcgagcccgagtgtgatggttcaccgctgtgcacattgcattggagtgaagtgaacaaggctgtcaccaaatcacacacgttttaataagaaatgtttactaagggagcatctttggactctctgttttaaaaccttgtgaaccatgactcggagccagcagagtaggctgtgtctgtggacttgagcacaccatcaacattgctgttcaggaaattataatttacgtccattccaagttgtaaatgctagtcttttattttttttttccaataaaaagaccattaacttaaaagtggtgttaaatggtttgtaaagctgagcttggaagggggacaaggccgttggaggggaggtcagcggacatagaaacacccaacgtccagtacaagctggatttcccgcccaggttctctagcatcaacccctgaaaccagacagattctttgtcatctacgaccatgtaagtctagttattcaaatctgcgcgcatgcgcaaatcatggtgaattgatacttggagtagagccctagtgaaggaaggcctcaagcattcagtaaggatgtcttggctgtgctgctgctgacctgttgaagtacatgaggccatctgtgcaggagacatgatttagtgtgtgtgtaatcctatactcactgtgtatggtgaagcaggccagtcaaagacactacctttgattcagtttaatttatggttatacttaactttagccttttttattatttaagttcactgctttttctccccctaagtagagttaatgcttaacactgtcttgaaagcaaaacaatatcccagaatgaattttgtgtcttaattacgaacctgtaaccaaaacgtacatgtgctggtactggtcccttagcccaaggcactgggctatttaaaaagtcccccttaagaagtgtgttgcatttaaaacaagggccttgtacatttttcagggtgttaactggctgtatctgattaataaggagtgttggcttccaaattcgggggtggcagggagctggcaggcttgtagcaaggcaatgagaagcccttggcaaccacacgggtgcactcggggtaacctacagacccctggttgctccttctcctgctccctgtctttctggcgttttgtagctccttagaattttttttctttctgccaggaggataggtcagagcagtagagaggaagacattgcctgagcgcttctgctcatctttggactgggtggttggcagacaggtcgatgggtggtaaattgacttcagtatcggactcagtaggtattcccttttggtagagaggactgagggctccaggtgtgaagtgaatggccgtggatatgttgtgtaagaggattaagtcgcccagtcgatgacccagtctcaggcttgtggtctgttacctcttggtagtttcaaagggggtcggaggtggctttttaaaaacaatttaccccctatctttaaccatttaccaagtctgtagaagctgggtagacaatattttagcagctccgtagcctgtcctaaaaggttaccttctaaacaggattcttgtgtggccagggatcctgcatgggaactggaaacccctaacccccggggggtgggaagcaggagtttggaactgtaggaggcagagtccccccacctcctcagccttctggcatccaggggcacaagcagcccagggcttggtgttggcagtctgagttcgtgaggtagaaagagtggggtgtcaaggcagtacccctgaagttggatagtactttcctgtaaactgtccctcacttataactactctataaatatatgcatatatttatataaatatatatatataagtgactggttagctggcatcctgctttagcctgagacttgccctaagaaactgctgagcccttggtaaacgtctacacagtaagtttttctgtctgttggggggagctgttgaacaaggcagacatcttgatagttcagatgggctttaatgtactgttgccagggaaggctttttctggttttttgacaaatttttagcacacttcaattggtgtctcgagcaactttaacacattgaagatgaggtattgtacatatttttatattctctttataagtgcatgtctccaacttgtaaccaatattgtacggaatggctgtccagtaggcctagtgtttctgtcacacgagagggatagcatgtaccattcacccctcagcatcctgggagcttcttcttgaatgaagactgtaaatttggtcaagtcaactcttagttcggtttccttaccatttgaatgattgactgtgtgtcctgcgtgtatttctcttttggcagcgaccagagttacactgatgtgtctcaaccgacccactcggctggcaaccacctatttattttct

SEQ ID NO: 3916 - DNA, 2455 bp, Rattus norvegicus
  Genbank Accession No. NM_031971
agagaagcagagaagcagagcaagcggcgcgttcccgaacctcgggcaagaccagcctctcccagagcatccccaccgcgaacgcacccttctccagagcataccccagcggaggccacccttccccagagcatccccgccgccaagcgcaaccttccagaagcagaccgcagcgacatggccaagaaaacagcgatcggcatcgacctgggcaccacctactcgtgcgtgggcgtgttccagcacggcaaggtggagatcatcgccaacgaccagggcaaccgcacgacccccagctacgtggccttcaccgacaccgagcggctcatcggggacgccgccaagaaccaggtggcgctgaacccgcagaacaccgtgttcgacgcgaagcggctgatcggccgcaagttcggcgacccggtggtgcagtcggacatgaagcactggcccttccaggtggtgaacgacggcgacaagcccaaggtgcaggtgaactacaagggcgagaaccggtcgttctacccggaggagatctcgtccatggtgctgaccaagatgaaggagatcgccgaggcgtacctgggccacccggtgaccaacgcggtgatcaccgtgcccgcctacttcaacgactcgcagcggcaggccaccaaggacgcgggcgtgatcgcgggtctgaacgtgctgcggatcatcaacgagcccacggcggccgccatcgcctatgggctggaccggaccggcaagggcgagcgcaacgtgctcatcttcgacctggggggcggcacgttcgacgtgtccatcctgacgatcgacgacggcatcttcgaggtgaaggccacggcgggcgacaccgacctgggcggggaggacttcgacaaccggctggtgagccacttcgtggaggagttcaagaggaagcacaagaaggacatcagccagaacaagcgcgcggtgcggcgcctgcgcacggcgtgcgagagggccaagaggacgctgtcgtccagcacccaggccagcctggagatcgactctctgttcgagggcatcgacttctacacgtccatcacgcgggcgcggttcgaggagctgtgctcggacctgttccgcggcacgctggagcccgtggagaaggccctgcgcgacgccaagctggacaaggcgcagatccacgacctggtgctggtgggcggctcgacgcgcatccccaaggtgcagaagctgctgcaggacttcttcaacgggcgcgacctgaacaagagcatcaatccggacgaggcggtggcctacggggcggcggtgcaggcggccatcctgatgggggacaagtcggagaacgtgcaggacctgctgctgctggacgtggcgccgctgtcgctgggtctggagaccgcgggcggcgtgatgacggcgctcatcaagcgcaactccaccatccccaccaagcagacgcagaccttcaccacctactcggacaaccagcccggggtgctgatccaggtgtacgagggcgagagggccatgacgcgcgacaacaacctgctggggcgcttcgagttgagcggcatcccgccggctcccaggggcgtgccccagatcgaggtgaccttcgacatcgacgccaacggcatcctgaacgtcacggccacggacaagagcaccggcaaggccaacaagatcaccatcaccaacgacaagggccgcctgagcaaggaggagatcgagcgcatggtgcaggaggccgagcgctacaaggcggaggacgaggtgcagcgcgagagggtggctgccaagaatgcgctcgagtcctacgccttcaatatgaagagcgccgtggaggacgagggtctcaagggcaagatcagcgaggctgacaagaagaaggtgctggacaagtgccaggaggtcatctcctggctggactctaacacgctggctgagaaagaggagttcgtgcacaagcgggaggagctggagcgggtgtgcaacccgatcatcagcgggctgtatcagggtgcgggtgctcccggggctgggggcttcggggcccaggcgcccaagggaggctctgggtcggggcccaccatcgaggaggtggattagaggcttttctggctctcagggtgttggctagagacagactcttgatggctgctggtgcacgattcttatcaagttactccttctctccggagttcagtttaaagttacagccttttatacggtaattgatttgagtttgttacattttgtatgctcgtgggttttttatatattcaaattaaggttgcatgttctttgcgtttaatctaagtagctgtgtaaaaatggtgtttccttcctgcgaacacctcagcactgccaccctgtgtacagttttttccttgcatccctacaaactgagaaaaaaagttatcttttgtaacttaaacattcaaaataaaatgttacaagt

SEQ ID NO: 3917 - DNA, 1720 bp, Rattus norvegicus
  Genbank Accession No. NM_031973
catgactgccagcggcccgctcagaatcaggcatgggtctccatccttgttctcctgtggaccatggggtcccctcctgggtcctggtcttgttgctgacactgggtctgtgcagcctgcaggctacagccgacagcgttctagaccctgactttcgtgagaattactttgagcagtacatggaccatttcaactttgagagtttcagcaacaagacctttggccagcggttcctggtgtcagataagttctggaagatgggcgaggggcccattttcttctacacagggaatgagggggatatctggtccctcgctaacaactctggcttcatagtggaactggcagcccagcaggaggccctgctggtctttgctgagcatcggtattatgggaaatcgcttccattcggtgtgcagtccacacagcggggatacacacagctgctgactgtggagcaggcgctggctgacttcgccgtgctgctccaggccctgcggcacaatcttggggtccaggatgcccccaccatagcctttggagggagttatgggggaatgctgagcgcctacatgaggatgaagtacccccacctggtggctggggcactggcggccagcgctcctgttatagctgtcgcaggccttggcaaccccgaccaattcttccgagatgtcacagcggacttctatggccagagtcccaagtgtgcccaggctgtgcgggatgctttccagcaaatcaaagacttgttcctccagggagcctatgacaccatcagccagaattttgggacctgccaatcactttccagcccaaaggacctgactcagctctttgggtttgcccggaatgcatttactgttctcgccatgatggattacccgtaccctactaactttctagggccccttcctgccaaccctgtcaaggtgggctgtgaacggttgttgagtgagggccagaggatcatgggtctacgggcactggcagggctggtctacaactcctctggcatggaaccctgttttgacatctaccagatgtaccaaagctgtgctgaccccactggctgtggcactggctccaatgccagggcctgggactaccaggcctgtacggagatcaatctgacctttgacagcaacaacgtgacagacatgttccctgaaatccctttctctgatgaactccgccagcaatactgcctggatacatggggcgtgtggcctcggccagactggctgcagaccagcttctggggtggcgaccttaaagcagccagcaacatcattttctccaacggtgacctagacccctgggcagggggtggaatccagcgcaacctgagtacatcaatcattgctgtcaccatccaagggggagcacatcacctagacctcagagcatctaactcagaagaccccccgtctgtcgtggaggtgcgtaagctggaagctaccctcattcgcgagtgggtagcagcagccagactaaagcaaccagcagaggcacagtggcctgggcctaagtagcagccttccagccgagatgcagcaaacccagagaccctgttctatgtgagccgctgtgtgacagctcgccttacgtctgatactatccagactcatggtgctttgtctgagctggacctcagcaaggagctggtgggagatggagagacagaataaacacgtgctatgtcaaaaaaaaaaaaaaa

SEQ ID NO: 3918 - DNA, 1124 bp, Rattus norvegicus
  Genbank Accession No. NM_031974
tctccgctcgtcctccggtagcagccgccagcacagtgtccgctgctgggcggggtgtcggcggatcggtcggttggtttcggcttcggtgtcgctgcgtttgagttgggccgtcatggctgagttggatccatttggcgctcccgccggtgcgcccggtggccccgcgctcgggaacggggtggcgggcgccggcgaggaagacccggccgcggccttcttggcgcagcaggagagtgagattgcgggcatagagaacgacgaggccttcgccatcctagacggcggcgcccccgggccgcaggcacacggcgagccgccggggggtcctgatgcggttgatggagtgatgaatggcgaatactaccaggagagcaatggtccaacagacagttacgcagccatttcagaagtggatcggttgcagtcagagcctgaaagtatccgtaagtggagagaagagcagacagagcgcctggaagccctcgatgccaattctcggaagcaggaagcagagtggaaagaaaaggcagtgaaggagctggaagagtggtacgcaaggcaggatgagcagctacagaagacaaaagccagcaacagggtggcagatgaagctttctacaaacaacccttcgctgacgtgattggttatgtcacaaacataaaccatccttgctacagcctagaacaggcagcagaagaagcctttgtaaacgacattgacgagtcatccccaggcactgagtgggagcgggtggcccgcctgtgtgactttaaccccaagtccagcaaacaggccaaagatgtctctcgcatgcgctcagtcctcatctccctgaagcaggcgcccctggtgcattgaagagccaccctgtggaaacactacgtctccgatcttaatcctactcagtgaagctgttcacgcaattggattaattatgccgagttcttttggaccaaaccttttgtctttagagttgatcattgtttgtgattgcatgtttccttcaactgtgttctccctggcattcagagaagagagaggaagaggaagggaggggagctcccaacagtagcctcaacctgtgcttttgtgcattattctgagaataaatttctgtttc

SEQ ID NO: 3919 - DNA, 936 bp, Rattus norvegicus
  Genbank Accession No. NM_031975
gaattccggccgccgccaccgcgccaagttccggccgcggccaccttccgccgtccagggctcctccgcctcggccccgggaccccggctccccgccagccccggccccggcaccatgtcggagaagagcgtggaggcagcggccgagctaagcgccaaggacctgaaggaaaagaaggacaaggtggaggagaaggctggccggaaagaacggaagaaagaagtagtggaggaggaggagaatggagctgaggaggaggaagaagaaactgctgaggatggagaggatgatgatgaaggagacgaagaagatgaggaggaagaggaggaggaggatgaaggccccgtgcggaagagaactgctgaagaggaggatgaagcggatcccaagaggcagaagacagaaaacggggcgtcggcttgagcccctgcccgtgggcttggggatgggaggcccctcaggtcctggaggtggggcaggaacacacaaatccagccccccttctcctggctccctcgtctggccctgccccagagctgtgacccttgccctttgacccagcctctcatttccatctctccagacactgctccttcaccctcactgccacaggtccagcccccaacccgcctcatccaagctccccagccggccctcacttgccctagcattccttgttcttccctgccttcctcaccatcgatctgttccagtccttgcgaagcctctccttcccctctgcaccccgagcctctcagcctgcccttctctctcctgcctgacccctgggtctccctcagattccctcctctcagacagcgccaggccggggtggggctggggttggggccaagccccgaagctgccccctcccctttttgtataatttaataaagaaacggtcgcgcttcaaaaaaaaaaaaaaaacggaattc

SEQ ID NO: 3920 - DNA, 1978 bp, Rattus norvegicus
  Genbank Accession No. NM_031976
  misc_feature (1)..(1978): n = a or c or g or t
ctcgctgcggtccaagcaggtaaagcggggctcggcgaacgcgcgcgacccgaggggcgtggtccgcggtcccgggggtcccggcccggcccttcccgcttccctgtgtccccgcagacacttcgccatgggcaatacgagcagcgagcgcgccgcgctggagcggcaggctggccataagacgccgcggagggacagctcggagggcaccaaggatggggacaggcccaagatcctgatggacagccccgaagacgccgacatcttccacaccgaggaaatgaaggctccagagaaggaggagttcctggcgtggcagcacgacctcgaggtgaatgagaaagcccccgcccaggctcggcccaccgtatttcgatggacagggggtggaaaggaggtctacttgtctggatccttcaacaactggagcaaattgcccctcactagaagccaaaacaacttcgtagccatcctggacctnccggaaggagagcatcagtacaagttctttgtggatggccagtggacccacgatccttccgagccaatagtaaccagccagcttggcacagttaacaacatcattcaagtgaagaaaactgactttgaagtatttgatgctttaatggtggattcccaaaagtgctccgatgtatctgagctgtccagttcccccccaggaccctaccaccaggagccttacatctctaaaccagaggagcggttcaaggccccgcccatcctcccgcctcacctgctgcaggtcatcttgaacaaggacacgggcatctcttgtgatccagcgctgcttccggagcccaaccacgtcatgctgaaccacctctatgcactctctatcaaggatggagtgatggtgctcagtgcgacccatcggtacaagaaaaagtacgtcaccaccctcctctacaagcccatatgagaggatgagccagccgtgggccacgggacagcaggcgggagccgctgggctctccgtgtgcatgcgcatcctcactccgggacatctcacccccacatagtcctccttgaaggtctgtccaggcacagccagaaatcggatggacggcagaccgtggtcccagcaccgcaggcagtgcgccaggctctagtgctctaagcatcatccctctgctggcccgagatgtctacagccagacctgaatgctggttcctgctagaaaacctaggacaggaactgaagtcaccaaagccctcatcatccctgctgaagcctggcttggaagaaagcagtgctcggtcttgcctgtccttccgaatcacagcagtagattgtagactccatggaatttcagtgtccaatttccagatgcagcttcgcaatcgattcctgacactgtgcactgagaccttcttaaccagagtggctggctgtccactctcacttaaggcaataagtcaccaggacgagactataggtcatgtgactactgagcaataatcgttctcanacagacatcagaaaccactgccatttctccatcaagccagacgatcctgaggactgaccaccatgggaggttgtccaccttatttcagttgcagtgttggccatgttaccgtgacaacctggtcgaagtgcccgccctctttttagttctagcacgtgctactcagctgggggccgtgtctccagtgagcagagagtgtacacggtggttactattgcctgatcctaagagagcttggcaccctgcggcagactgctaggttccagcagggttggcacgagtgaacctatgtgtgctcagtgtgatttccacagtgatgtcacagacgtgcccattggtacaggctcctgtcacctgtcagcataggtaggcacaagctctgtggtgtccgctatttggttaaacctgagttttgggtaccttttgttactgttttcaaaacacggacttgctgtcatcttgatgtacaagtttcaataaagctttgg

SEQ ID NO: 3921 - DNA, 3089 bp, Rattus norvegicus
  Genbank Accession No. NM_031978
gatacactgcgcagtggaacggcgagtgcagggcgcagccatgatcacttcagccgctggaattatttctcttctggatgaagaagagccacagctcaaggaatttgcactacacaaattgaatgcagttgtgaatgacttctgggcagaaatttctgagtctgtagacaaaatagaagttttatatgaagatgaaggtttccgcagtcggcagtttgcagccttggtggcatcgaaagtattttatcacctgggggctttcgaggagtctctgaattatgctcttggagcaggtgacctcttcaatgtcaatgataactctgaatatgtggagactattatagcaaaatgcattgatcattataccaaacagtgtgtggaaaatgcagatttgcctgaaggagaaaagaagccaattgaccagagattggaaggcatcgtgaataagatgttccagcgatgtctcgatgatcacaagtataagcaagcgattggcattgctctggagaccaggagactagatgtgtttgagaagactatactggaatctaatgatgtcccaggaatgctagcttacagcctcaagctctgcatgtctttaatgcagaataagcagtttcggaataaagtattgcgagtcctggttaaaatctacatgaacttggaaaaacctgatttcatcaatgtttgtcagtgcttaatcttcttagatgacacccaggccgtgagtgatatcttagaaaagctggtaaaggaagacaacctgctgatggcctatcagatttgctttgatttgtacgaaagtgccagccagcagtttttgtcatctgtgatccagaatcttcgaactgttgggacccctattgcttctgtgcctggatctaccaatacgggtactgtgccaggaccagagaaagacagtgactctatggagaccgaggagaagacagccggtgcagtggcagggaaaacaccagacgctagtccagagcccaaggaccagacattgaaaatgattaaaattttaagtggtgaaatggctatcgagttacacctgcagttcctaatacgcaataataacacagacctcatgattctgaaaaacacaaaggatgcagtacgaaattctgtatgtcatacagcaactgtaatagcaaactcattcatgcactgtgggactaccagtgaccagttccttagagataacttggaatggctggccagagccactaactgggccaaatttactgcaactgccagcttgggtgtaatccataagggccatgagaaggaagcactacagttaatggcaacatacctccctaaggacacttctccaggatcagcctatcaggaaggtggaggtctctatgcattgggtctcattcatgccaatcatggtggtgacataattgactatctccttaatcagctcaagaatgccagcaatgatatcgttagacatggaggcagcttgggccttggtttggctgcaatgggaactgcacgtcaggatgtatatgatttgctgaaaacaaacctgtatcaggatgatgctgtgacaggggaggcagctggcctggccttaggtttggttatgttaggctctaaaaacacccaggcgattgaggatatggttggctatgcacaagaaactcaacacgagaagattctgcgtggtctagcagttggcattgcgttagtgatgtatgggaggatggaggaggccgatgctctcattgaatctctctgtcgtgataaggacccaattcttagaagatctggaatgtatactgtagccatggcttattgtggctctggtaacaataaagctattcgacgcctgctgcatgttgctgtaagtgatgtcaacgatgatgtcagaagagcagcagtagagtctcttggcttcattttgttcaggacgcctgaacagtgtccaagtgtggtctctttgttgtccgagagttataaccctcatgtgcgctacggcgctgcaatggccctgggagtctgctgtgctggtacaggaaacaaggaagcaattaatttactggagccaatgaccaatgaccctgtgaactacgtgcggcaaggggctctgatagcctcagctctcatcatgatccaacagaccgaaatcacgtgtccaaaggtaaaccagttccggcagctgtattccaaagtcatcaatgacaagcatgatgatgtcatggccaaatttggcgctattctggcccaaggcatactggatgcaggtggtcataatgtcacaatctccttacagtccaggactgggcacactcatatgccttctgtggttggcgtccttgtctttacccagttctggttctggtttcccctttcacacttcctatcattggcttatactcctacctgtatcatcggccttaacaaggatttaaagatgccgaaagttcaatataaatcaaattgtaaaccatccacattcgcataccctgcccctctggaagttccaaaagaaaaagaaaaggaaaaggtttccaccgctgtgttgtctattactgccaaagctaaaaaaaaagaaaaagaaaaagaaaaaaaggaggaggagaagatggaagtggacgaagcagaaaagaaggaagagaaagagaagaaaaaagaaccggaaccaaacttccagctgttggataatccagcacgggtcatgcctgcccagctgaaggtcttaagtatgacagagacctgcagataccaacccttcaagccactctccatcgggggcatcataattctgaaagacaccagcgaagacattgaggaacttgtggaacccgtggcagcacatggcccaaagattgaagaggaggagcaggagccagagcccccagagccatttgagtacatcgatgactagggccagggatcccacctgctcagctgtagatgactatcctggcacacactgaaatgtcgtgagggaacccacgctgagacccgctcgatccacacatcattgcctacgctgacataaggaacccgtgtcctgagtctttgattgagaagattctgactgttcagtgttctctttcacaaaaaaaaaa

SEQ ID NO: 3922 - DNA, 1846 bp, Rattus norvegicus
  Genbank Accession No. NM_031980
cggatgcctgggaagtggatttctgctctgctcctgctgcaaataagtttctgctttaaatctgggaactgcggaaaggtgttggtatggccgatggaatatagtcactggatgaatataaagataatactagaggaacttgtacagaagggccatgaagtcactgttctgagaccttcagcttctgtctttcttgatcccaaggaaacttctcaccttaaatttgtaacttttcctacatctttcagtagtcatgacctggaaaatttttttacaaggtttgtgagtgtatggacttatgagttgccaagagacacatgtttgtcatattttctttatctacaagatacgattgatgaatattctgactactgtctgactgtttgtaaagaagcagtttcaaacaaacagttcatgacaaaactacaggaatccaaatttgatgtcgttttctcagatgccattggtccctgtggagagctgatagctgaactgctccagattccttttctgtacagtcttcgcttctctcctggctacacaattgaaaagtacattggaggagttctattccctccttcctatgtacccatgattttttcaggattagctggccaaatgacattcatagagagggtacacaatatgatatgtatgctttattttgacttttggttccaaacatttagagagaagaaatgggatccattttacagcaaaactttaggaaggcccaccacattagctgagataatgggcaaagcagaaatgtggctcattagatcctactgggatttggagtttccccacccaatatcgccaaatgttgactacattggaggactccactgcaaacctgctaaacccttgcccaaggatattgaagacttcgtccagagctctggagagcatggtgtggtggtgttttctctggggtcaatggtcaggaacatgacagaagaaaaggccaacatcattgcatgggcccttgcccagattccacaaaaggttctttggagatttgacggcaaaaaacccaccaccttaggacccaataccagactctacaagtggcttccccaaaatgatcttcttggtcatccaaaaaccaaagcctttgtaacgcatggtggagccaatggcatctatgaggcgatccatcatggaatccctatgattggcattcccttatttggagagcaacatgataacattgcccacatggtggccaaaggagcagccgccacagtaaatttcaggacaatgtcaaagtcagatttgctcaatgcactggaggaagacatagacaatcctttttataaaaagaatgctatgtggttgtcaaccattcaccatgaccagcctacgaagccactggacagagctgtcttctggattgagtttgtcatgcgccacaaaggggccttgcacctgagatcacttggacataaccttccctggtacctgtaccactctctggatgtgattggattcctactttcctgtgtggcagtcactgtagtccttgctctaaagtgctttttatttgtttatcgattctttgtaaagaaggaaaagaaaacaaagaatgagtagagctcaatgataatgcatcacatgaatgaaatttgttcatcattttaagttatgaaccaccttctaaaaattcattaataactttacagaagcatattgtaattttgtatcatgtaaaaagacatataattctgaggcttctgatatgtgatcaaagaatcccatcatttattttaattttcaaactattcaatgtaaaacaatttgcctgtgtagaaaaatatataaataaagatttaattgaaaaaaa

SEQ ID NO: 3923 - DNA, 1451 bp, Rattus norvegicus
  Genbank Accession No. NM_031981
gccaggcgccctgccgctggacactgtagaacggcgggcggaacgcagacctgggttcgggctgttgcagtgtccgccggagcggtttggggagtgcacggggtgaagatggcggaggagcggcaggacgcgttgagggagttcgtggcggtgacgggcgctgaggaggaccgggcccgtttcttcttggagtcagctggctgggacctgcagattgcacttgcaagcttttatgaggatggaggggatgaagacattgtgaccatttcacaggcaaccccaagttcagtgtccagaggcacagctcctagtgataatagagtaacatccttcagagacctcattcatgaccaagatgaagaggaagaggaagaagagggacagaggttttatgctgggggctcagagagaagtggacagcagattgttggtcctccccggaagaaaagtcccaacgagctggtggatgatctgtttaagggtgccaaagagcatggggctgtagctgtggaacgagtgaccaagagccctggagagaccagtaaaccgagaccatttgcaggagggggctaccgccttggagcagcaccagaagaggagtctgcctatgtggcaggagaaaggaggcggcattcaggccaggatgttcatgtagtgctaaagctctggaaaactggattcagcctagacaatggtgaccttagaagctaccaagacccatccaatgcccagtttctggagtctatccgtagaggggaggttcctgcagagcttcggaggttagctcacggtgggcaggtgaacttggatatggaggatcatcgggacgaggacttcgtgaagcccaagggagctttcaaagccttcactggcgagggccagaaactaggcagcacggccccgcaggttttaaacaccagctctccagcccagcaagcagaaaatgaagccaaagctagctcgtccatcttaatcaatgaggcagaacctaccacgaacatccaaatccgactggcagatggcgggagactggtgcagaaattcaaccacagccacaggatcagcgacatccggctcttcatcgtggatgcacggccggctatggctgccaccagttttgtccttatgactaccttccctaacaaagagctggctgatgagaaccaaaccctgaaggaagccaatcttctcaacgctgtcatcgtgcagcggttaacataaccgcccagctgctgcctcacctccctatgtgtcccccatgactgtggccatgcccgtggggattacctcctgccccctgtacacctagctcttccagtgccacgtctcgtccgtagctctggattcttagacttcagttggacatttgttttctctttagttgtatttcctgggtttttgtgatgatcaatggactttaaagaaaaaaaataaaaaacacaaaaaattgg

SEQ ID NO: 3924 - DNA, 2280 bp, Rattus norvegicus
  Genbank Accession No. NM_031984
tgtaaatacagggctgaaagtgggagtggcgctccctcttcctgttatccccttggctcagcctcactgcctgatagaaatgtttctaatatggcacctggtcacagtccattgtagctgaactcccaggtcctgcactgtacaaccctcaccttcccagttcccttaccacctaataaagggcctgcctccggacagcgcccggcccgccgcgcccagctcagcctgctcagccctctggtcccgaggttccgctcagcgctctctcaaactagccgctgcaccatggcagaatcccacctgcagtcatctctgatcacagcctcacagttttttgagatctggcttcatttcgacgctgatggaagtggttacctggaaggaaaggagctgcagaacttgatccaggagcttctgcaggcacgaaagaaggctggattggagctatcacctgagatgaaaacctttgtggatcaatatgggcagagagatgatgggaaaataggaattgtagagttggcccatgtcttacccaccgaagagaatttcctgctgctctttcgatgccagcaactgaagtcctgcgaggaattcatgaagacttggagaaagtatgacactgaccacagtggcttcatagaaacggaggaacttaagaactttcttaaggacctgctagagaaagcaaacaagaccgtggatgatacgaaacttgctgagtacacagacctcatgctgaagctgttcgactcaaataatgatgggaagctggagctgacagagatggccaggttactaccagtgcaggaaaatttccttcttaaattccagggaatcaaaatgtgtgggaaagagttcaataaggcttttgagttatatgatcaggatggcaacggatacatagatgaaaatgagctggatgccttactgaaagacctgtgtgagaaaaacaaacaggaattggatattaacaatatttctacatacaagaagaacataatggccttgtcggatggagggaagctgtaccgaacagatcttgcccttattctctctgctggggacaactagagttggtggccacaaccacttgctagtgatacattgtatctaaaaccataactgtgcgctataaaggagtaggctgtattttcttttatatctgtaaattctactgcatatagagaattatccaggatgtgtggcacattcttttctgcttgtttctatactgtttgtaatgtacagtttttgtaagcatataattgaaaagaagaaagtctatgcttaggccagtcagtataatccattttcaaagatgaatctaacatgattctgctttcataaatacagatgaacacttggatttccctaaaactctaccatctcaacaattctagtgtcagatgtgtaaatgcacagctgtcagtgagtaaaagaataattcatgacaagccaagtgttttttaatttaggcaatcatagaactgtcccacaaagcacttctgtgcgttttccatctagtggaagggatgtgcttctgcttgtgaagcaccaaatgtcaatagttaactatggctttatcataaaacgatctccctagagatttaatttactgatcagtggcatgtctactgcttgaatagataccacactgttggttcaagctggcttggtggcaagggaaggtagccagatgacacataaatctgtctgatactatgcctatatttccaagaagtctattgcagagagtatgaccttagcccattttctaaattattttcatgtgttccagatgacaattattctagtaaactgctgttttgtgtcatattctgtgtgtactctctgattaaattcaatgtacctctgaggcctgtcgcagttgggctccggctcctttgcggagcaccatgtcgcagagggggaggagaccctgcagggcgcctgggtagaactgcacttcagcaatgggaatgggagcagcgttccagcttccgtctctatttataatggtgacatggaaaaaatactgctggatgcgcagatgaatctggacgaagcatctccaagagctctcactgtgacagcccacctcgctcccagacaccacaagataccaacaagagctgaaatagcaccacacgtttggtgagaaaaaacagcatgtgtgtctgaggaagattatattgagagaagaagagaagttgaaagtatcctgaagaaaactcagattggatatgggattggtcaagtcggccagaaaatgttcccccc

SEQ ID NO: 3925 - DNA, 2287 bp, Rattus norvegicus
  Genbank Accession No. NM_031985
gtctgcggcgggtccgggcccatgaggcgacgacggaggcgggacggcttttacccagcgcctgacttccgacacagggaagctgaggacatggcaggagtgtttgacatagacctggaccagccagaggatgcaggctctgaggatgagctggaggaggggggtcagttaaatgaaagcatggaccatgggggagttggaccatatgaacttggcatggaacattgtgagaaatttgaaatctcagaaactagtgtgaacagagggccagaaaaaatcagaccagaatgttttgagctacttcgggtacttggtaaagggggctatggaaaggtttttcaagtacgaaaagtaacaggagcaaatactgggaagatatttgccatgaaggtgcttaaaaaggcaatgatagtaagaaatgctaaagatacagctcatacaaaagcagagcggaatattctggaggaagtaaagcatcccttcattgtggatttaatttatgcctttcagaccggtggaaaactctacctcatccttgagtatctcagtggaggagaactatttatgcagttagaaagagaggggatattcatggaagatacagcttgcttttacttggctgaaatctccatggctttggggcatttacatcaaaaggggattatctacagagacctgaagccggagaacatcatgcttaatcaccaaggtcacgtgaagctgacagactttggactatgcaaagaatctattcatgatggaacagtcacgcacacattttgtggaacaatagaatacatggcccctgaaatcttgatgagaagcggccacaaccgtgctgtggattggtggagtctgggagcattaatgtatgacatgctgactggagcacctccattcactggggagaatagaaagaagacaattgacaaaatcctcaaatgtaaacttaatttgcctccctacctcacacaagaagctcgagatctgcttaaaaagctgctgaagagaaatgctgcttctcgtcttggagctggccctggggatgctggagaagtccaagcgcatccattttttagacacattaactgggaagagcttttggctcggaaggtggagcgcccctttaagcctctgttgcaatctgaagaggatgtgagtcagtttgattcaaagtttactcgtcagacacctgttgacagccccgatgactcaactctcagtgaaagtgccaaccaggtctttctgggttttacatatgtggctccatctgtacttgaaagtgtgaaagaaaagttttcttttgaaccaaaaatccgatcgcctcgaagatttattggtagcccacgaacgcctgtcagcccagtcaaattctctcctggggatttctggggacgaggtgcttcagccagcacagcaaatcctcagacacctgtggaatacccaatggaaacaagtggaatagagcagatggatgtgacaacgagcggggaagcttcagcgccacttccaatccgacagcccaactctgggccatacaaaaaacaagcttttcctatgatctccaaacggccagagcacctgcgtatgaatctatgatgaaacaatgcttttattaatgcaaatgcaaaaaggaaacaaatcctggaagggcatgtgtgaggatcctgcaagataaaaatgagaaaatggcagtctcaaagagtcagtgtcattacctggaatgctttcgatggaggaaaaaataaacatggatttttaaaaaaatcaatcaatggtgcaaaaaataaacccacaaaaaactcaaacaaaatagtattgtggaacccacagacacatcaactgactggttcctaccctagcaacatctcagcgttcgtaaggattctcatgctgatggccgtaaactgacagtattaagggtaggatgttgcttctgaatcactggtaaagtctgatgatgtcacataagggttatcctaataggcaaagtacaagattgcctgtaatacttgcaactaaggacaaattagcatgcaagctttgtcaaactttttccagcaacacagaatcaaagacaaaagaaacttatcgattgatgttttacgtgcaaacaacctgaatcttttttttatataaatatatatttttcaaatagatttttgattcagctcattatgaaaaacatcccaaactttaaaatgcgaagttattggttggtgtgaagaaagccagcttctgttcttctcttgatgaaataaaatgcaaatggatcattgttaaaaaa

SEQ ID NO: 3926 - DNA, 2077 bp, Rattus norvegicus
  Genbank Accession No. NM_031986
gacccacgcgtccgggagccggagcgagcggcaggaacaacgcggtgttcggggcagaaaacacctgcaaaaatgtctctctatccatctcttgaagatttgaaggtagacaaagtaattcaggctcaaactgcctcttctgctaatcctgccagccaggccttttttttaaatgtggtcgattctgctgccttccctccaggtggaaatctctatcctaaactgtatccagaactctctcaatacatgggactgtctttaagtgaagctgaaatatgtgaaaacatgcctgtggtctctggagcgccaacccaagggcagttggtagcaaggccatccagtgtgaactacatggtagcacctgtgacaggtaacgatgcggggattaggagagcagagattaagcaagggattcgggaagtcattttgtgtaaggatcaagatggaaaaattgggctcagactgaagtcagtagataatggtatatttgttcaactagtccaggctaattccccagcctccttggttgggctgcgatttggggaccaggtgctccagatcaatggtgaaaactgtgccggctggagctccgataaggcacacaaggtgctcaagcaggcctttggagagaagattaccatgaccattcgtgatagaccctttgaacggacagttaccatgcataaggacagcagtggacatgttggctttatctttaaaagtggaaaaatcacatccatagtgaaagacagttctgctgccagaaacggccttctcactgatcaccacatctgtgagatcaacggacagaacgtcattggcttgaaggatgctcagattgcagatatactgtcaacagctgggactgtggtcaccatcacaatcatgcctgcctttatcttcgaacatattattaaacggatggctcccagcattatgaaaagcctgatggatcacaccattcctgaagtttaaaccttgtacagtgcatcaccgccgaacgcttccagtcttcctcttcggcaacttctctatttcaccgcacatgaagctttcccggatccagggagactgtgctgcatggagacctgtctatcttccaccatggctgggaacctcactctatctgagagcgtcttcagattttaagataggtgtagccttatcctggttttacagatgtgaactctcaaaagattccctgactttctagacttggttctttactgggaacctgatgtttttctataagccattgtgattaggatgactggtgtaggcttagctgtgtccgagaactggtctgctttctccgagaagtgcacagtgctaggcacgtgcttcagttctgtggcatatgtggagtgtagtacatcagcatagtacctgtaggatgagtgcctttgatcgcaactttttaagtgtgtgtgtgagtgtgtaaaattccagttaatcaacacttcattcacaaaagcattatacagttctgtgtaggtggcaagagactaatgattgtcactaaattctaacaccttcacctaatgtgcttcagttgtcgcctaacacagaagcatttagataaagcaaatagaaattattgctgccttctgaaacctgagaggtagctctctatcaagctgttctatgctagccctgagcagcttactggtgtcgcagagctgcctagctgtaccaagattttctagtcactgcataaaggaaacgcctaagagttgccgtattgctttctgagatacaaattgctatatatttcatgtaaaagttgttatactaaataggataaattttggagtctcttttcactcgtagataaagtgggtaatatctaatttggcacttgagtcctaacattatgtaactttagctaggttggggtgggtttagaatgtttccctagtcatctcagtttgttccattttctgactctatcctgcaaacaaaaatggcaatgacactttatcctgactctttccttcttagtttgtgcctatcttattattttatgtgatattatcctattaaatgtataaaaatattaaaaaaaaaaaaaaaaaaa

SEQ ID NO: 3927 - DNA, 2681 bp, Rattus norvegicus
  Genbank Accession No. NM_031987
gagtgcagagagccaagccgggtgcaggagttttcttactgtgactataccatggaaaatcaattggctaagtcaattgaagaacgaacattccagtaccaggactctcttccgcccttgcccgttccttcgcttgaagaatcactgaagaagtaccttgagtcagtgaagccatttgcaaatgaagacgaatacaagaaaactgaagaaatagttcaaaagtttcaagatggagttggcaagacattgcatcagaagttacttgaaagggctaaaggaaaaagaaactggctggaagagtggtggctcaatgtcgcctacttggatgtgcgtattccatcacaactgaacgtgaactttgtgggtccgtctccccactttgaacactactggcctgcaagggaaggcactcagttggaaagaggaagcatactactgtggcacaacttgaactactggcagctgctaagaagagaaaaattgcctgtacataaatctggaaatactcctctagacatgaaccaattccggatgctgttttctacctgcaaggttccgggaatcactagagattcgattatgaattattttaagactgagagcgaggggcattgtccgacccacattgccgtgctgtgtcgaggcagagcgtttgtcttcgatgtcctccatgacggttgtttgatcaccccaccagaacttctcagacaactgacatacatctaccagaaatgctggaatgaacctgttgggcccagtatagcggcattaaccagtgaggagcgaactcggtgggcgaaggcaagagaatatctgattggtcttgatccagagaacttgactttattagaaaaaattcaatccagtttatttgtgtattccatagaagacaccagtccacatgcaaccccagaaaatttttctcaggtctttgaaatgcttcttggtggagatccagcagtgcgctggggtgacaagtcctataatctgatttcctttgctaacggaatatttggctgtagctgtgatcatgctccttatgatgcaatgcttatggtgaacattgctcactatgttgatgagaagctcctagagacggaagggagatggaagggttcagaaaaagtccgggatataccgttgccagaggagctggctttcactgtggatgagaagatactgaatgacgtctaccaagccaaagcccaacacctcaaagcagcatctgatttacagatagcagcatctaccttcacatcttttggcaaaaagctcactaagaaggaggcccttcaccctgacacctttattcagctcgctcttcagctcgcctactacagacttcatggacgccccggttgctgctatgaaacagctatgacaagatacttttaccatggccgaacagagactgtgcgatcttgtacagtggaggccgtcaggtggtgccagtccatgcaggatccttctgccagtctccttgaacgtcagcaaaagatgttagacgcttttgcaaagcataacaagatgatgagagattgttcccatggaaaaggatttgaccgtcaccttttaggccttttgctcatagcaaaagaggaaggcctccctgttccagaactgtttgaggatccacttttctccagaagtggaggaggtgggaattttgtgctgtcaacaagtctggttggttacttacgaattcagggagtcgtggttcccatggtacataatggatacggctttttctaccacatcagagatgacaggtttgtggtgacatgttcatcctggaggtcatgtcttgagactgatgcagaaaagttagtggagatgatttttcatgctttccacgatatgatacatctgatgaacacggctcatctttagagactcagagacatacaggtcacagaaactgggtacggagaatgggatggtgatacgacatggaaggaatgttgacttaaaggaaacctgttaatgcagggattagagagggatgcactctagatttattctaccttaaagccttctgttgcaacagcaatgcaaactcagacatagtgaatagaactatgcaatgttttaagcctcaacaatgcacatctgtatattttaacaatacaaatcctactctaatgttaaaatatttttgttggcacatgtgtaggttgcaagtcctctgtgaacataattatagagtatttctcaagcactttaatactttctaatggccagagggtataaaacccatggttagatgctaatttccctgacatcagtgccttctacatccagcacaggagtacaagcctatgagatttcatgggaaaaccactattgttcaatattgatctaaaatagctcctttgaacagacaaaagtatcaagttgtattagaaaagaatattagcaaaactcattatgatatgttgtaattaattttgtgaatataaaatcaaaacacttccatttaaatctacttggtagagttagtggctttaaagggttaaatgtcgagtatgattctcagaactttataattatttcccactgttattcaaaatgttagcatatagacattctcccattgtaattcagtgtttatattctcaaagaataaagcatccagaatccttgtaatttctcatttattttcaataaaaatgattcctgat

SEQ ID NO: 3928 - DNA, 2075 bp, Rattus norvegicus
  Genbank Accession No. NM_032057
cgttacctccggaagagccgaagaaccgatccctcggacgccagcggttgagcatcgattgcggtgcgctcgcgcgaaataatggcagacccttggcaggagtgcatggattatgcagtgatcctcgcaagacaagctggagagatgattcgtgaagctctaaaaaataagatggatgtcatgattaaaagttctccagccgacttggtaacagttactgaccaaaaagttgaaaagatgcttatgtcttctataaaggaaaaatacccatatcacagtttcattggtgaagaatctgtggcatccggggaaaagacagtcttcacagagcagcccacgtggatcattgatcccattgacgggacgaccaactttgtgcaccggtttccctttgtagctgtttcgattggcttcgttgtaaataaagagatggagtttggagttgtatacagctgtgtggaagataagatgtatacgggcaggaaaggaaaaggcgccttttgtaacggtcagaagcttcgggtctcgcagcaggaagacattaccaaatcactcttggtgaccgagctgggctcgtccagaaagccggagactttgcggattgttctctccaacatggaaaggctttgctccattcctatccatggaatccggagtgttgggacagcggctgttaatatgtgccttgtggcaacgggaggagcggatgcctattacgagatggggatccactgctgggacatggctggagctggcatcatcgtcatagaggctggcggagtgctgctggatgtgacaggtggaccattcgatttgatgtctcggagaataattgctgcaagtaatatagcattagcagaaagaatagccaaagaacttgagataatacctttacaacgagacgacgaaagttaggcacgtagaaccgcatccagctccgtcacacctgctctccctgggatgtttaaagatgtatgatgtcactgatttaaatttaactttgcagtcctgatttttaagcgggaacttttttttacagatgacatgttcaaaagtagatggaatatttgattattgaaagaaaatttgcatgtaataatatccttggggaaaatatacaggaagtataattaatgaactagccattgaaatagtccccagcccatatgatccctttcaacttaatttactatttatatgcacagttcttaactagaaagttttcttttttgtaagcggttttctctttgttccaaaagccatatttgattaagtctgtaaggctgtaaccagcaggctctccctgtgcagaaggccttcgtgttttattaatcactgtaatacagcacctagtgcagaaccagtcagacagtaggcgatctccaatcgacacctcacactgagtgcttgaagctgcaattcctgcttctaatgtgtcagaataagataaccattctactgtggcttcctgttttgaagtaaaagtttcctcactgtccttttacatttcatattgttgtgccatttcatagggccaccctgccagaggccattgcttctagttggcatttctgcagttagtatactgctgtgtgttgtaggttctgtttggagcccccacgctagagagaaatttccacagacgtcttccatgtacctggtgcagttagtggcagtgtgacgttttaggaaatgcagtatcacattcagatccataccgtggtgttggctggtgtgaactgtgtattgtggcgttcatggtgaactttttgatttctttcaaaacttgctgaatttcaccactgctctctttggctattctataaggtcttgggcctctcaaacacaagaaaatgcaatgactcctattccttttcaaaggattaattcattgtccagccttggcgcttggcataggagcagactttgttcttagtatgtttgaaccttgcgttggataaaatgaagtgttcttgtaaagttccaaggcagttattaccttgttgttggacgatttgatatattaaatctatatgatactccgaaaaaaaaaaaaaaaaaaaaaaaaaaaaaaa

SEQ ID NO: 3929 - DNA, 8950 bp, Rattus norvegicus
  Genbank Accession No. NM_032062
gcccggtctctcagggcagccataatggttttatctggatcttttcggaatgatggtttgaaagcttctgatgtccttcctatcctaaaggagaaagtggcctttgtgtctgggggtcgtgataagcgaggtggacccatcctgaccttccctgcccgaaccaatcatgacagaataagacaggaagacctacggaaactcgtgacgaatttggccagcgtgccaagcgaggacgtttgcaaacgtggcttcaccgtcatcatcgacatgcggggctccaagtgggacctcatcaagcccctcctcaagacgctgcaggaagcctttcccgccgagatccatgtggccctcatcatcaagcctgacaacttctggcagaagcagaagaccaactttggcagctccaaattcatctttgagacgagcatggtgtctgtggagggcctcacgaagctggtggacccctcccagctgacagaagagtttgacggttccctggattacaaccacgaggagtggattgagttgcgcctctccctggaggagttcttcaacagtgcggtccacctgctctcacgcctcgaggacctgcaggagatgctggcccggaaggagttccctgtggatgtggagggctctcggaggcttatcgacgagcacacacaacttaagaaaaaggtgctgaaggcccccgtggaagagctggaccgggaggggcagcggctactgcagtgtatccgctgcagtgatggcttctcagggcgcaactgcatcccaggaagtgccgacttccagagccttgtacccaagatcaccagcctcctggacaagctgcattccacccgacaacacctgcaccagatgtggcacgtccgaaagctcaagctggatcagtgcttccagctgcggctcttcgagcaggatgccgagaagatgttcgactggataagccacaacaaggagttatttcttcagagccacacagagatcggagtcagctaccagcatgcactagacctccagacacagcacaatcactttgccatgaactccatgaatgcctatgtcaacatcaaccgcatcatgtctgtcgcatcccgcctctcagaggctggccattatgcctcccagcaaatcaagcagatctccacgcagctagaccaggagtggaagagctttgctgctgccctggatgaacgcagtacaatcctggccatgtctgctgtgttccaccagaaggcagagcagttcctgtcaggagtggatgcctggtgtaagatgtgcagtgaaggcggccttccttctgagatgcaggacctggagctggcaatccaccatcaccagtccttgtatgagcaggtgacccaggcctacacagaggtcagccaggatgggaaagcactcctggatgtcctgcagcgtcccctgagccctgggaactccgagtccctcacagccacagccaactactccaaggcggtacaccaggtgctggatgtggtacatgaggtgctgcaccaccagcggcggctcgagagcatctggcagcaccgtaaagtgcggcttcaccagcggctgcagctgtgcgtcttccagcaggatgtgcagcaggtgctggactggattgaaaaccacggtgaggcctttctcagcaaacacactggggtcggcaagtccctgcatcgggcacgggcattgcagaagaggcatgatgactttgaagaggtggctcagaatacatacaccaatgcggacaagctcctagaggcagcagagcagctggctcagactggggaatgtgacccggaagagatctacaaggctgcccgacacctggaggtgcgcatccaagacttcgtgcgcagagtggagcagcggaagcttcttctggacatgtccgtctctttccacacgcacaccaaagagctgtggacatggatggaagaccttcagaaggaggtgctggaggatgtctgtgcagactctgtggatgcggtccaggaactgatcaagcagttccagcagcagcagaccgctaccctggacgccactctcaacgtcatcaaggaaggcgaagaccttatccagcagctcaggtcagcgcctccctccctgggggagcccaccgaggccagggactcagctgtatccaacaacaagacgccccacagtagttccatcagccatatcgagtctgtcctccagcagctggacgatgctcaggtacagatggaggagctgtttcacgagcggaagatcaagctggacatcttcctgcagctgcgcatcttcgaacagtacaccattgaggtcaccgcagagctggatgcctggaatgaggacttgctccggcagatgaatgacttcaacacagaggacctgaccctggcagagcagcggctacagcgccacacagaacggaagcttgccatgaacaacatgacattcgaggtcatccagcagggccaggacctgcaccaatatatcatggaagtccaagcctcaggaatcgagttaatctgtgagaaggacgttgacctggcagctcaggtgcaagagctactggaatttctccatgagaagcagcacgaactggagctcaatgcggagcagacgcacaagcggctagagcagtgtctccagctgcggcacctccaggctgaggtcaaacaggttctgggatggatccgcaatggagagtccatgctcaacgccagcctggtcaatgccagctctttgtctgaggcagagcagctacagcgggagcacgaacagttccagctagccatcgagaagacgcaccagagcgccctgcaggtacagcagaaggcagaggcactgctccaggccggccactatgacgccgatgctatccgggaatgtgcggagaaggtggccctccactggcaacagctcatgctaaagatggaggaccggctgaaactcgtcaatgcctctgtggccttttacaagacctctgagcaggtgtgcagcgttctggagagcttagagcaggagtaccggagagacgaagactggtgcggcgggagagacaagctggggccggcggcagagatggaccacgtcattccactcctcagcaagcatctggagcagaaggaggccttcctgaaggcctgcactctggcacggcggaatgccgaggtgttcctcaagtacatccacaggaacaatgtgagcatgcccagtgttgccagccacaccaggggacccgaacagcaagtaaaagccatcttgagtgagctcttgcagagagagaatcgcgtcctgcacttctggaccttgaagaagcggcggttagaccagtgtcagcaatatgtggtgtttgaacgcagtgctaaacaggcactagactggatccaagaaacaggagaatattacctctcaacccatacctccactggagagaccacagaggagactcaggagctgctgaaagagtatggagaattcagggtgcctgccaagcaaacaaaagagaaggtgaagcttctgatccagctagcagacagctttgtggaaaagggccacatccatgccacagagatacggaaatgggtgaccacggtggacaagcactaccgggatttctccctgaggatggggaagtaccggtacaccctggagaaagccctgggagtcaacacggaggataacaaggacctagagctggacattatcccagcaagcctttcagaccgggaggtcaagctccgggatgctaaccacgaggtcaatgaagagaaacggaagtcagctcgaaagaaagaattcattatggctgaactgctccagaccgagaaggcttatgtaagagacctacacgagtgcttggagacctacctgtgggaaatgaccagtggtgtggaagagataccacctgggatcctcaataaggagcacatcatcttcggcaacatccaggagatctatgacttccacaacaacatcttcctcaaagagctggagaagtacgagcagctgcctgaggatgtgggacactgctttgttacctgggcagacaaatttcagatgtatgtcacctactgtaaaaacaagcctgattccaaccagctgatcctggagcacgcaggcaccttctttgatgagatccagcagcggcacgggctggccaactccatctcttcctacttaattaagcctgtccagagagttacgaagtaccagctgctcctgaaggaacttttaacttgctgtgaagaagggaaaggggagctcaaggatggcctggaggtgatgctcagtgtccccaagaaagccaatgatgccatgcatgtcagcatgcttgaagggttcgatgagaacttggatgtacagggggagttgattctccaggatgcctttcaagtgtgggacccaaagtcgctgatccggaaggggcgggaacggcatctgttcctctttgagatctccttggtgtttagcaaagagatcaaagactcttcaggacacacgaaatatgtttacaagaacaagctactgacctcagagctgggtgtgaccgagcacgtagaaggtgacccctgcaaattcgccttgtggtctgggcgcaccccatcctcagacaataaaacagtgctcaaagcttccaacatcgaaaccaagcaggaatggatcaagaacattcgggaagtgattcaggaaaggatcattcatcttaaaggagctttaaaggagccaatccagctccccaaaacaccagccaaactgaggaacaatagtaagagggatggggtagaggatggtgacagccagggggacgggagcagccagcccgataccatatccattgcctccaggacctctcagaacacagtggagagtgacaagctctcaggtggatgtgagctgaccgtggtcctccaggacttcagcgcggcccacagcagtgagctgagcatccaggtggggcagactgtggagctgttggaacgacccagtgagagacccggctggtgtctggtccgcaccacagagcggagccccccacaggaaggcctggtccccagcagcaccttgtgcatctcacactcgagaagcagcgtggaaatggactgcttcttccccctggtgaaagattcatactctcattcctccggtgagaatggaggcaagtctgagtccgtggccaacctgcagtctcagccctccctgaactccatccacagttcccctggtcccaagcgctccaccaacacccttaagaagtggctgacgagccctgtgcgtcggctcaacagcgggaaagcagacggaaacatcaaaaagcagaagaaagtacgggatgggcggaagagcttcgacctgggctcacccaagccaggggacgagacaacccctcagggagacagcgctgatgagaagagcaagaaaggttggggagaagatgagccagatgaagagtcacacacacctctccccccgcccatgaagatctttgacaacgaccccacccaggatgagatgtcctctttgctagcagcccggcaggctcccactgacgtgcctactgctgcagaccttgtcagtgcaatagaaaagttggtcaaaagtaagctgactctggaaggaggctcttaccgggggagcttgaaggaccctacagtctgcctgaatgaggggatggcccctcccacacctcctagaaacctggaagaagaacagaaagccaaggctctaagaggcaggatgtttgtcctgaatgagttggtgcagacagagaaggactacgtcaaggacctggggattgtggtggagggcttcatgaaaagaatagaagagaagggggtccccgaggacatgcgagggaaggaaaagatcgtgtttggaaacatccaccagatttacgactggcataaagattttttcctggctgaactggaaaaatgcatccaagagcaagacagattggcccagctcttcattaaacatgagcggaagctgcacatctatgtgtggtactgccagaacaaaccacgttccgaatacatcgtggctgaatatgatgcctactttgaggaggttaaacaagagatcaatcaaaggctgacccttagtgacttcctcatcaagcccattcagagaataacaaagtaccagctgctactcaaggacttcctgcggtacagcgagaaggctggtttggagtgttctgatattgagaaagcagtggagttaatgtgccttgtccccaagcgctgtaatgacatgatgaatctgggacgcctgcagggctttgagggcaccctgaccgcccagggcaagcttctacagcaggacacgttctatgtgattgagctggatgctggcatgcagtcccggaccaaggagaggcgtgtgtttctctttgagcagattgtcatctttagtgaactgctccgaaagggatccctcaccccaggctacatgttcaagaggagcatcaagatgaattacttggttctggaagaagatgtggatgatgacccctgcaaatttgcacttatgaacagggagacttcagaaagggtcattctgcaggccgccaactcagacatccagcaggcctgggtgcaggacatcaaccaagtcctagaaacacagagggacttcttaaatgctctgcagtcacccatcgagtatcagcggaaggagaggagcacagctgtgatccggtcccagccccctagggttcctcaagccagccccaggccctattcgtctgtcccagtgggctcagagaaaccccccaagggctccagctacaacccgcccctgccacccctgaaaatatctacctcgaatggcagtccagggttcgactaccaccagcctggggacaagtttgacgctagcaagcagaacgacctgggaggctgcaatgggacctcaaccatggccgtaattaaagattactatgcactgaaggagaacgaaatctgtgtgagccaaggtgaggtggtccaggtcctcgccgtcaaccagcagaacatgtgtctggtgtaccagcctgccagcgaccattccccagcagcggagggctgggtcccaggcagcatcctggcacccctcaccaaagccacagcgccggccgagagtagtgatgagagcatcaagaagtcatgctcatggcacactctacgcatgagaaagcgggcagacgtggagaacacgggtaaaaatgaagccacagggcctcgtaaacccaaggatattctgggcaacaaagcctctgttaaagagacgaacagttccgaggagtcagagtgtgatgatcttgaccctaatactagtatggagatcttgaatccgaatttcatccaggaagtggctccggaattccttgtgcccttggtagatgtgacctgcttgctcggagacacagtactgctacagtgcaaagcctgtgggcggccaaagcctaccatcacctggaagggtccagatcagaacatcctagacaccgacaacagttcagccacatacaccatctcctcctgtgattctggggaaagcaccctcaagatctgcaacctgatgccccaagacagcgggatttatacctgcatagcaacaaatgaccacggaaccgcatccacgtctgctacagttaaggtgcaaggtgtacccgcagcccccaatcgcccaatcgcacaggagaggagctgcacctccgtcatcctccgctggctgcccccagccagcaccggaaactgcactatttcggggtacacagtggagtaccgcgaggaaggttcgcaggtctggcagcagtcggtagcttcaaccttggacacttacctagtcattgaagatcttagtccagggtgcccttatcagttcagggtcagcgccagcaacccctggggaatcagccttcccagtgagccctcggagtttgtgcaccttccagagtacgatgcagctgctgatggtgccaccatttcttggaaggaaaattttgattctgcttacaccgaactgaacgagattggcagaggccgtttctctattgtaaagaaatgcattcacaaagctacccgcaaagacgttgctgtgaaatttgtgagcaagaaaatgaaaaagaaggaacaggctgcgcacgaggccgccctgctccagcacctgcagcacccccagtacgtcaccctccacgacacctacgagtcccccacatcctacatcctgattttggaactgatggatgacggccgactcttggactacctaatgaatcacgatgagctgatggaagaaaaggtagctttctacattcgagacatcatggaagctctgcagtaccttcacaactgcagggtggcacatttggacataaagcctgaaaacctcctcattgacctccggatcccagtgcctcgagtgaaactcatcgacttggaagatgctgtccagatctcaggccacttccacatccaccatctgctggggaaccctgagtttgctgccccggaagtgatccaaggcatccctgtctccctgggcacagacatctggagcatcggggttctgacctacgtcatgcttagcggggtctcccccttcttagatgagagcaaagaggagacctgcatcaacgtgtgcagggtggacttcagcttcccccacgaatacttctgcggtgtaagcaatgctgccagggacttcatcaacgtcatcttacaggaagacttccggaggcggcccacagcagccacgtgcctgcagcatccgtggctgcagccccacaacggcagctactccaagatccccttggatacctcccgcctggcctgcttcatagagcgccgcaagcaccagaatgacgtgcggcccattcccaatgtcaaaagttacatcgtcaacagggtgaaccaggggacctagctatcccaccgtccctccaccccgaggtttcacatagacgtgcagt

SEQ ID NO: 3930 - DNA, 2795 bp, Rattus norvegicus
  Genbank Accession No. NM_032063
ggcacgagaaaaccagaaagcaggcgaccctcacttacccgtggactggaagccagaagaagaggaaaccgaaagttgtcctttctcagtgcctcgcagagctcttgtcagggacatatctgtagcaccgcaccctcctgaagcgacctggcccgatatcacacctggagccgagaggcgcctttccaccagtgctcctcgggtcacatagactttccgggcatccctgggtctttgaagaagaaagaaaagagatactctaggagagtcaagggcgtccagcggtaccatgggccgtcggagcgcgctagcccttgccgtggtctcagccctgctgtgccaggtctggagctctggcgtatttgagctgaagctgcaggagttcgtcaacaagaaggggctgctggggaaccgcaactgctgccgcgggggctctggcccgccgtgcgcctgcaggaccttctttcgcgtatgcctcaagcattaccaggccagcgtgtccccggagccaccctgcacctacggcagtgcggtcaccgcagtgctgggtgtcgactccttcagcctgcctgatggcgcaggcatcgaccccgccttcagcaaccccatccgattccccttcggattcacctggccaggtaccttctctctgatcattgaagccctccacacagattctcctgacgacctcgcaacagaaaacccagaaagactcatcagccgcctgaccacacagaggcacctcactgtgggagaagagtggtctcaggaccttcacagtagcggccgcacagacctccgctactcttaccggtttgtgtgtgatgaacactactatggagaaggctgctccgtgttctgccgaccgcgggatgatgcctttggccacttcacctgcggggagagaggggagaagatgtgcgaccctggctggaaaggccagtactgcactgaccccatttgtctgccaggctgtgatgaccaacatggatattgtgacaaaccgggggaatgcaagtgcagagttggctggcagggccgctactgcgatgaatgcatccgatacccaggctgtctccatggtacctgccagcagccctggcagtgtaactgccaggaaggctgggggggcctcttctgcaaccaggatctgaactactgcactcaccataagccatgcaggaacggagccacctgcaccaacacgggccaggggagctacacatgctcttgccgacccgggtatacaggggccaactgtgagctggaggtagatgagtgtgctcccagcccctgcaggaatggagggagctgcacggatcttgaggacagctactcttgcacctgccctcctggcttctatggcaaggtctgtgagctgagcgccatgacgtgtgcagatggtccttgcttcaatgggggacgatgttcggataaccccgatggaggctacacctgccattgccctgcgggcttctctggcttcaactgtgagaagaagattgatctctgtagctcttccccttgttctaacggtgccaagtgtgtggacctcggcaactcctacctgtgccgatgtcagactggcttctccgggaggtactgcgaggacaatgtggatgactgtgcctcttctccctgtgcaaacgggggcacctgccgggacagtgtgaacgatttctcctgtacctgcccacctggctacacaggcaggaactgcagcgcccctgtcagcaggtgtgagcatgcaccctgtcataacggggccacctgccaccagaggggccaacgctacatgtgtgagtgcgcccagggctatggcggcgccaactgccagttcctgctccctgagccaccaccagacctcatagtggcggcccagggcgggtccttcccctgggtggctgtgtgtgccggggtggtgcttgtcctcctgctgctgctgggctgtgctgctgtggtggtctgcgtccggctgaagctacagaaacaccagcctccgcctgatccttgcgggggagagacagagaccatgaacaacctagccaattgccagcgtgagaaggatgtttctgttagcatcattggggctacacagatcaagaacaccaacaagaaggcggactttcatggggaccatggtgctgacaagagcagctttaaggcccgataccccactgtggactataacctcattcgagacctcaagggagatgaagccacggtcagggatgcacacagcaaacgtgacaccaagtgccagtcacagggctctgtaggagaagagaagagcacctcaacgctcaggggtggggaggttcccgacagaaaaaggcccgagtctgtctactctacttcaaaggacaccaagtaccagtcggtgtatgttctatctgcagaaaaggatgagtgtgttatagcgactgaggtttaaggtggaagtgatgtggcaaagttcccatttctcttaaataaaattccaaggatatagccccgaggaatgctgctgagagaggaaccggagaggaaaccccagggactgctgctgagaaacagactcaggcggagggttcatctcggagttagcagagaaccggacacacccagcccaggattgatgccgctgtactgcctgctggatgttcccgttgcactatggacagttgctttgaagagtataatatttaaatggacgagtgacttgagttcacacaggaagcacgcactgccggacatgtctatcttggattactatgagccagtctaaacttgaactagaaacacaactgccttta

SEQ ID NO: 3931 - DNA, 1518 bp, Rattus norvegicus
  Genbank Accession No. NM_032079
gtcgcgctccttccgctccgccgcctgcttgcgagtgctgccgggcaggccgccatggcgaacgtggccgacacgaagctgtacgacatcctgggcgtccctcccggcgccagcgagaacgagctgaagaaggcataccgaaagttagccaaagaataccatcctgataagaatccaaatgctggagataaatttaaagaaataagttttgcctatgaagtattgtcaaatccagagaagcgggagctatatgacagatatggagaacaaggtctacgggaaggcagcggcgggggtggcggcatggatgatattttctcacatatttttggtggaggattgtttggcttcatgggcaatcaaagtagaagtcgaaatggcagaagaagaggcgaggacatgatgcatccgctgaaagtgtctttagaagacctgtacaatggcaagaccaccaagctgcagctcagcaagaatgtgctctgtagcgcgtgcagtggccaaggtggaaagtctggagctgttcagaaatgcagtgcttgccggggtcgaggtgtgcgcattatgataagacagctggctccagggatggtacagcagatgcagtctgtgtgctctgactgtaatggagaaggagaggtcatcaatgaaaaagaccgctgtaaaaaatgtgaaggaaagaaggtgattaaagaagtcaagattctggaagttcatgtagacaaaggcatgaaacatggacagagaattacgttcactggggaagcagaccaggctccaggagtggaacctggagatattgttcttttcgtacaggaaaaagaacatgaggtgttccagagagatgggaatgatctgcatatgacatataagataggacttgttgaagctttgtgtggatttcagttcacatttaaacatcttgatgctcgtcagattgtagtgaaatacccccctggcaaagtaattgaaccaggatgtgttcgtgttgttcgaggcgaaggaatgccacagtatcgtaatccctttgaaaagggtgatctttacataaagtttgatgtgcagtttcctgaaaacaactggatcaacccagacaaactttctgaattagaagatctcctgccatctagaccagaagttcctaatgtaattggggagacagaagaagtagagcttcaggaattcgatagcactcgaggctctggaggtggtcagaggcgtgaagcctacaacgacagctctgatgaggaaagcagcagccatcatggacctggagtgcagtgtgcccatcagtaaactgcaggcaactgcacggtggattttctccacatttgccggatttgccagctgctggagtacctggatgagtccagatgaactgatggacatctgctgatctatgtgtaacttctaaacttggtatagtatcacagagtgtataatttaaactaaccacggagctttacgtcttcatttcgactgtctatagcagagtaaagcacttgaaataagactcccttt

SEQ ID NO: 3932 - DNA, 1525 bp, Rattus norvegicus
  Genbank Accession No. NM_032080
ggccaagagaacgaagtcttttttttttttttcttgcgggagaacttaatgctgcatttattattaacctagtaccctaacataaaacaaaaggaagaaaaggattaaggaaggaaaaggtgaatcgagaagagccatcatgtcggggcgaccgagaaccacctcctttgcggagagctgcaagccagtgcagcagccttcagcttttggtagcatgaaagttagcagagataaagatggcagcaaggtaaccacagtggtggcaactcctggacagggtcctgacaggccacaggaagtcagttacacagacactaaagtcattggaaatgggtcatttggtgtggtatatcaagccaaactttgtgactcaggagaactggtggccatcaagaaagttcttcaggacaagcgatttaagaaccgagagctccagatcatgagaaagctagatcactgtaacatagtccgattgcggtatttcttctactcgagtggcgagaagaaagatgaggtctaccttaacctggtgctggactatgttccggaaacagtgtacagagtcgccagacactatagtcgagccaagcagacactccctgtgatctatgtcaagttgtatatgtaccagctgttcagaagtctagcctatatccattcctttgggatctgccatcgagacattaaaccacagaacctcttgctggatcctgatacagctgtattaaaactctgcgactttggaagtgcaaagcagctggtccgaggagagcccaatgtttcatatatctgttctcggtactacagggcaccagagctgatctttggagccaccgattacacgtctagtatagatgtatggtctgcaggctgtgtgttggctgaattgttgctaggacaaccaatatttcctggggacagtggtgtggatcagttggtggaaataataaaggtcctaggaacaccaacaagggagcaaattagagaaatgaacccaaattatacagaattcaaattcccccaaatcaaggcacatccttggacgaaggtctttcggccccgaactccaccagaggcaatcgcactgtgtagccgtctcctggagtacacgccgaccgcccggctaacaccactggaagcttgtgcacattcattttttgatgaattacgggacccaaatgtcaaactaccaaatgggcgagacacacctgccctcttcaactttaccactcaagaactgtcaagtaacccacctctggccaccatccttatccctcctcacgctcggattcaggcagctgcttcaccgcctgcaaacgccacagcagcctcagatactaatgctggagaccgtggacagaccaataacgccgcttctgcatcagcctccaactctacctgaacagccccaagtagccagctgcgcagggaagaccagcacttacttgagtgccactcagcaacactggtcacgtttggaaagaaaattaaaaagaggaaaacaaaaacaaaaacaaaaaacccc

SEQ ID NO: 3933 - DNA, 2309 bp, Rattus norvegicus
  Genbank Accession No. NM_032083
ggcacgaggacactgatgagcagagaagaaagctttcagcaatgtgtcatttgtcacaattgtcaggctttttaaaaaaggactcccaaagagagatgctgcatgttttctgtgttaacacagactgatttcctctccagactctttaagtttgcagaagcttaaatatagagccctgtttaaaaaaaaaaaggaagagagaatttgtgtgttaatcggccttgtgaagaagtgcttcatcacccttctgcacctccctgtgctctggtgtgtggcgtggccacggctctctaggttagggctctgagctggctgcagcatgctcatgtgttagctgagtagagttcaccggcagtcgcaggctgatacagggttttttgttttttgttttttgtttttctattcctttgagtatcaaaatgccatccaaagagtcctggtcggggaggaaaactaatagagctacagttcacaaatcaaaccaagagggccgtcagcaagatttattgatagcagccttgggaatgaaactgggttctcaaaagtcgtctgtgacaatctggcaacctctgaaactctttgcttattcgcagttgacatcacttgttagaagagcaactctgaaagaaaatgaacaaattccaaaatatgagaaggttcacaatttcaaggtgcatacgttccgagggccacactggtgtgaatactgtgccaacttcatgtggggcctcattgctcagggagtgaaatgtgcagattgtgggttgaatgttcataagcagtgttccaagatggtccccaatgactgtaagccagacctgaagcacgtgaagaaggtgtatagctgtgacctgacaacactcgtgaaagctcacatcaccaagaggcccatggtggtagacatgtgcatcagggagatcgagtccagaggtctgaattctgaaggactctaccgagtgtcgggatttagtgacctaattgaagacgtcaagatggcttttgatagagacggtgaaaaggcggatatttctgtgaacatgtatgaggacatcaacattatcactggagcgcttaaactgtacttcagggatctgccaattcctctcatcacctacgatgcctaccccaagttcatagagtctgccaaaattgtggaccctgatgagcaactggagacccttcatgaagcactgaggtctctgccgcccgcccactgcgagacgctccggtacctcatggcacacctcaagagagtgacccttcacgagaaggagaatctgatgagtgcagagaaccttgggatcgtgtttggtccaaccctcatgagatcaccagagctagaccccatggccgccctgaacgacatacgctatcagagactggtggtggagctgcttatcaaaaatgaagacattttattttagagttttgacttgaggagaaaaagaaatggtttacagatgaaggaatgttttctagtaatttaattagcttcattagctgaattgtttcttggttagaggtttggccaaatacccagattaaaatgaaggaacttcctgtcatttctctagcaccgctcagccgtccttgtaaaaccgtgaacacacgctttctggtcctggtaatcctgggtgtttatcatgttaagagaaactcaagctactgcatgattacccctttttggtgaggaaaccccatattgaagaatcacagacttgttcctgcaccatctctctgtcctgggttgtctgtggttgtcacccagcatgcttcccagagtaaactgtcatgacattgcttttggggtccataccactggtttctgacgcttgcacatgcgcacacgtgcacacgtactcacacacacacacatgcacatacacatacacacacatacacaccacacacacaccacaaacacacacacaccacaaacacacaaacacactcacaccacaaacacgcacacacacaccacaaacacactcacaccacaaacacgcacacacacaccacaaacacactcacacacacacagacacacacgtataagcagcaccctggctgttgcactctcatccctgtaccatacgccagctccacagcagttccttcccagcttcctcctctcagacatagtgctttgtcttcagcagaagcgagacgtgttttcagatgttacttcagtaagcttccaataaaaatgcaccacacagcactttcctgttaaattattggttttcaactgtaaatttatatttttacctggcatgcagttattaatttattaaatttggcctcgtgcc

SEQ ID NO: 3934 - DNA, 1889 bp, Rattus norvegicus
  Genbank Accession No. NM_032416
gctttatctgctaagctccgctcagttcagcatgctgcgcgccgcactcagcaccgcccgccgtgggccacgcctgagccgcctgctgtccgccgccgccaccagcgcggtgccagcccccaaccagcagcccgaggtcttctgcaaccagatcttcattaacaatgagtggcatgatgctgtcagcaagaaaacattccccaccgtcaacccttccacgggggaggtcatctgccaggtagccgaagggaacaaggaggacgtagacaaggcagtgaaggccgctcaggcagccttccagctgggctcgccctggcgccgcatggatgcatctgacaggggccggctgttgtaccgattggctgatctcatcgaacgggaccggacctacctggcggccttggagaccctggacaacggcaagccttatgtcatctcctacctggtggatttggacatggttctgaaatgtctccgctattatgctggctgggctgacaagtaccacgggaaaaccattcccatcgatggcgacttcttcagctacacccgccacgagcctgtgggcgtgtgtggacagatcattccgtggaacttcccgctcctgatgcaagcctggaagctgggccctgccttggcaactggaaacgtggtggtgatgaaagtggccgagcagacaccgctcactgcactctacgtggccaacttgatcaaggaggcaggcttcccccctggtgtggtcaatattgttcctggattcggccctaccgccggggctgccatcgcgtcccacgaggatgtggacaaagtggccttcacaggttccactgaggttggtcacctaatccaggttgccgccgggagcagcaatctcaagagagtaaccctggaactggggggaaagagccccaatatcatcatgtcagacgctgacatggactgggctgtggaacaggcccactttgccctgttcttcaaccagggccagtgctgttgtgcgggctcccggaccttcgtgcaggaggatgtgtatgatgaattcgtggaacgcagtgtggcccgggccaagtctcgggtggtcgggaaccctttcgacagccggacggagcaggggccgcaggtggatgagactcagtttaagaagatcctgggctatatcaagtcaggacaacaagaaggggcgaagctgctgtgcggtgggggcgccgccgcagaccgtggttacttcatccagcccaccgtgttcggagacgtcaaagatggcatgaccatcgccaaggaggagatcttcggaccagtgatgcagatcctcaaattcaagaccattgaggaggttgtggggcgagccaataattccaagtacgggctggctgccgctgtcttcacaaaggacctggacaaggccaattacctgtcccaagctctgcaggctgggactgtgtggatcaactgctacgatgtgtttggggcccagtccccatttggtggctataagatgtcggggagcggcagggagctgggcgagtatggcctgcaggcctacacggaagtgaagacggtcaccgtcaaagtgccacagaagaactcgtaaagtggcgtgcaggcttcctcagccagcgcccaaaaacccaacaagatcctgagaaaagccaccaccaagcacactgcgcctgccaagagaaaaccccttcaccaaagcgtcttgggccaagaaagtcaggatttgataaacagggcagggttggtgggcggtgtgtggggagcatcccagtaaactggggaagggaggagctctgtgcagactaccacgcgcacgcacacacgctcactgggtccttctgtgctggatgctggttccaccctcagtgcttaaacaaatgagcaataaa

SEQ ID NO: 3935 - DNA, 1089 bp, Rattus norvegicus
  Genbank Accession No. NM_032614
gcggccgctccagcatggcggcgggggcggctgaagcagccgaggcggccgtggcagtggtggaagtcggctctgcccggcagtttgaggagctactgcgcctcaaaaccaagtcactccttgtggtccatttctgggcgccatgggctccacagtgtgtacagatgaacgatgtcatggcagagttagctaaagagcatcctcatgtttcatttgtgaagctggaagccgaagctgttcctgaagtatctgaaaaatatgaaattagttctgttcccaccttcctgttcttcatgaagggaacacctcaggaaccacgctgtggttttagcaagcagatggtggaaatccttcacaaacacaatattcagttcagcagttttgatatcttctcagatgaagaagttcgacaggggctcaaaacatactctaattggcccacctatcctcagctctatgtttctggagagctcataggaggacttgacataattaaggagctggaagcatcagaagaactagatacaatttgtcccaaagcacccaagttagaggaaaggctcaaagtgctgaccaataaagcttctgtgatgctctttatgaaaggaaacaaacaggaagcaaaatgtggattcagcaaacaaattctggaaatactgaatagtactggggttgaatatgagacttttgatatactggaggatgaagaagtgcgtcagggattaaaaacgttctcaaattggccaacctaccctcagctgtatgtgagaggggatcttgttggaggactggatattgtcaaggaactgaaagacaacggtgaattgctacctatactgaagggagaaaattagtgaacgttaagcacggtgtccaaggactgcaagaagtatttaattatcgtggaatagttgatggcttggtcctgcgaagtggactgagagtagaaatgcgacatagtcagctgtgctcaatgtgcttcacaaagttgtgctgaaaaaaacatatgttacattttccatgaagcatagaaggcaataaactccagattcagctaaaaacgaaaaacaaaaaaaaaaaaaaaaaaaa

SEQ ID NO: 3936 - DNA, 1203 bp, Rattus norvegicus
  Genbank Accession No. NM_032615
aggtccggggctccggtccgtgccggtgcaggcgccggcatgtggctgtgggaggaccagggcggcctcctgggccccttctctttcgtgctggtgctgctgctggtggtgacgcgcagccccttcaacgcctgtgtgctcactggcagcctctacctcctgctgcggttcttcagcttcgagccggtgccgtcccgccgggccctgcaggtgctcaagccccgtgaccgcgtgtccgccatcgcccatcgcggcggcagccacgacgcgcccgagaacacgctggcggccatccggcaggcagctaagaatggagcaacaggtgtggagctggacatcgagtttacttctgatggagttcctgtcttgatgcacgataacacagtagataggacaacagacgggtctggccgattatgtgatctgacatttgaacaagttaggaaacttaatcctgcagcaaatcacagactcagaaatgagttccctgacgaaaggatccccaccctgagggaagcagttacagagtgcctctgccataacctcaccatcttcttcgatgtcaaaggccatgcagatatggcttctgctgctctaaagaatatatacatggaatttccccagctgtacaacaacagtatggtctgctcattcttgccggaagtcatctataaaatgagacaaacagatcagaaggtaatcacagccctgactcacaggccttggagcctgagccacactggagacgggaagcctcgctacagcgtcttttggaagcagtctgtgtttgtggtgttggacatcttgcttgactggagcatgcacaatgtcttgtggtacctgtgtgggatttcagccttcctcatgcagaaggattttgtctccccggactatttgaagaagtggtcagccaaaggaatccaggttgttagttggactgtcaatacctttgatgaaaagaattactacgagtcccaccttgggtccagctacatcactgacagcatgctggaaaactgtgcacctcacttctagactccccaggaggaaacacagatgcaaaactgcctggaggccttttgcagggacacgagaacactctgttagcacaagccctgggaatcctgcggctcatactagcaatagccacagttttaccccaagcagaaaccaggcatggcgaccatgctccaaggaaggctc

SEQ ID NO: 3937 - DNA, 1010 bp, Rattus norvegicus
  Genbank Accession No. NM_032617
tcgggtgtttgtggtggggctgcggagtcgccgatcccgccggaagcgccaggacaatggggacccgggacgacgagtacgattacctattcaaagtggtgcttattggggactcaggtgtaggtaagagcaacctgctgtcacgcttcaccagaaacgagttcaacctagagagcaagagcaccattggagtggagtttgccactcgcagcattcaggtggacggcaagaccatcaaggctcagatctgggatactgctggccaggagcgctaccgtgccattacctctgcgtactaccgtggtgcagtgggtgcactgctggtatatgacattgccaagcacttgacatatgagaatgtggagcgctggctgaaggagctgcgggatcatgcagatagcaacattgttatcatgctggtgggcaacaagagcgacctgcgccatcttcgggctgtgcccactgacgaggcccgtgcctttgcagaaaagaacaacttgtccttcattgagacctcagccttggattccaccaatgtagaggaagcattcaagaacatcctcacagaaatctaccgtattgtgtcacagaagcaaattgctgaccgtgcagctcatgatgagtcccctggcaacaatgtggtggacatcagtgtgccacccaccaccgatggacagaaacccaataagctgcagtgctgccagaacctgtgactgccctgcacctccacccagcgtgcgtgcacgtcctcggtccttggccagcccctcaccagtgtcctcccggcccctcccttgtccctctaggacaggctgctcccaccctccaagtgagctccgcctgccagcccgatggcccaggaagagcaggagtccagtggcctctcctgtcctgcctgcttgagagaagctagaagcccccttgcttatgtacctgctcttggatattgtgggcatcttgacagggtagggaggttggtaggatggacaggaccagccagaggtgaggaa

SEQ ID NO: 3938 - DNA, 4422 bp, Rattus norvegicus
  Genbank Accession No. NM_033021
gatcctgggagagtccgacgttcgccggctaacgcaggacaggtcactgaggtccgccaggtgtgtccgccgtttgtttcctgcccctcgccaggttcggtgtccgctgccgaggcccgaggcccttcttccgctgtcggcgcgcccccctgtctcgtttcggccccgccgggacaacgcctggagtcgcagcagccgggtgatcgcgcccgtcatcctctaccaacgtttccaggctgccctgctcgggagtgggtgagaatgaagctaaaggagatagaccgcacagcgatgcaggcgtggagccctgcccagaaccaccccatttacctggccacagggacatctgctcagcagttggacgcgacattcagtaccaacgcttcccttgagatattcgagctcgacctttccgacccgtccttggatatgaagtcctgtgctactttctcctcgtctcacaggtaccacaagttgatttggggacctcataaaatggattccaaaggagatgtttctggagttttgattgcaggtggagaaaatggaaacattattctctacgatccttctaaaattatagctggagacaaggaagttgtgattgcccaaaaggacaagcatactgggccagtgagagccttggatgtaaacatcttccagaccaatttggtggcctctggtgctaatgaatctgaaatctacatttgggatctaaacaattttgcaactccaatgacgccaggagctaaaacacagccaccagaagatatcagctgcatagcctggaacagacaggtccagcatatcttagcatcagccagtcccagtggccgggcaacggtctgggatctcaggaaaaacgagcctattatcaaagtcagcaaccacagtaactggatgcactgctctgggctggcatggcaccctgatgtcgctactcagatggtccttgcttctgaggatgatcgattaccagtggtccagatgtgggatcttcgatttgcttcctctcccctccgggttctggaaaatcatgccagggggattttggcaattgcttggagcatggcagatcctgaattgttgttaagctgtggaaaagatgctaagattctctgctctaaccctaacacgggagaggtattatatgaacttcccaccaacacacagtggtgctttgatatccagtggtgtcctcggaatcctgccgtcctgtctgccgcttccttcgatggtcgcatccgtgtctactccatcatgggagggagcatagacggcttaaggcagaaacaagttgacaagctttcgtcgtcttttgggaatcttgatccgtttggcacaggacagccgctccctccattacaaatcccacagcagacttcacagcacagcatcgtgctgcccctgaagaagccgcccaagtggatccggagacctgtgggcgcctccttctcattcggagggaagttggtgactttcgagaacgttacagggcagcctcagcagggagctgagcagccacggcggcagcccgtgttcatcagtcaggtggtgacagaaaaggacttcctcagccgctcagagcagctacagcacgtcgtcgagtctcagggctttatcagttactgccagaaaaagatcgatgcgtcccagactgacttcgagaagaatgtgtggtccttcttgaaggtaaagtttgaggaggattctcgtgggaaataccttgagcttcttggatatagaagagaagatctgggagagaagattgctttggccttgaacagagtggacggatccgatgtggctcttaaggactctgaccgcgtagcgcagagtgatggggaggagagccctgccgaggaagggcagctcctgggagagcgcattaaagaggaaaaacaggagtgtgactttctgccctcggctggcggtgggacctttaacatctccgtcagtggggatattgatggtttaattacccgggctttgctgaccggcaattttgagagcgcagttgacctttgtttacacgataaccgaatggctgatgccatcatattagccatcgcaggtgggcaggagctcttggctcaaacgcagaagaaatactttgcaaaatcccaaagcaagattaccaggcttatcactgcggtggtgatgaagaactggaaggagattgttgaatcctgtgatcttaaaaattggagagaggctttagctgcggtcctcacttatgctaagccagatgagttctccgccctgtgtgatctcttgggagccaggcttgaaagtgaaggagacagcctcctgcggactcaggcctgcctctgctatatctgtgccgggaatgtagagagattagttgcttgttggaccaaagctcaagatggtagcaaccccttgtctctccaggatctgattgagaaagttgtcatcctccgaaaagctgtacagctcacgcaagccctggacacgaacactgtcggggctcttctggccgagaagatgagtcagtatgccaacttgttggcagcccagggcagcattgccgcggccttggcgtttctgcctgacaacaccaaccagccagatatcgtgcagctgcgtgacagactctgcagagctcaaggcaggtctgtgccggggcaggagtcctctaggagctcctacgaggggcagccgctgcccaagggcgggcccgggccgtttgctggtcacccgcaggtgtccagagttcaaagtcagcaatattatccccaggttagaattgcccctactgtcactacctggagtgacagaactcccactgccctccccagccatccacctgcagcctgtccctctgacacacagggagggaatcctccacctccaggtttcataatgcatggcaacgttgttccaaatagccctgccccactgccgacgtctccaggccacatgcacagccagccaccaccttatccgcagccgcagccttaccagccagcccagcagtattccttgggaacaggggggtcagcagtttatcgacctcaacagcctgttgctcctcctgcttctaagcgttaccctaacgccccatacgtatctcctgtcgcttcctactccgggcagcctcatatgtacacagcacagccagcctcctcccctacctccagctctgctcctcttccccctcccccttcctctggagcgtccttccagcatggcggaccaggagctccaccgtcatcttcagcttatgcactgcctcctggaacaacaggtacaccgcctgctgccagtgagctgcctgcgtcccagagaacaggtcctcagaatggttggaatgatcctcccgctttgaacagagtaccgaagaagaagaagctgcctgagaacttcatgcctcctgtccccattacgtcaccaatcatgaaccctgggggagatccccagccacaggggctgcagcaacagccttcagcttcagggccacggtcaagccacgcctccttcccgcagccgcacctagccggcggccagcccttccacgggatccagcagcctcttgctcaaacaggcatgccaccgtctttctcgaagcccaacactgaaggggcccccggcgctcccattgggaacaccatccagcatgtgcaggctctgccaacagaaaaaattaccaagaagcctattccagacgagcacctcattctaaagactacgtttgaggaccttatccagcgctgcctctcctcagctacagacccccaaaccaagaggaagctggacgacgccagcaaacgcctggagtgtctgtacgacaaacttagggaccagacactttctccaacaatcatcagcggtctccacagcattgcgaggagcattgagacgaggaactactctgaagggttgaccgtccacactcacatcgtcagcaccagcaacttcagtgagacctcagccttcatgccagtcctcaaggttgtgctcagccaggccagtaagctgggcgtctgagacagctgccatgacctccgactccgccacttctccaaagaaagccatgctaagactgggaccagcccctcattagcatgtttccatggcacccgccacccaggagctttgacatttctgcaggcaaactcccctagaactgcttgaaccccccctcccaccccgcccgtgctttcctttgttttaatcccctcgcccattatgattttcccattctgcaaatagtgtctttcctggattacacatagtgtggtttcctgagggattctgacaaaatgtggtttttaaaacttgggtgtactttttaggaaaattgcatctggctgtgtataaaacagacctaaaatagatttctttaatgtcttccctaccttcttcacgttcatcagattaaagttgtaatcccatctt

SEQ ID NO: 3939 - DNA, 3257 bp, Rattus norvegicus
  Genbank Accession No. NM_033096
ggcacgagcgctgctcaatggcggaaaagccgctggtactctgaccgcctggtcccccctggcagttgcgggggagtttcctgccggcgcggctggagtctctgtttctctgtgtccggtggctggaagatgctccagagagatcaggctgcggcggaggaggtggcggcggccgagtcggcagcggcgctgggttggagagaaggcggcggcggcggcgtgaggggccggacggtgtaaacagctcgggcggcggcggtggccgagcccccgagggcgaagcggcggcggaggcggtgtcgcgtctcgggagaaagccgggggccgcgggcggctgtgcggcgggcaagcccgcgagaccttgccttccaccttcgccccagattcgttactaaacatgggtgcatttttggataaacccaaaactgaaaagcacaatgctcacggtgcagggaacggtctgcgttacggtctgagcagtatgcaaggatggagagtagaaatggaagacgcacacactgctgttgtgggaattcctcacggcttggaggactggtcgttttttgcagtctatgatggtcatgctggatcccgagtggcaaattactgttcaacacatctattagaacacatcactaccaatgaagactttagggcagctgacaaatcaggctttgctcttgagccgtcagtggaaaatgttaagactggtatccgaactggctttttgaaaattgatgaatatatgcgtaacttttcagacctgaggaacgggatggacaggagcggctctaccgcagtgggcgtgatgatttcaccgacacacatctactttatcaactgcggtgactcgagagctgttctatgtaggaatggacaagtctgcttttctacccaggatcacaaaccttgtaatccaatggaaaaggagcgcatccaaaatgcaggaggcagtgtaatgatacagcgtgtgaatgggtcgttagcagtgtctcgtgctctgggggactatgattacaagtgtgttgatggcaagggccccacagagcagcttgtttctccagagcctgaggtttatgagattctaagagcagaagaggatgaatttgtcgtcctggcttgtgatgggatctgggatgtgatgagcaatgaggagctctgtgagtttgttaactctaggcttgaggtgtcagacgacctggagaatgtgtgcaattgggtagtggacacttgtttacataagggaagtcgagataacatgagtattgtgttagtttgctttgcaaatgcccccaaggtctcagatgaagccgtgaaaagagatttagagttggacaagcacttggaatcacgggtggaagaaatcatgcagaagtctggagaggaaggaatgcctgatcttgcccatgtgatgcgcattttgtctgcagaaaatatcccaaatttacctcccgggggaggcctcgctggcaagcgcaatgttattgaagctgtttatagtagacttaatccaaacaaagacaatgatgggggcgctggcgatctagaagactcattggtagccttataaccttctaaatgcttttgattctgaaaattgggggaaaacttttaatcatattttcttcaatacaaggggaactattcttgtgaattcccactgttttgtggtatgagcagaagccattagcatttcccaccatttgctcatgtttgtacttcccagtaatcgccactcttagcactgcctggactcaacagtattctcgccagcctcaggcctctgcttacaactgtattgaatttttggccctagaaaaacaaaatgaccctacaaatcaacaagtgtgcctgaggtgcatgggaatatagttagctatactctgaagatacgttaagggtttgtttgtttggttgttttttaaaagcaaaacaaaacaacaacatagaagcatgtaagagtaaaggattgcaagagaagttcagtttttcagtttactaagttggaagcctttcgttagttctgtggcttggaatttcatttgagcaatatactataggatatgtatttattattaattgttatttaatttttttccaatttacttgtattaccaaattgggttctccaataatgtaacattgccttgcttcaagatccattgtttggcaataatataaacccttaaagatttccgcatgtgtctgctacatcgttcagatcttactagaagatcttttgaaaccaagtgagttaatttaaggctatttataatttgctttgtcatcttactggcttcgcattattttaattgatgagatttacctttataatgtaaattgtaatcttcttgttttacatgtggatttctatagttttaattttttcagcttttaagatacaagttttatgtaatttggtataatttttaactgtttatgttattttaaaagctcagaatatcacatcaaaatactataaatacattttaaagtatctattttagatctaaggaaatacagagatattttcatgggttcagtaacctttcattttataacattgggcacggtacagagtggctgtcacatcggtacttaaattatttagttctatttttacaataactttaaattttttaagttttgcatgtattgaatttagtgctgaacatgaagagtaaactatttaccaaaaagaagttcctggagtttggagaagtaacgaatgtatccatctgtacatgatttacatgttgtggatgctttgtaaacatttccccatgttttaattgtgtttcagcaggttgtaattgcctctgtgtgtagctgaacatgagtcattatctggtcctgtatgaaatggaatgtatggtattttctgtatcattttcctgaggctgtgtttggggagccacacattcgaatacagttttcctgatcacttgatttcttgtgcacctgatttttgctctcaaaggaattactgccacaatatattttatttattctttagattttagccttgtcagttgaagtgcttcacatgatggtgttaaaaactacttgtccctttactgggggtttgggggttgttaaaagatggggaggaagaatgcaaatgggtcattgttaacctgtccccactgatcccacctgtactcatagtcccttccaggatggtattctgatgtttcctacaatacggtgaccataggcaacttgttacctgaataaaggatcgattttaaacagcc

SEQ ID NO: 3940 - DNA, 620 bp, Rattus norvegicus
  Genbank Accession No. NM_033234
tgcttctgacatagttgtgttgactcacaaactcagaaacagacaccatggtgcacctgactgatgctgagaaggctgctgttaatggcctgtggggaaaggtgaaccctgatgatgttggtggcgaggccctgggcaggctgctggttgtctacccttggacccagaggtactttgatagctttggggacctgtcctctgcctctgctatcatgggtaaccctaaggtgaaggcccatggcaagaaggtgataaacgccttcaatgatggcctgaaacacttggacaacctcaagggcacctttgctcatctgagtgaactccactgtgacaagctgcatgtggatcctgagaacttcaggctcctgggcaatatgattgtgattgtgttgggccaccacctgggcaaggaattcaccccctgtgcacaggctgccttccagaaggtggtggctggagtggccagtgccctggctcacaagtaccactaaacctcttttcctgctcttgtctttgtgcaatggtcaattgttcccaagagagcatctgtcagttgttgtcaaaatgacaaagacctttgaaaatctgtcctactaataaaaggcatttactttcactgc

SEQ ID NO: 3941 - DNA, 1266 bp, Rattus norvegicus
  Genbank Accession No. NM_033235
ctttgctggtgcagagatcggccttgcagtttgcaataatgtctgagccaatcagagtcctcgtgacaggagcagccggtcagattgcatattcgctgctgtacagcattggaaatggatctgtctttgggaaagaccagcccatcattcttgtgctgttggacatcacccccatgatgggtgttctggacggtgtcctgatggagctgcaagactgtgcccttccccttctgcaggatgtcattgcaacagacaaagaagaggttgccttcaaagacctggacgtggctgtccttgtgggctccatgccaagaagggagggcatggagaggaaggacctactgaaagccaacgtgaagatcttcaaatcccagggcgcagccttggagaagtacgccaagaaatcagttaaggtcattgttgtggggaacccagccaatacaaactgcctgacggcctccaagtcagcaccatcgatccccaaggagaacttcagttgcctgactcgattggaccacaaccgagcaaaatctcaaattgctcttaaactcggtgtaaccgctgatgatgtaaaaaatgtcattatctggggaaatcattcatcaacccagtatccagatgtcaatcatgccaaggtgaaattgcaaggaaaagaagttggtgtgtatgaagccctcaaagacgacagctggctcaagggagagttcatcacgactgtgcagcagcgtggtgctgctgtcatcaaggctcggaagctgtccagtgccatgtctgctgcgaaggccatctcggaccacatcagagacatctggtttggaaccccggagggcgagttcgtgtcgatgggcgtaatctctgatggcaactcctatggtgtccctgatgacctgctctactcgttccctgtcgtgatcaagaataagacctggaagtttgttgaaggcctccccattaacgacttctcccgtgagaagatggacctgacagcaaaggagctgaccgaggaaaaggaaacggcttttgagtttctctcctccgcatgactacacagtcgtgttgacgtcagcagacatcccaaggctgaggaatcaaaatgtcgtctttgagcctagtaccaaacagtaataatggtacattcagattgtgaacagcaaaatattttaaatattatgtgctttgtgattcgtgaaagtctatcacgttgttagtgctgcgatctaaataaaagtatattcaagtgaaaaaaaaaaaaaaaaaaaaaaaaaa

SEQ ID NO: 3942 - DNA, 1403 bp, Rattus norvegicus
  Genbank Accession No. NM_033236
gggcttgcggcttctaaaatgccggattacctaggtgcagaccagcggaaaaccaaagaggatgagaaggacgacaagcccatccgagctctggatgaaggggatatcgccttgttgaaaacttatggccagagtacttattcgaggcagatcaagcaggttgaagatgacattcagcaacttcttaaaaaaattaatgagctcactggtatcaaagagtccgacactgggctggcccctccagccctctgggatttggctgcagacaaacagacacttcagagtgaacagccgctacaggttgcaagatgtaccaagataatcaacgccgattcagaggacccgaaatacatcatcaacgtgaagcagtttgccaagttcgtggtggatctcagtgatcaggtggcacctactgacattgaggaagggatgagagtcggcgtggacagaaataaataccaaattcacattccactgcctcctaagattgacccaacagttaccatgatgcaggtggaggaaaaacctgatgtcacatacagtgacgttggtggctgtaaggaacagattgagaaattgcgggaagtggttgaaacccctctactccatccagagaggtttgttaaccttggaatcgagcctccgaagggtgtgttgttatttgggccaccaggcacaggcaagaccctctgtgccagggcagtggccaatcggactgatgcttgcttcatcccagttatcgggtctgagcttgtacagaagtacgtcggtgagggggctcgaatggttcgggagctttttgaaatggccaggacaaaaaaagcctgccttattttctttgatgaaattgatgccattggaggggctcggtttgacgatggcgctgggggtgacaatgaggtgcagaggaccatgttggagctcatcaatcagctggatggctttgatcctcggggcaacatcaaagtgctcatggccactaaccgacctgatactctggacccagcgctgatgaggccagggaggctggacagaaagattgagttcagcttacctgacttagagggtcgaacgcacatctttaagattcatgctcgctcaatgagtgtggaaagagacatccgatttgagctactagcccgcctgtgtccaaacagtactggagcggagattagaagcgtttgcacagaggctggtatgtttgcaatccgagcccggagaaagattgctacagagaaggacttcttagaagctgtaaataaggtcatcaagtcgtatgccaaatttagtgctactccccgctacatgacatacaactgagccacagaggctttgactgaaggaacttcctgtgcgttcataacttgttaccgcctcacaaaaataaaagacttaaaaactgt

SEQ ID NO: 3943 - DNA, 783 bp, Rattus norvegicus
  Genbank Accession No. NM_033349
atgaagatcgaactactgcctgccctgaccgacaactacatgtacctgatcattgatgaggacacccaggaggccgccgttgtggacccagtgcagccacagaaggttatagaaactgtgaaaaagcaccgtgtgaagctgaccacagtgctcaccactcaccaccactgggaccacgctggtgggaacgagaagttggtgaagctggaacctgggctgaaggtttatggaggtgatgaccgcattggggccttgacccacaaggtcacacacctttccacactggaggtggggtctctcagtgtcaaatgtctgtcaacaccctgccatacttcagggcacatctgttactttgtgagcaagcctggtagctcagagccttctgctgtgttcacaggtgacacattgtttgttgctggctgtgggaagttctatgagggaaccgcagacgagatgtacaaggcgctgcttgaagtcttaggccggcttcctccagacacaaaagtcatctgtggccatgaatacaccgtaaacaaccttaagtttgcgcgccatgtggagcccggcaataccgccgttcaagagaaactggcctgggccaaggagaagaatgccatcggggagcccacggtgccatccaccctggcagaggagttcacttacaaccccttcatgagagtgaaggagaagaccgtgcagcagcacgctggagagaccgaccctgtgaccaccatgagggccatccgcagggagaaagaccagtttaaggtgcctcgggactga

SEQ ID NO: 3944 - DNA, 1552 bp, Rattus norvegicus
  Genbank Accession No. NM_033351
tcagttctgtaattaattaactaacgtggatcaaatgagaaggtgaaagttcacacaggagcactcctgtcgtcttggactgggtctccatcccaccatccagtgccctggtctacgaagagtccacagggaccttgtgaagaatcaacaaggcggggtccagaggagtcacgtgtgccttccactccgggtcgccctgtcaggatggggatgtcccagcccggggtcctcctcagcctcttattggtcctcctgcctcagacctggggagcggagccccgtctcccactgatgtatcatcttgcagctgtgtctgacttatcaacggggcttccctctttctgggccacgggctggctgggtgctcagcaatatctgacctacaacaacctgcggcaggaggctgacccctgtggggcctggatatgggaaaaccaggtgtcttggtattgggagaaggagaccacggatctgaaaagcaaagaacagctcttcttggaggccatcaggaccctggagaaccaaataaatgggaccttcacactgcagggcctgctgggctgtgaactggcccctgataattcttcattgcccacggctgtgtttgccctcaatggtgaggagttcatgcggttcaacccaagaacgggcaactggagtggggagtggccggagacagatatcgttggtaatctgtggatgaagcaacctgaggcggccaggaaggagagcgagttcctgctaacttcttgtcctgagcggctgctaggccacctggagaggggccgtcagaacctggagtggaaggagccgccatctatgcgcctgaaggcccgtcctggcaactctggctcctcagtactgacctgtgctgctttctccttctacccgccggagctcaagtttcgattcctgcgcaatgggctagcctcaggctctgggaattgcagcactggtcccaatggtgatggatctttccatgcatggtcattgctagaggtcaaacgtggagatgaacaccattaccaatgtcaagtggagcatgaggggctggcccagcctctcactgtggacctagattcgcccgccagatcttctgtgcctgtggtcggaatcattcttggtttattgctggtggtagtggccatcgcagggggtgtgctgctatggaacaggatgcgaagtgggctgccagccccatggctttctctcagtggtgatgactctggcgacctattgcctggtgggaacttgcccccggaggctgaacctcaaggtgtaaatgcctttccggccacttcctgatgccaacccaggccccatacccattgcagcctgtggggctgtgtgacctcctgaactgtctctgagcctcccgagggagccctgggctggatgtcctcctcgtggatcccttcttttgtggcctgcttcagtttcccctcttaatgtcaatggctatttccatctccacataaatttgggcccaaatctgtgtgtgcatcgttattctcaggtttcaggcagccggaataaattgaacaagtttgag

SEQ ID NO: 3945 - DNA, 5531 bp, Rattus norvegicus
  Genbank Accession No. NM_033352
  misc_feature (1)..(5531): n = a or c or g or t
gagggactcgcccccggtggatgcggtggagtttgagctttttgctgcatccgtccctgaagaacaaaataagagtaagggagacaagctgcagagcatgggaggctgtggggttttctgaaacgtttgctgggctctccgcggagcatgagcttttaaaaggagttctttggagagaaatccatttgtgttagctggaaaaatgatacacatgctaaatgcagcagcctatcgggtgaaatggaccagatccggtgctgctaaaagggctgcctgcctggtggctgcggcatatgctctgaaaaccctctatcccatccttggcaggcgtttaaagcagcctggccaccggaaggcgaaagcagaagattacccgcctgcagagaacagagaaagactgcattgcacagagatcatctgtaaaaaacctgcgccgggactaaatgcagattttttcaaacagctactagaacttcggaaaatcctctttccaaaacttgtgaccactgaaacggggtggctctgcctccactcggtggctctaatctcacgaacgtttctgtctatctacgtggctggtctggatgggaaaatcgtgaaaagcatcgtggaaaagaagcctcggactttcatcatcaaactagtcaagtggcttatgattgccgtccccgctacctttgtcaacagcgctatcaggtacctggagtgcaaactggcattggcctttagaactcgcttagtggaccatgcctatgagacctattttgcaaatcagacttattataaggtgataaatatggacgggaggctggcaaaccctgaccagtctcttactgaagacattatgatgttctcgcaatcggtggctcacctgtattccaaccttaccaaaccgattttagatgtaattctaacctcctataccctcatccggacagctacatccagaggagcaagccccatcgggcccaccctgttagcagggctcgtggtgtatgccactgctaaagtcctgaaagcttgctcgcccaaatttggtactctggtggctgaagaagctcatagaaagggctacttgcggtatgttcactccagaatcatagccaatgtggaagaaattgccttctacagaggacataaggtagaaatgaagcaactgcagaagtgttacaaggctttagcttaccagatgaaccttattctatccaaacgtttgtggtacatcatgatagaacagttcctgatgaagtatgtgtggagcggctgtggactaattatggtggccatacctatcatcactgcaacaggctttgcagatggtgatctggaggatggccctaagcaggctatggttagcgatcggacagaggcctttaccactgctcggaatttactggcctctggagctgacgcgattgagaggattatgtcttcatacaaagagatcactgaactagcgggttatactgccagagtgtacaacatgttctgggtcttcgatgaagtgaagagaggcatttataagagaactgtcactcaggagcctgaaaacaatagcaagagtggaggtggcctggagctgcccctcagtgacaccctggcaatcaaagggacagtcattgacgtggatcatggaatcctttgtgaaaatgttcccataatcacgccggcgggagaagtggtggcttccagtctgaacttcaaagtagaagaagggatgcatcttttgataaccggccccaatggttgtgggaaaagctctctgttcagaatcttaagtgggctctggcctgtgtatgaaggagtcctttataaaccacctccccaacatatgttctatattccacagaggccgtacatgtctcttggaagtcttcgggatcaagtcatttatcctgactcggtggatgacatgcatgagaaaggttatacagaccgagacctagagcatattctgcacagcgtccacctctaccacatagtccaaagagaaggaggatgggatgcagtcatggattggaaagatgtcctttcaggaggggagaaacagagaatggggatggcacggatgttttaccataaaccgaagtacgcattgctggacgagtgcaccagtgctgtgagcattgacgtggaaggaaagatatttcaggctgctatcggggctggcatttccttactgtctataacgcacaggccttctctgtggaaataccacacccacctattgcaatttgatggcgaaggaggttggcgctttgaacagttggacactgctatccgcttaacgttaagcgaggagaaacagaagttggagtcgcagctcgctggaattcccaaaatgcagcagagactcaatgaactgtgcaaaattttgggggaagactcggtgctgaaaacgatccaaactgcagaggacacatcctaactgaccttgacatgttttaagttaacttctaggtgatgcctcagagactctttctttactgcatgcagtatgttaagctaagtgaagagaaagcaagccagcaaaaaaaaaaaaaaaagtattttgtatgatttcagcatcgaggaaatatgataactttttcgaatgaaaaaaaaagcgaacgaattagttgcggttagtcatgactcaggttagtgccccgtgagaggctagctcacctgtaaagtgggtttctagattaggagagtgtgtgtggttcttcctaggagagaatgccccaaaacaagacagcaggggcaccagctgggccgatgtcaggaattagacctttgagggctctttcaacccaggtaacggggacaataggtgcaacacctggaatctatagtcagcattgctaggggccaactcaaactgtgtacaaagtagcaggctgtttgatacatagtttcagtctgaaaagggtgtatccgaatgacagtggttgaaaacaagcacggctagacaagtataaagtactgtattaaattttttcataccttgagcatcttaatacagatacagaaattaacattaataaaaattgtgtgtatgtgtttaaaaaaaaacccttttatgttttaaaaagagaattgcccatacagaagaggacggtctgaacgatatttgttctggctaccgcttgactctgcagtcctatttagtacggtttctgtccagaaatactgtctgtctggtgcccaaaatggcattttagaaacttgattgctgccctaaatatggatcctggaaatcacagttatgttcctacattcattttaccttactccatcttttaagacatacaagtttttgttcctttttcttctgaaacgcgcgcgcgcacacacacacacacacacacacacacacacacacacacacacacagatttactttaatcacatgatttattttggaagagctgtagcgatcatgaaggtctccctcccccacacaccagacccagtgctgtcatcactaatggcccttaaatttaactgggatataatgtcagttttaaaangatgtggaccaggcagatggccagaaatggttgtaggcaaagcagggcataagggaaaaaattaaagcagataaataaatattattcaggcatagaagagtgacagttgcttctcttgtaggggacctgagttccattgccaacatccacatggtggctcaaacgtgtgtctaattccagctccaggggatctgacatacatgtagactccagggatcctgcatacatgtagtcctcatacacacatacatgcagacaaaacattcatagcattaaaaatcaataaatctgaaagatagtaaggatattgaaagctggcaatgttgatgttaccatcacttaattactgtttgcgagaagtgaaaattgagtgagaaatgcaatgggcgttggtcaacgcagctcggctgtgcacacccacctgatgccgaagtgtctgcagtgccagcgctcaggagggcagtacattgcacttccggtaagcttcacgctgctgaagatgacagagaccctcacatcatatgaaatacagtgcatctggagtacaaaaccacgactaatgctttaatctcatcctctctcagacatgacgaggtatgtgaaaacccgagatgaacagttttaggggcttaaggttttgtttctgtattcagacagcgctttagcagacactaactctcgataacagacggtttggaagacagaccccctagaagtcattcacaatgatggtcgtgagaaattgcagcatttccacattttcaattccgcaaaaatctacacaatttgaattaccaatcactgtgaccaccttacacaaaacaatacaaggtcataatcagtacctttgtatttgtctgttactgctacttcttactaataatgtgggacactaatgaaatatttggtttagcaaaagtataaaaccagaaattgacactgaattaaaaaaaaaaacacacaattcactaatctcttaacaaccgtgctagcagttacccaggttatagtgctaaaggagaatcatttgaagcaagggtcttatattagctctgacaagcacaagaggaaaattgaaagttcacatttgaaattataccatttcagacttaaaataaaccatgtaagacctgatatcctacgttttcaagctttgcgaaagatgccaacatcaatgctacattcggaactagaccttatttagtagaggttaccagcgagctggatcgaaataaataagactcgttacacagtggatgggggttcaacgatgtttggaattcggtactaaaactctagtcacgaaatttaaacgttaaggtttcaggactaactgtttcccagtagccttttggtaactactgatttaatgctggatatctttttttttcttttttttctttttttttccagagctggggaccgaacccagggccttgcgcttcctaggcaagcgctctaccactgagctaaatccccaaccccactactgattttctgaactgcctcttctgagccagagtaccctccgtcttagagggagaacccgatgtggatctgtgttgtgtataatctgactctttccaaagtgctcccacgggagaccagagctgatactctgacaggcatacttgtgaaaacacaaagaccactgagacctcttctttgactaggacaaagaataataaggaagacgaaggatagcttcatctgtcaaactactttttttttccttagaaaaggcataaatgtatggagttcgattatttcggggaataactcaaaacctgcattgtgacatccgatctctggagcatgctatggtatgccaagcacccaagcacactgtgttcactcttacagacgagataattgctaaaatcctcttgagtcacaaggtcggtgatcgtacttgaaaaccagcccagttcaccctatgtttacacgggaagagttttcctttgatagcaatttgacttttgacccaaattttggcgtgtcaataaaggtataagc

SEQ ID NO: 3946 - DNA, 2122 bp, Rattus norvegicus
  Genbank Accession No. NM_033485
caggcggcggcggcgggagtcaggagtcgcggcgtgaggggcgcccccgccggcccctctgggaacatggcgaccggcggctatcggagcagcggcagcaccacggacttcctggaggagtggaaagcgaagcgcgagaagatgcgcgccaagcagaaccccgtgggcccgggttcgagcggcggggatccagccgccaagtcccctgcgggaccgctcgcccagactacggccgcggggacctcggaactcaaccacggccccgccggcgcggccgcacctgccgcccccgggccgggcgccctgaactgcgctcacggctcgtccgcgctgccccgcggggctcccggctcccggcggccggaggacgagtgtcctattgccgctggggccgcgggagcacccgcgtcccggggagacgaggaggagccggatagcgccccggagaagggccgcagctcggggcccagcgccaggaaaggcaaagggcagatcgagaagaggaagctgcgggagaagcgccgctccaccggcgtggtcaacatccccgcggcggagtgcttagatgagtacgaagatgacgaagcaggacagaaggaacggaagcgagaggatgctatcacacagcagaacaccatccagaatgaagctgcgagcctcccagatccaggaacctcctacctgccccaggacccgtcgagaacagtcccaggcagatacaaaagcacaatcagtgccccagaagaagaaatcttaaatagatatccccgaacagatagaagtggcttcagtagacacaacagagataccagtgcgcctgctaacttcgcttcaagtagcaccttggaaaagagaattgaagatcttgagaaggaagtcttgagagaaaggcaagaaaaccttcgacttacgaggctgatgcaagataaagaagaaatgattggaaaactcaaggaagagattgatttgttaaatagagacctcgatgacatggaagacgaaaacgagcaactaaagcaggaaaataaaactcttttgaaagttgttgggcagctgacaaggtagaagacgcaaggctgcctcggtgtgggaaacctgcttttaaaccgcggatgaatgtcatggcgaaggcgcccgtgattcagtgcgctgagagaactgtatatttatttctagaaaacacatggatctcttcttctcaaaatttactctttctcattactagtttttaaaaagtgtaaatccccgtctttcaacatagaagttaacatctttagctattaaaatgataggtgatgcctcttggttctgtgtgatactcagataatatatggttcgaagtagcagccatttgcatatgttttatctatgttagcacatattctccctaaaggaagatgcatagtctttgtttacatgaattcaaatccttgggggagttgcctacagatgccctattactaatgtgtgcgccttccgtgtgctaatgcctactcataaagacgcatctgccgtctcgtcctcccacgggctctcctgattccgagtggtaatagatacactactttgtatagcagtaatcgttcaaaggaaagctattttgcagttatttcatatgttctagttggctaaatataaacttaagaaaatacttgaactgtgttatagtaagtgaaaaattactattttgtgtttgaatattgaaaaaaaatttcagtaacttctgaaaaacagttaatgtatagtttcttatgtaggtactatcattcctttttttttattgctctagggtttactagtaaataatgggatatttaaaaagttgtttattcttcaggcctcaattgtgtacaatttcagtattgaagaagaaaattgatgctgtgaatagcatgtgcttcaaaaatcagaactaaaaaatttttccacacttaaaatatgtacacatacgtcagcatgtgtaagcagagataacacagatatctcagccgattcctgagttggagacaccctgggatgctttttgtcaatagagaatcatcccataaccctaacactgaagattttaaagcaaccatatttgaagatttataaaataaagttgtcttctattaaaaaaaaa

SEQ ID NO: 3947 - DNA, 2563 bp, Rattus norvegicus
  Genbank Accession No. NM_052798
cggaacagtctaagggtgttcactttggggactcagtgagtccccctctgttatggagtacagtgtctcttgaatcttacttctggaaatccacggacaagaagactggtgacctatcgattttgtgatgcccacccctggctcctggttccctctctagaggcagaagagccaggcgcagctaatgggacgctttcggagatgctgcgtctgacaggtgcgaagcaacatgtgcaactcctttcttcttcctcccctcagatcctcctccatcttcacccatctttagaggaagagcctacagaaagaagatggctcctgagcaaagagaaggggcctctcaggtgtcagtgacatttgaagatgtggctgtgctctttactcgggacgagtggaagaagctggatctgtctcagagaagcctgtaccgtgaggtgatgctggagaattacagcaacctggcctccatggcaggattcctgtttaccaaaccaaaggtgatctccctgttgcagcaaggagaggatccctggcaggtggagaaagagggccccagatacttctctctcggattgaagtgcagtcatagaaccactaagtcaactcaaacacaagactcttcatttcaggaactgattgtaagaaaatctaaaagaacctttgccttcgaacctttgaacatgaagtcagaaaatcttttcatacatgaaggcaaattagaggaaaagtgggataagaatactttgactgtagaaagaagccataaaaacaatgaatttagcccaaagtcccatagagaaaaacggtcctcagaatgtaaaaagcagatatcttatttatctaacccaccaggaatcacaccggataaacgctataaatgtagcatgtgtgagaaaaccttcattaacacctcatctcttcgcaaacatgagaaaaaccatagtggagagaaattatttaaatgtaaagaatgttcaaaagccttcagccaaagttcagcccttattcaacatcaaataactcacactggagagaagccttacgtatgtaaagaatgtgggaaggccttcactctcagtacgtccctgtataaacatctcagaacccacactgtggagaaatcctacagatgtaaggaatgtggtaaatcctttggccaaaggtcaggtctttttatacaccagaagatccatgcccgagaaaaccctcatagatataacccaggaaggaaggcatccgcttccctctctggatgccagagagctcattccaggaagaagacctacttgtgtaatgaatgtggcaacaccttcaagtctagctcctccctccgttaccatcagagaatccacaccggagagaaacctttcagatgtagcgaatgcggcagagccttcagtcagagcgcatcacttattcagcacgaaagaatccacacgggagaaaagccctacaggtgtggcgagtgtgggaaaggcttcacttctatctcaagactcaatagacaccggataattcatacaggagagaaattgtataattgcaatgagtgtggcaaagccttaagttcccactcaactcttattattcacgaacgaatccacactggagagaaaccgtgtaaatgtaaagtttgtgggaaagccttcagacagagttcagctctgatccaacatcagagaatgcacactggggaaagaccctataaatgtaatgagtgcgggaaaacattcaggtgtaactcatccctaagtaaccaccagcgaatccacactggagagaaaccttatcaatgtatagaatgtgggatgtcgtttggacaaagttctgctcttattcagcaccgaaggattcacacgggagagaaaccgtttaaatgtaacacatgcggaaagacctttaggcagagctcctcacgtatagcacatcagcgaattcatactggggagaaaccctacgaatgtaacacgtgtgggaaacttttcaactataggtcatcccttaccaatcattataaaatccatgtggatgaggacccttaaaaagtaaatttgcatgtaaaaaagccttaaaccaaagctcttcagagaatgggcttgagagctgtaataaacatactatggcgtccctgtagtcatttagttactgtcaactaaattccatggataaatcctgtgtaacaggtaggagtgaaatattcatgcctgtccaacactttaaaaaaattgcttgaaatccggtggttatgtgtagtcctggctaccggggaccctgaggattgcttgactccacaagtttgaagagcaaatgttatggagctttccatctcagaagattagtgacctgaaatgaagaattcacagctgaaggccttgacttcaggtatttggaaaatggtgcttttctctctgcaacagtgtgtgctagatacaattgtaatcataggcatctaagtgaacagaggagtgggatggacttagcaaaacacaaaactctactgttgtgatacttttatactattttaataatatccaaaagggatcaacacaaatcaaaaaaaaaa

SEQ ID NO: 3948 - DNA, 2807 bp, Rattus norvegicus
  Genbank Accession No. NM_052801
ccgcgttaaagccggacggagtacttctattgctggcagacctgccccggagcgcgtaaacccgcacgctcgcgccgcccacgtccagctcgcgaatccggaggcgtccggttccaataatgccccggaaggcagctagtccagaggaggcagaaaggatgccgggctctgaagagatagaggctgggcggccgcggccggttttacgctctgtgaactcgcgcgaaccctctcaggtcatcttctgcaaccgcagcccgcgcgtcgtgctgcctttgtggctcaactttgatggtgagcctcagccctacccgaccttaccaccgggcaccggccgccgcatccacagctaccgaggtcacctttggctcttcagggatgcggggacccatgatggacttctggttaaccaaacggaactgtttgtgccatccctcaatgttgatggacagcctatttttgccaacatcacattgccagtgtataccctgaaagagcggtgccttcaggttgtacggagcctggtcaagcctgagaactacaggaggctggacatcgtcaggtcgctctatgaagacttggaagaccacccaaatgtgcggaaagacatacagcggctgacccaagagcacctcgagaatcaggccctgggagaggagcctgaaggagtccactgagattacttggtcctgaatttcggccttgatggtctgaaatcgatctacacataggacaggtcactttctttcggttttaaaatggttcattcttggagtaaaatatccatcatgtaaaagaaagttaactaacatcactgagctttgtagtgtttaagactaaacctgcaaagtgccaccgagtctgccctttctagagcattcatcagaagaagctgttttcagttttgcttcctagtaaggctggatgttcagcataaggatgttagtgtgagcgattcgcgaggagttgctctgtgtcctctaatctgaagaatacagcctcgtatgaacagagccccaccgctcacttggggaaggctgagaaggccctaatgctgggatggacatcctgtagaggcccagtgcctaatgtgtgtggagtcttcagtcagtgttggaggaacaaaccattgggtacttagtgggagagttggagggcctggctctctgtctgaggaaatcttaagtgtacacgtaaaggaacaacttagcagcttctgtttagaaagaactttctcttgagtttccatgtctcagcactttctttctactttgttagtttattttattttatttttgagacttgtgtagcccaggtcagcctcagtcactccggaggggatgctggtcttgaattccggatcctctgggagtgtgtcagcattgggagcacatgggtcgaccacagtctgctctgttcttgcttttcccattttgagacgggctcatactgtagccctgcctggcctcaagctagagtcagccctgtctccccacccagtctggctgcttagactgggtgggcttcccatattcactgccccagacagcagagacgagctgtccttgtgtttaggtctggttttgagagttccttctctgaggaagctgctggcaggagcagggtttctgttccttcccgtcagcccctagcattccagctgggcgccgcactctgctttggcaggcgctagttatgcttcgatgggagaggggagtgaagctccctcagccacacactccaaaccatgggtcccagagcagtctgcaatgagtagtagtttgtgggcagtcacagcttttcttacatattcaaatattgatgttcactacttctatcaaacattttgtagaacataattttttatttgtttttaattcctcagcagagaaaaatgagagaagcttgggcattgtgtgtggcacacaccagaaaggacagtcagctgagagggtgcagaaaggctcttgtgcgctggctctcagctgcatgtagtcctgtaacccagtgttctctctagtacacattttaattggttaaagcactttgtcctggccgagatcataaggtatatacagttttgtggcctgatttttcattgaacttcattgttttgttttcccctctttttcgtttttggttttgtttttggtttgttttttgctttttgttttatcaagatagagtttctctgtgtagcccaggctgtcctggaactccctttgtagaccaaacaactgattactggcctcaaacggagatctgtctgcctctgcctctccagtgctgggattgaagtatgcctaatcttcatctaacttagtaacttgtcttttccatgttactgcacacactgtctaaattccggtgtgctagcctctccctttgagggtgactgttgggagtatttgtctcagtcctgggctccttgagtgcagtctgatgctctaagatcagcaaaatcactgaacttaatactgacactcctgccgccctctcagcgtctctccttagtctgcagcattccgtgagtgaagcggcacaggccagtgtggagcctgtgtgtgggaagtcagcaggtgccgagctattgcaacattggttttattttttaagcctatctctgtctctaaaagatgtaatgtttgtcttatttaactggaagtttgaatactgttctctgtgccttaggacatgagtcacttgtccttgcacatcctgtaagtgtgttcctcagactttgtactctcctttgagttctctgaaaaagctgacctttagtacaataaacggtgctaagtgaagga

SEQ ID NO: 3949 - DNA, 2461 bp, Rattus norvegicus
  Genbank Accession No. NM_052806
ccgggacatacgctcactcgcggttccattgtagagtgaccggctgccacccggctggccatgaggggtacgcccctgctcctcgtctctctgttctctctgcttcaggacggggactgccgcctggccaacgcagaggagaagctgatggatgacctcctgaacaaaacccggtacaacaacctgatccgcccagccaccagctcctctcagctcatctccatccgcctggagctatcactgtcccagctcatcagtgtgaatgagcgagaacagatcatgaccaccagcatctggctgaaacaggaatggactgactaccgcctggcctggaacagctcctgctatgaaggggtgaacattctgaggatccccgcaaagcgtgtctggttgcctgacatcgtgttgtacaacaatgccgatggcacctatgaggtgtctgtctacaccaacgtgattgtgcgttccaacggcagcatccagtggctgccccctgctatctacaagagtgcctgcaagattgaggtgaagcactttcccttcgaccagcagaactgcaccctcaaattccgctcctggacctatgaccacacggagattgacatggttcttaagtcgcccacggccatcatggatgacttcacccccagtggtgaatgggacattgtggccctcccaggacggaggacggtgaaccctcaggaccccagctacgtggatgtgacctatgacttcatcatcaagcgcaagccgctcttctacaccatcaatcttatcattccttgtgtgctcatcacctcgctggctatcctggtcttctacctgccctccgactgtggggagaagatgacgctctgcatctctgtgctgctggcactcacgttcttcctgctgctcatctccaagatcgtgcctcccacctcccttgacataccgctcattggcaagtacctcttgttcaccatggtgctggtcaccttttccatcgtcaccactgtgtgtgtcctcaatgtgcaccaccgctcacccagcactcacaccatggcatcctgggtcaaggagtgcttcctgcacaaactgcccaccttcctcttcatgaagcgtcccggtcttgaagtcagcctggtcagggtccctcatcccagccagctgcacttggccacagctgatactgcagccacctctgccttaggccccaccagcccatccaacctctatgggagttccatgtactttgtgaaccctgtccctgccgctcctaagtctgcagtcagctcccacacagcaggcctccccagggatgcccgtctgaggtcctccgggaggttccgggaagatctacaggaagcattagagggtgtcagcttcatcgcccagcatctggagagcgatgaccgagatcaaagtgtcatcgaggactggaagttcgtcgcgatggttgttgaccgcctgttcctgtgggtgttcgtgtttgtgtgtattctgggcaccatggggctcttcctgccaccccttttccagatccacgcaccctccaaggactcctaggctacccggcgtgcctcgggcccgggttgtagtgagatgatatgagaagccgtgtgggaagctgggcgtgtcttggcccgggttgtagtgagatgatatgagaagccgtgtgggaagctgggcgtgtctcgggcccccgggttgtagtgagatgatatgagaagccgtgtgggaagctgactgttccatttgggccatagctaatgaagccctaagtaaagccgtgactattggcaatcagcccatcaaactagccacagccacgagaaggacagagatagatgccttctgctgatccctctgatgccgtccagtaagtccctgaaggaggaggatgaggctgctgaataccagcctggcctccttccttccacgtgccaggcaccggagtcagacagccgtgtatcatgccgtcacaccccagcccgccttcccacccatctccctctgattcgcagctacccactagattcccccaccatctttcatttccatacacttctagattctcccaagtcagaacctttatatcttctactgctaccgtccaaacctcactgtaaactcccaagcttttcacgtggctgcaccagtcagagctctgctccaatgccacttccttgtataagccttcccatgatcctctgctccagtgtcatttccttgtataagccttccctagtcatgcattgcaaagcagtgtctcccataaccacatcaaatctccagcttccttgagtgttccccgtcagtagctgcagcctttagttggtggcacactagtcaccagcaccttgcccataaaagtgtatgctccataagggctgggtgtgtggattcacattcactccagagcttgggacccagctctgcacacagaaggtgcaaaataaatgtttattgaatgaaaaaa

SEQ ID NO: 3950 - DNA, 1458 bp, Rattus norvegicus
  Genbank Accession No. NM_052809
gagggtttaggctggtctccggtgacctcctagtcctaaatcttgatacccttgcaagagctttgagcgtgtggggtcccgggcgttcggggtcccgggtgtgtgcggtttgtatagcctgaagccggggtcctccgcgctcgcgtcctccgcagctggactgaagagacgcgtcccagccctgcggggatggaacggaccgagctgctgaagccccggaccctggccgacctcatccgaatcttgcatgagctcttcgccggggacgaagtcaatgtggaggaggtgcaggctgtgctggaagcctacgagagcaatcctgccgagtgggctttgtatgccaaattcgatcaatacaggtatacccgaaaccttgtggatcaaggaaatgggaagtttaatctgatgattctgtgctggggtgaagggcatggcagcagtattcacgatcacacggactcccactgctttttgaagctgctgcaaggaaatctaaaggagacattgtttgactggcctgacaagaaatccaacgagatgatcaagaagtctgaaagaactttgagggaaaatcagtgtgcctacattaatgattctattggcttacatcgagtagagaacgtcagccacacagagcctgctgtgagccttcacttgtacagtccacctttcgatacatgccatgcctttgaccaacgaacagggcataaaaacaaagtcaccatgacattccacagcaaatttggaatcagaactccatttacaacttcaggttcactggagaacaactaagacctgccaagcctttcaaagttttgcttctgggtcgttggaatgttttaccttggataagagaggccacccatcatttgctgtccagttatacattttaataagtccatgctcagtgtgtatactaaggaagcaaaccatcccctgagctatgcaggagaaaaatcccactaaagaaaaagtcacttgatttttaatagccaaatcaccttgctcccagttcttctgtcttctaactccatggaaattctattgggagttctcagtggggttttttttcaaccttaggaaagcacttctggtctctgaactctaataatcaataagtaaaaatgaagaaaccacaagctatcacatgtctgttttcatacctggaagtctaagtgtggaaatctttaatttactttgtatgttcttaatgtttgacaagaatttttttaaatcttggttttcagttttttcaaccctgtttgacaaattcctatgctgtggagactagggatgcagatagcagtttggtgtttggtagtgaacagcagtggggccagaaatgtgcatgtatccagacctcctgcaaataaaaactgaaactcatgtgtaatgtgtgccaccaccttaagctgccaccaaaattgccaaacgactttaataaaactggatttgaga

SEQ ID NO: 3951 - DNA, 770 bp, Rattus norvegicus
  Genbank Accession No. NM_053288
  misc_feature (1)..(770): n = a or c or g or t
nctcttcctgggccggtgcctctgagtgtcttcggcatggcgctgcacatggttcttgtcgttttgagcctcctgcccttgttggaagctcagaacccagaacctgccaacatcaccctaggcatacctattaccaatgagaccctgaaatggctctcagacaaatggttttacatgggagcagctttccgagaccccgtgttcaagcaggcagttcaaacgatacagacggaatatttttaccttacccccaacttgataaacgacacaattgaacttcgggagtttcagaccacagacgaccagtgtgtctataacttcacccatctaggagtccagagagagaatgggaccttatccaagtgtgcaggagcagtgaaaatctttgcccatttgatagtgctgaagaaacatgggaccttcatgcttgcctttaacctgacagatgagaaccgggggctgtccttctatgctaaaaagccagacttgtccccagagctgcggaaaatattccagcaggctgtcaaagatgtgggcatggatgaatcagaaatcgtatttgtcgactggacaaaggataagtgcagtgagcagcagaagcagcagctggagctggagaaggagactaagaaggagaccaagaaggatccttaggccaagcatgaactcagctctctgaactccggggactgtccccatgcccactctacccccactcctgtgcacctcgattctattttccacaataataaaggtttggttaaacaatc

SEQ ID NO: 3952 - DNA, 1675 bp, Rattus norvegicus
  Genbank Accession No. NM_053291
ggcctctctccgggcctctcgacctcacggtgttgccaaaatgtcgctttctaacaagctgactttggacaagctggacgtgaaggggaagcgggtcgtgatgagggtggacttcaatgttcctatgaagaacaaccagataacgaataaccaaaggatcaaggctgctgtcccaagcatcaaattctgcttggacaatggagccaactcggttgtgcttatgagccacctgggccgtcctgatggtgtgcccatgcccgacaagtactccttagagccagttgctgcagaactcaaatctctgctgggcaaggatgttctgttcttgaaggattgtgtgggctcagaagtagagaatgcctgtgccaacccagcggctgggactgtcatcctcctggagaacctccgctttcatgtagaggaagaagggaagggaaaagatgcttctgggaacaaggttaaagctgagccagctaaaattgatgctttccgagcctccctgtccaaacttggagatgtctatgtcaatgatgcttttgggactgcacacagagcccacagttccatggtgggtgtgaatctgccacagaaggctggtggatttttgatgaagaaggagctgaactactttgccaaggctttggagagtccagagcgacccttcctggctatcttgggaggagctaaagttgcagacaagatccagctgatcaataatatgctagacaaagtcaatgagatgatcatcggtgggggaatggcttttaccttccttaaggtgctcaacaacatggagattggcacatctctgtatgatgaagagggagccaagattgtcaaagatctcatgaccaaagctgagaaaaatggtgtgaagattaccttgcctgttgactttgtcactgctgacaaatttgatgagaatgcaaagactggccaagctactgtggcctctggtatacctgctggctggatgggcttggactgtggtactgagagcagtaagaaatatgctgaggctgtggctcgagctaagcagattgtttggaacggccctgttggggtatttgaatgggaagcatttgccaggggaaccaagtccctcatggatgaggtggtgaaagccacgtctaggggctgcatcactatcataggtggtggagacaccgccacttgctgtgccaaatggaacacagaggataaagtcagccatgtgagcactgggggcggcgccagtttggagctcctggaaggtaaagtccttcctggggtggatgctctcagcaatgtttagtattttcctgccttttggttcctgtgcacagcccctaagtcgacttagtgttttccgcatctccatttggtgttagtgcagctagtggccaagacgagcaccaggaacctaagcagcagctgcacagcatctcagctcgtctttactgcatgggattcattatagttaagtccatttaatttcttagtgactaaaccttgcattaaggcatatatttatactctgcctgtgaaaggaagtgagctgtaaaagcttagctctcttcgctgtatgtagcctctggttagcctgtcactgttcatgacagcatggaaataacgatgaggattccagctgtaggtttgggaggttgatgatattgaaccaataaaagatcccact

SEQ ID NO: 3953 - DNA, 914 bp, Rattus norvegicus
  Genbank Accession No. NM_053293
  misc_feature (1)..(914): n = a or c or g or t
atggtgctggagctctatctggatctgctgtcgcagccctgtcgcgctatttatatcttcgccaagaagaacaatatcccgttccagatgcatactgtggagctgcgcaagggtgagcacctcagcgatgcctttgcccaggtgaaccccatgaagaaggtaccagccatgaaggatggtggcttcaccttgtgtgagagtgtggccatcctgctctacctggcgcacaagtataaggttcctgaccactggtacccccaagacctgcaggcccgtgctcgtgtggatgagtacctggcatggcagcatacgacccttcggagaagctgtctccggaccctgtggcataaggtgatgttccccgttttcctgggtgagcagatacgcccggagatgctggcagccacattggcagatctggatgttaacgtacaggtgctggaagaccagttcctccaggacaaagacttccttgtcggaccgcacatctccctggctgacgtggtagctatcacggagctgatgcatcctgtaggtggtggctgcccagtctttgaagggcgtcccaggctggctgcatggtacaggagagtggaggcagctgtggggaaggacctcttcctggaggcccatgaggtcatcctgaaggtgagagactgtccacctgctgaccccgtcataaagcaaaagctgatgcccagagtgctgaccatgatccagtgacgtcagaagcttcatccctgcaccagccaggccactcgcattacacgactgtgcgccccagccctcacggcatgatggtttctgggcgagggtccctcttcacccttttcccatgctagccacccatggtcacaactacaaccactacttttccctttgagtttgggcaataaaccgaggctcgattcgan

SEQ ID NO: 3954 - DNA, 2041 bp, Rattus norvegicus
  Genbank Accession No. NM_053295
ctggcacatctcccagaatgagtaccacaggagctaaggctgtgaaaatagagtctgagaagtcacaatcaagtgagccacctgtgattcatgagaaaaagccaaaaggaaagccaaaggaagggtcagagccccaaactcttcctaagcatgcatcagatacaggaagtaagcatgctcacaaagaaaaagcactttccagatcaaatgagcagatagtgtcagagaaatcatcagaatcaaagacaaaatttcaagatgctccttctgctgatggagagagtgtggctggaggtgtgactgtggccactgcctcagacaaggtggttgttaagaaaaaagagaagaaatcattaacacctactttacctatggagtccacactaaacaagctatctgacaagtcaggcgtgaatgctgctttggatgacctgatagacaccttaggtgaatgtgaagatactaacaaagatgatccaccatatactggaccagtagttctggacccaatggattctacctaccttgaggcactgggtataaaagaagggactattcctccagagtataggaaacttctggagaaaaatgaagctatcacaggacctcttccagattctcctaaacctatgggaatcgaccatgctatagatgccttgtcatctgatttcacctgtagctctccaactggaaagcaaactgagaaagagaagtctactggggaaagttcgaaagctcagtctgcaggagtgaccagaagtgctgttcctccccaggagaagaaaaggaaagtagaagaggaggtcatgaatgatcaagccctgcaggctctgtcagattcactgggcacccggcagccagaccctcagagccatcttaggcaagccaaacaagtcaaagaggcaaaagcaaaagaagaaaggcaggagaaatgtggtgaagatgaggacacagtacctgctgagtacaggttaaaaccagccaaggataaagatggaaaaccactattgccagaacctgaagaaacatctaagtgcctgagtgagtcagagctgattggggagctttcagcagattttgtccaacctacatatcaagaaaaaccatctatgccagctgcaaaaataaagaagggcgtagtgccagatgatgctgtagaaaccttggctagaagcctggggacaaggaaagaagatccagaagatgaaaaatctctggtggataaaggcaaggagaaagctaaagaagaagatcatgaaaaacttggtgaaaaagaagaaacaattcctcctgattatcgactagaaatagtcaaggataaggatggaaaaccgctcctgccaaaagaagccgaggaacaacttccacccttaagcgatgacttccttcttgatgcattgtctcaggacttctccagtcctgcaaacatattgtctcttggttttgaagatgccaaactttctgctgctgtttctgaaacagtttcccaggtgcctgctccaagcaaccacacagcagccccaccgcctggcactgagaggagagacaaagaactcgatgatgccttggatgaactttctgacagtcttggacaaagacagcctgatccagatgagaacaaaccactagatgataaagtaaaggaaaaaatcaaagcagagcatagcgagaaactgggagaaagagacgacaccatcccccctgaatataggcatctcctggataatgatgggaaggacaaaccagagaagccactgacaaagaacacagagaagcttggtcaggaccaggaccccattgatgccctctcagaagacttggatagctgccccccaactacagagacttcacagaatacaacaaaggagaagggtaagaagacttcaagttccaaagcatccaagaatgaagagaaaacaaaggattcctccaagaagacagaggaagtgcccaagccaaaggtggatgaagatgcaacataaagtttatgcattttggtatctgaataaaaattcttcagctggtggatggtgacttttga

SEQ ID NO: 3955 - DNA, 1197 bp, Rattus norvegicus
  Genbank Accession No. NM_053302
atgtcagtcatacccagctccaggccggtctccaccttggcacctgacaatgattttagagagatccacaactggacagagctgctccatctcttcaaccaaaccttttctgattgccgcatggaactcaatgagaacaccaaacaagtggtcctctttgtcttctacctggccatctttgtggtagggttagtggagaacgtcctggtgatatgtgtcaactgccgccgctcaggccgggtggggatgctgaacttatacatcctcaacatggccgtcgcggacctgggcatcatcctgtctctgcctgtttggatgctggaggtcatgctggagtacacctggctctggggcagcttctcctgtcgcttcattcattatttctaccttgccaacatgtacagcagcatcttcttcctcacctgcctcagcattgaccgctacgtcaccctcaccaatacctctccctcctggcagcgccaccagcaccgaatacggagggccgtgtgcgcaggcgtctgggtcctctccgccatcatcccactgcctgaggtggtacatatccagctgctggatggctccgagcccatgtgcctcttcctagcaccttttgaaacgtacagcgcctgggccctggcagtggccctgtcggctaccatcctgggcttcctactgccttttcctctcatcgcagtgtttaatatcctgtcagcctgccggcttcggaggcaagggcagacagagagcaggcgccactgtctgttgatgtgggcttacatagttgtctttgccatctgctggctgccctaccacgtgactatgctgctgctcactctgcacacaacccacatcttccttcactgcaacctggttaacttcctctacttcttctacgaaatcactgactgcttctccatgctacactgtgtcgccaaccccatcctctacaactttctcagcccgagcttccggggccgactgctgagccttgtggtccgttaccttcccaaggagcaggccagggcagcaggcggtcgagcctcctcttcatcttccacccagcactccatcatcattaccaaagagggcagcctgctcgctgcagcggatctgcacacccacgccatcagaaacgtgcaggcctcctctctgcctccgaacacctcacctacactctgcaattccatagccagctaa

SEQ ID NO: 3956 - DNA, 1994 bp, Rattus norvegicus
  Genbank Accession No. NM_053309
ggcacgagcgggagggaccggcggctccgcccgagcgcggccgcccagccccgggccgcccagccgcccagcccccgccctcccgccggcccgcgcctggcggcggccccgacaccgacagagcagccgcgctgccggcggaatggagcggcgccggggctgagccgggcgcactcgggccgccgcatgtgccgcgcggggagcagctgccgagcgggcggagagcgaacgccaggggccccgtcggagcggccacaggagcagcgccggagatgggagagcagcccatcttcaccacgcgagcgcacgtcttccagattgaccccagcaccaagaagaactgggtgccggcaagcaagcaggccgtcactgtttcctacttctacgatgtcaccaggaacagctatcggatcatcagtgtggatggagccaaggtaatcataaacagcaccatcaccccgaacatgacgttcaccaaaacttcacagaagttcgggcagtgggctgacagcagggccaacaccgtgttcggtctgggattctcctcagagcagcagctcacaaagtttgcagagaaattccaggaggtaagagaagctgccaggttagccagagacaagtcccaggagaaaatcgagacgtcaagtaatcattcccaagaatctgggtgtgaaaccccgtcttccactcaggcatccagcgtcaatgggacagatgacgagaaagcctcccatgcgagtccggccgacacacacctcaagtctgagaatgacaagctgaagatcgctttgacacagagtgctgccaatgtgaagaagtgggagatcgagctgcagaccctgcgggagagcaatgcccggctgaccaccgcgctgcaggagtcggcggccagtgtagaacagtggaagcggcaattctccatctgcagagatgagaatgacaggctccgcagcaagattgaggagctggaagaacagtgcggtgagatcaacagggagaaggaaaagaacacccagctgaagaggaggattgaggagctggagtcagaggtccgagaaaaggaaatggagttgaaggatctccgcaaacaaagtgaaatcatacctcagctcatgtccgagtgtgaatatgtctctgagaagttagaggctgcagaaagagacaatcaaaacttggaagacaaagtgcggtctctaaagacagacatcgaggagagtaaataccggcagcgccacctgaagggggagctcaagagcttccttgaggtgctggacggaaagatcgatgacctccacgacttccgccgagggctctccaagctaggcacggataactagggtggggcggagcctagatggagagtggaaagcgtgtgtgagagatgaagtgggcatagggcattctccgtttgcttctgtaatgcgggtgcgttctgtctgtctccaggccagtcgtgccgtccactcgctcctccagaatagaaaatctcttgcttctctggctttgtgaggtcgtggacacctggaagcttctgactcaggaatccagaacggtctaccttagccgtttacgcagtcagggcagggacattcagatcttcccttaagggctgttgcaaccctatgaactggggatgggggaagtattttctaatccaagtatcattaacctttacaacaggcctttgggcgccttccgctgcgtggcactcagtgtgtgagactctagattccagaccgggagcacgtggagggaacatcttttcccaggatgcattctgttcctttagcagaggtagctaacctttcgaagttatgacagatttcacactcaaaaactgcacaattgatctacccaaaaagaaataattatttaaaaaaaaaaacctaacatattttaagtaaatacactgttttgggttggagcgcattcatagttaccctcagctgcatgtggcctttggactgtaggccacacaaacctcgtgccgaatt

SEQ ID NO: 3957 - DNA, 505 bp, Rattus norvegicus
  Genbank Accession No. NM_053319
ggagagcggccgcgctgtcgcctctgctgcttgagcggcgccagcaccttccctaggagctcgcagcagccggctggcccctgctccacggtaaccatgtgcgaccggaaggcggtgatcaaaaatgcagacatgtcggaagagatgcaacaggactcggtggagtgcgctactcaggcgttggagaagtacaacatagagaaggatatcgcggcccatatcaagaaggagtttgacaagaagtacaaccccacctggcactgcatcgtgggccggaacttcggtagctacgtgacacacgagaccaaacacttcatctacttctacctgggtcaggtggccattctcctgttcaaatctggttaatagcatggactgtgccaaacacccagtgatccatccaaaaacaaggactgcatcctaaattccaaataccagagactgaatcttcagccttgctaagggaacacctcgtttgaatctgttgtgttttgtacagggcacc

SEQ ID NO: 3958 - DNA, 2388 bp, Rattus norvegicus
  Genbank Accession No. NM_053328
ttccctcccgcctctccacccgccccacttctcattcacttggctcgcacggcgcagacagccaggcgagcacacaccgccagtctgtgtgcagagcgggagccagaagccgtgggggacacccggtcatgcacgcccccaactgaagcgacacctcaaagccgcagctcctggcagcccaggccattgcaagaagctcaggctagctcataggaacataccccttgagaccctcggatcctcccttccaggccagtcctctctcagactctctgctaagtgcagacaggagcgcacagtggcccctgctcgccgcatcatggagcggatccccagcgcgcaaccacctcctacctgcctgcccaaaacgccagggctggagcacggagacctgtcagggatggattttgcccacatgtaccaagtgtacaagtccaggcggggaataaaacggagcgaggacagcaaggaaacttacaaattgccgcaccggttgattgagaaaaagagacgtgaccggattaacgagtgcattgcccagctgaaggatctcctacccgaacatctcaaacttactactttgggtcacttggagaaagcagtggttctcgagctgacgctgaagcacgtgaaagcattgacaaacctaattgatcagcagcagcagaaaatcatggccctgcagagcggtttacaagctggtgatctgtcgggaaagaatattgaggcaggacaagaaatgttctgctccggtttccagacctgtgcccgggaggtacttcagtacctggccaagcatgaaaacactagggacctgaagtcttcccagcttgtcactcatctccaccgtgtggtctctgaactcctgcagggtagtgcttccaggaaaccattggactcagctcccaaacccgtggacttcaaagagaagcccagcttcctagccaagggatcagaaggccctgggaaaaactgtgtgccagtcatccagaggacttttgctccctcgggcggggagcagagtggtagtgacacggacacagacagtggctacggaggcgaattggagaagggtgacttgcgcagtgagcaaccctacttcaagagcgatcacggacgcaggttcaccgtgggagaacgcgtcagcacaattaagcaagaatctgaagagccccccaccaaaaagagccgaatgcagctctcagatgaggaaggccacttcgtgggcagtgacctgatgggttccccatttcttgggcctcacccacatcagcctcccttttgcctgcccttctatctcatcccaccatcggccactgcctatctgcctatgctggagaaatgctggtatccgacctctgtgccactgttatacccaggcctcaacacctcagcagcagccctctccagcttcatgaacccagacaagatcccaactcccttgctcctgccccagagactcccttctcccttggcacattcgtcccttgactcttcagccttgctccaggccctgaagcagatccctcctttaaacttagaaaccaaagactaaactcttgagggcgaatctcctgctgctttgcttttcctttccccactaattccaagaccacaaaaggtttctgtgagtgcagagagatcggcccaccatgcagacccacagagaagattcagaatgtgtgtgagagtgagtgtgtgagtgcgcgtgcgtgtgcttgtatgtgtgtttatagatgtaggacattaagttccttctgacacagggaagatgtgagaaggatggcctgacatcagatgacaagaggtctatagcacatctctgggcttttccctacccagagaagagccccctttgatacaaatcagttggattttcatatgcttcaaaggcttgatctgtgagtcactccagtttgggacataggtctgtctgtggctttgagaaaaggtactttcaaaagagggctttccagagcacagctcacagccagctgttaggaccccacccttctcctttattgtggaggtgactcacagcagactgacagtggtcagactgagctttctgctaaggtggtgaggtagccaacactggcatgtctcggtagtggtttgggcaaatttccgcaggtctcttcccccaaccctgcctctgatgaataaagacaatgagtacagttccttaattcaggcttttgtgactagcttactacggaaccgaaaatggtcccctttgtacaagccgagctgttatggaatcacggtgaaccagacccaggtctgtggcacctgtttgtttgtttttttttttttttttttttagctctcatttctacggcatgctttccaaggaaccaaaggagggtctcagagatgccccctcgt

SEQ ID NO: 3959 - DNA, 1812 bp, Rattus norvegicus
  Genbank Accession No. NM_053329
atggccctgaggacaggaggcccagccctggtggtgcttctggctttctgggtggcactgggcccctgtcacctgcaggggacagatcccggagcgtcggcagatgccgagggcccccagtgccccgtcgcctgtacctgcagccatgatgactacacagatgagctcagcgtcttttgcagttcaaagaacctcacacatctgcctgatgacatcccagtcagcaccagagccctgtggcttgatggcaacaacctctcttctatcccctcagcggccttccagaacctgtccagcctggactttctcaacctgcagggcagctggctgaggagcctggagccacaggcactgctggggctgcagaacctctactatctgcacctggaacggaaccggctccggaacctcgccgtgggcttgttcacacacacaccgagtctggcttcactcagcctgagcagcaacctcttgggccggctggaggaagggctgttccagggcctcagtcacctttgggacctcaacctgggttggaacagtctagtggtcctgcctgacacagtgttccagggactgggcaacctccacgagctggtgctggctggcaacaaactgacttacctgcagcctgcgctcttctgtggcttgggcgagctgcgggagctggatctgagcaggaacgcactccgaagcgtcaaagctaacgtctttgtacatttgcccaggctgcagaagctgtacctggaccggaacctcattacagccgtggcccctcgtgcctttctgggcatgaaggccctgcgttggctggacctgtcgcacaaccgcgtggctggcctcatggaggacaccttcccaggcctgctgggcctgcacgtcctgcgcctggcacacaatgcgatcgctagcttgcggccgcgcactttcaaagacctgcacttcctggaggaactgcagctgggccacaatcgaatcaggcagctcggggagaggacattcgagggcctggggcagctggaggtgctgacgctcaatgacaaccagatcactgaggtcagggtgggcgccttctctggccttttcaatgtggcggttatgaatctctccggcaactgtctgaggagcctcccggagcgggtgtttcagggtctggacaaactgcacagcctgcacctagagcacagctgcctgggtcacgtccgcctgcacacttttgctggcctctcagggctgcgcaggctcttcctcagggacaacagcatctccagcatcgaagaacagagcctggcagggctttcggagctcctggaactggatcttactaccaaccgcctcacacatctgccccgccagctcttccagggcctcggccacctggagtacctgcttctctcctacaaccaactgacgactttatccgcggaggtcctgggccctctgcagcgggccttctggttggatatctcacacaaccacctggagacgctggccgaaggccttttctcatctctggggcggcttcgctacctcagcctcaggaataactccttgcagaccttttcaccacagcccggcctggagcgcctgtggcttgatgccaacccctgggactgcagctgtcccctcaaggcgcttcgagactttgccctgcagaaccctggtgttgtcccccgctttgttcagactgtctgtgagggggacgactgccagccggtgtacacctacaacaatatcacttgcgctggccccgccaacgtctcgggcctcgacctaagagacgttagtgaaacacattttgtgcactgctga

SEQ ID NO: 3960 - DNA, 554 bp, Rattus norvegicus
  Genbank Accession No. NM_053330
ctttccgccggggcagccatcttccagtaactcgccaaaatgacgaacacaaaaggaaagaggaggggtactcggtatatgttctctagaccttttaggaaacatggagtcgttcctttggccacatacatgcgaatctacaagaagggtgatattgtagacatcaagggaatgggcactgttcaaaaaggaatgccccataagtgttaccatggcaaaaccggaagagtctacaatgtcacccagcatgccgtgggcatcattgtgaacaagcaagttaaaggcaagattctggccaagaggatcaatgtgcggattgagcacatcaagcactcaaagagcagagacagcttcctgaagcgggtgaaggagaacgatcagaagaaaaaggaagccaaagagaagggcacctgggttcagcttaacggccagcctgcgccacccagagaagcccactttgtgaggactaacggaaaggagcctgagctgctggagcccattccatacgaattcatggcctaatgtatacaaaggaaataaagaacccgaactgc

SEQ ID NO: 3961 - DNA, 1362 bp, Rattus norvegicus
  Genbank Accession No. NM_053334
accgaactctgaggccctgcctgaagtcatcctcgcctttactgtcaccctgaaccaggcagtagagaaagcatggagccgatgccttcggccaccgacggcggggacaggtccgcggcgccctcgggcctgtcggcttctcagcgtcgagcagagctgcggaggaggaagctgctcatgaactccgagcaacgcatcaaccggatcatgggctttcacaggcccgggagcggcgcggaagaaaatcaaacaaagtcaaagccactggacagtgacatactgaatcccctcggcgttccttccgtttccaagagggtagtgcttggcgattcagtcgatggaggagtaactgactaccagcccagtggtggcgccgacatcaggggagcccagctgggagacaaactggactcattcattaaagcaccagagtgcagtagcaaggatggagttgagcttcggcagcggaacagaggtgacctgacggcagactcggccccgaggggttctcaccacggcctagaacagtacctctccagattcgaagaagcaatgaagttgcgcaaacagctgatcagcgagaagcccagccaggaagatggacggacgacggaagagtttgactcttttcgaatatttcgactggtggggtgcgccctgcttgctcttgttgtccgagcttttgtttgcaaatatttgtctatattcgctccatttcttactttgcaacttgcgtacatgggactgtacaaatattttcctaagggtgagaagaaggtaaagacgacagtgctgaccgccgcactgttgctgtccgggattccggctgaggtgataaaccggtccatggacacctatagcaagatgggtgaggtcttcacggacctctgcgtctacttcttcaccttcatattctgccacgaagtgcttgagtactggggtccggaagtgccctgaaacctgaggaacttggaagtttacgagtgaaaactacttcccttctacactgcagtgtctctaaagggggcaaatcggtttataacttcatcaaattctttggctttacagaaaacccagttaatcgtttccccgatttaaaagggttgaatttctatcagtccaggtctgagttaccacatagggtaacaatggcattaacaatttttcttgtttaattagaagtccagccttacacctctcccctaatgtctgagatttgtgacccccccttacaggcccaggctggtacttgtaggggaccagacggacaggtctcagctggcctaaaggcctaaaccttgtatttgtgtcattccttcctgagaaatgaaaccatcctaaaaataaagcaaatggaactgg

SEQ ID NO: 3962 - DNA, 1858 bp, Rattus norvegicus
  Genbank Accession No. NM_053337
cccgccgcgtctagagcggcgcccagtgcaggatgttgcaggagacggcggcggtgtcgttggcggtagcgggcggaggagcggtgacggctgaggcgcccgcgggcgggataaaatggcggatttcgaggagttgaggaatatggtttctagttttagggtttctgaattacaagtgttactgggctttgctggacggaataaaagtgggcgcaagcatgacctcctgatgagggcgttgcatttactgaagagtggctgcagccctgcggttcagattaaaattcgagaattatacagacgccgatacccacggacacttgaaggactttctgatctatccacaatcaaatcttcagttttcagtttggatggtagctcatcaccagtagagcctgacttggccgtggctgggatccactcgttgccttctacttccattgcacctcattcaccgtcatctcctgtcgcttctgtgctgcttcaagacactaagcccacgtttgagatgcagcaaccatctcctcccattcctcctgtccatcctgacgtgcagttaaaaacgctgcccttctatgacgtccttgatgttctcatcaagcccacaagtttagttcaaagcagtattcagcggtttcaagagaagttttttatttttgctttgacaccccagcaagttagagagatatgcatttcaagggattttttgccaggtggcaggagagactacacagtccaagtccagctgcgactttgcttggcagagaccagttgccctcaagaagataactatcccaatagtttgtgtataaaagtaaatgggaaactctttcctttgcctggctatgcaccaccacctaaaaatgggatcgaacagaagcgtcctggacgccccctgaatattacatctttagtgagattgtcttcagctgtgccaaatcagatttctatttcttgggcatctgaaattggaaagaattactccatgtctgtgtatcttgtacgacagcttacatcagccatgttattacagagattaaaaatgaaaggtattagaaatcctgatcattccaaagcactcattaaagaaaaacttactgcagatcctgatagtgaaattgctacaactagtcttcgagtgtccttgatgtgccctttaggaaaaatgaggctgacaatcccgtgccgcgcagtgacgtgtacacatctgcagtgctttgatgctgccctgtatcttcagatgaatgagaagaagcccacctggatttgtcctgtttgtgacaaaaaggctgcctatgagagtctgatactagatgggctttttatggaaattctcaatgactgttctgatgtggatgagatcaaattccaggaagatggttcctggtgccccatgagacctaagaaagaagctatgaaagtaaccagccagccctgtacaaaagtagaaagttcaagtgtctttagtaaaccttgttcagtgactgtagccagtgatgcaagcaagaagaagattgatgttattgatctaacaatagagagctcttctgatgaagaggaagaccctcccgccaaaaggaaatgcatctttatgtcagaaacacaaagcagtccaaccaaaggggttctcatgtatcagccatcttctgtaagggtgcccagtgtgacttcagttgatcctgctgctattccaccttcattaacagactactcagtaccattccaccacacgccagtgtcgagcatgtcatcagatttgccaggagaacaaagaagaaatgatattaataacgaagtgcagcttggaacatcttctgatactgtgcaacagtgaatgcaaaataaaacakaatttgta

SEQ ID NO: 3963 - DNA, 1607 bp, Rattus norvegicus
  Genbank Accession No. NM_053341
cctcgagcggcggcggcgcaggtctcccggccaagtccccacttctggctgctcatgccactgggactggggcgaaggaaaaaagcaccacctctggtggaaaatgaggaggcggagccaagccggagtgggctgggcgtcggggagcccgggcccctgggtggaagtggagcaggggaatcccagatgggtttgcccccacctcctgcttccctccggcctcgcctcgtgttccatacccagctggcccacggcagccccacgggccgcatcgagggcttcactaatgtcaaggagctgtacggcaagatcgctgaggccttccgactaccggctgctgaggtgatgttctgtaccctcaacacccataaagtggatatggacaagctgctggggggccagatcgggctggaggacttcatctttgcccatgtcaaggggcagcgcaaagaggtggaagtattcaagtctgaggatgctctggggctcaccatcaccgacaacggggccggctatgccttcattaagcgcatcaaggaaggcagtgtgattgaccacatccagctcatcagcgtgggtgacatgattgaagccatcaacgggcagagcctgctgggctgtcggcattatgaggttgccaggctcctcaaagagctgccccgaggccgcaccttcaccctcaaactcaccgaacctcggaaggcgtttgatatgatcagccagcgttcatcaggtggtcaccctggctcaggcccacaactgggcactggccgagggaccctccggctccgatcccggggccctgccacagtggaggatctgccgtcagcttttgaggaaaaggccattgaaaaggtggatgacttgctagagagctacatggggatcagagacacagagctggctgccacgatggtggagctggggaaagacaaaaggaacccagacgaactggcagaagctctggatgaacggctcggtgacttcgcattcccagatgaattcgtctttgatgtctggggagccatcggggatgccaaggttggccgctactaagactgggactgaacctggaccttgagataacctgctttgcccagctggggtttccagaaaccacagccaagacctgggctgacagcttaggctgtaactccgcagcctggggatggcacaggctgcaagtgccctgtggtccaggccccgctccaatcagtaccgccacggtgcccagcctggttggggtccccggccaacccctgccgggttccccacctacctcaatagagtaagcgcatggggagggaccaacacactaggcagccagccacctctatccccaacacttcccactatcagctggcaactgccccttctgtccccctggcctcagctctcttcggggtcatgacctccctactttactttttttgctttgtttttttcaagacaaagtcactatgtagctctggctgtcctggaactccttctgtaaaccaggctggccttgaactcacagagatccacctgcatctgcattcacagtgctgggaataaaggtgtgcatcaccactcccaaaaaaaaaaaaaaaaaaaaaaaaaaaaaa

SEQ ID NO: 3964 - DNA, 330 bp, Rattus norvegicus
  Genbank Accession No. NM_053345
atggcatatcagttatacagaaatacaactttggggaacagtcttcaagagagccttgatgagctcatacagtctcaacagatcaccccccagcttgcccttcaagttctacttcagtttgataaagctataaattcagcattggctcagagagtcaggaacagagtcaatttcaggggctctctaaatacatacagattctgcgataatgtttggacttttgtattgaatgatgttgaattcagagaggtgacagaacttattaaagtggataaagtgaaaattgtagcctgtgatggtaaaaataccggttccaataccacggaatga

SEQ ID NO: 3965 - DNA, 1392 bp, Rattus norvegicus
  Genbank Accession No. NM_053348
cctcctctgattgcaattataaaacggctcaagcaatcttgaggccccaccaatagggcccgtcctgtcagctcgaccctgacacgtcctggatcttgttctccacagaatgggtgtgctacggcttctggtgctctgcaccctggctgcatgctgtgtggcccgctctcccccagctccacccctgccaaacgcccccttcgcacctctgcgtcccctgggctgtaacgactctgaagtgctggcagttgcaggttttgccctgcagaacatcaacagagtccaaaaggatggctacatgttgaccctcaacagagtacacgatgctcgggttcaccgtcaggaagacatgggctctctgttctacctcacgctggacgtcttagagactggctgccacgtgctcagcaggaaggcactgaaggactgcggaccgaggattttctatgagactgttcatggacagtgcaaagctatgtttcacgttaacaagccaagaagagttctctacttacctgcttataactgtacacttcgcccagtttctaaaaggaagattcattctatgtgccctgactgcccgcatcccgttgacttgtcagcccccagtgttctggaagctgccacagaatcacttgcgaagtttaacagcgagaacccctcaaaacaatatgcactcgtcaaagtcaccaaggctacgacccagtgggtggttggtccttcttactttgtggaatatttgatcaaagagtcaccatgtacccagtctcaggacagctgttcactccaggcctccgactctgagcccgttggtctttgccaaggttcactgattaaaagtcccggggtccctcctcaacgctttaaaaagactgtcactgtgtcgtgcgagtttttcgaatctcaggaccaggtccctggaggtgagaaccctgctgatacccaagatgctaagaaactccctcagaaaaacacagcccctaccagctcaccctccataactgcaccaagaggatctatccaacacctccctgagcaggaggagcctgaagactccaagggaaagagtcctgaggaaccctttcctgtgcagctggatctaaccacaaacccacagggtgacacactggatgtctccttcctctacctggagcctgaggaaaagaaactggtggtcctgcctttccctgggaaggaacagcgctcccctgagtgcccggggcccgaaaagcaaagaaccccctgatgctccccgctgagactcactagcagggttccacggggtacggtcccctgcagtagatgggaggtggtgggcattgggaaggcacagacaatcaaatgtagaccggctaataaagtgtgtcctttggatgcttcttgatctcaaaa

SEQ ID NO: 3966 - DNA, 503 bp, Rattus norvegicus
  Genbank Accession No. NM_053359
ctcgtgccgaatcggcacgagcggcacgagtggtgttcgggagaggcgttctagtcctcgccgccgcctgtgccgccgcctgtgccgcctgtgccgcctgtgccgcgtcagtcatgccgaagcacgagttctctgtggacatgacctgtggaggctgtgcggaagccgtctcccgagtcctcaacaagctgggaggagtggagttcaacattgacttgcccaacaagaaggtctgcatcgagtctgagcacagctcagacatcctgctggcaactctcaacaaaacaggaaaagcggtctcctaccttggccccaagtagccaggacctgggcgagtccttccggatagaaactgaagaggcagactgttgatctggtctcccccgctgatctggaacaccaactgctcagtccagctccgccatggaattccagcccagacaggccttccctgctggctccctgccagcttccttgcaattaaagtcaagctgcatttgttg

SEQ ID NO: 3967 - DNA, 600 bp, Rattus norvegicus
  Genbank Accession No. NM_053365
  misc_feature (1)..(600): n = a or c or g or t
cttaggnaccctgctagcaganaattcggcacgagtccttgaaagcttacaaaatgtgcgacgcctttgtggggacctggaaactcgtctccagtgagaacttcgatgattacatgaaagaagtgggagttggcttcgccaccaggaaagtggccggtatggccaagcccaacttgatcatcagcgtagaaggggacttggtcgtcatccggtcagagagtacttttaaaaacaccgagatttccttcaaactgggcgtggaattcgatgaaatcaccccagatgacaggaaagtgaagagcatcataaccctggatggtggggtcctggtacatgtgcagaagtgggatggaaagtcgaccaccataaagaggagacnagatggtgacaagctggtggtggaatgtgtcatgaaaggcgtgacttctacaagagtttacnaaagggcatnagccaagggacgaggccctggactgaaatttgcatcaaactctacaataacttgatgggatttggtggttttgntatttntttttttaagatcnattttgcactaattagcaagcaatcactttnttcttgaactgggaatttattgga

SEQ ID NO: 3968 - DNA, 2059 bp, Rattus norvegicus
  Genbank Accession No. NM_053369
gcacgagtacgggctcaaatgtagaagacagaagtagctcagggtcctgggggaatggaggtcatccaagcccgtccaggaactatggagatgggactccctatgaccacatgactagcagggatcttgggtcacatgacaatctctctccaccttttgccaattccagaatacaaagtaaaacagaaaggggttcatactcatcttatgggagagaaaacgtacagggttgccaccagagtctcctcggaggggacatggatatgggcaacccaggaaccctttcgcccaccaaacctggctcccagtactacccatattccagcaataacgcccgacggaggcctcttcacagtagtaccatggaggtgcagacaaagaaagtcagaaaagttcctccaggcttgccatcttcagtctacgctccttcagccagcactgccgactacaacagggactcaccaggctattcttcctccaagccagcagccagcactttctccagctccttcttcatgcaagatggccatcacagcagtgacccttggagctcctccagtggaatgaatcagcccggctatggagggatgctaggcaactctcatatcccacagtctagcagctactgtagcctgcatccacatgaacgtctgagctatccatcgcactcctcggcagacatcaactccagtcttcctccgatgtccacgttccatcgaagtggcacaaaccattacagcacctcttcctgcacacctcctgccaacggaacagacagtataatggcaaacagaggaactggggcagcaggcagctcccagactggagacgctctggggaaagccctggcttcgatctattctcctgatcacacgaacaacagcttctcctccaacccttcaactcctgttggctcccctccttcactctcagcaggcacagctgtttggtctcgaaacggaggacaggcctcgtcatctcccaattacgaaggacccttgcactccttgcagagccgaattgaagaccgtttagaaagactggacgacgcaattcatgttctccggaaccacgcggtgggcccatccacagctgtgcccggtggccatggggacatgcatgggatcatcggaccctctcacaatggagcaatgggcagtctgggctcaggatatggaactggccttctctcagccaacagacattcactcatggtcggggcccaccgtgaagatggcgtggcactgagaggcagccattctctcctgccaaaccaggttccggttccacagcttccggtccagtctgcaacttcccctgacttgaacccaccccaagacccttacagagggatgccaccaggcctccagggacagagtgtgtcttccggcagctctgagatcaagtccgacgacgagggcgatgagaacctacaggacacaaaatcttccgaggacaagaaactagacgacgacaagaaggatatcaaatcaattactagcaataacgatgatgaggacctgaccccggagcagaaggccgagcgtgagaaggagcggaggatggccaataacgcccgtgagcgcctgagggtccgtgatatcaacgaggctttcaaggagctgggccgcatggtacagctccacctgaagagcgacaagccccagaccaagctcctgattctccaccaggcagtggctgtcatcctcagcctggagcagcaagtgcgagaaaggaacctgaacccaaaagctgcctgtctgaaaagaagggaggaagagaaggtgtcctcagagcctcccccgctctccttggctggcccacaccctgggatgggagacacagcgaatcacatgggtcagatgtgaaagggtccaagttgccaccttgcttcattaaaacaagagaccacttccttaacagctgtattatcctaaacccacataaacactgctccttaaccccgttttttttgtaatataagacaagtctgagtagttatgaatcgcagacgcaagaggtttcagcattcccaattatcaaaaaaaaaaaaaaaaaa

SEQ ID NO: 3969 - DNA, 485 bp, Rattus norvegicus
  Genbank Accession No. NM_053370
ggcacaaggccgcgtggtcgtgccgggatggagtcctcctcgtcctcttcgggctcggctttggccgccgtggaccctcagctgcagcatttcatcgaggtggagacacagaagcagcgcttccagcagctggtgcaccagatgacggaactttgctgggagaagtgcatggataagcctgggcctaagttggacagtcgggctgaggcctgttttgtgaactgcgttgaacgcttcattgatacaagccagttcatcttaaatcgactggagcagacccagaagtccaaacctgttttctcagaaagcctttctgactgatttcagcattacctctttggaaaagtagttcaagaagggaagagctgctgctgagtcggttaaagaaatggctatggggggattaactcccaattctcttcatcatcttgggacaaattgtcacctgagaatgaacaaagaccaatttttatgtatgggagttg

SEQ ID NO: 3970 - DNA, 780 bp, Rattus norvegicus
  Genbank Accession No. NM_053371
gacgccatgcgccctgggcgtgatggagcaccagcagcagcaactgagaaacttgcgagactttctgttggtctacaatcggatgacagaactgtgcttccagcgctgtgtgcccagcctgcaccaccgagctctggacgctgaggaggaggcctgcctgcacagctgtgctgggaagctcatccattctaaccaccgcctcatggccgcttacgtgcacctcatgcccgccctggtccagcgccgcatggcggactacgaggctgcctctgccgtgccaggtgttcctgcagaacagcccagagactcgccatcaggcagctagctagctgtccctgaccgcaggagagaaggtggttttgctgtgggcacattggtcttcaatacgatcctcctgtctcagcctcccaggaaggtggagacccaggatattgtgtgactgctgagagagctctacatcagcatctgtatgtatcccttcaataaacatgtgctgtgagttactggaattacagacatgggctacaactggttgctagataattctttaggaatataaaaattgctgaccagaagcttccctacagagtgacctgtgtacatgattaatttcactccttgacaagtacaaacgtgagtagagcagcttgtgaacttaattccccaaaccaggaaggtggagacccaggatattgtgtgactgctgagagagctctacatcagcatctgtatgtatcccttcaataaacatgtgctgtgaaaaaaaaaaaaaaaaaaaaa

SEQ ID NO: 3971 - DNA, 4776 bp, Rattus norvegicus
  Genbank Accession No. NM_053400
gcacgagccgaggcttcctatgccggctggagttaggatgccacggcccattatttgcaccgactaacccggagttcctcctcggccctgggaaggactggcggcggcggctggagcagacagagcagcaggctctcttctccgaggggaggggggggcgtcgaagcgccctcgctgggctctagccctcacccacggtcctcaagccgtcacctcggtggcctgcttcctttttcttctccccgcgactccgggcccgaccgcctctgggatttgacccgcgcgccccggatgctccgagctgcccagacgcgcccccccccctccagcctcatcgtgctgattgacccgtgaggggacaagagaaacccaccccccaacctccgggcctcgggatcctgctctggagctgccagggagccgatgatgtccacgcagacccggcttctgacactgtccacgcagccgggggaaggtggccggccgcagccggccgagccttaggcgcacaaagcgcgagcccgccgacgactttgccgctcgctccgccgctctttgtctgcacttggggcgcacgcccgactctgggatttcgctgcgagagcgggctgggggggccgggggcgagctctcggttccccggccgccccccgctcgggctcgcctcccccctcccccgcacgtccccggctcgggctctcagcgcttccaagctctcggaatcgcgacccctccctgccatgtatccgcaaggcagacatccggcaccccatcaacccgggcagccaggatttaaattcactgtggccgagtcctgtgacaggatcaaagacgaattccagttcctgcaagctcagtatcacagcctcaaagtggagtacgacaagctggcgaacgagaagacagagatgcagcgccattatgtgatgtactatgagatgtcctacggcttgaatatcgaaatgcacaagcagacagagatcgcgaagagactgaacacgattctagcccagatcatgccttttttgtcacaggagcatcagcagcaagtggcgcaggctgtggaacgcgccaagcaggtcaccatgacggagctgaacgccatcatcgggcagcagcaactccaggcacagcacctctcccatgccacacatggtcccccggtccagctgccaccccacccgtcaggcctccaacctcctgggattcccccagtgacaggaagcagctctgggttgctggcacttggtgccctgggaagccaagcccacttggcagtgaaggatgagaagaaccatcatgaactggatcacagagagagagagtccagcacgaacaattctgtgtcaccctcagaaagcctccgggccagtgagaagcaccggggctctgcagactacagcatggaagccaagaagcggaaagcggaagagaaagacagcctgagccgatacgacagcgatggggacaagagtgatgacctggtagtggatgtctccaatgaggacccagcgacaccccgggtgagcccagcacactcccctcctgaaaatgggctggacaaagcccgaggtctgaagaaagacgcccccaccagcccagcctctgtggcttcctccagcagcacgccttcctccaagaccaaagaccttggtcataatgacaaatcttccacacctgggctcaagtccaacacaccaacgccaaggaacgatgccccaactccaggcaccagcaccaccccggggctccggtcaatgccgggcaaacctccaggcatggacccgatagcctcggccctgcgcacacccatctccctcaccagctcctatgcagcaccctttgccatgatgagccaccacgagatgaatggctccctcaccagcccaagcgcctatgctggcctacacaacatcccatcccagatgagcgccgccgcagcagctgcagccgccgcctatggccgatcgccaatggttggttttgaccctcatcccccgatgcgggccacaggcctgccctccagtcttgcctccattcctggagggaaaccggcgtactccttccatgtgagtgccgacgggcagatgcaacctgtgcccttcccccatgatgcgctagcaggccccggcattcccaggcatgcccggcagatcaacacactcagccatggggaggtggtatgtgccgtgaccatcagcaaccccacgaggcacgtctacacaggcggcaagggctgtgtgaagatatgggacatcagccagccgggcagcaagagtcccatctcccagctggactgcctgaacagggacaactacatccgctcatgcaagcttctccctgatgggcgcacgctcattgtgggtggtgaggccagcacactcaccatctgggacctggcctcgcccacgccccgcatcaaggctgagctgacgtcctcggctccagcctgttacgccctggccatcagtcctgatgccaaagtctgtttctcctgctgcagtgatgggaacattgcagtttgggatctgcacaaccagaccctggtcaggcagttccagggccacacggatggggccagctgtatagacatctctcatgatggcactaaactgtggaccgggggcctggacaacactgtgcgctcctgggacctgcgtgaagggcggcagctacagcaacacgacttcacctcccagatcttctccctgggttactgccccactggggagtggctcgccgtgggcatggagagcagcaacgtagaggttctgcaccacaccaagccggacaagtaccaactgcatctgcacgagagctgcgtgctgtccctcaagtttgcctactgtggcaagtggtttgtgagcactgggaaagacaaccttctcaatgcctggaggacgccttacggagccagcatcttccagtctaaagaatcctcgtccgtcttgagctgtgatatttcagcggatgacaaatatattgtaacgggctctggtgacaagaaggccacagtttacgaggtcatctactgaacaaggactctaagaggcctgtcaaactctgggagacacccacgcggccctgacagggagatgctggccaggccccgaggatggcagaagagtgagggacagcattgtggggctgccctccggaaggtggagaggacgcacgcccctttgtggattgctgtgtctgacagacttgaaggactttctcctctccccctcaccagtgctggcagatgcttcaattagatttctctggaggcttctgctttcgtttcccacacagacaccctcatgagtctctgtctcttcctcccctgtctgatctgtcccctccctactccgggttgggggcatgctggagtagacattgttgtttctggggaggggcgcctcgttctgattgtgcagtgcacaaggtttgtgaacaatgtaaataagagactgtggttgctgactggccagtgagggaggaggccccttcccaccagtgctcgccgtgtattttgcctgctgtatttgtaacccactcgcggtggtggcttttctttctttcttttcttaagattttttttaaacagatgttctgtggggaaagtaggcagagatagagagtcggggagtggaatgagaagcttcctggggatgggcaaaccagcctggcccactgggactgaagtatatctccacacgggttttagcaccatcttcagatggaatgataggcagatggacagacaagctgatggacagacagtactgggatgggccagcttgggctattatccacaggaacagcgaggatttcctgtgggtttctctgctccatcttctcttgccttgccctcacacctcctgacctccatctctttctgcccccctccccccgctcgcctctcccactggaccccatctttctctttggtgcacactcaatcattgtgatgaggaatggaagttcaagggaactccctctctgactctcctccgccagcctagaaaggattccatatgggggtgggagggagacaagcgactcagctcagggagctaccagagaaaaacagcaactggtgtgggtgctttttttttttaatttgaataaaaataattagaagtgatatcctttgataagatgccgtctcccctttcctgctctcagccctttctgctccctgaagccggggatatggtgacccccagggtcgtaagtctaagaagatgggcgggggagcgggctgggggctggggcagacggaatgtcatctgcagatatcacccctagggtaccaatgtttgtggtattaggtttgctttgttttgttttggtcttttgttgttttattaaagaaaagctaaagaccgtgtgagccctgctggtgggctttccatggatgtagcatatggaagagagtttttatattgcatttttatggattattttataatgtgggactcagtctgggaagaaagatgagggtgtctaaaacctgcccatctccagtgctccaactgagcggctgccccgaacaggatgtatgttgggacatggaaagaccgtggcaccccgcaccttcctgagaggcatgtcgacatgcctgtctggagtctgtccatctgtctctgggtttcagatgatcactggccaccacttgttaaggctctagccagaagggagggttagggtggaagagagttattcctgaagaaaaaagaaaaattgaaacatcattgtaatgaagctttttatatttttaaaagttac

SEQ ID NO: 3972 - DNA, 519 bp, Rattus norvegicus
  Genbank Accession No. NM_053401
aggaggactacgcggcaagggataggcccaggaaaacgaagaaatggagcagcccctgcagaatggacaggaagaccgccccgtgggaggaggtgagggccaccagcctgctgcaaacaacaacaaccacaaccataaccacaaccacaaccacaaccacaaccacaatcatcaccggagaggacaggcccgccgacttgcccctaactttcgatgggccattcccaacaggcagatgaatgatgggttgggtggagatggagatgatatggaaatgttcatggaggagatgagagagatccggagaaagcttagggagctgcagttgagaaattgtctgcgtattcttatgggggagctctctaatcaccacgaccatcacgatgaattctgccttatgccttgacttcggtcatttcccctgagattcatactgtgattcccgctgtattcctagcccttgcattttcctgacatgcctttaaatgacccgttttgtggtgagccttggtgttattt

SEQ ID NO: 3973 - DNA, 2065 bp, Rattus norvegicus
  Genbank Accession No. NM_053410
atttctggatccaaaatggacgttcctagctcctccagctcccgattctcggtcggctctgccagccctagcagtgtgctcctctatgcgaaagacctcaaaaagtgggatgagtttgaagacctgttggaggagaggagacaggtcagtgatttcaaatttgcaatgaagtgctacacaccacccttgtatagaggaattactccctgcaagccaagtgatatcaagtccatcgttctcaattctgaagagattaactatgtcattaagcagctttccagggagtccctgacgggtgtggatgtgctcagagaagaggccaatgagatcctggaggaaatgagtcacaaactgcgtataggagccattcggttctttgcctttgttctgagcaaagtttttaaacagatcttctcaaaggtgtgtgtgaatgaagaaggcattcaaaagctacaacgagcgatccaggagcaccccgtgatcctgctgcccagccaccggagctacatcgacttcctcatgctgtcctttgtcctctacaactatgacctgcccgtgccggtgatcgcagcagggatggacttcctgggaatgcgagtggtgagcgagctgctcaggatgtctggggccttcttcatgcgacgtacttttggaggaaataagctctactgggccgtattctcggaatacgtgaagaccatgctacggagtggttatgctcctgttgaatttttcctcgaagggacaaggagtcgagctgccaagaccttgactcctaaattcggtctcctgaatattgtgatggaaccattttttaaaagagaagtttttgatacctactttgtcccaattagcatcagttatgataaaatattggaagaaagtctttatgcgtatgagctcctaggaatccctaagccaaaggaatccactaccggactgttgaaagctagacggattctctctgagaactttggaagtatccatgtgtactttggagaccctgtgtcactgcgctctctagctgcagggcggctcagtcggaacacgtataacttggtgccaaggtgcatccctcagaagcagcctgaggatgtgcaagcctttgtcactgaagttgcctataagatgcagcttttgcaaattgaaaacctggctctgagcccatggcttctggtagttgccattctgcttcagaaccagctgtgcatggacttcgatgccctggtggaaaagactctgtggctgaagggcttaacgcaggtgtttggagggttcctgctttggcctgataacaaacttcctgaggaagtggtccagtcgagcatcctcctgcactctaacctggccacccttgtcaaagaccaggtggttctgaaagtggactctgaaagctcacagatggtcaacgggcttgtgccccaacacattgccttcctcatgtgctcggcgtacaggaaccagctgctcaacgtgtttgcccgtccttccctagtagctgtggctttgcacatgactcctgggctcaggaaagaggatgtcttcagttgcttttccttcctccgcaacgtgttttcagatgagttcatcttccttccaggaaacacactcagggactttgaggaaggctgttacttgctgtgtaaaactgaggttatgcagatgactgggaaggacatcatcctcacagacaaagggaatgctgtattacagttcctcacaggactctttaaaccttttgtggaatcgtatcagatactttccaaatgcctcttgcatgaagaggactacttcagtgagaaggagtacttggtcacagccaggaagttcacccgccagcttctggatcaagatgcctctcagtgttacgacgcgctgtcctctgaacttcagaagaatgccttagcagccttcgtgagactcggggtggtagaaaagaataaggtagacagtaaatatgtgtattatgtcaacgggcctgccacaagcaagttagaagaaatgctcggatgtaagaagccaataggaaaaccagccactgcaaaactttaaaagcttagaaatc

SEQ ID NO: 3974 - DNA, 3168 bp, Rattus norvegicus
  Genbank Accession No. NM_053412
gaagagggtgtcggccttcttgggacagatgattgtaagctgcatgtgggtgccaggaactgaaccctggttcctctgcaagagcagtaaatagttgaagtattggtaacaccaaggaactgtcacaatttgaaaagataagccaaggctgatttccagacactacaggaaaaaaggaggggaaaatggcattgtatcatcatcacttcatcacaagaagaagaaggcgtcccatgagaatttttgtgaatgatgatcgccatgtgatggcaaagcattcttcagtatacccaacacaagaggagctggaggctgtacagaacatggtgtcccacactgagcgggccctcaaggctgtctctgactggattgatgagcaggagaaaggcaacagcgagctctctgaagcagaaaatatggacacacccccagatgatgagagcaaagaaggggctggggaacagaaggcggaacacatgactaggaccctgaggggcgtgatgcgggtcggcctggtagccaagggtcttctgctcaagggggacttggatctggagctggttctgctctgtaaggagaagcccacaactgcccttctggacaaggtggctgacaacctggccatccagcttactactgtaacagaagacaagtatgaaatactccaatctgtggatgatgctgcgattgtgataaaaaacacaaaagagccccccttgtccttgaccatccatctgacctcccctgttgtcagagaagaaatggagaaagtattagctggagaaacgctatcagtcaacgaccccccggacgttctggacaggcagaaatgccttgctgccttggcgtccctccgacacgccaagtggttccaggctagagccaatgggctgaagtcatgtgtcattgtcatccgtgtcctaagggacttgtgtacccgagtgcccacctggggtcctctcagaggatggcctctggagctgctgtgtgagaagtccatcggcactgccaataggccaatgggtgctggtgaagccctgcggagagtactggagtgcctggcttccggcatcgtaatgccagatggttctggcatttatgacccttgtgaaaaagaagccactgatgctattgggcatctagacagacagcaacgggaagatatcacacagagtgcgcagcatgctctgcggcttgctgcctttggccagctccataaagtactgggaatggacccactgccttccaaaatgcccaagaaaccaaagaacgagaacccggtggactatactgttcaaatcccccccagcaccacctacgccatcacacccatgaaacgccctatggaagaagatggggaggagaagtctcccagcaaaaagaaaaagaagatccagaagaaagaggagaaggctgagcctccccaagctatgaatgccctgatgaggttaaaccagctgaagccagggctacagtacaagctgatctcccagacgggtcctgttcacgctcccatcttcaccatgtctgtggaggtagacggcagtacctttgaggcctcagggccatctaaaaagaccgccaagctacatgtggctgtgaaggtgttacaggacatgggattgccaacaggcgctgaaggcagagactccagcaagggggaggactctgctgaggagtcagatgggaagccagcagtagtggccccaccccctgtggtggaagcagtctccaaccccagttctgtcttcccttcagatgccactactgagcaggggccgattttgactaagcacggcaagaatcctgtaatggagcttaatgagaagagacgtggcctcaaatatgagctcatttctgagacagggggcagccacgacaaacggtttgttatggaggttgaggtggacggacagaagtttcaaggtgctggctcaaacaaaaaggtagcaaaggcttatgctgcacttgccgcattagagaagcttttccctgacgcccctcttgctcttgaagccaacaagaagaaaagagcccctgtgcctgtccgaggcggacccaaatttgctgccaagccacataaccctggctttggcatgggaggccccatgcataatgaagcgcccccacctcccaacatccgaggtcggggccgaggaggtaacatccgagggcgaggacgggggcgaggatttggtggcaccaaccacggaggaggctacatgaatgctggcgctggatatggaagctatgggtacagcagcaattcggccacagcaggctacagtcagttctacagcaatggagggcattatgggaatgccggtggtggaggcagcgggggaggtggtggctcgtccagctacagctcctactaccaaggagacagctacaactcaccagtgcccccgaaacatgctgggaagaagccgctgcatgggggccagcagaaaccctcctacagctcgggctaccagtcccaccagggccagcagcaaccttacaaccagagccagtacagcagctacggcacgccacagggcaagcagaaaggctatggccatgggcagggcagctactcctcctactccaactcttacaactcccctggtggtggtgggggctctgactacagctacgacagcaaattcaactacagtggtagtggaggccggagtggagggaacagctatggctccagcgggtcatcctacaacacaggctcacatgggggttatggcgcaggttctggaggcagctcttcataccaaggcaaacaaggaggctactcatcacagtcaaactacagctcccctgggtccagccagagctacagcggccccgccagctcctaccagtcctcacagggtggctacagtcggaacacagaacacagcatgaactaccagtacagataaaggcccaggctgcccctctcaaccttctgcacctctgcctccaacttgtctcgggagattgagtctgcacatcaccagttgccatgtccactgggccagtgcccacccgtccacgttgctgacgttgccacgctgtgaggcgtggtggtccctgggacccgtgccgttgaccctatttagctgtgttttggactcagtgtcttcagtggtttgttagttaccattacaccttgtctgagtagtgttccga

SEQ ID NO: 3975 - DNA, 2842 bp, Rattus norvegicus
  Genbank Accession No. NM_053416
  misc_feature (1)..(2842): n = a or c or g or t
ggaattcggcacgaggtaaaaatcgagaagctaaaataccataggaaaccatgagatctattagatcttttgccaatgatgatcgccatgttatggtgaaacattcaacaatctatccttctccagaggaacttgaagctgtgcaaaatatggtgtctactgttgaatgtgctcttaaacatgtctcagattggctggacgaaacaaacaaaggcacaaaacctgagggggagacagaagtaaagaaagatgacgctgtggaaaactattccaaggatcaaggtggccggacattgtgtggtgtaatgaggattggcttggttgcaaaaggcttgctgattaaagatgacatggacctggagctggtcttaatgtgtaaagacaaacccacagaaactctgctaaatacagtgaaagataaccttcctattcaaattcagaaactaacagaagagaaataccaagtggaacaatgtataaatgaagcgtccattataattcggaacacgaaagagccaacactgactttgaaggtgatacttcattcccctctaattagggacgaattggagaagaaggatggagaaaatgttatgatgaaagaccctccggacttattggacaggcagaaatgcctgaatgccttggcttctcttcgacatgccaaatggtttcaggcaagggcaaatggattaaaatcatgtgtaattgtcctccgcattctgcgtgatttgtgcaacagagtacccacatgggcaccattgaaaggatggccactagagcttatatgtgaaaagtctataggtacttgtaatagacctttgggcnctggggaggccttgagacgagtaatggagtgtttggcatctggaatactacttcctggtggtcctggtcttcatgatccttgtgagcgagacccaaccgatgctctaagctacatgaccacgcagcaaaaagaagatatcacccatagtgcacagcatgcacttagactatcagcctttggccagatttataaagtactggagatggaccctcttccatctagtaagccttttcagaagtattcctggtcagttactgataaagaaggtgccgggtcttcagctctaaagaggccatttgaagatggattaggggatgataaagatcccaacaagagaatgaaacgaaacttaaggaaaattctggatagtaaagcaatagaccttatgaatgcactaatgagattaaatcagatcaggcctgggcttcagtataagcttttgtcgcagtctggcccggtccatgccccagtcttcacaatgtcggtagatgtggacggcacaacatacgaagcctcaggaccatccaagaaaacagcaaagcttcatgtggcagtgaaggttttacaggcaatgggatacccaacaggttttgatgcagatattgaatgtatgagttccgatgaaaaatcagataatgaaagcaaaaatgatacagtatcttcaaactcaagcaataatactggaaattgtacaactgagacctccagtaccttagaggtaagaactcagggtcctatcctatcctcacagcaagtggcaaaaatcctgtgtggagctaatgaaaaaagacgaggtctcaagtatgaactcatctcagaaactggtggaagccatgacaagcgctttgtaatggaggtagaagtagatggacagaaattcagaggtgcaggtccaaacaagaaagtggccaaggaagtgcagcgtacgctggaaaagctgttttctggacccaatgcagcaaataataagaaaaagaagatcattcctcaggcaaagggtgttgtgaatacggcagtatctgacgcagtccaggcagttcgaggcagaggaagaggaactctgacaaggggagcgttcgtgggagctacagcagctcctggatatatagctccaggttatggaactccatatggttacagcacagcgtcccctgcatatggtttgcccaagagaatggttctgttacccgttatgaaattcccaacatatcctgttccccactactcattcttttagcaaatgacagaagctcattcctattgaacaacaatacagtacaatgcagaatgttagagaaaaaagcctttttatcctgctttctttgaacacatacttacttgatcaaaattatttgtaaagaacatctttcctactttttgattttaacaaatgcaaatccagttctctaaaacttgaaaacaaacaaagaaaccagttctgtgaaacggtacctcattcctggaaataatttataccagccccttcgttgtagggaagtctagcagctcaaagttgacgtttaagagagtatcagattatgtaaagttaaatttgtgaaggatgtatagagtctcaacactgatcacaataaactgctttgttgtaacacagaaaaaattgcctgttgccagcgtctccaccttctacaaagtgagttgtctttttcttcattccacctcgtgggaagacagtttgaagggccacaggaagttatttgcttccttaaagcgttttccaactgtatagatctcatgaattagatctatacagttggaaaacgctttaaggaagcaaataacttcctgtggcccttcaaactgtcttcttcccacgaggtggaatgaagaaaaagacaactcactttgtagaaggtggagacgctggcaacagggaagaccagataaacaggcttattagacggatgaactaaggtattgcccgtggtatttttataatctggtcggttaataaacagtcacagcttggcaaattgaaaaaaaaaaaaaaaaaaa

SEQ ID NO: 3976 - DNA, 2192 bp, Rattus norvegicus
  Genbank Accession No. NM_053430
gcggcgaagctggaaacgatttcggctcgacattgtaagaacaggcttgtggctgtccacagaacactggggatccaaaccactgctagctaggtgaagcctcgtgcactcgaggcggagtgaggtctcgcggaagcgtctccgagagcggcgagggccgcgagagcaacaccaagcagcccggggcttgggctattctcactgatccgaacatctctcttcgctggtaggaagaagccattgctcctgtgttaccatgggaattcaaggccttgccaaactaattgctgatgtggcccccagtgccatccgtgagaatgacatcaagagctactttggtcgcaaagtggccattgatgcctccatgagcatttaccagttcctgattgctgttcgtcagggtggggacgtactgcagaacgaggagggggagaccaccagccacctgatgggcatgttctaccgtaccatccgcatgatggagaatggcatcaagccggtgtatatctttgatggcaaaccaccacagctgaagtcggcccagctggccaaacgcagtgagcggcgtgcagaggccgagaagcagctgcagcaggctcaggaggcgggggcagaggaggaggtggaaaagttcaccaagcggcttgtgaaggtcaccaagcaacacaacgatgagtgcaaacacctgctgagcctcatgggcatcccataccttgatgcgcccagcgaggcagaggccagctgtgctgccctggcaaaggctggcaaagtctatgccgcagccacggaggacatggactgcctcacttttggcagccccgtgctaatgcgacacttaactgccagtgaggccaagaagctgcccatccaagagttccacctgagccgcgtcctgcaagagctgggtctgaaccaggagcagtttgtggatctgtgcatcctgctgggtagcgactactgtgagagtgtccgtggcattggacccaagcgggctgtggacctcatccagaagcacaagagcatcgaggagatcgtgaggcggctggatcccagcaagtaccctgttccggaaaactggctccacaaggaagcccggcagctcttcctggagccggaagtagtggacccagagtctgtggagctgaagtggagtgagccaaacgaagaagagttggtcaaatttatgtgcggtgaaaagcagttttctgaagagcggattcgtagtggggtcaaacggctgaataagagccgccaaggcagcacccagggacgcctagatgatttcttcaaggtgacaggctcactctcctcagccaagcgcaaggagccagagcccaaggggcctgccaagaagaaagcaaagactggggcagcagggaagttccgaaggggaaaataaatgtgtccttcccctccactgtcccttggccccaggacagtgttttgtaccctcagctagagcacatccctctcgccctgcgtcttgaggacaagttcattgcttcccagcgctgcccttcagagctttccctcgcttgaccctgtgccaggaagcccgtagctctgcttttcctcatttttagctcaggaaagatgtcaggctcaaaccacttctcaggttaatggaccctgtccgttgctctgtgcaactgctagcagtattttaagggagaagataaggcagggagagagtaggaggtaatttcccagctggccagctggtgggggacaggtgactagagcgcggctggcgactgctctttctaatttcactgtgccctggaagacagccatcagtctgggattagctgatgagagagccgcaaagagaaacagaggagtctggcgacaacagatttaatactgactggctgttttgtggacttgctgtctggtgagcccagtagttgcgcaagggagtgaaaacacagtgtttaggtttaggtttgtagtgtttggttttgtgcctcccctctccagtgttgggaattgaacccagggcaaaggcattaagtgtaccactgacctgtagctccaagtgatgttctgaggctccaagtgatggcctttctgaggcagtcaatttaattgaggttttggaagaaaaaacttgttcatgggctgtttctattttaaaagatgtgaagaaaaaaaacaataaaattataaaagcaaaaaaaaaaaaaaaaaaa

SEQ ID NO: 3977 - DNA, 2037 bp, Rattus norvegicus
  Genbank Accession No. NM_053433
ctctttcagactttcgagaagactaggggtttagacacagagaagaaaggaagacaaataaaaggccaccatgaagaggaaagtggcagtcattggggctggtgtcagtggtctggctgccatcaggagctgtctggaggagggactggagcccacgtgctttgagaggagtgatgacgttgggggcctgtggaaattttcagaccacacagaagagggcagggccagcatttaccaatcggtcttcaccaactcttccaaagaaatgatgtgttttccagacttcccctatcccgatgactttcctaacttcatgcataacagcaagctccaagaatatatcacttcatttgccacagaaaagaaccttctaaaatacatacagtttgagacacttgtaaccagaatcaataaatgtcctgatttctcaaccactggcaaatgggaagttaccactgaaaagaacagtaaaaaggaaacagctgtctttgatgctgtaatgatttgttctgggcaccatgtatatccccatctaccaaaagactcctttccaggtctgaaccgtttcaaaggcaaatgcttccacagcagggactataaggagccaggaacatggaaaggaaaacgagtcctggtgattggcctggggaactcaggttgtgacatcgctgcggaactcagtcacgtggctcagcaggtcatcataagctccagaagtggttcttgggtgatgagccgggtctggaatgatggctacccttgggacatggtggtgatcacacgatttcaaacatttctcaagaacaacttacccacagccatttctgactggtggtatatgaagcagatgaacgcaagattcaagcatgaaaactacgggttgatgcctttaaatggaacactcaggaaggagcctgtgttcaatgatgagcttccagcccgcatcctgtgtggcactgtgtccatcaagcctaatgtgaaggagttcacagagacctccgctgtgtttgaggatgggactgtgtttgagggcattgactgtgtcatcttcgccacaggctatggttatgcctaccccttcctggatgacagcatcatcaaaagcagaaacaatgaggtcaccttgtacaaaggcatcttccctcctcaactagagaaaccaaccatggcagtgattggccttgtccagtccctgggtgctgccatccccacaaccgacctgcaggcacgctgggcagcacaagtaataagaggaacttgcattttgccttctgtaaacgacatgatggatgatattgatgagaaaatggggaagaagcttaaatggtttggcaacagcaccaccattcagacagattacattgtttatatggatgaattggcctccttcatcggagcaaagcccaatatcctatggctgtttctcaaggaccccaggttggccatagaagtgttctttggcccttgcagcccctaccagttccggctggtaggcccagggaagtggtcaggagccaggaacgccatcctaacccagtgggaccggtcactgaagcctatgaagacccgtgtcgtcggtggtattcagaaaccttgcttgtattcccattttctcaggctcctggctgttccagtgctcattgctttgttcctcgtgttgatctgattgagattccctctagaatgtctgcgagtcaccgacaataaccagacaagaactttgctatttaaaattaaggttttcatacctctccctttcctgttcaagatcatttgccagaactctagacatttattagtaagcaagacaatgttttgctctggccttgtaaataagtcacctttcagaatcatgctgacccgcagtgagcataagtcatttctcctaagttccactaacaatttgtaacaagaatggtatttttatggacaacttgaatcatctcctgaaagggttgaacagattccatttctcttttaaacgatgcttaaaagatatacttcagatctggacagggaataaagtacagcatttag

SEQ ID NO: 3978 - DNA, 3059 bp, Rattus norvegicus
  Genbank Accession No. NM_053436
  misc_feature (1)..(3059): n = a or c or g or t
gcgctcccccttcttctgacccccggcccggcggcgcccgccttctccgcagccactccgtctcttccctcccccggtctttctttcctcgccctcttcttttgcttttcttcctcgccgccgcccaataccgccggccccgggacgagctctggggaagcagccagaaagtatagcttctaccattgagctcaatgcactgtgcgtgaaactggaaagaaaaccaatgtataagcccgtggacccccactctcggatgcagtccacctacagctatggcatgcgtggaggtgcctatccccccagatacttttacccatttccagttccaccgttactctaccaagttgagctctccgtgggaggacagcagtttaatgggaagggaaagatgagaccacctgtgaaacatgatgccactgcccgagccctgaggactctgcagagtgagcccctaccagagaggctagaggtaaatggaagagaatcagaagaagaaaaccttaataaatcagaaataagccaagtgtttgagattgcgctgaagcggaatttgcctgtgaattttgagtctttccctctgacacaggtggcccgggagagtggcccgccacacatgaagaactttgtgaccagggtttcagttggggagtttgtaggggaaggagaagggaaaagcaagaagatctccaagaagaatgcggcaagggccgtgctggagcagctaaggaggctgccacctctacctgctgtggagcgagtgaagcccagaatcaagaagaaaagtcagcccacctgcaagctacagactgcccccgactatggccaagggatgaatcctattagcagactggcacagatccagcaggcaaaaaaggagaaggagccggagtacatgctccttacagaacgaggtcttccacgtcgcagggagtttgtgatgcaggtgaaggttgggcatcacaccgcagaaggagcaggtaccaataagaaggtggccaagcgcaatgctgctgagaacatgctggagatcctggggttcaaagtcccccaggcgcagcctgccaagccagcactcaaatcagaagagaagactccagtaaagaaaccaggagatggaaggaaagtaacattttttgaacctagccctggggatgaaaatggaaccagtaataaagaggatgagttcaggatgccctatcttagccatcagcagctgccagccgggattctccccatggtgccagaggttgcccaggctgtcggggttagtcaaggacaccataccaaagatttcgccagggcagctccaaatcctgccaaggccacggtaactgccatgatagcccgagaattgttgtacgggggcacctcgcccacagccgagaccattttaaagagtaacatctcttcaggacatgtaccccatggacctcgcacaagaccctctgagcaactgtactacctttccagagcccagggattccaggttgaatacaaagacttccccaagaacaacaagaacgagtgtgtatctctcatcaactgctcttcacagccacctctcgtcagccatggcatcggcaaggatgtggagtcctgtcatgatatggctgcactgaacatcttaaagctgctgtctgagttggaccaacagagcacagagatgccaaggacaggaaacggaccagtttcagcgtgcgggaggtgctgaacctattctggccatgaaccattataaaacccaacatatataccgaaaatactgagaactgctttgaaaatttggaatttctgataactccagtgggccaagacatggtggataaaaaaatgtggcaaagaagaaaaggaactgcaggtggtggccttggttgggctgggctgctggtgacgctgtgctccgccatccaccaggagaccagcagctccagtgtctccagctttttttttgcctcgtgacagagaaacggagagcgtggccaactctcacgctggcttcttcagattctttggaaaaccgggacagccacaccagagaggccttacagcggccccggagctaaacgcaccagagaaaaaccagtgcttcctacatgactgacgcaactctgccacacgtagcacccaccgtaaccactgctttctcttcaacagtgatggatgcctgttagttccattattccctttggttgagatgacactatgtaattttcatttcagtttctcagttgcatctacttacctagcagtttagaaactagtctgagacagatgctatccagctatgtaactggcaaagaccacagccctgtttggtgatgcnttctgtgcctctggctcggctggcagttctggacttanccacaagaatccttgactcccaaccccttgtataaattggacagcttaggacttttaaactttaggagatcaaaagatttggtcctttttaactttatttttaagcagcatacttaaaagtgagcctgacctttaccagttataacagattgtcaacgggagaggttgtcacccattttaacagattgccagtgggaggtcacttgagggagtattgctcaaggtggctttttctacacactacaggacattacctgtgggcccagaagactatgggctggtgtccctggagggcccaatacagtcaatcccagcctccacgtagggaagggcgacaggtttcctggtgctgtgctagtgtgcacagaggcaggaaggtctgccggcctggtgtggagcattgtggctccgagtgcaaccctgctgctcccactcggggtttagctggaccttttcacccatggaatataaggaaacttagtctttgtcaccaataaatgagaatactaaattttttttgttaatttattttcaaatgtcactacttctagatcaatctccttctggttcatccccttccccacctttttttaaaagaagagaatatttgtaatgcttgtgattctgtctgggcaaaaatctgaagatctaaaatctctttatattaaactattgatcaataaacagctactaag

SEQ ID NO: 3979 - DNA, 1751 bp, Rattus norvegicus
  Genbank Accession No. NM_053437
gaagattgggccgcgacgaggtgcgggccgaagccatgggcgaccgcggaggcgcgggaagctctcggcgtcgcaggaccggctcgcgggtttccgtccagggaggtagtgggcccaaggtagaagaggacgaggtgcgagaagcggctgtgagccccgacttgggcgccgggggtgacgcgccggctccggctccggctccagcccatacccgggacaaagaccggcagaccagcgtgggcgacggccactgggagctgaggtgccatcgtctgcaagactctttgttcagctcagacagcggtttcagcaattaccgtggtatcctgaattggtgcgtggtgatgctgatcctgagtaatgcaaggttatctttagagaatcttatcaagtatggcatcctggtggatcccatccaggtggtgtctctgtttctgaaggacccctacagctggcctgccccatgcttgatcattgcatccaatatctttattgtggctacatttcagattgagaagcgcctgtcagtgggtgccctgacagagcagatggggctgctgctacatgtggttaacctggccacaattatctgcttcccagcagctgtggccttactggttgagtctatcactccagtgggttccctgtttgctctggcatcatactccatcatcttcctcaagctttcttcctaccgggatgtcaatctgtggtgccgccagcgaagggtcaaggccaaagctgtgtctgcagggaagaaggtcagtggggctgctgcccagaacactgtaagctatccggacaacctgacctaccgagatctctattacttcatctttgctcctactttgtgttatgaactcaactttcctcgatccccccgaatacgaaagcgctttctgctacggcgggttcttgagatgctctttttcacccagcttcaagtggggctgatccagcagtggatggtccctactatccagaactccatgaagcccttcaaggacatggactattcacgaatcattgagcgtctcttaaagctggcggtccccaaccatctgatatggctcatcttcttctattggcttttccactcatgtctcaatgctgtggcagagctcctgcagtttggagaccgcgagttctacagggactggtggaatgctgagtctgtcacctacttttggcagaactggaatatccccgtgcacaagtggtgcatcagacacttttacaagcctatgctcagactgggcagcaacaaatggatggccaggactggggtcttttgggcgtcagctttctttcatgagtacctagtgagcattcccctgaggatgttccgcctttgggcattcacagcaatgatggctcaggtcccactggcctggattgtgaaccgcttcttccaagggaactatggcaatgcagctgtgtgggtgacactcatcattgggcaaccggtggctgtgctcatgtatgtccacgactactacgtgctcaactatgatgccccagtgggggcatgagctactgccaaaggccagcctccctaacctgggcctggagttctggagggcttcctgctgctgcacactcccctagtttggaggcctttctgcccctatggggcctactcctgctcttggggatggccctgagccagctggttgagccagtgctgggagtttgtgctgaccaggggcttaggatatcaataaagagctatctaaaaaaaaaaaaaaaaa

SEQ ID NO: 3980 - DNA, 1084 bp, Rattus norvegicus
  Genbank Accession No. NM_053439
catctttccagcttcagtcggacaggcgcggagactcttctggaagccgctctctcccgcaggatcgccgcgatggccgcccagggagagccgcaggtccagttcaagctcgtcctggtgggcgacggcggcaccgggaagacgacgttcgtgaagcgccacttgacgggcgagtttgagaagaagtatgtagccaccctgggcgtggaggtgcacccgctcgtcttccataccaacagaggacccatcaagttcaacgtgtgggacacagccggccaggagaagttcgggggcctgcgcgatggctactacatccaagcccagtgtgccattataatgtttgacgtaacatcaagagttacttacaagaacgtacctaactggcatagagatctggtacgcgtgtgtgaaaacatccccattgtattgtgtggcaacaaagtggatattaaagacaggaaagtgaaggcaaaatctattgtctttcaccgaaagaagaatcttcagtactatgacatttctgccaaaagtaactacaactttgaaaagcctttcctctggcttgccagaaagctcattggagatcctaacttggagttcgttgccatgcctgctcttgccccacctgaggtggtcatggacccagctttggcagcacagtacgagcatgatttagaggttgctcagacgactgcgctcccggatgaggatgacgacctgtgagaaaatgaagctggagccctgcgtcagaagtctagttttataggcaactgtcctgtgatgtcagcggtgcagcgcgtgtgccaccttatttagctaagcagatcgtgtacttcattgggatgctgaaagatgaatgggcttcgagtgaatgtggcagttaaacatacccgtcattttttggacttgcatatttagctgtttggaacagagttgtttccttcctgaatttcaaagataagactgctgcagtcgcatcacaatattcagtggtgaaatcttgtttgttactgtcattcccattcttttcgtttagaatcagaataaagttgtatttcaaataatctaaaaaaaaaaaaaaaaa

SEQ ID NO: 3981 - DNA, 1314 bp, Rattus norvegicus
  Genbank Accession No. NM_053467
atgtctggtttgtctggcccactatcctggcctggccctctcctatccgccttgctctttctgttccttctcggccccagctcggtcctcggcatctccttccatctacccgtgaactctcgcaagtgtctccgcgaggagatccacaaagacttgctggttacgggcgcgtacgagatcaccgaccagtctgggggcgctggcggcctgcgcacccacctcaagatcacagattctgctggccatattctgtatgccaaagaggatgcaactaaagggaagtttgcctttaccacagaagactatgacatgtttgaagtatgctttgagagcaagggaacagggcggatacctgaccaactagtgattctagacatgaagcatggagtagaggcgaaaaattatgaagagatcgcaaaagttgagaaactcaaaccactggaggtggagctacggcgcctcgaggacctttcagagtctattgttaacgactttgcctacatgaagaagcgggaagaggagatgagggacaccaacgagtccacaaacacccgcgtcctgtacttcagcatcttttccatgttctgcctcattggactagccacctggcaggtcttctacctgcgtcgcttcttcaaggccaagaagttgatagagtaatgaggctcagtcttctgtcccctggagccagcagaacatcgctgggacgtgcctggcctagcccaaggccaagttactaacagtatatcaaggcgcacgtgagcatcttgccagaactgatccttctggtgtgggagagcatgggcaccacccacacccagcaagtcagagaggactttttaatgcagtaggatttggactggtttgcaacaagattattaaagtcgcctatggaaaaacaaaacaaaacaaaacaacaaacaggggttacctagataacgccaaagccagcattcgtcctgggtcgcctcacaggatcggtttgagctgtttgctttttctctcccacttgctcaccgccttggtcctccactctagttctcctccaagatttctctgacctcggtcagctccttcatatcagttgtctctttggtttccttgtgaaacaccttgaacttctcttggtccttagatgaaatgtttacagagcttctggtgatatccttcataattttatgtcttctaaaagggtcatgggtgggacacaaaacaaagtgagctttgaactgtagataatctcttaaaagaaaatctcattttagaccattaaaatgtttgtgctcaaaaaaaaaaaaaaaaaaaaaaaaaaaa

SEQ ID NO: 3982 - DNA, 367 bp, Rattus norvegicus
  Genbank Accession No. NM_053469
cacgagggcaggacagaaggcaagatggcactaagcactcggatccaggctgcctgtctcctgcttctcctcctggccagcctgagcagcggtgcctatctccggcaacagacgagacagactacggctctgcagccttggcatggggcagaaagcaagactgatgacagtgcgctgctgatgctgaagcgaaggaagcgagacaccaacttccccatatgcctcttctgctgtaaatgctgtaagaattcctcctgtggtctctgttgcataacatagagagccaagagccttgtcctgacctctcaacacactgcctcccctccgccccattatttattcctgtcctaccccagcaatgaccttg

SEQ ID NO: 3983 - DNA, 704 bp, Rattus norvegicus
  Genbank Accession No. NM_053472
ccgccgtcttcagcttgcaactatgttttccagagctacccggagtctggtaatgaagacaggaggactcagaactcaagggacacacagcccaggaagtgctgctagcagcagccagcggaggatgaccccctatgttgactgctatgctcagcgctcctatcccatgccggatgagccttactgcacagagctcagcgaggagcagcgggccctgaaggagaaagagaagggcagctgggctcagctgagccaagcagagaaggtggccttgtaccggctccagttccacgagaccttcgcagagatgaaccatcgctccaacgaatggaagacagtaatgggctgcgtcttcttcttcattggattcacggctctggtgatttggtggcagcgggtctatgtgttccctaagaaggttgtcaccctgacggaagaacggaaagcccagcagctccagcgcctcctggacatgaagagcaaccccatacagggcctgtctgcccactgggattacgagaagaaagagtggaaaaagtgaccaacatcacagtctgctgcctgcccttgcaaaccgattccgcttccgcagcctaggagaccctcctctcctctcttctcctcccttcccctcccccacctcctgtcttgtctcctccattcccttctgctccaataaaagcagcctgcattgttctgcctgc

SEQ ID NO: 3984 - DNA, 2020 bp, Rattus norvegicus
  Genbank Accession No. NM_053477
atgagaggcttggggccaagcttgagggctcggcgcctgctcccactgcggtacccgccgcggcctccggggcctcggggacctaggctgtgcagcgggctcacggctagcgccatggacgagctgctacggcgagccgtgccacccacgccggcctacgagctgcgcgagaagacgccggccccggccgaggggcagtgcgcggacttcgtgagcttttacggcggcctggccgaggcggcccagcgcgccgagctgctcggccgcctggctcagggcttcggcgtggatcacggccaggtagcggagcagagcgccggagtgctgcagctgcgccagcagtcgcgcgaggcggccgtgctgctgcaggcagaggaccggctacgctatgccctcgtgccgcgataccgtggcctcttccaccacatcagtaagctggacggcggcgtgcgcttcctggtacagctgcgggccgatctgctggaggcgcaggccctcaagctggtggaagggccgcacgtccgggaaatgaacggagtgctaaaaagcatgctgtccgagtggttctcctctggcttcctgaacctggagcgggtcacctggcactcgccctgtgaggtgcttcagaagatcagcgattgtgaggctgtgcagcctgtgaaaaactggatggacatgaagcggcgtgtggggccataccggaggtgttacttcttctcccactgctccacccccggggaccccctggttgttctgcatgtggctctgaccggtgacatttccaacaacatccagagcattgtgaaagagtgccctccgtctgaaacagaggagaagaaccggatcgctgctgctgtcttctactccatcagcctgacccagcagggcctgcagggcgtgggactcggcaccttcctcataaagcgagtggtcaaggagctgcagaaggagtttcctcatctgggggccttttccagcctgtcacctatacccggattcaccaagtggctgctgggccttctgaatgtgcagggaaaggagtatgggaggaacgagctgttcacagactcagagtgcaaagaaatcgcagaggtcacgggcgaccctgttcacgagagcctcaagggtctcctgagcagtggtgagtgggcgaagtctgagaagctggcacaggcactgcaggggccactgatgagactgtgtgcctggtacctttacggtgagaagcaccgatacgccctcaatccagtggccaacttccacctgcagaacggggctgtgatgtggcgtatcaactggatggctgacagcagcctcaaaggcctcaccagctcgtgcggcctcatggtcaactaccgttactacctggaggagaccggccccaacagcatctcctacctgggctccaagaacatcaaagcttccgagcagatcctcagcctggtagcccagttccagagcaacagcaaactctagggacatcctgcccagcgcttggccctgctcagaaaggaggctgtattctgatgggccagcgctgctcaccacagcaaccactcaggaggccacacctcagctgtcactgtgctggcggactcactggttggagtggtggtggttttgggtacacctgccctgaggatgtcactgtgcttctccaaaagcccttgctgctgcccccacagcctgtgctttcagaaagctctacagatgcagccacaggccgcccaggacggagcccagagcacagaccctgtagagtacagagagttggcagtcatgtcctctattcgggagagggctaaggtctgtgccgtggctgctaccacagcttaagctcagactagggagaccttgtggtgtgcacagggtgtgatctgcaacccagggatgctgctacttgaggccagaataggctcgtagggtttaaatgagatcccagttcataatgaactgaacagtaaagaacaaatttgttctgtaaacattaaacatgattgttcactgtaaaaaaaaaaaa

SEQ ID NO: 3985 - DNA, 1194 bp, Rattus norvegicus
  Genbank Accession No. NM_053487
agagagagagagagagagagagagagagagaacccacccacccggcgactaatctgatcccggctgtcccccgggaccagcgaggtcccagaagacccacgagggagcgggcgtaacgcgtggctgcgggtgggagccatggacgccttcatccgagtcgccaaccaaagccaaggtcgggaccgacttttcagagccactcaacacgcatgcatgttgcttagatatttgttagagtctaaggctggcaaagaggcggtggtaacgaagctcaagaatctggagactagtgtgagcactggccgtaaatggttcagactaggcaacgtgctccatgccatccaggccactgagcagagcatccaagccactgaccttgtgccccgcctatgcctaacattagccaacctgaaccgcgtggtttattacatctgtgacactgtcctctgggcgaagagtgtgggtctgacatctggaatcaacagagagaagtggcaaatgcgggcggcccgccactactactatttcctcttgctgagcctggtccgggatctgtatgaggtcttgctgcatatgggacaagttgcacgcgacagagcaaagagagagaagtcctccggggaccctcctaagtacagcgtcgctaatgaagaaagtgaatggctccagtccttcctcctcctcctcttccagtctctaaagcgaaatccgcccttattcctggacaccgtgaagaacttctgtgacatcctgatccctttgaaccagctcgggatctacaagtccaaccttggcgtggtaggatttggaggtctcgtgtcctctgtggctggcctcatcactgtggtgtatcctcagttgaaactgaaggcccgctagggtgtttggaaaatttaagactgacgttcagtggagcaaacatttgcttttgtcatgatgtctactgtacttaattttttttaatcatgtgagcatcttaccaaccggtgatgtgagcagaggtaggacccacaacggagcctgaagactgatgacgtttttgtaaacacggcagtaacttctgcacatttccccttcagtgacttctgactactgcaaaaacatttgtgccgtcattgaagacgtgtaaaggggaagtcagaacattgctgagcatcttttctgtacatagtaagagctcatatatctaacaaa

SEQ ID NO: 3986 - DNA, 645 bp, Rattus norvegicus
  Genbank Accession No. NM_053507
catgatctgtctggtgctgaccatctttgctaacctcttcccctcagcctacagcggcgtgaacgagcgcacgttcttggcagtgaagcccgacggcgtgcagcggcggctggtgggcgagatcgtgcgtcgctttgaaaggaagggcttcaagctggtggcactgaagctagtgcaggcctccgaagagctactgcgggagcattatgtcgagctgcgggagagacctttctacagccgattagttaaatacatgggctctggtcccgtggtggccatggtgtggcaagggctggatgtcgtgcgcgcttcgcgggccctcataggggccactgacccaggggacgccacgcccggtacgatccgtggtgatttctgtgtggaggttggcaagaatgtgattcatggcagtgattcggtggaaagtgctcagagagagatcgctctttggttccgtgaggatgagcttctgtgctgggaggacagcgcgggacactggctatatgagtagacgctaaaatcaacattaccaatctggaggttgttggtcttctgtgatcttcacagtgacagtgctatgtgggtgcaggtccacccaacccagtctgtccaggggcaaccacttccacatcccaccctctattt

SEQ ID NO: 3987 - DNA, 1876 bp, Rattus norvegicus
  Genbank Accession No. NM_053516
cggtaattatcgcaattcctacaggcgtaaaagtattcagctgactcgctacactacatggaggaaatatcaaatgatcccccgccatattatgagccttagggtttatcttcttattcacagtagggggcctaacagggatcgtactatctaactcatcccttgacattgtacttcatgatacatactatgtagtagctcacttccactatgtcttatctataggagcagtattcgccatcatagctggcttcgtccactgattcccactattctcaggctataccctaaatgacacatgagcaaaagcccactttgccattatatttgtaggtgtaaacataacatttttccctcaacacttcctagtattagcggggatacctcgtcgttactctgattatccagatgcttacaccacatgaaatacagtctcctctataggctcattcatctcacttacggccgtccttgtaatgatcttcatgatttgagaagccttcgcatcaaaacgagaagtactctcaatttcctactcctcaactaacctagaatgactgcatggatgccccccaccctaccacacattcgaagaaccttcctacgtaaaagttaaataagaaaggaaggattcgaaccccctacaactggtttcaagccaatttcataaccattatgtctttctcaataaaaaaaaaaaaaaaaccacttccttccttcccaggctaccgggaccgcagctatgaccctccatgcccaggccactggacgccagaggcacccagttcagggaccacatgtcctgggctgcccagagcttcagaggaagaggagatcggaggtcctgaggactctgaggcagtacagcctcgaacaccagaggagccagaactagaagctgaagctactaaaggggatgagccagacctggaacaagaaatggaaccagaaccagagccagaggtagaaccggagccagagccggagccggagccggagccggagccggagccggagccggagccggagccggagccagagcgagagcctgacttccaagaaggggatgagtctgaaggttgtgagaacacctaaaccctagcttgcaggcttgttagaaattgtggactgggaagtaggggttgatccccactccactgaccatcattttcatctctagattcttgaaggccagaatatccttacctgtccaaatctgattcaagctggataagatctggaaacctgccagaactggaccaagtcaatgcagcaagactccatttactgccaaatgagtaaactcgggagggttagcctggacctgattcttcacaactcaggctctttactcaagaatggtctgaatcccactgacctgagcaggcttgtgtgaaaaataccatcccccccaccaacagtattccactcccaaagtagcccaagctgtatttctagagatcttagattcaggcccctaaatcagaccctcttccactccctttttccccctcaggggccatttgggagcccaagtgggcaacacttctacaccatggaaacgactagacttaagagtatcaagcaagtgaaggtggctggctgtccatccacacacagagagaagtcttggagctcacagtcttgaaggggggacctgagagaaaactggagtagacagaagccacacgcatcattgtaactgctctttaattgtctggccttcctctgaactgggagctccgtgtggggtgtggggtctaaccagtcacagacatacacaaggagctctgtacattatctactaagcaaatgaataaaaacttcccagctgtgtttccaagctttcacagatggaaaaattaaataaaaagcc

SEQ ID NO: 3988 - DNA, 3873 bp, Rattus norvegicus
  Genbank Accession No. NM_053522
ccggcggatcctcctggggaggccgggccggggagcgggttcgggcgccgagcggcggggccagcagccgggcgcggcgagcgggaccagggcggggagcggggtagcgatcgaagcggcggcggctgcgctccgggcccgccgcaccttcccctccggtcaggggaaccgctgcatggggccgggggggcggccctgctgcgccgagcggcggcgacggcggaccccccaggcgggctggggctgagcccggggccggggcgggggctccggggggaccatgccccgaggccggccggccgcagcatggctcacgggcccggcgcgctgatgctcaagtgcgtggtggtcggcgacggggcggtgggtaagacgtgcctgctcatgagctatgccaacgacgccttccccgaggagtacgtgcccactgtcttcgaccactacgcagtcagcgtcaccgtggggggcaagcagtacctcttgggactctatgacacagctggacaggaagactatgatcgtctgaggcctttatcttaccccatgactgacgtcttcctcatatgcttctctgtggtaaatccagcctcatttcaaaatgtaaaggaggaatgggtaccagaactaaaggaatatgcaccaaatgtccccttcttgttaataggaactcagattgatctccgagatgaccccaaaactttagcaagactgaatgacatgaaagaaaaacctgtctgtgtggaacaaggacagaaactagcaaaagagatcggcgcatgctgctatgtggaatgctcagctctgacccagaagggtttgaagactgtgtttgacgaggctatcatagccattttaactccaaagaaacacacagtaaaaaagagaataggatcaagatgtataaactgttgtttgattacgtgagaaacatctttagtggccaaggaaactgtcatttctcccagaaagcatttgaaatgctacagcaatgtcctgacctcttacaatgaagcagtttaacttgaggggggagggagcctgtcctcagcatcctacagagttcattgagaatgtttcataaaggtctaagcggcagcgaacagcatctgaagccacaatctactataaatactttatttcaactagaaggtacaatctctcaggggtttcatagttaaaaagctacaatcacatcatgttgaaatgacatttagaaaaccacagtgctgtaaatggacggctcggctttgaccacgtacacttctgcacagcccttatggactctgcacaaagaaatcacttctctcccttctcctcttaattgttcttgtatgtaagttgctttctattccagtatatccagagtggcgagataaccaggccagccacgtagccaaaggtcgctccgagtgtacaggagatgggccacacctaaggaaagaattgagatctaagccaaccgatgctttattacacttgagcacaaatgaagtgtactgcacacatttctatagtgaagcttagtgtgcttcataaagaatgccaagtttaataggtcatgactgcattgatcataacactaaaagtgtccacattttagttaatgtgcattaaacagtaacatggcctctggcaactgtagctctagtttgcttttatctaaactgcatgaaatacatgcaaaagtaacatgtaaaaatgggtcattgtttaccataatcctgaactcagtttggctctgaattagttggccatttttctaactcctacactggctgtgtacatcaaatgaaataagtgagcaaaccttagaaacgttcagtcgtgtgagaggaaagacgtgggatgcgagcatgtcacgtggaatttgtggttatctcttccatggtaagctgatggccacttggagctgcagatagtgtgtccacagcagaaggtctacacaccacagcttacgtacacacctagagcgtgaggcaagaacacactccccacgctacatctcactaagccagaaatagaggagactttttaatgccacagacagggtgtgtgtgtaaagtcttgcagacaccttcatgtcctttgtaaagcttatctggtgtactgcagcctttcttacccttctctggggaatcggccatccaagtgtactggagggaaaccatcctaataactggctgctacctcgttggctttcttcttccgtctgctatggatctgccttattctaaatgccatgcaacagacagtagtgtaggcaaagcttccatgaaccacctcatgcagtctggggaagcgcaagcagatccacacattggcaccagcctcccttaggttcaaagttgctgttgcttaaactacgacatctgtctttagcaagcttctgttatcttccatggtttgtgcttaagcttggtctagtgcacagattgggtaatggaacactaaacatttatacttgaaaatgacagccttaaatgttcataccagtcacaaatctagatgtactgtcttgcatgtgagctttgtaggagtttttaaaatatgagcaccacactccccacgcggtagcagaccgtctactgacaagagctctcttggaagtggacgcaggatgtcctcaggcagtggcggttcacattaggtatatcatggccttatttatgtatgctcaaatgggacttctgtaattttcccatttagtttcggtctgtttttagatagaattgaaagaaattgtatagtcggctaacgtactagctaagttgtcaaacctatgatatgaaggaatcaagacagtaaagtattattcatttccaagttgcctttggagatttgatggtttgtttttttcttcaaatctacatctgtgaaacccttgacactcggtgtgttagcaatgagataaagtcaaggacttgcctgcttcaagagaaaaggattaagaatctaaaggtgcagtggtgtcacctcagtctcctcatgtgtggccgtggggggacgaccgtgtgtcctagtcattcttgagcgcttatcactctctcctagttgacagcagtccgttgggcttcagcttctccagatggtaagaatcatgtacacagactgtttgaactctaagcagacgattgtatcatctgaacctgaggtgccttaggtactctacttaccttgatggggtttggagtttcccattgcttgttaagagctctttgtgtttgttatttaatatttctttttgcaaaatcttctctgccactttaagcagaaaaccaaagatttgttttctattcatgaacagattatagagagactgccttattttcagacgcatgtcttcattaatggcttaggttgccacagaaattcagactaatctctggaataactctttcaaactagtgaaatatctgggaaagaaaattcttctcaatgttttattaatatgaactgtgttagtaagaacactgcttcaaataaggtcatgtgtgaaagaacatacaacaaattatagttggttagtgtttgcatagaaaatctgttctaaagccctttaaaatgttgaggggaatcctgcactctaacagcctctctttgctaacgtatgcccttcctgtccttgcaggtacattgtagctcactcgtgatgaattatcatatttcaatacacagagcttgagttcatactacttgttatcttagttattttacatactgcttccgtttgactttcaatgattggttttaaataccaaattaaatgctggtttgttggttgttgtttttaaatgattgttacttcaatagcatcccctcctgacatatggagtcataataaaatgagatgcatagtttaaaaaaaaaaaaaaa

SEQ ID NO: 3989 - DNA, 1857 bp, Rattus norvegicus
  Genbank Accession No. NM_053523
aagacaccaagtgtcgttgtggggtcgcagacggctgcgtcgccgcccgttcggcatccctgagcgcagtcgagcctccagcgccgcagacatggagcccgagccacagcccgagccggtcacgctgctggtgaagagccccaatcagcgccaccgcgacttggagctgagtggcgaccgcggttggagtgtgagtcgcctcaaggcccacctgagccgagtctaccccgaacgcccgcgcccagaggaccagaggttaatttattctgggaagctgctgttggatcaccaatgtctccaagacttgcttccaaagcaggaaaagcgacatgttttgcacctcgtgtgcaatgtgaggagtccctcaaaaaagccagaagccagcacaaagggtgctgagtccacagagcagccggacaacactagtcaggcacagtatcctggggattcctcaagcgatggcttacgggaaagggaagtccttcggaaccttcctccctctggatgggagaacgtctctaggcctgaagccgtccagcagactttccaaggcctcgggcccggcttctctggctacaccacctacgggtggctgcagctctcctggttccagcagatctatgcaagacagtactacatgcaatacttggctgccactgctgcttcaggagcttttggccctacaccaagtgcacaagaaatacctgtggtctctacaccggctcccgcccctatacacaaccagtttccggcagaaaaccagccggccaatcagaatgcagccgctcaagcggttgttaatcccggagccaatcagaacttgcggatgaatgcacaaggcggccctctggtggaagaagatgatgagataaaccgagactggttggattggacctactcagcagcgacattttccgttttcctcagcattctttacttctactcctccctgagcagattcctcatggtcatgggcgccaccgtagtcatgtacctgcaccacgtcgggtggtttccattcagacagaggccagttcagaacttcccagatgacggtccccctcaggaagctgccaaccaggaccccaacaataacctccagggaggtttggaccctgaaatggaagaccccaaccgcctccccgtaggccgtgaagtgctggaccctgagcataccagcccctcgttcatgagcacagcatggctagtcttcaagactttctttgcctctcttcttccggaaggcccaccagccctagcaaactgatggcccctgtgctctgttgctggaggctttcacagcttggactggatcgtcccctggcgtggactcgagagagtcattgaaaacccacaggatgacgatgtgcttctgtgccaagcaaaagcacaaactaagacatgaagccgtggtacaaactgaacagggcccctcatgtcgttattctgaagagctttaatgtatactgtatgtagtctcataggcactgtaaacagaaggcccagggtcgcatgttctgcctgagcacctccccagacgtgtgtgcatgtgtgccgtacatggaagtcatagacgtgtgtgcatgtgtgctctacatggaagtcatagatgcagaaacggttctgctggttcgatttgattcctgttggaatgttgcaattacactaagtgtactactttatataatcagtgacttgctagacatgttagcaggacttttctaggagagacttattgtatcattgctttttaaaacgcagtgcttacttactgagggcggcgacttggcacaggtaaagcctttgccgggttttctgttcaataaagttttgctatgaacgacaaaaaaaaaaaaa

SEQ ID NO: 3990 - DNA, 2847 bp, Rattus norvegicus
  Genbank Accession No. NM_053527
ggtcgctcttggaggaagtggcctctttgcgtcccgtgaccgaagcgccgttactactttctcgaagctccactcggccgcttgccggacactccgccgccaagatgccccggattatgatcaaagggggcgtgtggaggaatacggaggatgaaattcttaaagcagcggtaatgaaatatgggaaaaaccagtggtctaggattgcctcattgctgcataggaaatcggcaaagcagtgcaaagccagatggtacgaatggctggacccaagtattaagaaaactgaatggtccagagaagaggaagaaaagctcttgcacttggccaagctgatgccaacgcagtggaggaccattgctccaatcataggaaggacagcagcccagtgcttggagcactatgaattcctcctggacaaaactgcccaaagggacaatgaagaggaaacaacagatgacccccgaaaacttaagcctggagagatagatccaaatccagaaaccaaaccagcccggcctgatccaattgacatggatgaggatgaacttgagatgctttctgaggctcgagcccgtttggccaatactcaaggaaagaaggctaagaggaaagcaagagaaaagcagttggaagaagcaaggcgccttgctgccctccagaaaagacgggaacttcgagcagctggcatagagattcagaagaaaaggaaaaagaagagaggagttgattataatgctgaaatcccatttgaaaaaaagcctgctcttggtttttatgatacttctgaggagaattaccaggcccttgatgctgatttcaggaaattacgacagcaggatcttgacggggagctaagatctgaaaaagaaggaagagatagaaaaaaagacaaacagcatttaaaaaggaaaaaagaatctgatttaccatctgctatccttcaaactagtggtgtctctgagtttactaaaaagagaagcaaacttgtgctgcctgcccctcagatttcagatgctgaactccaggaagttgtcaaggtaggccaggccagtgaagttgcacggcagactgcggaggagtctgggatcacaaactctgcttctagcactctcctgtctgagtacaatgtcacaaacaacagcattgctctgagaacaccacggactccagcctcccaagacaggattctacaggaagctcagaacctcatggccttgaccaatgtggacactccactgaaaggtgggcttaacaccccactgcacgagagtgacttctctggtgtgacgccacagcggcaggttgtgcagactccaaatacggttctgtctacccctttcaggactccttctaatggagctgaagggctgactccccggagtggaacaaccccgaaaccagtcactaacgccaccccaggtagaacaccacttagagacaaattaaacattaatccagaggatggaatggcagactacagtgacccctcttacgtgaagcagatggaaagagaatctcgtgaacatctccgtctagggttgttaggcctccctgcaccgaagaatgattttgaaattgttctgccagaaaatgcggagaaggaactggaagaacgtgaaatggatgacacgtacatcgaggatgctgctgatgtggatgctcgaaagcaggccatacgagatgctgagcgtgtaaaggaaatgaaacgaatgcacaaagctgttcagaaggatctacccagaccgtctgaagtaaatgaaactattttaagacctttaaatgtagaaccacctctaacagatttgcagaaaagtgaggaactgatcaaaaaagagatgattacgatgcttcattatgacctgctgcatcacccctacgagccgtctgggaataagaaagggaaaaacgtcgggtttgctaccaacaattcagagcacattacctatcttgagcatagcccttatgagaagttctccaaagaggatctaaaaaaggcccaggatgttctggtgcaagagatggaagtggtaaaacaaggaatgagccacggagaactctccagtgaagcttacaaccaggtgtgggaggaatgctacagtcaagtcctctatcttcctgctcagagccgctacacacgggctaatcttgctagcaaaaaggacagaattgaatcacttgaaaagagacttgagataaacaggggtcacatgacaacagaagccaagagagctgcaaagatggaaaaaaagatgaagattttgctgggtggttaccagtcccgcgccatggggctcctgaagcagctgaacgacctgtgggaccaaatcgagcaggcgcacctggagctgcgcacctttgaggaactcaagaaacacgaagactctgctattccccgtaggctagagtgtctaaaggaagatgtgcagcggcaacaggaaagagagaaagagcttcagcaaagatatgcggatttgctgatggagaaagagactttacaggcaaagttctgaagcacagaggacgctctgcctcagaagaactagttgctggtttcgtactcagcaaggccgagactgacctttctcctcattgacaaagtcacccagcacctgtgggctctcggttgcttgttttgaatgatactgatcttgcgtgttctgtgttacaaacttggactccaggataataagggtttaaattatccagatgctcattctttgccagtgtcatatttacaaaatttcgtagtttaggcctttaatttaaaaagcctgattttaaatactgcctgcaagtaaacccttgaataaaaagaacatgtgaagaaaaaaaaaaaaaaaaaaa

SEQ ID NO: 3991 - DNA, 2458 bp, Rattus norvegicus
  Genbank Accession No. NM_053536
atacggagccgggccgcacgcgcgaggccgtgccaggcgacgccgagtccaggcagtcctgttctgggtcctgggacaccgtgtgcactgaatttgcgtgactgtacagacgctaagtgctcagtatgtggaagttgttgagtattcgtataccctacgtataggagccacgtcacactggcagcaaacagatgtgcgcacagagacgttgtgctgctttcctgaggttgcacagctgacagctgcagacaagtcaccacaggctcggccaggccagcatggtggaccacttgcttccagtggacgagaccttctcgtcaccgaaatgcccagtgggatacctgggagataggctggccagccggcagccataccacatgttgccctcgcccatctccgaggatgacagcgatgtctccagcccctgctcttgtgccagccctgactcgcaagccttctgttcctgctacagtgcaggtccgggccctgaggcccagggcagcatcttggatttcctcctatcccgggccacactgggcagtggtggtgccagtggaggtgtcggagatggcagtggccctgtgacctggggatcgtggaggagagcctctgtgcctgtgaaggaggaacatctttgcttccctgaatttctgtcaggggaccctgatgatgtctccaggcccttccagcctaccctggaggagattgaagaattcttggaagagaacatggaggctgaggtcaaggaggccccagagagcagcagcagggacctggaagcctgtagccagctctcagctgggtcacaccggagccacctccatccagagtccggtgggagagagtgccgtatcccaccaccaggtggcaccagtgggggtggtacccaaggtgcaggtgaggggtcagctcatgatggccccatgccggtgctactgcagatccagcctgttgctgtgaagcaggaagcaggtgcagggccagcctccccagggcaggccccggagagcgtcaaggtcgcccagcttctggtcaacatccaggggcagacctttgcactcctgcctcaagtggtaccatcctccaacttgaacctgtcctcaaagtttgtgcgaattgcgcctgtgcccattgccgccaaacctattggctcaggatccctagggcccggccctgctggtctccttgtgggccagaagttccccaagaacccagcagcagaacttctcaaaatgcacaaatgcactttcccaggctgcagcaagatgtacaccaagagcagccacctcaaggcccacctgcgccggcacacaggcgagaagccctttgcctgcacctggccgggctgcggctggaggttttcacgctcagatgagttgtcacggcaccgacgatctcactcgggtgtgaagccgtaccagtgtcccgtatgcgagaagaaattcgcgcggagtgaccacctctccaaacacatcaaggtgcatcgcttcccacgaagcagccgcgcagtacgcgccatcaactgagcgcagtggccgccctcccctcccccacctccacattttgtttttaaatgcaataacttattgcctctttcagaaggatgtgacaatattaccagtcccccttctgaatcttaggaggtatgacccagagccgccgtggctgcctttccggggaggacccagagtccccaaggtccctgggggctggttccccggtggcccaggtggcccaggcaggcctgtgcccttgtgcctttgtgccttcctgccagctggaagcagtgtttggggggcccttgccctcctcccattgggctccctaccagggccaaagccaacattatcactggggaaggagtgttttggctgtgtcgaaatagtagctcccagaggaagccatgctgagaaaaaggaagtaggtcaaaagcgcagggctgtactgtggtgcgaggaccgccatatgcaagaggcctctgagggtccaggaggatggccaccctcgctctaggccctaacgcaagtgcttaaatgcaagacaaatggagccatatccatccatacccagcctggctcaccctcctccagacgccaacctcctggctgtggtgggaagcgaaaggagcaggtctggtggatgcaaagcgactagctagcgcctcccagtctgacttagatccgcattcctcgtcaggtctagaaattagtaccaattgaactagcttgtttcgacaggtctgtttcacatcctatgaatgtatgtaaataaactgtacataggtgcgcatctacataaaatatcttttaataacacgttgacatttgtgtaaatttgaaatttaaaaaaattctatgaagtcagtgtacatatgttacaattatgtatattttctttggtccttcataaaaaatatatttactttgccaataaaaagagagaaaaaaaaaaagaactc

SEQ ID NO: 3992 - DNA, 1910 bp, Rattus norvegicus
  Genbank Accession No. NM_053537
gtccaagggtccatgtggtaagcagactgaaccgtcctagataccaaagagggacaccttgtgggtgggtagcatgggcttcgaagacctgctggacaaggtgggcggctttgggcccttccaacttcggaatctggttctgatggccctgccccgaatgctgctccccatgcactttctcctgcccgtcttcatggccgctgtgcctgcccaccattgtgccctgcccggtgcccctgccaacctcagtcaccaggacttatggctggaagcccatctaccccgggagactgacggcagctttagctcctgcctccgatttgcctatccccagactgtccccaatgtcactttggggacagaggtgtccaactctggggagcctgagggtgagcccctcacggtgccctgctctcagggctgggagtacgaccgctcagaattctcctccaccattgcaactgagtgggatcttgtgtgtcagcagagaggactgaacaaaattacgtccacctgcttcttcattggtgtgctggtgggagccgtggtgtatggatacttgtctgacaggtttggcaggcgccggcttctgctggtggcctacgtgagctccctggtgctgggtctgatgtctgcagcctccatcaactacatcatgttcgtagtcacccgtacactcaccggctcagccctggctggcttcaccatcattgtgctcccactggagttggagtggctggatgtggagcaccgcactgtggccggggtcatcagcaccgtcttctggtcgggaggcgtgctgctgctggcactggtgggctacctgatccggagctggcgctggcttctgctggctgccaccctgccgtgtgtcccaggcatcatcagcatctggtgggttcctgagtctgcacggtggcttctaacccagggtcgtgtggaggaggcaaaaaaatacttgctgagctgtgccaagctcaatgggcggcccgtgggtgagggcagcctgagccaggaggccctgaacaacgtggtcaccatggaaagggcgttgcaaagaccctcatacttagacctgttccgaacatctcagctccgacatatctcactgtgctgcatgatggtgtggtttggagtgaacttttcctactacggcctgactctggacgtgtctgggctggggctgaacgtgtaccagacacagctgctgtttggggctgtggagctcccctccaaaattatggtctacttccttgtgcgccgtctgggacgccgtctcacggaggctgggatgctgctgggcgctgctctgacctttggcaccagcctgctggtatccttggagactaagtcatggatcactgctctggtggtggtggggaaagctttttctgaagctgcttttactacggcctacctgttcacgtccgagttgtaccctactgtgctcagacagacaggattgggacttactgcactcatgggcaggctaggggcctctctggcccgactggcggccttgctggatggagtgtggctgttgctgcccaaagttgcttacggggggattgccctggtggctgcctgcactgcactcctgctgcctgagacgaagaaggcacagctgccagagaccatccaggatgtggagaggaagagtacccaggaggaagatgtgtaggtccgggactgagttggactagcgacagttctccacaggagctgggcacagaaggcagcctcttgtgactgggacatcagactcctccacctaaggatggagctgctcctgatgccctctgcctgtgctctccagcagcagaacaacttcccgcagcactgggccgctgggattctggactcccctctcatggccgggggcttctataaataaagacggttgctcatgg

SEQ ID NO: 3993 - DNA, 1182 bp, Rattus norvegicus
  Genbank Accession No. NM_053539
ggaagcttccccaccgcaaagcagctagacgtgcgggcagtctcagctgtccactgggagtcgccaacaccatctcttgggctccagggtcgcaatcactaccggggatctccagcaagtcttccggacccacgcgtagaggaggtggtgccaccgcgcgcaaacctggcgcggtcgtgacgtcaggactacgctagattggcaattggctggaggcatgtggcgcggacgggcactggcaggagtgattggatcagctcttaaggggcggggtctggaggcggagcatgctgccgagagcgttgaagtacggcgctccgcacagcttctcgacactcctgtctggaatcgctgtgttctaggtcagatcagacattctgtcacaatgcctgaaatcaatgccagcaatcttgatgaaaaacaggttcagcttctagcagagatgtgtattcttattgatgaaaatgacaataaaattggggctgacaccaagaaaaattgtcacctgaatgaaaacattgacaaaggactaatacatcgagctttcagtgtcttcttgtttaatactgaaaacaagctcctgttacagcagagatcggatgctaaaattacctttccaggttgtttcaccaatagttgctgtagtcatccattaaataaccccggggagctggaagaaaatgatgccatgggtgtcaaacgagcagcacagaagcgcttaaaggcggagctggggatacccttggaagaggttgatctaaatgaaatgaattatctaacaagaatttactacaaggcccaatctgatggtatctggggtgaacatgaaattgattacattttgtttctgaggaagaatgtaaccctgaatccggatcccaacgagattaaaagctattgctatgtatcaaaggaagaactcaaagaaattttgaagaaggaagccaggggcgaaattaagtttactccatggtttaagattattgcagacgcttttctctttaaatggtgggataacttaaaccatttgagtccttttgttgaccatgagaaaatacatagaatgtgaatgtgtaaatgatttgagatttttttctacctactaagaatggtttgattttgttttaaattgggctcccttgtatgacacatagatattttacaaccagaatttgttttgag

SEQ ID NO: 3994 - DNA, 3891 bp, Rattus norvegicus
  Genbank Accession No. NM_053541
ccgatcgacgcaccctcgttgacatcgtgcggcgcggcgcggcgcgggcggcccggggaccgacgggcaggcgcaccggggcatgggcgcgccggaggtctcggtgtgcaggcagggctgggtgcgccggccggggctcggggacagcggcgggctcaggtcttccctggcgaccgctgctgagcccccgcggggcccgtgacgccgcggccgatgtggcccagcgcgttgcgggcctgcaccgccgctgcacaaagacgccgccgcagccgccgcccgcaccccggccgcagccgccgcgccagccctagccccaggcggagtcccggccgcagggcagcaggcgtccgcgcgcggccggccacggcatggagaagcgcgcggccgcggggccggagggggcgccgggcgccagggcgccgctcgcagtcgtctgcctggtgaacctctttctcactgggagactcagcagtgcagttcctgccttagctgcctgcagtgggaagttggaacagcacactgaacggcgaggggttatctacagcccagcctggcccctcaactaccctccaggcaccaactgcagctggtacattcaaggtgaccgtggtgacatgatcaccatcagtttccgaaactttgatgtagaggagtctcaccagtgttccctggactggctcctgctgggcccagcagctccccctcgccaggaggccttccgcctctgtggttcagccatcccaccagccttcatctctgcccgtgaccacgtctggatcttcttccactcagacgcctccagttccggccaggcccagggttttcgcctctcctatatccgagggaagctgggtcaggcatcctgccagacagatgagttccgctgtgacaacggtaaatgcttgcctggtccttggcagtgcaacatggtggatgagtgtggagatggctcggatgagggtaactgttcggcacctgcctcagagccaccaggcagcctgtgccccgggggcaccttcccgtgcagcggagctcgctccacacgctgcctgccggtagagcggcgctgcgacggcacccaggactgcggtgatggctctgatgaggctggctgccccgacctagcatgtggccggcggctaggcagtttctacggttccttcgcctccccagacctgtttggtgccgcccgtgggccttcggaccttcactgcacatggctggtggacacgcaggacccgaggcgtgtgctgctgcagctggagctacgactgggttatgatgactatgtccaggtgtatgaaggcctgggcgagcgtggggaccgtctgctgcaaacgctttcctaccgcagcaaccaccggcctgtgagcctggaagcagcgcagggccgcctcactgtggcctaccatgctcgcgcccgcagtgctggtcacggcttcaacgccacataccaggtgaagggctactgcctcccatgggagcagccgtgtgggagcagcagcgagggagatgacggcagcacaggggaacagggctgcttctcagagccacagcgctgtgatggctggtggcattgtgcgagcggccgggatgagcagggctgtccagcatgccctccggaccagtatccctgtgagggtggtagcggcctgtgctatgcacctgccgatcgttgcaacaaccagaaaagctgccccgatggcgccgatgaaaagaactgcttttcctgccagccgggcaccttccactgtggtacgaacctgtgcatctttgagacatggcgctgtgacggtcaggaggactgccaagatggcagcgatgagcacggctgcctggctgccgtgccccgcaaggtcatcaccgccgccctcattggtagcctagtatgcggactgctgcttgttattgccctaggctgtgccttcaaactctactccctgcgcacgcaggagtacagggcctttgagacccaaatgacacgtttagaggctgagtttgtgcggcgcgaggcgcccccatcctacggtcagctcatcgcacagggcctcataccacccgttgaggattttcctgtctacagtgcatcccaggcttcagtgctacagaaccttcgcacagccatgcgacgacagatgcgtcggcatgcctcccgcagggggccatctcgtcgcagactgggccgcctctggaacaggctcttccaccggccacgggcacctcgaggccagatcccactgctgactgccgcccgtacctcacagaccgtgctgggtgatgggctcctccaggcagcaccagggcctgtaccagaccccccagtgcccaatacagacacaggcagccccagggaggctggagatgggcctcctagtggctctggccatgcaccagaagtggggccttcagtgccgcccccgcccttgaaccttcgagacccagagtacaggccagaggacaaggagagaaaggcctgtgtggaccctctggaagacagtccagcccctgtggacacacctccagagccctgcttggcccaagacccccacccccagactcccactgccagtggcatccaagatccccactcagcagagccactgggggtctgcaggagccctccaccaacctgctccccaatattggaggctagtgatgatgaggccctgctggtctgctgacccattggacacactggtgactgccacagccccgctttggaaccagggaatacacagtcatttctaccctgcctctgcattctttcttacagagacccacctagcagctccggtgaagggcctgggcactcagtcagtgggctacctgtgcagtcctattgctctgaagggcattactgtcaggggcttcgggggtggacctgggaaagagggaccgaccacctttgagatcagcatgagcatagccccttggagtctcacagcaaattgctccctgctacactaatctcgggactcatttccagaaaagcaggagagccagaaccaggctttccggaatgttttctgtggcttctcagtttatccaccctgcagtggcaccagctgctcatcctcagacctgtgccaggagctgtagttgaggcctaaaaaggccatgagaggggtagggtggacctcattcatggtgagtactatattcatccttccccacagggtccctaggaaagatgggctagtggcttctgccccagtctcatgcctatggtggcagcataggcctggctaggctgggtcagtccccaagtatcatgggtaaggctaaaagtatgagataggatgaccacaagagaggccattctatgccttcaaaggagacagaagccaaggtactggctgacaatggaaataaccattctgtcttgcctcagagtctcagtttccccacctgaagagagggctgtgctatcataagtaatagcattcactctggtgatttatgggaaggacagtagttcagctggggaatttctgggttcttctggatggccaagttcaaggtggcgtggagggttatggatggagcctcattgtcttctatgggccccatggagccagcctcaggttcaaccagcaaaacccactagggctgaaaacctcctccatagcaccttcccagctagcaacccatataccgcgctgaggcatgtctccatgaactccccttacacacagaacaaccagccctgtttatttacagacttttctggagaagctagcagggcattgctaaggcaggaagcccgaccccagtggccagtcccttacaataggcctctaagggtcgggtctctttttttgtgcagaaaaaaaaatttttgaaaacaaaacagaacacaaaccccttctcaataaacaacatgtaaacaga

SEQ ID NO: 3995 - DNA, 1435 bp, Rattus norvegicus
  Genbank Accession No. NM_053551
gaattccggcacagcgcacttgctctcgctcgaccgcgctcccgccccgcagtcctcaccaaccctacggatcctagccaccgccagcctaggagggcatcaggatgaaggcagcccgtttcgtgatgcgcagcgccagctcgctgggcaacgccggcctggtccccagggaggtcgagctgttctcccgctacagcccgtccccgctgtccatgaagcagctgctggacttcggttcagaaaatgcctgtgagagaacttctttttcttttcttcggcaagaattgcccgtcagacttgccaacatcctgaaggagattgacatcctccctgaacacttagtgaacaccccttccgtccagctggtgaagagctggtacatccagagcctgatggatttagtggagttccacgaaaagagcccagaagaccagaaagttctatcagactttgtagacacgctggtcaaagttcgaaacagacatcataatgtggtccctacgatggcacaagggatcctggagtacaaagacaactgcaccgttgaccccgttaccaatcaaaatcttcagtattttttggaccggttttatatgaaccgcatttctactcggatgctcatgaaccagcacatcctcatattcagtgactcaaagacaggaaacccaagccacattgggagtatcgaccccaactgcgatgtggtagcagtagtcgaagatgcctttgagtgtgcaaagatgctctgcgatcagtattatctaacgtcgccagaattaaagctcacacaagtcaatggaaaatttccaggccaaccaatccacatcgtgtacgttccttcacaccttcaccacatgctctttgaactattcaagaatgccatgagggccacggtcgagcatcaagaaaaccgccctttcctgacaccagtcgaggccaccgtcgtcttgggaaaagaagatcttacaatcaagatttctgaccgaggtggcggtgttcctctgaggattactgaccgcctctttagttacacatactccactgctccaacgcctgtgatggacaattcacggaatgcccctttggctggttttggttacggcttgccgatttcccgtctctacgccaagtattttcaaggagatctgaatctctattccatgtcaggctatgggacagatgccatcatctacttaaaggctttatcatctgagtctatagaaaaactccccgtctttaacaagtcagccttcaaacattatcagatgagttctgaggctgatgactggtgtatcccaagtaaggaaccaaagaatctgtcgaaggagaaactggcagtgtgacggggatctcgcctggcacttttacgggatcaaagtgggtctacggcagtgctgcttcgtgaatgtgtgtggactcttgtttccgcaaaaca

SEQ ID NO: 3996 - DNA, 2050 bp, Rattus norvegicus
  Genbank Accession No. NM_053554
gaggggtggcggacgagctgcagagatgtctggccagagcctgacggaccgaatcaccgcggcccagcacagtgtcactggctccgcggtatctaagacagtatgcaaggccacgacccacgagatcatgggccccaagaaaaagcacctggactacttaattcagtgtacaaatgagatgaatgtgaatatcccacagttggcagacagtttgtttgaaagaactactaatagtagttgggtggtggtcttcaaatcactcattacaactcatcatttgatggtgtatggaaacgagcgtttcattcagtatttggcttcaagaaacacattgtttaacttaagcaactttttggataaaagtggattgcaaggatatgatatgtctacatttattagacgatatagtaggtacctaaatgaaaaggcagtttcatacagacaagttgcattcgatttcacaaaagtgaagagaggagctgatggagttatgagaacaatgaacacagaaaaactgttaaaaactgtaccaattatccaaaatcaaatggatgcacttcttgattttaatgttaatagtaatgaacttacaaatggggtaataaatgctgccttcatgctcctgttcaaagatgccattagactatttgcagcatacaatgaaggaattattaatttattggaaaaatattttgatatgaaaaagaaccagtgcaaagaaggtcttgacatctataagaagtttttgactaggatgacaagaatctcagagtttctgaaagttgcagagcaagttggaattgacagaggagatattccagatctttcacaggcccccagcagtcttcttgatgctttagaacaacatttagcttccttggaagggaagaaaatcaaagattccacagctgcaagcagggctacaacactttccaatgcagtctcttctttggcaagcactggcctatctctgaccaaagtggatgaaagggaaaagcaggcagcattagaggaagaacaggctcgattaaaagcactaaaggaacagcgtctaaaagaacttgcaaagaaaccgcatacctctttaacaactgcagcctctcctgtgtccacctcagcagggggaataatgactgcaccagccatcgacatattttctacccctagttcttctaacagcacatccaagctgccaaatgacctgcttgatttgcagcagccaacctttcatccatctgtccatgctatgtcagctgctcctcaggtagcaagtacatggggagatgctgttgatgatgccattccaagcttaaatcctttcctcacaaaaagtagtggtgatgttcaccttcctatttcttcagatgtatccacttttactactaggacacctactcatgaaatgtttgttggattcagtccttctccggttacacagccacatccttcagctggccttaatgttgactttgaatctgtgtttggaaataagtctacgaatgttgctgtagattctggtggtggacttctcaaaccaacagtggcctctcagaaccagagtcttcctgttgccaaacttccgcctaacaaattagtgtctgatgacttggattcatctttagccaaccttgtgggcaatcttggcattggaaatggaaccactaagaatgatgtaagttgcagtcaaccaggtgaaaagaagttaactggaggatctaactggcaaccaaaggtcgcaccaacaactgcctggagtgctgcaacaatggcaccccctgtaatggcctatcctgctactacaccaacgggcatgataggatatggaattcctcctcagatgggaagtgtacctgtaatgacacagccaaccttaatatacagccagcctgtcatgagaccgccaaacccctttggccctgtaccaggagcacagatacagtttatgtaactagatggaagagaatggaattactccaagaatagaagtgcacaggtggcgactccttacttccagcaaaatccaaactgctgtctctaagactcttcctcc

SEQ ID NO: 3997 - DNA, 309 bp, Rattus norvegicus
  Genbank Accession No. NM_053555
atggcagggaaagaattggagcgatgccagcggcaggcagaccaagtgacggaaatcatgctcaacaatttcgacaaggtcctggaacgcgatgggaagctgtcagagttgcagcagcgctcagaccagctcctggacatgagttctgccttcagcaagacaaccaagactttagcccagcagaagcgctgggagaatatccggtgccgggtctacctggggctagccgtggctggcggccttctcctcatcctggttgtgcttctggtcatctttcttccgagtggagaggacagtagtaaaccatag

SEQ ID NO: 3998 - DNA, 816 bp, Rattus norvegicus
  Genbank Accession No. NM_053556
cggcacgagcttgagtttccgatgagacacaagactgaagaggaaaactgatctcccccaaagacatagaataattggtaaatctggacgagaacacaggctcataactgcgaagagcaaggatttttatattactcttataggaaagagaccgaaagatctttacaagctatcttgctaggagatgcccaaagtcaaaagaagccggaaagcacctccagatggctgggagctgatcgagccaacgttggatgaactagatcaaaagatgagagaagctgaaactgaaccccatgaggggaagaggaaggtggagtctctgtggcccatcttcaggatccatcaccagaaaacccgctacatcttcgacctcttttacaagaggaaagccataagcagagaactctatgaatactgcattaaagaaggctatgcagacaaaaacctgattgcgaagtggaagaagcagggctatgagaatctatgctgtctacgctgcatccagactcgagacaccaacttcggcaccaactgcatttgccgggttcccaagagcaagctggaagtgggtcgcatcatcgattgcacgcactgtggctgccggggttggtctggttgactgacgcccctgactcctctgcatcttggactttggaccttgggctcctgcttattgggccactgcctcctgaagcaactcttctcagattggcactcagagaaaagacccaggggaagcatgagctctacaggtgacagctttagtgttcaccagctgagatctgtaaaaataaaacctttagacctcttaaaaaa

SEQ ID NO: 3999 - DNA, 1511 bp, Rattus norvegicus
  Genbank Accession No. NM_053563
tgggctcaaggaaggaagcgttgtagctcgcgtccaggggcgcggcgtgtacgggtggctctcttcgcagctcgcggaggcgaaccgggcaacagtgacatggcagaacaggatgtggaaaatgagcttttggattatgatgaagatgaagagccccaggtaccccaggagagcactccagctcccccgaagaaagatgtcaaaggatcttatgtctccatccacagttctggcttccgggactttctgctgaagccggagctcctgagagctatagttgactgtggctttgaacatccttcagaggtccagcatgaatgtattccccaggccattctgggtatggatgtcctgtgccaagccaagtctgggatgggcaagacagctgtgtttgtgctggccaccctgcagcagattgaacccatcaatggccaggtatcagtactggtcatgtgccacacaagggagctggccttccagatcagcacggagtatgagcgcttctcgaagtacatgcccagtgtcaaggtatctgtgttctttggaggcctctccattaagaaagatgaagatgtgttaaagaagaactgtccccatgttgtggtggggacaccaggccggatcctggccctcgtgcggagcaggagcctcaacctgaggaatgtgaagcactttgtgctagatgaatgtgacaagatgctggaacagctggacatgcgccgggatgtacaggagatctttcgtctgacaccccatgagaagcaatgtatgatgttcagcgccaccctgagcaaggagatccggccagtctgcaggaagttcatgcaggatcctatggaggtgtttgtggacgacgagaccaagctcacactgcatgggctgcagcagtattacgtcaaactcaaggacagtgagaagaatcgtaaactcttcgacctccttgacgtgctagagtttaaccaggtggtgatctttgtcaagtctgtgcagcgctgcatggccctggcccagctcctagtggaacagaattttccggctatcgctattcacagaggcatggcccaggaggagcgcctgtcccgataccagcagttcaaggacttccagcgtcgcatcctagtggctactaatctgtttggcagaggcatggacattgagagagtcaacatcgtcttcaactatgacatgccagaggactcggatacctacctgcaccgagtggctcgtgctggtcgctttggtaccaagggtctggcagtcacttttgtgtcagatgagaatgatgccaaaatccttaatgacgttcaggaccggtttgaagtgaatgtggctgagcttccagaagaaatagatatctccacatacattgagcagagccggtaaccatgtgtgtagccaggcacatggctttctctcctgctgcttcagatcctcctcctaggtggcaatcggcggcctctctttttattgttccaaagctttagctatgttaagaataaacttttattgtg

SEQ ID NO: 4000 - DNA, 1846 bp, Rattus norvegicus
  Genbank Accession No. NM_053568
tgtgtcgcgggagctgccaggacttgcggggggcctctggtgccatgatccggaacgggcacggggctggcggcgctgctgggctgaagggtccgggcggccagcgcaccgtgcgggtgtggtgcgatggctgctatgacatggtgcattacggccactccaaccagctacgccaggcgcgggccatgggggactacctcattgtgggcgtgcatactgacgaggagattgccaagcataaggggcccccggtgtttacccaggaggagcggtacaagatggtacaggccatcaagtgggtggatgaagtggtaccggctgctccctacgtcaccacactggagacactggacaagcacaactgtgacttctgcgttcatggcaatgacatcacgctgacagtagatggccgagatacctacgaggaagtgaagcaggctgggaggtacagagagtgcaaacgcacccagggtgtgtccaccacagacctcgtgggtcgcatgctgctggtgaccaaggcccaccatagcagccaggagatgtcctctgagtaccgggaatatgctgacagttttggcaagccccctcacccgacacctgccggggacacactttcctcagaagtctcctcccagtgccctggggggcagagcccctggacaggggtgtcccagttcctacagacatcccagaagatcatccagtttgcttctgggaaggagccccagcccggggagacagtcatctatgtggctggtgcctttgacctgttccacatcgggcacgtggacttcctacaggaggtgcacaagctagccaagaggccctacgtcatcgcgggcctacactttgaccaggaagtaaaccggtacaagggcaagaactaccccatcatgaacctgcatgagcggactctcagtgtgctggcctgccggtatgtttcagaagtggtgattggggcaccgtactccgtcacagcagagctcctgaatcatttcaaggtggacctggtgtgtcatgggaagacagaaattgtacccgacagggatgggtctgacccctacgaggagcccaagagaagaggcattttctgtcagattgacagtggcagtgacctcactacagacctgattgtgcaaaggatcatcaagaacaggttggagtacgaagcacggaatcagaagaaggaagccaaggaattagcctttttggaggccctgaggcagcaggaggcacagcccagaggggagactgactagcttctgacccggagacgtcattcacgccgttgccctgtgcccacctcatctctccctgccctgctctgcttctgtgtcttggtgtcagctcacacaattccaaaggaaactggccttgctgagggtgctgtccctgcctgcctgcagcaggctctcagtcctttccactgagctgctcagagagggtagctagcccagtggggcagccccgtggacaggataagcagacggcacctgtgactggaggattgttgctgtgtatccttggcatccacgggttccaactgcccactgtcccagtttggctggggatacccctcctgcctgactggaagctgcacttctgcccaccgagctttggtgaaaggtacagaggctttggggacctctgttcctgggccaccctgcacgtgggcaccctctaccttggggcacgttctagcaccccattcctgactcctagaagatgcacttgccccgggtggctgggccagcgtggctgccctccgcacagacttcctggtcctcgtttgtacctcagtggctgatgtaaacctctttggctcaactgaataaagcctagtggg

SEQ ID NO: 4001 - DNA, 4378 bp, Rattus norvegicus
  Genbank Accession No. NM_053571
agaaagcagtcctcagcaggtccctggagcaacgctgaaggaaggtggagagtcagcaaagcaggaaattaaataattacataacaacctcaagacccaaagggggaaaaaatcaaagggtcagagatggaactttgggttcctcagacacaaggaaggaccacgggactatcaagggatgcaaatagaagacttcagagtggacattatagaccccgtcctcaccctcagtacagcggagataactaccaccaatggcaggatgcccacaagaactcaaagccacagcaggaccccagggatgaccaccaacagccacactatgtacccaggagtggggagtggtcccagcctgtgtctggagctgactacttgaaaggatcttatcccagtcacccatactcaaggtcaggctacgaggacccctatcagagctaccacactccaacaccgagggatgagtacgcttatggaaattactactaccacgggcatccacagctgccgcaaggagaaagagtggcaaggcaagggagtccttatatctggcatgaagatcacagagaccaaaggcacttcagtgagcatcattgggaaaagcacaacagtacatttgaagcaaacagtgacacccaattccaatttaccagtaagaatccatacaatgacaaccctgcttccgcgtttggactggagcagcctggggagttctttccagagagtggagcccagaaacaaaagccatcgttgaccagcaaatccaaccttctccgacagcatgagtctgggctcagctctagtagctatgagctcagtcagtacatgaccgaggcccctgagcagtatgaacctatggtgtcagcaacttggaggcctattcaagctgatgacacctcagcgaccgttcccaaggcacccatgaggttctacgttccccacgtgtctgtgagctttgggccaggaggccagctgatatgcgtgtcccccaactctcctgctgatggacaaacggcccttgttgaagtgcacagcatggaggttatacttaatgattttgaggatcaagaggagatgagagctttcccagggcccctcatcagggaggacatacacaaggtggatatcatgacattttgtcagaagaaagcagctcagtgtctcaaatctgagacgccagggagcagggactcagctctgctttggcaactgctggttctcctttgtcgacagaatgggtccatggtggggtctgacattgccgagctgctgatgcaagactgcaagaagctggagaagtacaagaggcagccccctgtagccaacctcatcaacctgactgacgaggactggccggtgctgagctctgggactcgcaacctgctcactggggagattccccccaatgtggatacgcctgcgcagatcgtggagaaattcaccaagctgctctactatggaaggaagaaggaaggccttggaatgggctatgaagaaccacttgtggggccaatgccttgttccctagccagtaagatggatccaaggacctacaactgggtcatgagtggcttcaccactacgctggcgctcaatgaccctctgcagaccctcttccagctcatgtcaggaaggattccacaagcagccacgtgttgtggagacaaacagtggggagactggcggccccatttggctgtgatcctgtcaaatcaggccggagacgcagagttgtaccagcgagcgattgtcagcatgggggacaccctggctggaaaagggcttgtggaggcatctcacttctgctacctcatggctcacgtgcccttcggccactatacggtgaagacagaccatctggccttggtgggcagtaaccacagtcaagagtttttgaaatttgcaacaattgaggctatccagcggacggaaatcttcgagtactgccagatgctgggccgccccaaatccttcatcccgtccttccaggtgtataagctcctttatgcttcccgtctggcagattacggcctggcatcccaagccttgcattactgtgaagccattggtgcagctgtcctgagcgagggagggagcagtcaccccgtgctattagcggagctcatcaagcttgcagagaaactgaagctgtcggatcctctggttttagaaagccgccgtggggacagggtcctggaaccggattggcttgtgcaactgcggaggaagcacaaggaactggagcaaactagaactggagacctcagagatcctgatctgactccttcagatatttatggagccagaagaacaacagacactccctaccgcgatctttatggccagcaaaactactcagaagactctgagtacagctcagccttgtggccaacatctgagcagacaagcctgaccaatcccaccccacagcagcctttccccctgcagcgagatacctactcagagagagatggcccagtacacatggggaccccagtgcctctttactcagttcctgcaacccacctgacagtgattagtggctccagtagtggcagcggtgtggcagtgacaggggctcctggaggaagggttggagaggagatgctgcagaaacatcctgcccttggagagaacacagtgcctcaagaagccgtgcaggatcctgatggtctagcagtcatttccagtcctcagacaccactggctcccagggatcgaagtttttctgaggattctgccatttcagccaaggaggatgaggagggttcttctgatggagcagacaaaccacctcaccctgacgcttcacagaaagaaaagctgagagatgggaagaatacaaagagctctggattcggctggttcagctggtttcgatcaaagcctgccagcagtgtgtccacctctggagatgaagactctgtggacagttctgactcagaggagtctcccagagcatcacctcctcaccatgccagcctgggcctctcaccaacacctcctctctcatccccatctctgccaggtgccagcaccttcccgagaggcacaggtgggaatagtctccagggatcctcaaacagcagtggaatggctgaaggcgtggggattggagggttctcggggccacagggcgtttcttctgagttctactcccagcctggtgccctgcctcctccacctaccttgcaaggtgctgttcctctctacaatccatctcaggtccctcagcttcccactgctagtagcctgaaccggccaaaccgcctagcccagcgccgctacccaagccaaccatgctgagagcgaccgtctgtcccagggccatgaggatgaccacctacccatcctgggctcctcttctggagcacagctttcctgttgctttatacttctcagtgtcacctcacctcgtcacgctcaggcccgtgtcgtgagcctgctgcacgggcatacctggagtttgaggacaggatatcctagacaacaacttggtccagtcttcagcttagtttgagagtgatggaaattgtctcattagacggaggaacgggggccaatgtctatggtagagtgtcatggcagcagacttgaggtagaagcttgagcacctcgggaaagcgagggccccgagaatcccgggtgaaaaccggagatgacactacccggctgtacagtaggagctcagagcaatgtcccagaataactcagactccctccatagatccgcttaaagaccagtttatggctcttgttagtgaagtttttacattgaatttgattatcgctgcccttcagtgattcccttttcaatgacatttcagcaattttcctcctggtcctagttttgcgcacattttctgtgtggttcagactaattatatttctctcactttcttagccggtcctattttttttcacattctgacatctggctatcaagttagattgctgtaggcattgtattgtcatggtaactactgaacctaatgatgcagatggaggaacatcagtataataaatagtggaaaacgtttcctaagacgtcatcatttccataagaggggagggatgggcgcttcatattgctaatacctgccttcctacctcaggcctttgcaaatcgatgttctgtgagggtcaccggggccccatggaggagaaagctgtcttggaaatttccattttttcctttcaaacctcaaatagaaatgcttcttgctgtttgtcagatttgcttaaaattgctcgtcacaaagaacattttttgtatgtgtaattgtacataaaagttttgtactttaatgtactatggttctgatgttgatagcgattaaatccagataattttatagcaaaaaaaaaaaaaaaaaaactc

SEQ ID NO: 4002 - DNA, 1414 bp, Rattus norvegicus
  Genbank Accession No. NM_053576
gcgcctccttgttcccagcgtcaccactgccgccatgcccggagggctgcttctcggggacgaagcccccaactttgaggccaataccaccatcggccacatccgcttccacgatttcctaggagattcatggggcattctcttttcccacccacgggactttaccccagtgtgcaccacagaacttggcagagctgcaaagctggcgccagagtttgccaagaggaatgttaagttgattgctctttcaatagactctgttgaggaccattttgcctggagcaaggacatcaatgcttacaatggtgcagcacccacagaaaagctaccatttcccatcatcgacgataaggacagggaccttgccatcctgttgggcatgttggatccagcagagaaggatgaaaaaggcatgcccgtgacagcccgtgtggtattcatttttggccctgacaagaaactaaaactgtccatcctctacccagccaccacgggcagaaactttgatgagattctcagagtggttgactccctccagctgacagcatcaaatccagttgccactccagttgactggaagaagggagagagtgtgatggtccttcccaccctccctgaagaggaagccaaacaacttttccctaaaggagtcttcaccaaagagctcccatctggcaagaaatacctccgttatacgccccagccttaagtctgcgggaactggggctgcaactgctcgaccagcactgggacctgaggatgacagctgacagctgcagttccgtagaaagattgtggcgtggtcacagccgaagtcgcgtaggtcgctcgctatactactggctcattaaatggaaatggcaccaaaacattctcgggattctttactctgtgccttcgccagcattctgcccctccatccatcacagcgccctgctgactggctttctttgaaacgaattatgtgttggtgactgcagggtctctgcagggtctgtgatcagcaaggtagtgtcagtgtgggctccatgctagaatgataaacatcttttgtaggtttccaaactgaatcttctgttacccattgtggagaaccataaagtggggagaaactttcaattctgtactttcagtaaataaagcaggggaggtggggggggggggagagttctctataggaaatccatggtgagtttctatcaaagtgggcttccaagaatgtgtggaagacagcacatgtacttcctggagtttccaggtctgctctctagtgatctgtgaatgtgaactcgccttatgaaagacaggcagtgacattgtttgccactaaatgtcctaaaggagtgggttgccatttctaaattctgctgtgtgaggttcaacaataaaatcctgattagaaaaaaaaaaaaaa

SEQ ID NO: 4003 - DNA, 1977 bp, Rattus norvegicus
  Genbank Accession No. NM_053578
ctgaaagcgcagccagtgatcttaacccctgagccatcgctccagctaccagggtagccattttaagtcagtttaattcatggctacttctccagagcttgatgtaccctgggtgctcaggtagatctgtggggtgaaagaatgtatcagtaccagctatcagaagcgcaggaccgcaggaacacacactgcttagcaaagataagctggcattccttgtttgtctggtttgctcccagggtgtggcaatcaggctgtggcaaaccgactctgtgaagagtataatgaaaggatatttctgaaagattaatctgagtgactgtggagagaataagaggactggaagaaagctttgaatctgcctggaataagttaagcaaaccaaagcagtggattttcttgctagcaaaagaatggaaagaaagaaatccactggggggtggggggggagagggagagagagggagagagaggctttgaaggtcagatccacggtgtgggtgggagtgcagaggaggctggagcaggagatgagagttaagagcagattagttgggggaaatgacagtgcttacgaggagtactgtgtctgcattggaccctagctttcccctgtgcttgctctaccactgagccataccctggccttgggtactaagattcggaggagtgggggttggagaggggatagtgagttctattgtttggtttttaattgagatttttaaagattgattttatttttaaaatttgtgtgtgtgcatgtgtgtgtgtgtgtgtgtgtgtgtttgtgcgtgtgtgtgtgtgtgtgtgtgtgtgtgtgtgtgtgtgtttacgtgtgtgtatatgcacatgtttgtgggtacccacagaggccagaggtgtcagatctcctggagttaagggcaactgtgagtgctgagaactgaactggagtcctctgcaagagcagggttgaccgagttgagttctgctttagaaatgctgaaactcagctggccggagccccaactctttataaataaatagagacaggcagaggtccagctagtgagcatagttttagctctgccaaaatgagttgttggtccagacttctcagtttctgatcaaactgtggtatcaacatattccctaaacacacgtgttcgattatgtacttacacctgcccttactaccccggggcacaccgtgatgcaatggatgctgggacaagtgcaggtccgttgtctcggtatgcagcatgtgttcccacagtccgggagagcaggaaggagtgtacaattgttctgcaaggtctgcgtgcccactggtgtctaacatcggccttttcttttttttctagagttatcatcaccatgttggtgacctgttccgtttgctgctatctcttttggctgattgcgattctggcgcagctcaatcctctgtttggaccacagttgaaaaatgaaaccatctggtatctgaagtatcactggccttgaggatgaaggcatgctgcacagtgcaggcactgaggtcacagctagaagccttctagatacagaatcacctgcacaccgacctccttcctcgacagcctacttcggccattacctgccttacacttgaaggccttcctctgcatacagtattttttctccttcaccttttttacactttgaattatgtgcctgcatagctgactttgagatgtgtctctgcactcgactgagagaaaaggtgctgttctgggaaatctgttactcttgtcttgaagcctgccactttgaatatggctcttgcctgctcacaacatgagagtcagcgatgtgtttaagaattgctgcaagacaaatgagactcagtgggacagtcaggagtgcctgctcgagagaagctctaccccagcagatgtacaccaaactctattttcaggatgaatttcttacttctacatcttttggaataaattatttttcttctttctatgg

SEQ ID NO: 4004 - DNA, 2412 bp, Rattus norvegicus
  Genbank Accession No. NM_053584
ggcacgaggatggcggcgggaaccagcaattactgggaagatcttaggaaacaagctcgacagctggaaaatgaacttgacctgaaactagtttccttcagtaaactgtgtacgagttacagtcacagcagcgcccgggatggaggccgcgataggtatagttctgacacaacacccctattaaatggatcaagccaagacaggatgttcgagacaatggccattgaaattgaacagcttttggcgaggcttacaggagtaaacgacaaaatggcagagtatactcacagtgcaggggtgccctccctgaacgcagccctgatgcacacgctacagcgacacagagacattctgcaggattatacacatgaattccataaaaccaaagcaaactttatggcaatacgggaaagggagaatctcatgggatcagtacgaaaagatattgagtcatataaaagtgggtctggagtaaacaacaggagaactgaactgtttctgaaagaacatgaccaccttcgaaactctgatcgtctgatagaagagacaataagcattgctatggcaacaaaagagaatatgacttcgcagagaggaatgctcaagtccattcacagcaagatgaacactctggccaaccgctttcccgccgtcaacagcctgatacaaaggatcaaccttaggaagcggcgcgactcgctcatccttggaggcgtcattggcatctgcaccatcctgttgctgctgtatgcattccactgagaggtcggccccaggactctgcccaccctctgcggcctgctttggcaatggggaacctgcaaaggagagagaccgtccggccatgagcctgccagcagatgaattctaaactgcaccgtggctctgacctggtcggcctgagctgaagccacagtttttctgtgcctatcttttctaatacatattactctgtttttaattttaaaaacaacaaaaggtttcagttgctgcatctccctaggaggtaagcaagcagaagctgagaacctgggctttagtgactggtgaagccagatgaccagcgggcctcatagctggactcctcacagcaccaggctctacatccaaagatggcctcactttcagccacgagattggatgtgaataaaaataattcttgtccttttatttaacacttgtgatgagaagtcagctgtcctttgctgatactccgtgatccaatcgcgtattctgtgtccctaatctcttggcagtcaagaaaaattccatttcccacggattctgtaagatgttggtaggccagcttcatgtttgaggcggtctgaaatggaaagtgctatagaaagggtgtctcttttctgtttcagttgtgagccctgggtcaactactgccaccagcacatcagaatggcgggccttacagaggagctggtcattgctttattatttcttcccttgggctgatatttgcttgtattgataaaaatgcatttccagtgatagcccgtcagtgactgtcatcggccctcgaagtcccatatcatgtgaagcttaatactaggaactgaaggagggacttggttctctgtgaggcctgctcgtgagccactgctgtgagggttgggaggataaaattatgttttgggttttggtggtgggagattattttggagttgttgttggttgggaatgtggtgagggatatagagtaaattagtcgagtatagaagaataggcttaatagggctatgatagctattagtgttgatagggttgagcagttgttttttagaagctcggagataattgctcattttggtaaaaatcctgtgagaggggggagtcctcctagtgataggaggatgatggatgctatggttaggattatgggagttttatttcatgcgagtgagagtgtgttgattgttgttgctgagtttgttatgagtgtaatgaatattggaacagtaagtaggatgtaaattgttaagtttaggagggttaagttagggttgtatggaaggattgctgttattcatcctatgtgggcaattgatgagtatgctatgcatttttcgtgtttgggtctggttaagtcctcctcaggcgccaacaaagactgatgaaattgcgagaatggtggtgatagttgggtttaggagttgataaaattggtatagaattgatagtggagcaattttttgtcatgttagtaagattaatccaatgtgtaggggaattccttgggtgacttcgggtagtcagtagtggaatggggctagtccaagttttatggctagtgaaatgagtattatgttgagtagtatgttattggtttgttgttggagggttcatattcctgattgtttgtagttgaggatgatgactagtaggataattctcgtgccg

SEQ ID NO: 4005 - DNA, 485 bp, Rattus norvegicus
  Genbank Accession No. NM_053586
gcttgtctcgagcgagatggcttcaaggttacttcgcggagtaggcgctttggcggctcaggccctgagggcccacggaccccgtggcgtggccgctacccgctccatggcttctggaggtggtgtccctactgatgaggagcaggctaccgggctggagagggagatcatgatagcagcacagaggggactggatccatacaatatgctacctccaaaggcagcttcgggcaccaaggaagaccccaatctagtcccatccgttagcaacaagagaatagtgggctgcatctgtgaagaggacaactgtactgtcatctggttctggctgcaccaaggcgagagccagcgatgccccaactgtggaacacattacaagttggtgccctaccaaatggtccactgagcccacccctggtttaacatttcagaatgtaaaggaaaacgtctctcaataaagactagccaacgcactggctccttcc

SEQ ID NO: 4006 - DNA, 779 bp, Rattus norvegicus
  Genbank Accession No. NM_053588
ggcacgaggccatgtccgaggagctttcggcggacacgtcctacacggaagatgatttctactgcccagtctgtcaggaggtgctcaagacgccggtgcggaccgcggcctgtcagcacgttttctgtagaaaatgtttcctgactgcaatgagagagagtggaatacattgtcccctatgtcgcggaagtgtgactagaagagaaagagcatgtccggaacgggccatagatcttgaaaatatcatgaggagggtttctggtagctgcagatgctgttcaaaaaagattaaattttatcgcatgagacatcattacaaatcttgtaagaagtatcaggatgaatatggtgtctcttctgtcattccaaatgttaagatttctcaagattcagtaaggagcagtaataggagtgaaacatctgcatctgataacacagaaacttatcaagaggatacaagttcttctgggcatcccacctttaagtgtcccttatgtcaagagtcaaatttcaccagacaacgtttattggatcactgtaatagtaaccacctgtttcagatagttcctgtgaatcttcagctagatgaggaaacccaatatcaaactgctgtggaagagtctttccaagttaacatgtgatgtgtgtagacatctctgcctccttgctacctacaagtgccatctttaaggagaagacatgaagtcaccgttttcagtaatttgctgtgcatattaataaaaataataattcagtctaaaaaaaaaaaaaaaaaaaaa

SEQ ID NO: 4007 - DNA, 774 bp, Rattus norvegicus
  Genbank Accession No. NM_053589
gccaccatggcaactacaccgtacaactactcttacatctttaagtatattattatcggggatatgggagtaggaaaatcttgcttgcttcatcaatttacagaaaaaaagtttatggctgattgtcctcacacaattggtgttgaatttggtacaagaataattgaagttagtggccaaaaaatcaaactgcagatttgggatacagcaggacaggagaggttcagagctgttacacggagctactatagaggagctgcaggtgcgctcatggtgtatgacatcaccagaagaagtacatataaccacttaagcagctggttgacagatgcaaggaacctcaccaacccaaacactgtaataattctcataggaaataaagcagatttggaagcacagagagatgttacctatgaagaagccaaacagtttgctgaagaaaacggcttattgttccttgaagcaagtgcaaaaacgggagagaatgtagaagatgcttttcttgaggctgccaagaaaatctatcagaacattcaggatggaagcctggatctgaatgctgccgagtctggtgtacaacacaaaccctcagccccgcagggaggacggctaaccagtgaaccccaaccccagagagaaggctgtggctgctagtgacctctttgctctggtccctcattttgacctttcacctcttgtctgttggaagcagtactttttactgccttcttgtcttctgtacatcttactggggtttaattaaaaaaaaaaaaa

SEQ ID NO: 4008 - DNA, 799 bp, Rattus norvegicus
  Genbank Accession No. NM_053590
cagcaggagttaggcgcgatgctttccactgccgcttaccgggacccggaccgagagctggtaatggggcctcagggctccgccggccctgtgcagatgcgtttctcgccttatgccttcaacggaggtactgtattggcaattgctggagaagatttttccatcgttgcttcagacactcggttgagtgaagggttttcaattcatacccgagatagccccaaatgttacaaactaacagacaaaacagtaattggctgcagtggctttcatggagattgtctcaccttgacaaagattattgaagcaagattaaagatgtacaagcattccaataacaaggccatgacaacaggggcgattgctgcaatgctgtctaccatcctgtactcacggcgtttcttcccttactatgtctacaacatcattgagggacttgatgaagaaggaaagggagccgtgtacagctttgacccagtaggctcttaccagagagactctttcaaagccggaggctcagcaagtgccatgctgcagccgctgctcgacaaccaggttggcttcaaaaatatgcagaatgtggagcatgtccccctgactctggacagagccatgaggctggtgaaagacgtcttcatttctgcagccgagagggatgtgtacactggagacgccctcaggatctgcatcgtgaccaaagagggcatcagggaggagactgttccccttcggaaagactgatgtggggccagggtttggagctgtggcacgtttgttttattaaaaagaaatgtaaagg

SEQ ID NO: 4009 - DNA, 952 bp, Rattus norvegicus
  Genbank Accession No. NM_053592
ggcctccagcgccatgccgctcttgtgcgcgctgctgcgcagccgactccaaccttctctgctccgctcgcttacgctcacgtccgcgcaaagcctaagctgcggcggaagcagaggagtccggacctggagcgcgcggaccggacccggagcgtgcgctgaccctgcggtctctgtctctaagagggctcgagcggaagatgacgcttctctgcgtttcgtgcggctctcggagcacgctacggctcccacccgcgggtccgcgcgcgctgcaggctacgacctgtacagtgcctatgattatacaattccatccatggagaaagcccttgtgaagacagacattcagatagctgttccttctgggtgctatggaagagtggctccacgttctggcttggctgtaaagcacttcatagatgtaggagccggtgtcatagacgaagattatagaggaaatgtcggcgtcgtgctgttcaattttggaaaagagaagttcgaggtgaaaaaaggtgaccggatcgcgcagctcatttgtgagcggattctttatccagacttagaggaggtgcaaacactggataacactgagagaggttcaggaggcttcggctccacgggaaagaattaaaactttgcttgaagtactttgctgtttgaacactgtaaacgagctttaatttcagaagcattttgtgttctaggatgtaggaaaggatacctatcacggtggaactgctctgttctctagttgatggttgcctgtaaatctgtatcgtgagaactggcagtgacatgcagacttggttattagatattttttttaaatttggtattgtatttaaattatagtcctataagaactgattttgctctaattgctatattatttgtaattttttttttttatccaataagtccgaagtctttagcgaaaaaaaaaaaaaaaaaa

SEQ ID NO: 4010 - DNA, 1232 bp, Rattus norvegicus
  Genbank Accession No. NM_053593
ccgaagcgtccagctgcccgggaccgatccccggtgtatggcgccgcagaaacggctcccgggcccagataaagggcacctccgcagctcttggccgagagatcccctgctccgagaatggctaccactcgatatgaacccgtggctgaaattggtgtcggtgcctatgggacggtgtacaaagcccgagatccccacagtggccactttgtggctctcaagagtgtgagagttcctaatggaggagcagctggagggggccttcccgtcagcacagttcgtgaggtggccttgttaagaaggctggaggcctttgaacatcccaatgttgtacggctgatggatgtctgtgctacttcccgaactgatcgggacatcaaggtcaccttagtgtttgagcatatagaccaggacctacggacatacctggacaaagcacctccgccgggcttgcctgttgagaccattaaggatctgatgcgccagtttctaagcggcctagatttccttcatgcaaactgcattgttcaccgggacctgaagccagagaacattctagtgacaagtaatgggacagttaagctggccgactttggcctagccagaatctacagctaccagatggccctcacgcctgtggttgttacgctctggtaccgggctcctgaagttcttctgcagtctacatatgcaacgcctgtggatatgtggagtgttggctgtatcttcgcagagatgtttcgccggaagcctctcttctgtgggaactctgaggctgaccagctgggcaaaatctttgatctcattggattgcctccagaagacgactggcctcgagaggtctctcttcctcgaggagccttttcccccagaggacctcggccagtgcagtcagtggtgccggagatggaggaatctggagcgcagttgctgctggaaatgctgacctttaatccacttaagcgaatctctgccttccgagccctgcagcactcttacctgcacaaggaggaaagtgacccggagtgaggagaggggctgccttttccagtttccggacgctgtgtggaaagaaccttgctgaagtggcagcctctgccttcccctgaggctatggagagtcctccggtttagccttaaatgacaattccctacctctccttatgaggtttaccccacccccaccctcctgtttctctacactaaagggcaggcattatctgtcttcttcc

SEQ ID NO: 4011 - DNA, 4469 bp, Rattus norvegicus
  Genbank Accession No. NM_053596
cgtgcggtcggagcgtagagctcagcgcagagcaccgggagccggagccttagcgggaggtgcatccaaagcccggccgttcggagcccgcgagcgatgatgtcatcctacaagcgggccacgctggacgaagaggatctggtggactcactctccgagggcgatgtgtaccccaatggcctacaggtgaacttccgcagcccccggagcggacagaggtgctgggcagctcggacctcggtggagaagcggctggtggttctggtgacgcttctggcagcagggctggtggcctgcctggcagccctaggcatccagtaccggacaagaacgcctccggtatgtctgactgaggcctgtgtctcagtgaccagctccatcctaaactccatggaccccacggtagacccctgccaggacttcttcagctacgcctgtggtggctggatcaaggccaaccccgttcccgacggtcactcacgctgggggaccttcagcaacctctgggagcacaaccaagccatcattaagcatctgctggaaaattccacggccagcgcgagcgaggcagagaaaaaggcgcaagtgtactaccgtgcgtgtatgaacgaaactaggatcgaggagcttcgggccaagcccctgatggagctgattgagaagctcggaggttggaatatcacaggaccctgggccaaggacaacttccaggacacgctgcaggtggtcacagcgcactaccgcacctcacccttcttctctgtctatgtcagtgccgactccaagaactccaacagcaatgtgatccaggtggaccagtccggccttggcttgccctccagagactattacctgaacaagacggaaaatgaaaaggtactgactggctatctgaactacatggtccagctggggaaactgctgggtggtggggacgaggactccatccggccccagatgcagcagatcctggattttgagaccgctctggccaacatcaccatcccccaggagaagcgccgggatgaagagctcatctaccacaaagtcacggctgctgagctgcagaccttggcacccgccatcaactggttaccctttctgaatgccattttttacccagtggagatcaatgagtctgagcccatcgtggtctacgacaaggaatacctcagacaagtctccacactcatcaacagcaccgacaaatgcctgctcaacaactacatgatgtggaacctggtacggaaaacaagctcctttctcgaccagcgctttcaggatgccgatgagaagttcatggaggttatgtacgggacaaagaagacctgtcttccccgctggaagttttgcgtgagtgacacagaaaacaacctgggctttgccctgggccccatgtttgtgaaagcaacctttgcggaggacagcaagaacatagccagcgagatcatcctggagatcaagaaggcattcgaggagagcctgagcaccctgaaatggatggatgaagatactcggaggtcagccaaggagaaggcggacgccatctacaacatgataggctaccccaacttcatcatggaccccaaggagctggacaaagtgttcaatgactacacagcagttcccgatctctactttgagaacgccatgcgatttttcaacttctcattgagggtcacagccgaccagctcaggaaagcccccaacagagatcagtggagtatgaccccgcccatggtgaacgcctactactcgcccaccaagaacgagattgtgtttccagctggaatcctgcaggcgccattttatacccgctcttcgcccaacgccttgaactttggtggtatcggggtcgttgtggggcacgagctgactcatgctttcgacgatcaaggccgggagtatgacaaggatgggaacctccggccctggtggaagaactcgtcggtggaggcattcaagcagcagaccgagtgcatggtacagcagtataacaactacagtgtgaacggagagcccgtgaatgggcggcacaccctcggggagaacatcgcggacaacgggggactcaaggcagcctaccgggcgtaccagaactgggtaaagaagaacggagctgagcagatactgcccaccctgggtctcaccagcaaccagctcttcttcctgggattcgcacaggtctggtgctcggtccgcacaccagagagctcccacgaaggcctcatcaccgatccgcacagcccctcccgcttccgggtcatcggctcactctccaactccaaggagttctcagaacacttccgctgcccgctcggctcccccatgaaccctcgccacaaatgcgaagtctggtaagggctgaagcgcagagaacacaggtggaagaagggaaggggcctgcagccagctcccgggaacagggccgcgctgtcaccctccttccagcccctcggccgagggccccttccccaccctggagggtatgcagccatcttgtctaagcctatgccagaggctcagcactggaagccaacatttgacccccttcgaagctccagcatcccagacacccttgagtgatgctataccgggcctttgggtgtgtcaagctggtggcttgccagccctgggcctcacactgacaatggcagtgggacaggaccctttgccacgtccaatgccagatataccacaataccactgtgtcaaatgctttaaagatatattttttggggagactattttttaagcattatggaatacactggaaatcttcagggaaaatgcatttaaaacacttttttttaaaaaaagattagtatatttattatgttctctcttttttttctaaacaacctgcggacaaaggaaaccccactgattgaccccaggggaccccaggctgttgagcaggccaccagtttgagcactgctttagcccattgttggtgtaattgcttgtgcagtcaggagatgtaggggccaggcagaaggggtggccagctgaagggcctgatttatgagcatggccttctctgtcctgtctccggagtccaaccatgggaaccccaacaaggacgggctgttacccaagttgatccctatggcagtacaaagccagagtaatggcctccgtacaaccgggggacccctgaacactctggacaacatcacaggagcccgtcggggctgagaccccacaccccatcagatgcacactattgtccaaagatgtcttgttttggtcccacctcttctggccttgggaccggttgcctctctgtagcagttctgacatcctgaagtggtcgccctctgtaccaggggaaaggggaaagagaaagcagtccagttctccctccaagctccgtagcctgtagttaccctggcttggctcctgggaccccttctctagtgccttaccccaggccacagcccctgagcccctttgaggaggcagcatttgtcttgctttctcagtggagcccccaagtgtcctgactagaagccaacaccatagccccactcccagaagccccagggtaccgtcccaaaccctacaggacagccattccacacattccccaccccacccccctctgcagcaggccaagactggaaggttcccagccccatcgggctccagggaatggcaggatgtcatccacccacagcatcacctaacagatatgtgggcctccactaagtggcgctcactgaggttttcatgactgctgtagggagcaagctcttgtgacctgtgtgtgaggagcgcagtagaagtgcccatcacagcccctggcaagtcatgcccccacatagcacaacacacacacacactcacctggaagccagagtcctccttggccaagacgcagagacagtgtagtctcggtcctgctagcgtagcgatagtcttagcactgggatggggagctgcaagcgggtgtctggcaaggttcttggtccctgtgaacacattcgaggtctcagctcttcggggaaaagtaacacaggaagcaggaaggtgctggagccacgccctgccacacaggggggaccttctgggtgggatcatctgccctttctatcccctcgccctgcttccccacaggtggccgtcctggatgccagtatctagaagcagggtcctgagctggagttagccatgcacgcattgctcagggtgtgcagggagccaaggcaggaaaacccaggctggttagggatggatgggtgcaaaagcagcatcccgacccctgtccctccagagatttgagaagggcagaattaggaagggcacccgccctcagaaagagccctcctctcaagcccggagtttccctgcaggcacaaggacatggggtttggaactggggactctatttttttgtattattgtgttttgtgctactgtagttttggtgtggcacctattataattaaaataaagtacttatacc

SEQ ID NO: 4012 - DNA, 2954 bp, Rattus norvegicus
  Genbank Accession No. NM_053598
ccggctccggagcaccgcgacttcgttcggtccgactccccggcggggtggcggcggccgggtccccacggtggcggccggagcagcggctgcaggagcccggctctaggatgaagttcaagcccaaccagacgcggacatacgaccgcgagggcttcaagaagcgggcggcctgcctgtgcttccgcagcgagcaggaggacgaggtgctgttggtgagcagcagtcggtacccagaccaatggatcgtgccgggaggaggggtggagccggaggaggagcctggcggtgctgctgcaagggaagtgtatgaagaggctggagtcaaaggaaaattaggcagactcctgggaatatttgagaatcaagaccggaagcacagaacatatgtttatgttctgacagtcactgaaatattggaagactgggaagactctgttaacatagggaggaagagagagtggttcaaagtggaagacgcaatcaaggttcttcagtgtcacaagcctgtccacgcagagtacctggaaaggctgaagctggggtgttctccgaccaacgggaattccacggtcccttccctcccagataacaatgccttgtttgtgactgccgcaccaccctctggggtgccatccagtataagatagagagctggggcccctcccccaccgtgtcatggcacatgtcagagggagagaggcttttttacttctaacacatctgactgctgctggcagactctagatttgccatgcaggggtttcaaataatttgcatgtatttcagatgctttcaactcttttaaaataaataacaaaatagcaaaaatactttaagatgccaaagccatgtggattttttttaaagccttaattgtaagtctaccccattactttggttctcatttttataacctttcttaaaatttcacttttgaacactcaacattctatggtttattttgacagatcaactggttgttgggtatgtttttgccctaatatttttttcttacagtatcaaatagtcaccaaatctttgggaattaatgaaaaatattcttggtatttaaaaaaatatatatgtgccccaaaacttgtttaagagagtcgcattctctccacttgtaagctgcaggtttgcgctgatttgtatggacgggccagttgcctttgaccaagcactcaagtttactctatccgagaatttgtacacagcaagaattatgtcagtgcacaggcactgcctcccctctgacacggtgattccatatgaatcactccatttttagggaaaactgtcaggaacttgcctgtggcaccgcacagctcattctgaaactgttcagagaagtctgttcagcacgctctgcggctgcttcctccctgctccttccgacacagactgtgttaggggccacattgctcccatggccagtgctcttcatattttcagtctagcaacaacactgttgaccagtggattagactctaaccttagatacagcagtcactgactggcatccaaggttagatcacactaaacaaaatggctgtcctaggcctaagacactgtcttgagtgtcagtaagcagcttgtcagatgagtgtgagggaactagaactatgttaccttgtctttgtgctctctcaaaacgggccaccccatggaaaagtacctacatttccttcaggaagtcatggaggaagtgaagggggaggggggagaggaaaagatctttcgcagtacagttaggacatctgtaacctgttaacctttaaattgtaatgttgctgctgccaatgtccttacctgtaaggaaggaaaatgagatctcgtgcccaaatgcagcagaactaaaaacattaggttacaaagcagaaaaacccaaccagtagtgttcattctaaattatgtagcgtaaacaaatgtgatcgtccagaccttttctatttttctttgtacagaggtcatgtactctgggtgtgttttaaaagaaacattttaaagaaacccacagattgacattttctatcttttcgttttctcacgattctctgcaatttttccatgtactaaacacaacagaaactggactgttttgtatagaatactgcttccagctaaaaccatcacaagtgcccgggagtttatgtggacatgatagatactctgggcggtaataatgcatgaacctgttttataaactcttgaactgtgtattgccatgtaaaatatgtacagtattaatgtcaaccatctctttaaaagttagcctatgaacattgttgtataatttctttggtcagaaacatttggactaagtcatgtcacctgggtcaggattttcttcaatgccgtgtagcaaaactgtctttagtctatgcaaatagcgagtcactgagtgtgacagaatgcaacttcactgttaaacttcacctgagggttcctcattctggaatccagactgcaagattataaaggaaaagacctaaggcaattcagttctttttgcaaatcaattgaatccacgagagatgtctaccagcgagatgtttaccagcccagccgcctgcagcctgcagcctgctgtgtgtgcttatttgtgcgctgaataaaatggggcagctaaattctccagttccatatgcctccgaagttcaaagaaaagaaagcaaagtaacatgttagacttgacttgtgtggcggggtaaagaaatggcatcttcccactaagaacgaaccatccagttcttttgtcagtcacactatgaaacagggaaggtgaagggaagaaatggttatgtgtgcacgaatcgctttgcatggtctcatgagatggctgcattcgaactgttttaagaattgtaaggatcttgacttttttacatttggaaacatcaaataaaaacaaacataatctgtgaaaaaaaaaaaaaaaaaaaaaaaaa

SEQ ID NO: 4013 - DNA, 717 bp, Rattus norvegicus
  Genbank Accession No. NM_053599
tttcgtcctggcctggcccggcccggccccgcgctatggagttcctttgggcccctctcttgggtctgtgctgcagtctggccgctgttgaccgccacatcgtcttctggaacagttcaaatcccaagttccgagaggaggactacaccgtgcacgtgcagctgaatgactatctggacatcatctgcccacattacgaggacgactctgtggcagatgctgccatggagagatactcgctgtacatggtggaacaccaggagtatgtgacatgcgagccccagtccaaggaccaggttcgcgttaagtgcaaccagcccagtgccaagcacggcccggagaagctgtctgagaaattccagcgcttcacgcctttcaccttgggcaaggagttcaaggaaggacacagctactactacatctccaaacctatctaccatcaggaaacccagtgcctgaagttgaaggtgactgtcaatggcaaaatcactcacagcccccacgcccatgtcaacccacaggagaagagactccaagcagatgacccggaagtgcaggttttgcacagcattggtcacagcgccgccccccgcctcttcccattggtctgggcagtattgctcctaccactgctgctgctgcaaactcagtgaaggtatttgcttgccctggcttacggattggcacgggactaaggggcagggttaagcaccccca

SEQ ID NO: 4014 - DNA, 2155 bp, Rattus norvegicus
  Genbank Accession No. NM_053604
ccagttcctagggctacaggccaaggcgacggcgccgcccgcccgccccttccgtgcagaggccgccagctcctttccgcgcccggcctcccggccctggagaccatgaggttccgcatctacaaacggaaggtgctaatcctgacgctcgtggtggccgcctgcggcttcgtcctctggagtagcaatgggcgacaaaggaagaacgacgcccttgccccgccgctgctggactcggagcccctacggggtgcgggccatttcgccgcgtccgtaggcatccgcagggtttctaacgactcggccgctcctctggttcccgcggtcccgcggccggaggtggacaacctaacgctgcggtaccggtccctagtgtaccagttgaactttgatcagatgctgaggaatgtcgataaagacggcacctggagtccgggggagctggtgctggtggtccaagtgcataacaggccggaatacctcaggctgctgatagactcgcttcgaaaagcccagggtattcgcgaagtcctagtcatctttagccatgacttctggtcggcagagatcaacagtctgatctctagtgtggacttctgtccggttctgcaagtgttctttccgttcagcattcagctgtacccgagtgagtttccgggtagtgatcccagagattgccccagagacctgaagaagaatgcagctctcaagttggggtgcatcaatgccgaatacccagactccttcggccattacagagaggccaaattctcgcaaaccaaacatcactggtggtggaagctgcattttgtatgggaaagagtcaaagttcttcaagattacactggccttatacttttcctggaagaggaccactacttagccccagacttttaccatgtcttcaaaaagatgtggaaattgaagcagcaggagtgtcctgggtgtgacgtcctctctctagggacctacaccaccattcggagtttctatggtattgctgacaaagtagatgtgaaaacttggaaatcgacagagcacaatatggggctagccttgacccgagatgcatatcagaagcttatcgagtgcacggacactttctgtacttacgatgattataactgggactggactcttcaatatttgactctagcttgtcttcctaaagtctggaaagtcttagttcctcaagctcctaggatttttcatgctggagactgtggtatgcatcacaagaaaacatgtaggccatccacccagagtgcccaaattgagtcattattaaataataataaacagtacctgtttccagaaactctagttatcggtgagaagtttcctatggcagccatttccccacctaggaaaaatggagggtggggagatattagggaccatgaactctgtaaaagttatagaagactgcagtgaggaaaaaattcacaattgcaaaagcaacagtgacagtcttctattttttatatttgtctcaatgggatatacaattgaataaacgatataggaactggtttctgctttaatacataaacttcttgtaaaaggtgtccaaatacatagtaatccttttcagttatgactgattaaaatttcaaactgaaattttcattttgagacttgggttttaaaattcagtctgtatctgcttaaaagtaatgattagattattggtaaaaagaaagggggaaatttgatttaaatcacatctgttaatctttttatctaaaactttgtatacttttccactttcaaaagttattttaagtacagcaagatttatttaaaactgtcaacagtataaaaagtattacaataaatcattagagtattgctgggacagacccagtttcactattgacacagtgattaggaattgtttgactggtttaataactcagaaattaagtttgttaagcaccctgttggaagagtcattttcagtattactgatccctgtgctattgtgttaagatttgcctgtgctttcaaccttcatattacatgattcttttggaatgtatttgattaataagaaagtttaaacaatgttttcacctcaatgtagaaatacagtggttttgacttttttctttttagtgctgccaaaataaaatactcatttttgccggaattc

SEQ ID NO: 4015 - DNA, 5022 bp, Rattus norvegicus
  Genbank Accession No. NM_053605
tgaggtgctgagtccgagggaggctccggatgccagagccgcggctgctgcaaccctcgccgctgtgagagaagcctctgggaagccccggtcgctaggagctgggaggcgccgcgtgcgctgccccgcgccgagcgccctcgtgagcaccgtctgaggttttcaacaagcttccatgtcccagcatggccccttaaagtgaaccatgactgtctgtgggacactcaccactgatcatccagagtcccatctcaccaggaggtgacctgtcctccaccctccacctgcccccgcctgggaaagtgctgcagctgccacggacaccatgtagtagggccggctgcggcgcccagtgagctgcaatggttttgtacacgaccccctttcctaacagctgtctgtctgccctccacgctgtgtcctgggccctcatcttcccatgttactggctggtggaccggctggtcgcctccttcatacccaccacctatgagaagcgccagagggcagatgacccttgctacctgcagctgttctgcaccgtactcttcacgccagtctacctggctctgcttgtggctgcgctgccttttgcctttcttgggttcatcttctggtctccactgcagtctgcccgccggccctactcctactcccggctagaagacaagagcccagctggtggggcagccctgcttagtgaatggaagggcacaggggctggcaaaagcttttgctttgccacagccaatgtctgcctcctccctgactcgctcgcaaggctcaataatgttttcaacacccaagcccgggccaaagagattgggcagagaatccgcaatggggccgcccggcctcagatcaaaatctacattgattcccccaccaacacctccatcagtgcagccagcttcagcagcctggtgtcgccgcagggcagtgatggggccagagctgttcctgggagcattaagaggacagcctctgtggaatacaagggagatggtgggcgtcaccccagcgatgaggctgccaatggcccagcctctggggaacaggctgatggaagccttgaggacagctgcattgtgcgaattggtggtgaggaaggaggccgggcacaggaagctgatgaccctgctcctgggagccaagccaggaatggggctggtgggaccccaaagggccagacgcccaaccacaatcagcgggacggggattctgggagcctgggcagcccctccgcctccagggagtccttggtgaaggcacgggctggacaagacagtggtggcagcggagagccaggcagtaacagtaagctgctgtataagacctctgtggtgaagaaggcagcagcccgcaggaggcgccaccctgatgaagccttcgaccatgaggtctcagccttcttcccagccaacctggacttcctgtgcctgcaggaggtgtttgacaagcgtgcagctgccaagttgaaagagcagctacatggctacttcgagtacatcctgtatgatgttggggtctatggctgccatggttgctgcaatttcaaatgtctcaacagcggtctcttctttgccagccgctaccctgttatggacgtggcctatcactgttaccccaatgggtgcagcttcgatgccctggcctctaagggagctctgtttctcaaggtgcaggtgggaagcacacctcaggaccaaagaattgttgggtacatcgcctgtacacacctgcatgccccaccagaggacagtgccatccggtgtgagcagctggacctgcttcaggactggctggctgatttccgaaaatctacctcctcgaccagcacagccaaccccgaggagctggtggtgtttgacgtcatctgtggagatttgaactttgataactgctcttctgatgacaagctggagcagcagcattcactgtttactcgctacaaggacccctgccgcctggggcctggggaggaaaagccttgggccattggcaccctgctggacataaacggtctctatgatgaggatgtgtgtaccccagacaatcttcaaaaggtcttggagagtgaggaaggccgcagggagtatctggcctttcccaccagcaagagcccaggggctggacagaagggacggaaagatctgttgaagggcaatggccgccgcatcgactacatgctgcacgctgaagagggctgtgccctgactggaaggctgaggtggaagaattcagttttatcacccagctgtccggcctgaccgaccacctccccgtggccatgcggctgatggtgtctgcaggggaagaggaggcgtagaccagccatgccactgatctcgagcagtggggcctctgccagcccttcaagccacagcccatgtctggctgtgtcccctccactgagcacctagtgctgcggggaggagggcaggggcagggaagagcgagcccaccaatcccctgcaagcctgcaagccaggctgctctgtgcctctgggccatctctgcggacagaggacttgggccagcctgggagccccagccctctgaccagtgccattctttccagtcacgattttctacaaaaatacacagcacaacacagtttgtaacccaagggttcgtatgaggaccgggtttatgttctctttgtatctcttctcgagctttgtccagggttcatcgcttttgtctgctgccaatgttgtctcgcatgcctgcaccctcgcatgcccgctgcccgcatgccgtgtgccacactgtagcacccacctagactccttgctcgggcctcacctaaggccaaactcaaaacacaaaacaatcagaaccagccaaagaagcacttcctgggcacagttgccatctcccctccagctcggtgggggtgtgactgacggctgtcattacctgccagcccaggcctcttcccagggtcttgcattcaagggcgattacattttaagatgaaaacagaaaacgttaaacacaaaatcaccttcggttagggtctgtaagtcactgggtagaactgtgctcttccccagcctacacagagggtccagctgctctggccaccccagcagctcctgtaggggactgacaccagctgtggggccctagcaggaaatcccagagggatcacttttgtacaggaaggggacccagagcatggggggagggttcagaagacgacaggtttgtagcttcttcctacccaatatgtcctcttctatggggccccttgggttaacctcttcctgaggacttccctcatccatgtgtggctgagctcaggaacacttgcctgccccaagtcaggttgcacctctggcctcccaggcccacccttcctcagtggctaacctgaatgaagtgcaggaaaccaagatatagagaatggcttcttcaccactgaaagctcaggtggccagccaacagctactccttgtctagggcagggctgattccagacagcatccacaagccactcttgccactgtgactagagccagccccaagctcagcacagtcaggctgctagaagcccactgctctccacctgtcctgctcaggtgcccaagagcgcactgactccgccagcctcccttcagagagcagaggctgatccctgactacaaaaggaagatagtctgtctcaggctgctgagctactgatttgagggacttctgatatccctgatggtctctctcaagtcctttgatcttgtatctggcctggctcaaggccaactctgccttgtgatggagggagcatcaggcccctgctgttgggacctctaaaatgctggtgccctgaagctgtgccttgtcacccattgagtagcaagaggaatccagagaggcacacatttaacagatgccaggccctgtgctgagtggatccttcagagtatggcagcttggcactagggcatttacagctggtgacactggcctcttaacctcttggcctagagaaccctgccaatgtttgagtgtccagagctaggacagccttgctgggctctctgctatgcccctcttctgccagggcctgacctcccaggaatctggagtcctcatggaatgaaaggtccctactcctggaaacaaccaagattctaacattcaaggcaccattgggcaggcctaacccctaaaccaatggcactgtgtacaaggagagtagatgaggccaaggccacggctggggtccctaaacctgggttagggtaaaacgtttggagtcagagccgcatccttctctccttcccaactcccagggcggccttaggcaagtcaaacagccttgtgcctctgttattacaaggtcacctctacacagtcaggttctgaagcccagaggagggacagcctgccttcagatcccctacacttctcagcactgaggccatgaccatccgccacagttcactgtggtttgcctgtggactcagggctcgtgtactgccaggcctttctatttcaacttttaaaacagaagagacattgccaggattccagattccgtgacaaggccgacacaggggcagtcacagggaccacttgaatcctaaccggctctgcctgtccaggacctctcaaggaaacatagataagtgtattagtttaggaaagaccattcagttcatctttatttgtccaaaaccacctggagttttaagtatgaatattaaccttgatgctttttaactattgtattaacttgctcagatttagaaatactgttttaaaagaaaacgaagaaacttttttaatttctgtatttttttctgtattgtatcctcatgggacattaggggttttatatggtaagacacccaaggttttggtaaaacattatcaaatatatatccagacgattcttccctagaagaaaaaacaatctttatgcctgattttaaaaagttgaaaagaggtggatttttcctttatggtgctgaaaggaaggatggagaatgaggagaaaataaaactgtgaggctc

SEQ ID NO: 4016 - DNA, 2454 bp, Rattus norvegicus
  Genbank Accession No. NM_053607
gacggaggcagctgaatgtggtgctgaaccaacaacatctagctacaaggggagccactcctccacccagcgactgtgactgttctcacaggtctgaatttcctgttggtattcacaaagatgctttttatttttaacttcttgttttccccacttccgaccccggccctgatctgcctcctgacatttggaacggctatcttcctgtggctgatcaacagacctcagccagtcttacctctcattgacttggacaaccagtctgtagggattgagggaggagcacggagaggcgctttccagaagaacaatgacctaatcctttattacttctcagacgccaagacgttgtatgaagttttccaaagaggacttgctgtgtctgacaatggaccttgcttgggatacagaaagccgaaccagccctacaagtggatatcctacaagcaggtgtctgatcgagcagagtacctgggctcctgtcttttgcataaaggatacaagccatcgcaggaccaatttattggcatctttgctcaaaataggccagagtgggtcatctccgagttagcctgttacacatattccatggtagctgtccccctgtatgacacactgggagcagaagccatcatctatgtcatcaacagagctgatatctccgtggtgatctgtgatacaccccaaaaagcaacaatgctgatagaaaatgtggaaaaggaccttaccccaggcctgaagacagtcatcctcatggaccctttcgatgatgacctgatgaaacgaggagagaagtgtggcattgagatgttgtctctgcatgatgctgagaatctaggcaaagagaacttcaaaaaaccaatgcctccgaacccagaggatctaagtgttatctgtttcaccagtggaactacaggtgaccccaaaggagctatgctgacccatcaaaatatcgtttcaaacatggctgctttcctcaaatttctggagcctatcttccagcccacccccgaggatgtgaccatatcctaccttcccttggcccatatgtttgagaggcttgtccagggtgtcatattttcctgtggaggcaaaattgggttcttccaaggagatatccggttgctacctgatgacatgaaggctttgaaacccacagtgtttcccacagtgcctcgactccttaacagggtctatgataaggtacaaaatgaagccaagacacctttgaaaaagttcttattgaacttggctatcatcagcaaattcaacgaagtgagaaatggcatcattcggcggaacagtttgtgggacaagctcgtgttttcaaagatccaaagcagcctgggtgggaaggttcgtctcatgatcactggagccgcccctatctccactccagtcttgacgttcttcagggctgcaatgggatgctgggtgtttgaagcttacggccaaacagaatgcacagctgggtgttccattacatcacctggggactggacagcaggtcatgttgggactccggtgtcctgcaattttgtcaagctggaagatgtggctgacatgaactacttttcagtaaacaacgaaggcgagatctgcatcaaaggcaacaatgtgttcaaaggctacctaaaggacccagagaagacacaggaagtactggacaaggatggctggcttcacactggggacatcggtcgctggcttccaaatggaactctgaaaatcattgaccggaagaagaatattttcaaattggcacaaggagaatacatcgctccagagaagattgaaaatgtttattccaggagcagaccaatattgcaagtttttgtccatggggagagcttacggtcattcctgataggagtggtggttcctgacccagagtcacttccctcatttgcagccaagatcggggtaaagggatcctttgaagaactatgccaaaaccagtgtgtaaagaaagccattttagaagatttgcagaaagttgggaaagaaggtggccttaaatcctttgagcaggtcaagagcatctttgtgcatccggagccgttctcaattgaaaacgggcttctgacaccgacactgaaagccaaacgagtggagcttgccaagttcttccagacacaaatcaagagcctctatgagagcatcgaagagtaacttaaggttgctgagctggaagcggtgggggacgaagcggaaactatgtccagcgaacttttccagtaaatgaagcaatcactaaaggactgtcctgagttgggagcaaagcaacgtggacgagctcgatgtgacgcctgcactgcaggcgtcttctgtgatggaagctctggatctttctccttggacttcagtccctgcagtattttgctgccagatagcatgtggtgcctctacctgtaaatgtcagatctttgaaataaactattacagctcgtgccg

SEQ ID NO: 4017 - DNA, 978 bp, Rattus norvegicus
  Genbank Accession No. NM_053615
atggcgagcagcagcggctccaaggccgaatttatcgtcggtgggaaatacaaactggtgcggaagatcggatctggttccttcggggacatttatctagcgatcaacatcaccaatggcgaggaagtggcagtgaaactagaatcccagaaggccaggcatccccagttgctgtacgagagcaaactgtataagattcttcaaggtggggttggcatccctcacatacggtggtatgggcaaggaaaagactataatgtgctagtcatggatcttctgggacccagcctcgaagacctcttcaatttctgttcaagaaggttcactatgaagactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagggaagataaaaacctcactggcactgcccggtatgccagcatcaatgcacatcttggcattgagcagagtcgccgagatgacatggaatctttaggatatgttttgatgtattttaatagaaccagtctgccatggcaagggctaaaggctgcaacaaagaaacaaaaatatgaaaagattagtgaaaagaagatgtccactcctgttgaagttttgtgtaaggggtttcctgcagaatttgccatgtacttaaattactgtcgtgggctgcgctttgaggaagctccggattacatgtatctgaggcagctgttccgcatcctcttcaggaccctgaaccaccagtatgactacacgtttgattggacgatgttaaagcagaaagcagcccagcaggcagcctcttccagtgggcagggtcagcaggcccaaacccccacaggtttctaa

SEQ ID NO: 4018 - DNA, 1425 bp, Rattus norvegicus
  Genbank Accession No. NM_053617
aattccgacgagtgaaagaacaccaggaaacactggacatggacaatcctcgggactttctgcccgaggaacttggctgctcaacaagtcactgttgggatgaagctttatggccttggagtcctggtagccatcatcctctatgagaagcatggccttgcctttcagagtggccatgttctatctgctctccctcgaacctccaggcaagttcaacttcttcagaatctcactacaacttacgaggttgttctctggcagccagtgacagctgaattcattgagaagaaaaaggaagtccacttctttgtgaatgcgtctgatgtcaacagtgtcaaagcctatttaaatgcgagcagaattccatttaacgtcctgatgaacaacgtggaggatctaattcaacagcagacgtccaatgacactgttagcccccgagcctcctcctcatactatgaacagtatcactcgttaaatgaaatctattcctggatagaagttataactgaacagcaccctgacatgctccagaaaatctacattggatcctcatatgaaaagtacccactttatgtgttaaaggtctcaggaaaggaacacagagtcaaaaatgccatatggatcgactgtggaatccatgccagagagtggatttcaccagctttctgcttgtggttcataggctatgtaacgcaattccatgggaaagaaaatacatacaccagacttctgaggcacgtggatttctacattatgccagtgatgaatgtggacggctacgactacacgtggaaaaagaatcgaatgtggagaaagaaccgctctgtccacatgaacaaccgctgcgtgggcacagacctgaacaggaacttcgcttccaaacactggtgtgagaaaggcgcatcaagtttctcctgctctgagacctactgtggactttaccctgagtctgagccagaggtgaaggcagtggctgacttcctgaggagaaatatcaaccacattaaagcttacatcagtatgcactcatactcccagcaaatactgtttccctattcctacaacagaagcaaaagcaaggaccacgaggaactgtctctagtggccagcgaagcagttcgtgccattgaaagtattaataaaaacaccaggtacacacatggcagtggctcagaaagtttatatctagctcctggaggttctgatgattggatctatgatttgggcatcaaatattcgtttacgattgaacttcgggatacaggcagatacgggttcttgctgcctgagagattcatcaaacccacttgcgcagaagctttggccgcagtctctaaaatagcttggcatgtcatcaggaacagttaacaccctttcctctgctctcattacttttattttattgatttcagcaacactaaattg

SEQ ID NO: 4019 - DNA, 1772 bp, Rattus norvegicus
  Genbank Accession No. NM_053619
ccgttgctgtcgggtcaccacagagcccaggagaagccaggacatggaccccataagtaacgacagcagtgaaatcacctatgattactctgatggaaccccaaatcctgacatgcctgcagatggcgtttacattccgaagatggaacctggggacattgcagcccttattatctacttggccgtgttcctggtaggagttaccggaaatgccctggtggtgtgggtgacagcctttgaggccaaacgtactgtcaacgccatttggtttctgaatctggcggtggccgacctcctctcgtgcttggcactgcctatcctgtttacgtccattgtaaagcataaccactggcccttcggtgaccaggcctgtatagtcctgccctcgctcattctgctcaacatgtactccagcatcctgctgctggccactattagtgccgaccgtttcctgctggtgttcaaacccatctggtgtcagaagttccgccggcctggcctggcctggatggcttgcggagtaacctgggtcttagcattgctcctcaccattccgtccttcgtgttccggcggatacataaggacccctactcagatagcattctatgtaatattgactatagtaagggtccgttcttcatagagaaggctatagccatcctgcggctgatggtgggtttcgtgttgcctctgctcactcttaacatctgctacaccttcctcctgatccggacctggagtcgcaaggccacgcgctccaccaagacgctcaaagtggtgatggcggtggtcacatgtttctttgtcttctggctaccctaccaggtaacaggggtgatattagcttggctgccccggtcctcatccacttttcagtcagtggagaggctgaactccttgtgcgtttccctggcctacatcaactgctgtgttaaccctatcatctacgtcatggctggccagggtttccatgggagactccgaaggtcactccccagcatcatacgaaacgtgctctctgaggactccttgggcagggacagcaagagtttcactcggtccacgatggatacctccacccagaagagtcaggcagtgtagaggagatgccacaactgcctagctgctccttttccagtcctcctccccttcctccttcctcctctcacccctcctcccttcctcccatctctttgcatgtttaattttatgtgattctctttaaattgccctgactagccttgagcccaggatgctcacggatgctgagattataggtaaaaattcctttggagagaaacattacattaagatattactgggctttttttctgaggcaggccttggcctcgttgcccatctgcagtgtctaggcagatacacctagtgatgacgtctaggggtcaggtaacagagaacccaggtctcgagggaacccggggctcacggatacactacgtgagtaagctatagccctagactccaggcaacaaataagcacccaccctttatttcttttctatgtctgatttttttgtttatttgagacaaagtccatgtaggctagtctagccatggactcctcctgtgatcatcctccagaggtcgagactgtagacctgtgctaccatgcccgacctatcctttatttctgcaattttgtcttttcaaaaatggtattcgacagaacccaacatatccaagttttgtaaaaacaactgtgcacggcttacacgataaaaaatttttgtttttttaaaaaggcaaaaaa

SEQ ID NO: 4020 - DNA, 5333 bp, Rattus norvegicus
  Genbank Accession No. NM_053620
cacgggcagcgagaggccggcgcgtggggagcgggccggcgcggcaccatgtcggccaaggtgcggctcaagaagctggagcagctgctcctggacgggccgtggcgcaatgagagctccctgagcgtggagacgctgctggacgtgctggtgtgcctttacaccgagtgcagccactcggcgctgcgccgcgacaagtatgtggcggagttcctcgagtgggctaagccattcacccagctcgtgaaggacatgcagcttcatcgggaggactttgagatcatcaaagtgattggaagaggagcttttggtgaggttgctgttgtcaaaatgaagaacactgaacgaatttatgcaatgaaaattctcaacaaatgggagatgctaaagagagcagagacagcttgctttcgagaagagagggatgtgctggtgaacggtgactgccagtggatcactgcgctacactacgcctttcaagatgagaactacctgtacttggttatggattactatgtgggtggtgacttgctgaccctgctgagtaagtttgaagacaaacttccagaagacatggcgaggttctacattggcgagatggtgttggccatcgactcgatccaccagctccactatgtgcacagagacattaaacccgacaacgtccttctggatgtcaacggtcacatccgcctggctgactttggctcgtgcttgaagatgaacgatgacggcactgttcagtcttccgtggctgtgggcacacctgactacatctcaccagagatcctgcaggccatggaggatggcatgggcaaatacgggcccgagtgcgactggtggtccctgggcgtctgcatgtatgagatgctgtatggagaaacgccattttatgcagagtctctggtggagacatatggaaagatcatgaaccacgaggagcggtttcagttcccatcccacgtcactgacgtctctgaagaagcgaaagacctcatccagagactaatatgcagcagagagcgccggctcgggcagaacgggatagaggactttaagaaacatgcattctttgaaggtctaaattgggaaaatatacggaacctggaagcaccctacattcccgatgtgagcagcccttctgacacgtccaacttcgatgtggacgatgacgtgctgagaaacatcgaaatcttacctcccggctctcacacgggcttctcgggactgcacctacccttcattggctttacatttacgacagaaagctgcttttctgaccgaggctctctgaagagcatgatacagtctaacacgctaaccaaagatgaggatgtgcagcgggatttggagaacagcttgcagatcgaagcttacgagcgaaggatacgaaggctggaacaggagaagctagagctgagccggaagctgcaagagtccacccagactgtgcagtcccttcacggttccacacgggccctgggcaactcaaaccgtgacaaggaaatcaagaggctgaatgaagagcttgaacgcatgaagagtaaaatggcagattcaaacaggctcgaacgacagctcgaggataccgtgacccttcgccaggagcatgaagactccacacaacggctgaagggcctggagaagcagtaccgcctggcacggcaggagaaggaagaattgcacaagcaattggttgaagcttcagagcgattgaaatcccagaccaaagaactcaaagatgctcatcagcagcgaaaacgggccctgcaggagttttcagagctcaatgagcgcatggcagagctgaggtcacagaagcagaaggtgtcccggcagctccgtgacaaggaggaggagatggaggtggccatgcagaagattgactccatgaggcaggatatccgcaagtctgagaagtctaggaaagagctggaagctcggcttgaggacgcagtcgctgaggcctccaaggagaggaagcttcgagagcacagtgagagcttctctaagcagatggagcgcgagctcgagaccctcaaggtgaagcaaggaggccgggggccgggtgccacgttagaacatcagcaggagatctccaaaatcaggtcagagcttgagaagaaagtcttgttctatgaggaggagttggtccgccgagagcgctcccatgtgctagaagtaaagaatgtgaagaaggaggtgcacgaatctgaaagccaccagttggccctgcagaaagaggtcctgatgctgaaagataagttagaaaagtcaaaacgagaacggcacagtgagatggaggaggccataggtgccatgaaagacaagtacgaacgggagagggccatgctgttcgacgagaacaagaagttaacagcagaaaacgaaaagctctgttcctttgtggataaactaacagcccaaaacagacagctggaggacgagctgcaggacctggcctccaagaaggagtcggtcgctcactgggaggcgcagattgcagagattattcagtgggtcagcgatgagaaagatgccagaggctaccttcaagcacttgcttctaagatgaccgaagagcttgagactttgagaagctctagtttgggatccaggacactggacccactctggaaggtccgtcggagccagaagctggacatgtctgcgcggctggagttgcagtccgctctcgaggcagagatccgtgccaagcagctggttcacgaggagctgaggaaggtcaaagacaccagcctagccttcgaaagcaaactgaaggagtcagaagccaaaaacagggaattattagaagaaatgcaaagtctgaagaaaaggatggaagaaaaatttagagcagatacagggctcaaacttccagatttccaggatcctatctttgagtacttcaacactgctcctcttgcacatgacctgacttttagaactagctcagctagtgatcaggaaacacaggcttcaaagttggacttgtccccatcagtgtctgtggccacaagcacagaacagcaggaggatgcggctcgttcacagcagaggccgtctactgtgccgctgcccaacacacaggccctcgccatggctggaccaaagcccaaggcacaccagttcagcatcaagtccttccccagccccacccagtgtagccactgtacgtccttgatggttgggctgatccgacagggctatgcctgtgaggtctgcgcgttttcctgccatgtgtcctgcaaagacagcgctccccaggtgtgccccatacctcctgagcagtccaagcggcctctcggcgtagacgtgcagaggggcataggcacagcctacaagggctacgtcaaggtcccgaagcccacaggcgtgaagaaagggtggcagcgggcttacgcagtggtctgtgactgcaagctcttcctgtacgacctgccagaagggaagtccacccagcctggggtcatcgccagtcaagtcttagacctcagagatgacgagtttgctgtgagctcagtcctggcctcagatgtcatccatgctacacgccgagacatcccgtgtatattcagggtgacggcctctctcttaggttcaccttctaagaccagctcactgctcatcctgacagagaacgagaatgaaaagaggaagtgggttgggatcctggaagggctgcaggctatcctccacaagaaccggctgaggagccaggtggtgcacgtggcacaggaagcgtacgacagctcactgccgctcatcaagaccgtcctggctgccgctattgtggatggagacagaattgcggtcggcctggaagaagggctctacgtcattgagctcacccgagatgtgatcgtccgcgctgctgactgcaagaaggtataccagatcgagctggcgcccaaggagaagctcatcctcctcctctgtggccggaaccaccacgtgcacctctacccctggacctccttcgatggagcagaagctagcaactttgacatcaagctcccagaaacgaagggctgccagctcatagcaacagggacgctgaggaagagctcgtccacctgcctgtttgtcgccgtgaagcggctggtcctttgctacgagatccagagaactaagcctttccaccggaagttcaatgagatcgtggccccgggacatgtgcagtggatggccatgttcaaggacaggctctgtgttggctacccctccgggttctctctgttgagcatccagggggacgggcagcctctagacctggtaaatcccgctgacccctcgctcgcgttcctctcacagcagtctttcgatgccctctgtgctgtagagctcaaaagtgaggagtacctgctctgcttcagccacatgggactgtacgtggaccctcaaggtcggaggtcacgcacgcaggagctcatgtggcctgcggctcctgtcgcctgtagttgcagctcctcccacgtcacggtgtacagcgaatacggggtggatgtcttcgacgtgcgcaccatggagtgggttcagaccatcggcctgcggaggataagacctctgaactctgatggtagcctcaacctgctgggctgtgagcccccatgcctcatctacttcaaaaacaagttctcaggcaccgtcctcaatgtgcccgatacctcggacaacagcaagaagcagatgctgcggacgcggagcaaacggcgcttcgtcttcaaggttccagaggaagagaggctgcagcagcggcgagagatgctcagagacccggaactgagatccaaaatgatatccaatccgaccaacttcaaccacgtggctcacatgggccctggcgatgggatgcaggtgctcatggacctgcctctgagcgtgcgcccacagcccaggaggaaaagcagggtcctgccccaacaggcctccctcggcagcctcccatccaggaacaagccctatgtctcatggccgtcctcaggtgggtctgagcctggagtgcctgtgcctctgaggagcatgtctgaccccgaccaggattttgacaaagagcctgactctgactccacgaagcactcactccgtccaacagctccaaccctagcggccccccgagccccaactcaccgcaccggagccagctccctctgaaggcctggaccagccagcctgcgacgcctgaggccgccagcatagcaccatagggccagggagccagatggccccaacatcagtgccaagactgagctgaccctccagtgttgtccaaggaaatgtagaatcagtttgtagatagataaatgaatctttaattatatgatcagttt

SEQ ID NO: 4021 - DNA, 5508 bp, Rattus norvegicus
  Genbank Accession No. NM_053622
ccgcgatgtctccggcggctgcggcggctgacggaggcgagcggcggcggcctccgttgggcgtacgggaaggccggggccggacccgcggctgcggaggaccagcgggtgccgcggcactgggcctagcgctgctcggcctcgcgctctacctagtgcccgcggcggccgcgctggcctggctggccgtgggggcgagcgcggcctggtggggcctgagccgagaaccccgcggcccgaggggcctgtcgtcgttcgtgcgcgagtcgcgccgtcacccgcggcccgcgctcaccgcttcaccgcttccagccaagtcgccagtcaacggtagcctctgcgaaccccgcagcccgcttggaggccccgaccccgctgaactcttactcatgggcagctacctgggcaagccaggcccgccggagcctgccctcccgcaggaccctagagacaggccagggcgccgcccaccctcacggtccccgccgtcgtcttcgacggcccagcgagtccaccacgtctaccccgcgctccccaccccacttttgcgaccttctcggaggccgccccaccgagattgtgggcctttatccagtcggtttgttataacaccccgaagacgatatcccattcagcaagcccagtattccttgctgggggcacttccaaccgtatgctggaatggtggccataagaaagccgtgctatctgcacggaactcgaggatggtgtgcagcccagtgacagtgaggattgcccctccagacagcaagctatttcgatcaccaatgccggagcagatactcagcaccacactgtcttcaccatcaagtaatgccccagacccttgtgcaaaggagacggtgctgaatgccctcaaggaaaagaagaaaaggacagtggcagaggaagaccagctgcatcttgatggccaggaaaacaagagaagacgccacgatagcagtgggagtggacattcggcattcgagccccttgtggccaacggagtccctgctgcatttgtgcctaagcctggctccctgaagagaagtctggcttcccagagctcggatgaccacttgaacaaacggtctcgcacctcctctgtgagctccctgactagcacatgcacaggaggcatccccagctccagccgcaacgccatcaccagctcctacagctccacccgaggtgtctcacagctgtggaagaggagtggtcccacctcttctcccttctccagcccagcttcctcccgctcccagacaccagagaggccagccaagaagacaagagaggaggaaccatgtcaccagtccagttcttcagctcccttggtgacagacaaggagtccccaggagaaaaggttacagatccagccacggggaagcagcagagcctgtggacttccccacccacacctggcagctccgggcaacgcaaacgcaagattcagctgctgccctcccggcgaggggaccagctcaccttgcctccaccccctgagcttggctattccatcactgctgaagacctggacatggagaggagagcctcactgcagtggtttaacaaggtcttggaggataagacggatgatgcctctaccccagccactgacacctccccagccaccagccctcccttcacactcaccctgcctaccgtggggcctgctgcctcaccagcctccctcccagctcccagctctaacccactgttggagagtttgaagaagatgcaggagtctccagccccatcctcctcagaacctcctgaggcagcaacagttgcggccccttcacctccgaagacacctagcctcctggcccctcttgtctcaccactgacagggcccctagccagcacctcctcagactccaaacctacaaccaccttcctggggctggcttctgcttcatccgccacaccactcactgacaccaaggcccctggagtctctcaggcccagctgtgtgtcagcaccccagccgccacagctccctccccaactccagccagcacgctgtttgggatgctgagtccacctgccagctcctcttcccttgccactcctggcccagcttgcgcttctcccatgtttaagcccattttcccggccacacctaagagtgagagtgataatcccttgccaactagctcctcagccgccacgacaactccagccagcaccgccctccccacaacagcaaccgccacagctcacactttcaagcccatttttgagagcgtggagccatttgcagccatgcccctgtcacctcccttctccctgaagcagacaactgctccagccaccactgcagccacatcagctcctctcctcactggcctgggcactgccacttccacagtggccactggcaccacagcttctgcctccaagcctgtgtttggctttggagtgaccactgcagcgagcactgccagtaccatagcttccacctcccagtcaattctgtttgggggagccccgcctgttactgcttccagttccgccccagccctggcctccatcttccaatttggcaagccccttgccccagcagcgtctgtggcgggcacctcctttagccagtcccttgccagctctgcccagactgctgccagcaatagtagtgggggcttcagtggttttggtgggaccctcaccacctccacctctgcccctgccaccaccagccagcccactctgaccttcagcaacactgtcacccccaccttcaacattccctttagcgccagtgccaagcctgcgctcccaacctaccccggagccaactcacagcccacatttggagccactgatggggccaccaagccggcacttgccccaagttttggcagctctttcacttttggcaactctgtggcctcagccccgtcggcagccccagcaccagccgcctttggtggtgctgcacagccagctttcggagggttgaaagcctcagcctccaccttcggcacccctgccagcactcagccggctttcggtagcaccacctccgtgttctcctttggttcagccaccacatctggctttggtgctgctgccgccaccacacagaccacccacagtgggagcagcagctctctgtttggcagctctactccatccccattcacattcggtggctcagcagctcctgctggtggtggaggctttgggcttagtgctacaccaggtaccggctccacctctggaacttttagctttggatctggacagagcgggaccacgggcaccaccacctcctttgggggaagtctgagtcagaacaccctgggcgcacctagccagagctcaccgttcgccttcagtgtgggcagtacacctgaaagcaagcctgtgtttggaggcacatccacacctacttttgggcagagtgcccctgccccaggagtcggcaccacaggcagcagcctctcatttggggccccttcaacacctgcccaaggctttgttggagttggacctttcggatcaggagccccttccttttccattggcgcgggatccaagaccccaggggctcgacagcgacttcaggcccgaaggcagcacacccgcaagaagtagcctgcctgcctgcctgcctgcctgcacccccacccctgcctggacctggacctcagcacctgctaggaagagcctctgaccctgcaaatcccatagcaaacccagccgtcaccagggtggaagtctggccctttctgttctagaggaagcgagtgccccggggagcgaggtttacttgaacagtcacactggttaggctggagaactgaaaaaaaacatctgtacatattgtcctcttgctgccccagcgcttgtttagtgtataacctaggcagcccccctctccttgggcaccattctgctggcacccacttggatccctaatacatgaggtgggattgggggaaacggaatgtccctagctttgcctgcttggcttggccatgagtggttctcttcctctgatcccctcagggtctctccctatttcttgctgctttgtccttcaccggtcctctgtgagattcattccttttaaatggcggtgaatcttgctttgccttggagaccccagtggcgctgttttgcctcttctgtcaagtctgtttagtctccagccctctgctaacccagcctctcaaaaggttggtggctcaagactgttagcctggcagagccagggagaagtctgctccaggaggtcctggggcaggcagaccagaccgccccccactgcttctagctgcctcttcacctgcccgccaccccacgggccaacttgcctctttgggattgtattttccaagccttgtactgtgtttgtctgatgttaatgtgtgttgctccttgaatcgagtttggaggaagaattgaattgtatgtgtggcggcatgttggtaatgccggacttaatgtcacctgggcctcctgggcctagctaattgaatgctgaagtggcaccgccacagtgacagccacagtgctgactcctgaatctcaatagtgtttgactaagggctggcagcccaggggatggatggagccggctgggagcagacttccctctctgttggtcctccccatacagcccaccccaggccagggcggcttctgcctgtgcttggagctgtagataaccaactacactttgagttcttagttgtatttccaaaagggtcctacctagcctgtctctccttccaaagccacaccacacccttaggcccaagcctggctgccatgtccgccctctttgggagaagtatgaatgcgtgtgtctaaattaaaagaaaaaatatttaaacattttttaacaaaataaaaatttatttttgtatttaagctaaattgccttttaaattccttcaagcttggttcactgaggtggttaagtataaatgctatggaatagtaggaattagctgtatagttatgcctgtgtgaaggaagggctcatagctgtccccagcagctctcctgagggggcagagctccttctagacatgtcgtgtaagtgtaactcttattttataaacagtgtgatgtagctgtaactggtcccctttccttgtgagtgggattgaatgttttatggcaggggttaggctgggttgtatggaactggagaagagctggacctcaagtcccaaatgcctgtgaggatggggatgggtgggggtctgaacacgaaccctctacctgtgcctcaggtaaggaagggcctccctccaattcagtctgagctaattacctcagctccacagcaggcctgtatccagggtgccggaagaggtgtcctggaatagcctcggtgtgtgagcacatctgtccgtcgtcacgctggacagggacagggaggctggggcttccaccacagactgcgtttctgtgagtgtagctgagatttttagtatgaatgtgagattgttcttgcttatgtcattaaaaataaaactgtgatctg

SEQ ID NO: 4022 - DNA, 4862 bp, Rattus norvegicus
  Genbank Accession No. NM_053623
gccgaggctcgcccctccttgcaaggctgctccagagctagcgggcacgcgagctcctctccgggagcttccttccccgaaaggccgggacccagtggcggactcgtggtgagcgaggcagcaccttcgatcccaggagattgacctgttcttaaaagtgaaagaagaaatctaagaaaaacgctatggcaaagagaataaaagctaagcccacttcagacaaacccggaagtccatatcgctctgtcacgcacttcgactcactagctgtcatagacatccctggagcagatactctggataaattatttgaccatgctgtagccaagtttgggaagaaggacagcctggggacccgggagatcctgagcgaagaaaatgaaatgcagccaaatggaaaggtttttaagaagttaattcttgggaattataaatggataaactatcttgaagtgaactgccgagtgaataactttggaagtggcctcactgcactgggactgaaaccaaagaacaccattgccattttctgtgagaccagggcggagtggatgattgcagcgcagacctgctttaagtacaactttccgcttgtgactttatatgctacccttggcaaagaagctgtcgttcatggattaaatgagtctgaggcttcctatctgattactagtgttgaacttctggaaagcaaactgaaggcggcattattagatatcaattgtgttaaacatatcatttatgtggataacaagactatcaatagagcggagtaccccgaggggcttgagattcacagcatgcagtcagtagaggagctgggatccaagccagaaaactcaagcattcctccaagtagaccaactccttcggacatggccattgtcatgtacaccagtggctctactggccgccccaagggagtgatgatgcaccatagcaatctgatagctgggatgacaggccagtgtgagcgcatacctggattaggaccaaaggacacatatattggctacttacctttggctcatgtgctggaactgacagcagagatctcctgctttacctacggctgtaggattggatattcgtcaccactcacactgtctgaccagtccagcaaaatcaagaagggaagcaagggtgattgtactgtactgaaacctacacttatggcggccgttccggaaatcatggatagaatttacaagaatgttatgagcaaggttcaagagatgaattatattcagaagactctatttaaaattgggtatgattataaattagagcaaatcaagaaaggatatgatgcccctctttgtaatctgatactgtttaagaaggtgaaggctcttctaggaggaaatgtccgcatgatgctgtccggcggtgccccactgtccccccagacacaccgattcatgaatgtctgcttctgctgccccattggtcagggctatgggctgacagaatcatgcggtgctggaacagttactgaagttaccgactacactactggaagagttggcgctcctcttatttgctgtgaaattaaactgaaggactggcaggaaggtggttatacagttcatgataagccaaaccccagaggtgaaattgtgattggaggccagaatatctccatgggatattttaaaaatgaagagaaaacagcagaagattattctgtggatgaaaatggacaaaggtggttttgcactggtgatattggagaattccaccctgatggatgcttacagattatcgatcgtaagaaagatctggtgaagctgcaagccggagagtacgtgtctcttgggaaagtcgaagccgcactgaagaattgtccactgatcgacaacatctgtgcttttgccaaaagtgaccagtcttatgtgatcagttttgtggttcccaaccagaaaaagttgactcttttggcacaacagaagggggtagaaggatcttgggttgatatttgcaataatcctgccatggaagctgaaatactgaaagaaattcgagaagctgcaaatgccatgaaattggaacgatttgaaattccaatcaaagttcgattgagcccagagccatggacccctgaaactggtttggtaacagatgccttcaagctgaaaaggaaggaactgaagaaccattatcttaaagacattgagcggatgtatgggggcaaataaaaggcaactgtctacttcacatttgcacaggaggtggcctgatggtttttttagttctagagtttaagcctttgttgatctctctgttaaaatgtaaggtgaatcttctaaagacatgaaacaaaaaaacaaccaaaagtggttacaataaattgcatagtcctagagaagctgaaattgaagacatttccctttagctgtgttattaagtttagagcaaaaattctgttttagaatattagccttagctacacttgtttttctaaagatactccatgctaaagtaaacaaattggacttggactaggtgtagttgaagaaatctacagcttccagtgtctatgtcttcctagttcagaagtttctatcgtaatcattaggacaaaattacgtattaacactactcaaagccgaagttccaccaggctttgaaatcctcttccaaccatttctcttgaagggaaaaaaatcagttgtaataaatggattcagtatcttagaaggtattattttaagctcataattgccatgtaggtgagacatagaatcattataatattgtgaataattacagtgcctgaagttaaaactaaaacaacacacacataccaaaaatatctcataatgtatttgaagggaggctgaattgctcctttggatgtctaagaacttaaatcagcaactgtaattattgaaatgtcttcagaaaaatgtccactttgtaaaagtgacctttctgtgtgtgatctagtcaaaggctgagaccaaggggaacatgttagaaagtcaatcagaattcaataagatacattgcttttctgttagaaagttcatggcatcctaagcattcagaattaggatcctggcatagcactgagcctgggaaagagatttagcctctttaactttgataccagggcttgattttaaaatgtgcttgtattaaattacatttgtaatttatggtctgtttgctgttgctgattgattcttgatcagtagtgtgcatttcagagagcctttcattttgctttaatttcagcaaagcgggttatgataaatgacttcctcgaatcttgttcaaacctacgggtgattaagtgtcttggatgagtctgaggaagttaaagggaagaaaacactgttaacacttttcctgtttgtgaagagtttagaaactggaaatgctagatttgggagaagggcagagttacttgattaaggactgtctgtgcagtaacttgggagtgtgagtttctttttaaatcttcagctaaaatctggaattatatattcttgatagatattcgcacttgaaccatagttactgtatgtaaaaagcaaaaattcttaatactgttattctttgcacttttttcatagtcattttatacacacacacacacacatgcatgtgtatgtgtgtgtgtatatataatatatatatgttgcttacattgtgttgtacagatgtgggccaccactacaacaaaatgagttctttgtgctctaaaatatttataaagaaattatttaaatgttatgtatatggtggtaatattgagaaaaaaaatcatctggtattctgagcaacagcgaaggtttttgtaaaagtttcttttcagtgttgtgcaaactaaaatttgaggcaagttttccctgaagttctatgtgagtattctcatgcttcccatcttgcctttgaagtgtgaaaagacatcaagtagactactagtcagcttctacctactcctagtgcactgtttatccgtttttttttaaaggcttttccaatatatgtatcccatttggaatggtgattttaaaatgtgagtgcatgcagactatcttacttaagatacttgcaccccacccacagccatctcccaaagctggaacactgccaactaggtccttaagaatcacgcattgaatacaaggtcgggtgctgctaattcttcatgaaaatcctaacacacacgttaagggaccagggagatgccactgccctctgacttttcatcaaaaaaaaaatatatatatacatgtttatgtaaacagaactattttccatattcatagtgactttttaagtatttgagcctaaaggttttgatctccattttatacctatttaaatcgttcacaatttcatgtcagccatcaattaaagctgtgcttactgttgattgtgtgtgcatttctaaggtgaacgctcctaattttttgctttaattacatgaaagggtcttatttctttgatatttgtgctcttttttttaatgtagactgaaggtatgattgtgtgacttttaagaaatgaaataccgatgaatgatccatagagtccaaagtgagggagaatgctgtttctttgttcatagagactgactagtaatctttgcctatattttcctggtagcagatgacaaatgtttctacagtgacaagctgagaagaggttaaaggttaaagattgtgtggcattcgggaactggagagatacgttttaattttgaatgtagttacaaattttatattcatatttgtactttctgttaatgcacgattgtagaattgttctgtagattttttgtgtttactcttgaaaggctttgtttgttcttctttttaagtttgcacttgaatcttataaaataaatc

SEQ ID NO: 4023 - DNA, 3736 bp, Rattus norvegicus
  Genbank Accession No. NM_053630
caggcagcggcggcgagaggaggggaggaggcaggccggcgcatggggcgccccggccccgccggtagcgcgccccctccggccaggccgcgctgaacgcagcccgcgcaacgcctcgaattcgtacccggggccatgccggtcatgaaggggttgctggccccgcaaaacacctttctggacaccatcgccactcgctttgacggcacgcacagcaactttcttctggccaatgcccagggcccacggggttttcccatcgtctactgctctgacggcttctgtgagctcacaggctacggccgcaccgaggtcatgcagaaaacctgtagctgccggttcctctatggcccagagaccagtgagccggccttgcaacggttacaaaaagccctggagggccaccaagaacacagagctgaaatctgcttttaccgaaaggatggctcggccttttggtgtcttctggacatgatgcccatcaaaaatgagctgggggaggtggtgcttttcctattttcctttaaggacatctctcagagtggaggcccaggacttggctcaccagggatccatggggacaataataatcatgaaaactcccttgggaggagaggagctagctcaagacttaggtccacgaggaggcagaaccggacagttctacaccggttgactggccactttggtcgccgggaccagggaagcgtgaaagccaatagtaacgtgtttgagccaaagccatcagtgcctgagtacaaagtggcctccgtggggggctcccgctgcctgctcctccactacagcatccccaaggctgtctgggacggtctcatccttctcgctacgttctacgtcgcggtcaccgtcccttacaacgtctgcttcgctggtgatgacgacacccccatcacgtcccgacacacccttgtcagtgacatcgctgtggagatgctcttcatcctggacatcatcttgaacttccgcaccacctacgtgtcccagtcgggccaggtggtttctgctcctcggtccattggcctccactacctggccacctggttcttcgtggacctcattgctgctttgccctttgacctgctgtatgtcttcaacatcactgtgacctcgctggtacatctgctgaaaaccgtgcggctcctgcggttgctgaggctgctgcagaagctagagcggtactctcagtgcagcgcggtggtgctcacgctgctcatgtccgtctttgcactccttgcccactggatggcctgcgtctggtatgtcatcgggcgccgggagatggaggccaatgacccgctgctctgggacattggttggttgcatgagctgggtaagcggctggaggagccttatgtcaatggctcggccggtggaccatctcggcgcagtgcctacatcgccgcgctgtacttcacgctgagcagcctcaccagtgtaggcttcggcaacgtttgtgccaacactgacgctgagaagatcttctccatctgcacgatgctcataggcgcgctgatgcacgcggtggtgtttgggaatgtcacagccatcatccagcgcatgtactcccgacgctcgctctaccacagccgcatgaaggatctcaaggacttcatccgagtgcatcgtctgccccgcccactcaagcagcgcatgctcgagtacttccagactacatgggccgtcaacagcggcatcgatgccaacgagttactgcgtgacttcccggatgagctgcgagctgacatcgccatgcacctgaatcgggagatcctgcagctgcctttgtttggagcagcaagcaggggctgccttcgtgccctctccctgcacatcaagacctcattttgtgctcctggggagttcctgctacgccgtggggatgccctgcaggcacactactatgtctgctctggctctcttgaggtgctccgagacaacacggtgctggccatccttggaaagggggacttgattggggcagacatccctgagttggggcaggagcctggggcaggggcaggctgcgtgctgaagaccagcgctgatgtgaaagcactgacttactgcggcctgcagcagctgagcagccgagggctggccgaggtccttcggttgtatccggaatatgtggctgccttcagggctggcctaccccgggacctaaccttcaacctgcgccaaggctctgaaaacaatggcctcggccgcttctcacgttctcctcgactctcccaggcacgctccgacactcttggttcctcctcagacaagactctgccatccatcacagaaaccgagggtggcatggagcctggggctggttccaagccccgtcggcccctcctgctgcccaacctcagtccagcacgacctcgggggtccctggtcagccttttgggcgaagagctgcccccattctcagcccttgtctcctctccttccctgtccccaactccttcccctgccctggctggccggggttcaagtccctccctgcacgggccccccaggggctctgctgcctggaagcccccccagctcctcacccccccactgggaacatttggacctccggacctcagtccccggatcgtggatggcattgaggactccagtaacacagctgaggctcctacattccggttcagcaagaggccggagcccaccagaacccgttcacaggctcccctttcaggccctaggctcagccgggaactggccacagaggcagcagaggaggtgaaggaaaaggtctgcaggctgaaccaagagatttccagactcaaccaggaagtgtctcagctgagccgggagcttcgccaagtgatgggcctcttacaggccaggctgggtcccccaagtcacccacctgactccacttggctcccagaccttccttgtccccatcagagaccgccatgcatctctcctcatatgtctggacctccacctggtctccagaatactacacttgctgtagtccactgtccagccagtgttgggacagtggagataggggccaccccctcagagctgaggtcttccatggtgccaccctttccctcagaacctgatcctcttggaccctctccagtgccagaggcttctcctctgaccccaagcctcctgaagcacagcttccagtctgggtcagacacattccactgaccctggccttgggcccaggcctgtctggggtgggcttaattacctgccatccagggaggagctgggctccttggcctcttgccttggggtcagcagctgccagctggtctggttggctctggattctctggactttttaacaatgagtggccacatctaaccccgttccattttctaaaccatcccccccacccgtcctactcttgtgggaggggagtcacctgaagccgtggaatccagcaggcatgaaatggaccatggtgccctgttgggctacgcagaggagatgtcttactttctccccacgacttggaggctgtcatgcaaggtggtcccttctgctgccagcagctcaaagcattctagctttacccttctgcagttcccacctccaaacatcagtcatatctgcccccctccctcccaacatggtctcgacctcaatgaggatctgggcaactcacaaaccctctctggtttccagctcccctttctcactaaacaccccaggctcacttttggatagaaaataaatccatatattttt

SEQ ID NO: 4024 - DNA, 2976 bp, Rattus norvegicus
  Genbank Accession No. NM_053633
gcgattcattaattgctgggcgaggggacacactgactgttataataacactacatcagcaactcctggctccccaacagccggatcccaggcaggagagagtcagtggcagatagccatttttttttcttccttaagaagccaacaacttggttgctagttttatttctgttagaatttttttttttgtgtgtgtgtggatgtgtggtggtggtggtcttttctaagtgtggagggcaaaaggagataccatcccaggctcagtccaacccctctccaaaaacggcttctctggcactccaggtagcgagggagttgggtctccaggttgtgcgaggagcaaatgatgaccgccaaggccgtagacaaaatcccagtaactctcagtggttttatgcaccagctgcctgacagcctctacccggtggaagacctcgccgccccgtcggtgaccatcttccccaatggtgaactgggaggcccctttgatcagatgaacggagtggctggagatggcatgatcaacattgacatgaccggagagaagaggcccttggatctcccatatccgagtagcttcgctcccatctctgcgcctagaaaccagaccttcacttacatgggcaaattctccattgaccctcagtaccctggtgccagctgctacccagaaggcatcatcaatattgtgagtgcgggcatcttgcaaggggtcacccctccagcttcaaccacagcctcttccagcgtcacctctgcctcccccaacccactggccacgggacccctgggtgtgtgtaccatgtcccagactcagcctgaactggaccacctctactctccaccaccacctcctcctccttattcgggctgtacaggagacctctaccaggatccttcagcattcttatcgccgccacccaccacttccacctcctctctggcctaccagccacctccttcctacccatcccccaagccggctatggacccaggtctcattcctatgatcccagactatcctggattttttccatctccgtgccagagagatccacatggcgcggctggccctgatcgaaagccgttcccctgccctctggactccctgcgggtcccccctccgctcacgccactctccaccatccgtaattttactcttggggggcccagtgctggcgtcacgggaccaggggcaagtggaggcggtgagggtccccgactgcctggcagtgggtctgcagcagtgactgctaccccctacaatccgcaccacctgcctttaaggcccatcctgagacctcgaaagtaccccaacaggcccagcaagacgccagtgcacgaaaggccgtacccctgcccagcagagggttgcgacaggaggttctcacgctctgatgagctgaccaggcacatccgaatccacaccggtcacaagcccttccagtgtcggatctgcatgcgaaacttcagccgaagtgaccacctcaccactcacatccgcacccacaccggggagaagccctttgcctgtgactattgtggccgtaagtttgcccggagtgacgaaaggaagcgccacaccaagatccaccttcgccagaaggagaggaagagcagtgccccctcgtcatctgcatccgcccagtcttcagcctctggtcctgggggctcgcaggccgggggcagcctgtgcggtaacagcgccattggaggaccactggcctcctgcacctctcggaccaggaccccgtgagatgaagctccagctgacacaccagtttcttcaggccccagaggccctctatccactcgagctgcaaacactaccgcccttctgtgttcttccccgtgatcccgtgaacctgtgatcctgggcaaaggaccctaatggagcccagctctgtcccaccttctcacagacggccttctgaaaacttaggccattttaaaggagttgactgtcactccaagaaatggggagccagaagagggctgggcgagggcccctggcctacagggctgtgctctaaccctgacagagagatgtttgactatggtctgcgagcccttccctttgaccctcgatgccagttgctctgagactttttctacaataggttgggagttgttgattcctttgagcaaggacagcgaaaaagactaaattaaagcaaaaccgatgtggcactttaatggcttgggacggacttggggtaggggtggggggttgtacagtgagcacagtttagccctggcctggccgcagcactctgtggccctagaacagtgaatggaagtttctcgagccatctcagcccttaagcaatatgtcctataaactcaagagaacgaacggaagtgcaatgtcgggaaggacaaagcaatattggctcctttttgttgagaaacaaagattatttttccagtgtatatccatttagatttttgtgtattttttttttttgatgtgcactgttctccgagttctgaacctttgggaaaaaagtgtaaaacatttatgatctcttgaatcgagtcaaaagttaacttatttaaaggggggtgtacataggatgcatgcagtggtgttgcaagtgtcctctgtgccttgtgtgatgtgggcagtgttacagggtctgcatgtgtacaggatgccttactatgaaaaaaaaatcactccctgggtttaagtatggctgtatatttctgcctattaatatttggaatttttttagaaagtatatttttgtatgctctgttttgtgacttgaaagtgttaccttcgcagtcaaatttcagatgagagtgtgcttaacgtcactgcagctgacttgtttggttattagctcttaatagttgtggaaagattaaacaatctattctaacacagaaccactaactggagttcagatatcggacggcttatggcaatggtgtaaaataaatacttttcaacaataaaaaaaaaaaaaa

SEQ ID NO: 4025 - DNA, 2449 bp, Rattus norvegicus
  Genbank Accession No. NM_053638
ccacgcgtccgggggatcggacgcgtgctgtcgccgcggtgagggaagtggacgcgatggccgggtccgcgtgggtgtccaaggtctctcggctgctgggtgccttccacaacacaaaacaggtgacaagaggttttgctggtggcgttcagacagtaactctaattcctggagatggaattggcccagaaatttcagcctcagttatgaagatttttgatgccgccaaagcacctattcagtgggaggagcggaacgtcacagcgattcaaggaccaggaggaaagtggatgatccctccagaagccaaagagtccatggataagaacaagatgggcttgaaaggcccactgaagaccccaatagcagctggccatccatctatgaatctgttgcttcgtaagacatttgatctttatgccaatgtccggccatgtgtctcaattgaaggttacaaaaccccttacacagatgtaaatattgtcaccatccgagagaacacagaaggagaatacagtggaattgagcatgtgatcgtcgatggggttgtgcagagcatcaagctcatcactgaaggagcaagcaagcgcattgccgagtttgcctttgagtacgcgaggaacaaccacaggagcaatgtcacagctgtgcacaaggccaacatcatgaggatgtcagatgggctctttctgcaaaaatgcagggaagttgcagagaactgtaaagacattaagtttaatgagatgtacctcgacactgtatgtttgaatatggtacaagacccgtcccagttcgatgttcttgtcatgccaaatttatatggagacatccttagtgatctgtgtgcaggactgattggaggtcttggtgtgactcaaagtggcaatattggagccaacggtgttgccatctttgaatcggttcacgggacagccccggacattgcaggcaaggacatggccaaccccacggccctgctgctcagtgctgtgatgatgctgcgtcacatgggcctctttgaccacgcagcaaaaatcgaggctgcgtgttttgctacaattaaggatgggaagagcttaacaaaagatctgggaggcaactcgaagtgctctgacttcacagaagaaatctgtcgtagagtaaaagacttagattagcacttctggggatttgctgcagtccgtccgtcactccagggggatgccctgtaatcctccttgagagcgcccaccattggtttgcttgcttcgtgacagagcacatttcaaatctggctttttcctaacaaaacccttgcaatggatgcacacaatgccctaggcctttgtgcaaaggttcccaagtgcttgtatttattgtctgtctggtaaacctgttttgtaaactataagtgaactgtatcatttatcattgttaacccattttacacctcaggcaaaataatttttcctcaactgtaaatattctgatacagaattaagagaagatatttaactttttaacaaaagccctggatttttggtttatgcaaaacagctgggagtaaaacagggtttcaacaatcgcacaagataatgttattctaaaaatagtgggcacaaaagaaatttactgggaaagttcacagcaaaaatgatatatttcttaaaaatatggaagtaaagatatttgtcctatacatgaattactactaataaaaatgtaagctccaagaaacccataagaacggaagtaattttatttaatatatagataatccttgtcaaagccccagatgctctgtgtatttgattattttgttacttgagatttactattttggggggaagagctctcagacagggagatcactcctcttcactagactaatcatcagcagttgtcagtcagaggagccagccactgcagattccctcccacatgaccacactccagccagggctgcaggtgaccctggaaaggcctggctgccccttcacttcctaaagcaagcgtcactgccctatgcctcagtagtacccgttaaagacttaattgcagaggtggggtttactcaatccaaactgacacaaatcaggccaagctggggcctgtgtagccagcttctgaccatcagtttctgcccctccctctcccacccctgtcccttcccacagcctctgcaccacagcatgaaaatacccttcggcccataccaaagccaagctgttttccctagccgacagttgcaacccatggcttgcataagtaccctggccacaggggatttcttaacaacagatacccatgtctgggtcattttttaaagcttttatttggactcacagtcgtctctgtattttactttaaaaccgctgctttccctgtcttactggattgttctggttaccagtggctttgggtccacagtaataaagaacttaagaactgtcaaaaaaaaaaaaaaaaa

SEQ ID NO: 4026 - DNA, 1342 bp, Rattus norvegicus
  Genbank Accession No. NM_053651
ggacagcgggcaccatgcgggaaggctatccccgggggtgggcagtgccactctctgccacccacctggcgctgtgagaccggcgtcgccaccatgttccccagccctgcgctcacacacacgcccttctcagtcaaagacatcctgaacctggagcagcagcagcgcagcctggcggctggggacctgtctgcgcgcctcgaggccaccctggcgcccgcctcctgcatgctggccgccttcaagccggacggctactcaggccccgaggcggcagcgcccggcctggcagagctgcgcgcggagctgggccccgcgccttcgccccccaagtgctctcctgctttcccaaccgcccctacattttatccgcgagcctacggtgaccctgaccccgccaaggaccctcgggcggataagaaagagctgtgcgcgctgcagaaggcggtggagctggacaaagccgagacagacggcgccgagaggcgacgaccacggcggcgacggaagccacgcgtgctcttctcgcaggcgcaggtctatgagctggagcggcgcttcaagcaacagcggtacctgtcgcccgctgagcgcgaccaactggccagcgtgctgaagctcacgtccacgcaggtcaagatctggttccagaaccgccgctacaagtgtaagcgacagcggcaggaccagactctggagctgctggggccgccgccgccgcccgcgcgcaggatcgcggtgccggtgttggtgcgcgacgggaagccctgcctgggggactcggcggcctacgctcccgcctacggcctgggtctcaacgcctacggctacaacgcctacccctatcccggctacggtggcgcggcctgcagtcccgcctacagctgcgccgcgtaccccgccgcgccccccgccgcgcacgccccagccgccagcgccaacagcaacttcgtgaactttggcgtcggggacttgaacacggtgcagagtcccgggatgccacagggcaattcgggcgtctccacgctgcacggcatccgagcctggtagggaaagggcccgtctggggaaccccggaccgactcccacctttaggagaagggcgatgactccggggatggaaaggctcccactgtgtcctgtccctcggatttcacacccacacttgcgcaggcctgggacctttctccgatccatccccttttgttgacctaacctgatgcctcggtcctgggaaagcccttcagggccaaaggcaccctccacggattccatatcaggacccggagcctgggccgggcgcccgggccctgggtgccttgccggcgcccaccggccgggg

SEQ ID NO: 4027 - DNA, 1596 bp, Rattus norvegicus
  Genbank Accession No. NM_053653
gggactgggacgaggagcggacctcagcctcgcaccccagcctgcgcctgccatcggaccggcctcctcgctcccggtccatccaccatgcacttgctgtgcttcttgtctctggcgtgttccttgctcgccgctgcgctgatccccggtccgcgcgaggcgcccgccaccgtcgccgccttcgagtcgggactgggcttctcggaagcagagccggacgggggcgaggtcaagggtttcgaaggcaaagacctggaggagcagttgcggtctgtgtccagtgtagatgagctcatgtctgtcctgtacccagactactggaaaatgtacaagtgccagctaaggaaaggcggctggcagcagccctccctcaacatgaggacaggggacactgtaaaacttgctgctgcacattacaacactgagatcctgaaaagtattgataatgagtggagaaagactcaatgcatgccacgtgaggtgtgtatagatgtggggaaggagtttggagcagccacaaacaccttctttaaacctccatgtgtgtccgtctacagatgtgggggttgctgcaacagtgaagggctgcaatgcatgaacaccagcacaggttacctcagcaagacgttgtttgaaattacagtgcctctctctcaaggccccaaaccagtcacaatcagttttgccaatcacacttcctgccggtgcatgtctaaactggatgtttacagacaagttcattcaattattagacgttctctgccagcaacattaccacagtgtcaggcagctaacaagacttgtccagcaaactacgtgtggaataactacatgtgtcaatgcctggctcagcaggattttatcttttattcaaatgttgaggatgactcatccaatggattccatgatgtctgtggacccaacaaggagttggatgaagacacctgccagtgtgtctgcaagggggggcttcgaccatccagctgtggaccccacaaagagctagatagagactcatgccagtgtgtctgtaaaaacaaacttttccttaattcatgtggagccaacagggaatttgatgagaacacatgccagtgtgtctgcaagagaacatgtccaagaaatcaacccctgaatcctggaaaatgtgcctgtgaatgtacagaaaacacacagaagtgcttcctaaaagggaagaaattccaccatcaaacatgcagctgttacagacgaccatgtacaaatcgactgaagcattgtgatccgggactgtcatttagtgaagaggtgtgtcgctgtgtcccatcatattggaaaagaccacatctgaactaagatcataccagtttttcagtccatcattttgctgccttgaaaaactgttgccacattagaactgtcaatgcacagaaagactctgtgggaccatggtaacagggtccaagtctctgtctcctgaaccatgtggattactgtgggaatggactggcattcatgtgcataaagccttttaagagactggttttctgccagtgaccagacagctgaggtttttctcttgtgattttgaaaaaaaaaaaaaaaaaaaaaaaaaaa

SEQ ID NO: 4028 - DNA, 865 bp, Rattus norvegicus
  Genbank Accession No. NM_053654
ggagggaggggcgctaaattgtctctggtccctgtcggcttttcaggagctgcggtgctgaggatgagcggggaaggggagaacccggccagcaagcccacgcctgtgcaggacgtgcagggcgacggacgctggatgtctctgcaccatcgatttgtggcagacagcaaagacaaggaacccgaagtcgtctttatcggggactccttggttcagctaatgcatcagtgtgagatctggcgggagctcttctcacctctgcatgcacttaactttggcattggcggtgacagcacacagcatgtactctggcggcttgagaatggggagctggagcacatccggcccaagattgtggtggtctgggtgggcaccaacaaccacagccacacagcagaacaagtgacaggtggcatcaaagccattgtacaactggtgaacaagctgcagccccaggcccgggtggttgtgctgggcctgcttccaagaggccagcaccccaacccacttcgagagaaaaaccgacaggtgaacgagctggttcgggcagcactagctggctacccccgagcgcacttcttagatgcagaccctggctttgtgcactcggacggtaccataagtcaccatgacatgtatgactacctgcacctgagccgcctggggtacacacctgtctgccgggccctgcactccttgctgcttcgtctcctggcccaagatcagggccaaggcatccctctgccagagacagcaccctaagcatctttccttccttcccttgacaataaattctcctcttccacctaaaaaaaaaaaaaaaaaaaaaaaaaaaaaaaaaaaaataaaataaaaaaaaaaaaaa

SEQ ID NO: 4029 - DNA, 3845 bp, Rattus norvegicus
  Genbank Accession No. NM_053655
gtctgcagaggatggagcttacttattcagagttaaagatgtctccagcctgggaggctgagagtggaaattcaccggctcagcggttagtcaggagtgaatccctgcaggaaagccccgcctgcctaggctcagcaggtcactcattcgctgactcagtcgcttagcaaacacagtgttcaccacccacacgctaggccatgcatctagactgacatggcccctgccctactgaggggcagacactgcctccagggaggctcacttgctatgggcttgctttcttcccaagggctactgttcaaggaactcttgtgttgaccacaggctgaggcttccaacaacttctccaaattcacacagtagagaacaggccatgatgctctttcctgcagccagacccctgacatggggtgagagaacaggtgagcaggccagagtcagtgtccgggcccagcagctgccttttgggaagtcagttctgagtagacgggcctggttaaaatcctggcgatgccattttctggttgtgaccttgcacaggtcatcccctctctgagcacctgtttccctcctctataagtaagtggtgacaagactcagtttttcttccctaaggtgtccgaaaaggggagggccacagctcctcgtgccgaattcggcacgaggcgggctgcgggctgcgtccccattcattgcagtggtctgctgggttggggtccagtgtttccggagtcatggaggcgctgatcccggtcatcaataagctgcaggacgtcttcaacaccgtgggcgccgacatcatccagctgcctcagattgtcgtagtgggaactcagagcagtggaaagagctcagtgctggaaagcctagtggggagggaccttcttcccagagggactggtgtggtcacccggagacctcttattctgcagctggtccacgtttcaccagaagataaaagaaaaacaacaggagaagaaaatgaccctgctacatggaaaaactcaagacacctttctaaaggagttgaagcagaagaatggggtaaatttcttcacaccaaaaacaagctttacacagattttgatgaaattcgacaagaaattgaaaatgaaactgaaagaatttcaggaaataataagggagtaagccctgagccaatccatctcaaggttttctcgcccaacgttgtcaacctgacgcttgtggatttaccaggaatgaccaaagtacctgtaggtgatcagcccaaggatattgagcttcaaatcagagaacttattcttcggttcatcagtaatcccaattccattatccttgctgtcactgctgcaaatacagatatggcaacgtcagaggcacttaagatttccagagaggtagatccagatgggcgcagaactctagctgtaatcaccaagcttgatctcatggatgcgggtactgatgccatggatgtattgatgggaagggttattccagtcaagcttggaataattggagtagttaacaggagccaactggacattaacaataagaagagtgtaactgattcaatccgtgatgagtatgcttttcttcaaaagaagtacccatctctggccaacagaaatggaacaaagtatcttgctaggactctgaataggttacttatgcatcatatcagagactgtttaccagagctgaaaacaagaataaatgtcttagctgctcagtatcagtctcttctaaatagctatggtgagcccgtggatgataaaagtgctactttactccagctcattaccaagtttgccacagagtattgtaacactattgaaggaacggcaaagtacatcgaaacttctgagctatgtggtggtgctaggatttgttatattttccatgagacttttgggcgaaccttagaatctgttgatccactaggtggccttaacactattgacatcttgactgccattagaaatgctactggcccccgtccagctttatttgtgcctgaagtttcatttgagttactggtcaaacgtcagattaagcgtctagaggagcccagcctccgctgtgtggagctggtccacgaggaaatgcagaggatcattcagcactgtagcaactacagcacacaggaactgttacggttccctaaactccatgatgccatagttgaagtagtgacttgtcttcttcgtaaaaggttgcccgtgacaaatgaaatggtacataacttagtggcaattgagctagcatatatcaacacaaaacaccccgactttgctgatgcctgtgggctaatgaacaataacatagaggaacaaagaagaaacagactagcaagagaactaccttcagctgtatcgcgagacaagtcttctaaagttccaagtgctttggcacctgcctcccaggagccctcccctgccgcttctgccgaggctgatggcaagttaattcaggacaacagaagagaaactaaaaatgttgcatctgcaggtggtggaattggagatggtggtcgaattggagatggtggtcaggaaccgacaacaggcaactggagaggaatgctgaaaacttcaaaagctgaagaattacttgctgaagaaaaatcaaaaccaattccaattatgccagcaagtccacaaaaaggccatgctgtcaatttgctagatgtgccagttccagttgcacgaaaactgtctgcccgagaacagcgagattgtgaggttattgaaagactcatcaaatcatattttctaattgtcagaaagaatattcaagacagcgtcccaaaggcagtaatgcattttttggttaatcatgtgaaagatactcttcagagtgaattagtagggcagctgtataagtcatccttattagatgaccttctgactgaatccgaggacatggcacagcgaagaaaagaagcggctgacatgctgaaggcattacaaggagccagtcaaattattgctgaaatccgagagactcatctttggtgaacagaactgtttggtcttctacactttgctgacttgaacctactagctactgcctacctgagtagaagtttatttatggacttttgtgtatcgcagtgtatgaatttgcttgtgtgaagactggctataagctgaaaagtatattattcattacaagacaaatcacatgtttaattcacatttttcaagtttcctatgatgtatatcaagtctgtccgtttcagtcaaacttacaagaacaattgatgttctagttgtacaaagcagtttgcctgtgcatatgatgacccgcgtaacctttttttagtcttaaagctgcagccgtagtcctcaaagaggaagctccaggacatttcatgactataatgcatgcactatttatatagactgacctggcttcaaaaggtggagcctggcgagttcctcacataatcaatgtatccacctatccttcatttttatagtcttaaaaaacaaacaaaattctgtaacttctgcagttttaggaaaaatataagatctgaaagactcataaagatgtaggaacagactgtgtaattaatggctcctgagtctatactgccctaatgttagaaagtaaaatatgctttgattcaaaataagcctgaaaatataaattgacttcctgcattaaaaataactattaggaactttcttagtaacaataactggtcctgttagtttctaaatgactcagtgacaacctaaatttccctaatttacaagtacatcgattgcagtccagatgcaccttagggtggggcgctgactctggggctccgagactcagttatgtgagacctaaaagtctactctgtt

SEQ ID NO: 4030 - DNA, 1831 bp, Rattus norvegicus
  Genbank Accession No. NM_053656
gccgctgcacagccccggcttcccgcgggggcggccatggtccggcgcttggcccggggctgctggtccgcgttctgggactacgagacgcctaaggtgatcgtggtgcggaatcggcgcctgggattcgtgcaccgcatggtgcagcttctcatcctgctttacttcgtgtggtacgtcttcatcgtgcagaaaagctaccaggacagcgagaccggaccggagagctccatcatcaccaaagtcaaggggatcaccatgtcggaagacaaagtgtgggacgtggaggaatacgtaaagcccccggaggggggcagtgtagtcagcatcatcaccaggatcgaggttaccccttcccagaccttgggaacatgcccagagagcatgagggttcacagctctacctgccattcagacgacgactgtattgccggacagctggacatgcaaggcaatgggattcgcacagggcactgtgtaccctattaccatggggactccaagacctgcgaggtgtcagcctggtgcccggtggaggatggaacttctgacaaccattttctgggtaaaatggccccaaatttcaccatcctcatcaagaacagcatccactaccccaagttcaagttctcaaagggcaacattgcaagccagaagagtgactacctcaagcattgcacatttgatcaggactctgacccatactgtcccatcttcaggctgggtttcattgttgagaaggcaggagagaacttcacagaactggcacacaagggcggtgtcattggagtcatcatcaactggaactgtgacctggacttgtctgaatcagagtgcaaccccaaatattctttccggaggctcgaccccaagtatgaccctgcctcctcaggctacaacttcaggtttgccaagtattacaagataaacggcactaccaccactcgaactctcatcaaagcctatgggattcgaatcgatgttatcgtgcatggacaggcagggaaattcagtctcattcccaccatcatcaatctggccactgctctgacctccatcggggtgggctccttcctgtgtgactggattttgttaacgttcatgaacaaaaacaagctctacagccataagaagttcgacaaggtgcgtactccaaagcatccctcaagtagatggcctgtgacccttgcccttgtcttgggccagatccctcccccacctagtcactactcccaggatcagccacccagccctccatcaggtgaaggaccaactttgggagaaggggcagagctaccactggctgtccagtctcctcggccttgctccatctctgctctgactgagcaggtggtggacacacttggccagcatatgggacaaagacctcctgtccctgagccttcccaacaggactccacatccacggaccccaaaggtttggcccaactttgatctcatcctcactaaactacagacctggacctgggaaggcagagacagctttggctgctaaggcagtcctagagaagatctgcgctcttcagtaaccatgtccatgtgactgggaaacagaaacctgtgcaagaggacaggcgtcttgctttagcccaagcttacattcttcctctccctaaggcctctggggagaagtgggttccctgccatctcctttcccaacagaactcctcataggacctttccctgctcacctcttgtactctcatacagtattcagggaccccaagttaggggctatgctcctgttgtataatttcaagcccccctttagaagttgcagcatgctgagttcaataaaccagtgatgagc

SEQ ID NO: 4031 - DNA, 2092 bp, Rattus norvegicus
  Genbank Accession No. NM_053662
agtctcgctttgggttccggctgcgtcgggcgtgcgtgtagctcgctagaactatggcgtccgggcctcacccgacatcgaccgctgccgccgcctctgcctcgtccgccgccccgagtgcgggcggctccagctccggcacgacgaccacgacgacgacgacgaccggagggatcctgattggcgaccgcctgtactcggaggtgtcgcttaccatcgaccactcggtgattccggaggagcggctctcgcctaccccgtccatgcaggacggcctcgacctgcccagcgagacggacctgcgcatcttaggctgcgagctcatccaggccgccggcattctcctccggctgccgcaggtggcgatggctacggggcaggtgttgtttcatcgttttttctactccaagtctttcgtcaaacacagtttcgagattgttgccatggcctgtattaatcttgcatcaaaaattgaagaagcaccaagaagaataagagatgtgattaatgtattccaccacctccgccagttaagaggaaaaaggactccaagccccctgatccttgatcagaactacattaacaccaaaaatcaagttatcaaggcagagaggagggtgctaaaggagttgggattttgtgttcatgtcaagcatccccataagatcattgtaatgtatttacaagtcttagaatgtgaacgtaaccaaaccctggttcagactgcctggaattatatgaatgacagtcttcgaaccaatgtttttgttcgctttcaaccagagactatagcatgtgcttgtatctaccttgcagctagagcacttcaaattccattgccaactcggccccattggtttcttctttttggtaccacagaagaggagattcaagaaatctgcatagagacacttagactttataccaggaaaaagcctaactatgaattgctggaaaaggaagtagaaaaaagaaaagtagccttacaggaagccaagttaaaggcaaagggattgaatcttgatggaactccagccctttccactttaggtggtttttctccagcctccaaaccatcatcaccaagagaagtaaaagctgaagagaaatcaccagtttccattaatgtgaagacagtcaaaaaagaacctgaggatagacaacaagcttccaaaagcccttataatggtgtaagaaaagacagcaagagaagcagaaacagcagaagtgccagtagatcaaggtcaagaaccaggtcacgctctagatcacacaccccaagaagacattataataataggcgaagtcgatctggaacatacagctcaagatcaagaagcaggtctcgcagtcacagtgaaagtcctcgaagacatcataatcatggttctcctcaccttaaggccaaacataccagagaagatttaaaaagctcaaatagacatggtcataaaaggaaaaaatctcggtctcgatctcagagcaagactcgggatcactcagatgttaccaagaaacacaggcatgaaagggggcatcacagagacaggcgtgaaagatctcgctcctttgagaggtcccataaaggcaagcaccacggtggaagtcgctcaggacatggcaggcataggcgctgactttcatcctctgacactgcatcggtccctggtgttgcccatatgcagtgtgacgatgtatggactcaatcaaaacatgaaaagcaaactgattagggattgatttattaaaattgtctaggtttctagaaacactgaggacattttcttttgaaaagaactatgttaaggttttttgcacattaaaatgccctagcagtatctaattgaaaaccatggtcaggttcaattgtactttattatagttgtgtattgtttattgctataagaactggagcgtaaattctgtaaaaatgtatcttatttttatacagataaaacttgcagacactgttctatttaagtggttatttgtttaaatgatggtgaatactttcttaacactggtttgtccgcatgtgtaaagatttttacaaggaaataaaatacaaatcttgtttttctaaaaaaaaaaa

SEQ ID NO: 4032 - DNA, 2621 bp, Rattus norvegicus
  Genbank Accession No. NM_053665
atggcaatccagttccgctcactcttccccttggccttgcctggaatgctagcactccttggctggtggtggtttttctctcgtaaaaaagatcggctcagcagcaatggcaagcaggtggggacattgaaggttggccctgccatcgaggaccgactgcccactgaagaggcctgtcctggagtcctgtctgtgacccccagtgtcacacagcctcctggaaaggaagagcagcgctctatggacaggcctctttcagatcccccagccttgccaaggacccgtcaagttcgccgaagatcagagtcctcaggcaacctccccagcattgtagacacaaggttgcaggcaggacagtgcagcgatgagaattcaaaagtggtactctccctgatgggggacgaagccaaatctattcctcttggacgtccgcttttcccaaaggatctgtccttcccctatgaagcagtggaagggtgtaagcaagagtctgccctgggcagaactcctgggagaggctggctaagccagtgtgcagcctctggagagaacgcgagagagacgggtggggcggaagggactggagatgctgtgttgggggaaagtgtacttgaggaaggcctattgccccaggagtgtgtttcagaagtagagaagagtgagtttccgatcctagctcccgggggaggcgggggagagaaggtgagaagtggcccaccacaggtagatgagcttttaaagaaggaagaatatattgttgggaagttgccaagtagctttgtggggccagttcactcggagctggttaaggatgagggtgcgctggtaccccaagtcaaaggtagccaggacagaagcctggctagagaactggacaaagacaagaccttgcctgaaaaggaccagattgagcagactgccttccagatcatctcccaggtgatcttggaagcgactgaagagatacgggccaccacagtgggcaagactgtggcacaagtgcatccaaccccgggcactcagcctcaggggcaggaggagagctgtgtcccagccagccaggaaactagcttgggacaagaaatcccagatcctgcttccaccagaacaggtgccactgccagcccttcagcaggagccccaccaccaaagacctatgtgagctgtctcagcagtcctctgtcaggccccaccaaggaccagaagccaaagaactctgcacaccacatctccctggctccctgcccaccgccagttaccccccagaggcagtctctggatggggcaagtaacccgagaggtgatgacacctttgtcacctgtacgtccaacaacagccagagtgtcctttcagttacctccttggggctgtgctcagaccctgtcagtacttcgaggcttgaagactcttgcacagagaccatctcaagctccggagacaaagctgtcaccccaccactgccagacagtactgagcccttcagcaatggggtgctgaaggaggagttgtcagacttggggaccgaggatggatggaccatggatacagaagcagatcattcaggaggttctgacgggaacagtatggattcagtggatagctgttgtgggcttacgaaacctgatagcccccagactgtccaggcaggctccaaccctaagaaggttgacctcatcatctgggagatcgaggtgccaaagcatttagttggtcgactgattggcaagcagggacggtacgtgagttttctgaagcagacgtctggtgccaagatctacatctccaccctgccttacacacagaacatccagatctgccacatagaaggctctcagcatcatgtggacaaagctctgaacttgattgggaagaagtttaaggagctgaacctcaccaatatctatgcaccaccgctgccttctctggcactgccttccctgccgatgacatcgtggctcatgctgcctgatggtatcactgtggaagtcatcgtggtcaaccaggtcaatgctgggcacctatttgtacagcaacacacacaccccaccttccacgcactgcgcagcctggaccagcagatgtacctctgttactctcagcctggaatccccaccttgcccaccccagtggaaataacggttatctgcgctgcccctggtgcggacggggcctggtggcgagcccaagtagtggcctcctatgaggagaccaatgaggtggagattcgctacgtggactatggtggatataagagggtgaaagtcgacgtgctccggcaaattaggtctgactttgtgaccctgccattccaaggagcagaagtccttctggacagtgtggttccgctgtcagatgatgatcacttttcacccgaggcagacgcagccatgagtgagatgacaggcaatacagcactgctggcccaggtgacaagctacagtgcgactggccttcctctgattcagctatggagtgtggttggagatgaagtggtgttgataaaccggtcgctggtggagcggggcctggcacagtgggtagacagctgctatgccagcctttgaccgtggctcctgggctgcttcggtcttctttgcactgttgagagtgggtctagaac

SEQ ID NO: 4033 - DNA, 1408 bp, Rattus norvegicus
  Genbank Accession No. NM_053670
gaggcagaggcaacatggaagtgaaggatgcgaacgctgccctgctcagtaactacgaggtgttccagttactgacagacctcaaagagcagcggaaggagagcgggaagaacaagcatagcgccgggcagcagaacttgaacgccatcacctacgagacattaaaatacatatcgaaaactccatgtaagaaccagagtccggcgattgtccaagaattcctcacagcaatgaagagccacaagctgaccaaagccgagaagcttcagctgctgaatcacaggccaatgaccgctgttgagatccagctgatggtggaagagagtgaagagcggctcacggaggagcagattgaagctctcctgcacactgtcaccagcatcctgcctgcaggtccagaggatgagcagagcaaaagcactagcaatgacgcggcaatggaagaggaggagcctgcatagacatctgtggccattatgacacagctggccaggttgttcgtgatgctcaaagccacaacagccatttcctggacgttcagagaactgtttattcggcctgacccctctctcaaatattcctgatctcaggattggttgagaaaaaaaatcacaaaaataagatgaaaagaaatctttgtgccttgggttcaagaaacatggggtcagagaagggcagagggctcgagatggggcagcatggctatgcagccctctgggtagaaaggcttgtgtggcctctgtcgcacttgtacacagtggggagctattcaggcactttgatgactgtgttgtaggcaatgtcaggcaccgccatagaatggagctggggaacgacctcagacggtctcgagctcccagagctgcacacagctgctccaggggaaatgacccagggcttagctcacggtagaggaatgtcctcggcagagcaggaggcaaggaaaggagataagaggaaactgcagtctgagcccagcctggtgtacataataaggaacacacatgtgaatatacctaacacacatgcgtgccacacacacacatacaaagaaattagtcccttttctgtggcaaacccacaactctctggcctgggtgagagacaaggaaaaggcttattttgactcctggttctggtccaaggtcaaagggcatctgggtatggccctcttgttgccagagtgctcaggtagcattggctaacacattacaaaacatgagaagcgtttgtttgtcttcagagtctcttgtagcccacattgaccaaagttcattctgtctgaaatcgtcagacactttctgattctttggcctcagtctccttaaagctgggattcaaatatataccactcacttaggaggcagaggccagcctggtcacacagcaagttccatgccagccagcg

SEQ ID NO: 4034 - DNA, 2741 bp, Rattus norvegicus
  Genbank Accession No. NM_053671
atgagctggttcaatgcctcgcagttgtccagcttcgccaagcaggccctgtcccaggcccagaagtccatcgacagggtcctggacatccaggaggaagagccgagcgcctgggccgaggccatcccgtacggtgagccaggaataagtccctctgtgagtggaggatgggatacttcaacctggggattgaactcaagctctgaacctcagagttcaccaacagcctctcaagcaattacaaagccagttcggaggactgtagtagatgaatctgaaaatttcttcagtgcctttctctctccatcggatgtgcagaccattcagaagagtccagtggtctcaaagcctcctgctaaatcacagcgaccagaagaagaagtgaaaagcagtttacaagaaccatcgtctcctggccagtccagaacctctgagacagcagagtctgaagcgacagactctgcctgtgtttcgggagagactccagccgtgggcactccctcacctgtccctgaaggcaagcgtgaagaaactgctagtgaagagtctgaggggaaggtgcccaccgtgagagcgaaggcgtctgaaagcgtagttaaggtaaacacagcagaagatgtatctcccacatccactcagtctcttacgaccgaaacgaaggatatggctttggagcctaaagaacaaaaacacgaagacagacaaagcaacacaccttctcctcctgttagctccttctcgtcaggcacttccaccaccagtgacattgaagttttagatcatgaaagtgtaataagtgagagctcagctggttcaaggcaagagacttcagatgcaaagtcaagtcttcacctcatgcagacttcatttcagcttctctctgcatctgcttgtcctgagtatggccgcttagatgacttccaaaagctcagtgagagttgctgctcttcggatgcttttgagagaatagactcgtttagcgtgcagtctctggatagccggagtgtgagtgaaatcaactcggacgacgaactgccgggtagaggctatgctttagtacctatagtcgtgagtccttcagccccgaagacaaaagtagtagaatctactgaggaaaacgttgaagaagaggaagggaaacgagacttaattgcaccttctgaggaaacagaattagaggaaagtggccgaagtgctactccagttaactgtgaccagccagatacattggcttctcctacaccagtaaatgttgggccctctgcctctggaccggccgctgaggatggtgaagctgctgaaaaccacccaaaagcaccacagctggagcaagaagatgttggcaagacagttgaatttctgaatgagaagctagaaaagagggagactcaattattgtcacttagtaaggaaaaggcacttctagaggaagcttatgataacctgaaggatgaaatgttcagagtaaaagaagaaagtagtagcatttcttccctgaaagatgagtttacccagaggaccgcagaagcagaaaggaaagctcaactcgcctgcaaagagagagacactgcgaagaaggaaatgaaaaccatgaaggaagaacttgcctctagattaaatagtagtcagactgcagaccttctgaaggaaaaggatgaacagattcaaggcttaatggaagaaggagaaaaactttcgaagcagcagctgcataattccaacatgattaagaaattaagagctaaggataaagacaatgaaagtgttattgcaaagctgaagaaaaaagctaaggagctggaagaggagctacagcatttaagacaggtccttgatggcaaagaagaggttgagaaacaacatagagaaaacattaaaaaactaaattctgtagtagaacgccaggaaaaagatcttggccgacttcaggtagacatgaatgaacttgaagaaaagagccgaagtactcaggctgccctagacagtgcctacagagaacttactgatcttcacaaagccaacgctgctaaggacagtgaggtacaagaagctgctctgaggcgtgagatgaaagctaaagaagaactttctggggcactggagaaggcccaggaagaagcccgtcagcagcaagagattttagcgcttcaggttggggaccttaggcttgcgctgcaacgggcagagcaagcagctgccaggaaagaggattacttacgccatgagatcagtgaacttcagcagagactccaagaagcagagaatcgaaaccaggagctgagtcaaagtgtttcatcaacaacaagacctttgcttcgacagatagaaaatttacaagcaactctaggatcccagacatcgtcatgggagatgctagagaagaatctttctgatcggctcgatctggcaactgaacgcagggccttgcgcttgctaggcaagctctaccactgagctaaatccccagcccccacacataggattttaaaaagttagaaacatttcattagtgcagtcctttgatttttgagtgttagcctgggtgtctgttctgtagttgagtccccacttaattggggaaggatgtttcgtgtggttccagagtgagagtttggggaatgaagctgctgtaagtatcctttcaggaggagggaatgtggggtaaagactttcacagttttgaataaaggaccaaatatgcaactaaaaaaaaaaaaaaaaaaaaaaaaaaaaaaaaaaaa

SEQ ID NO: 4035 - DNA, 1198 bp, Rattus norvegicus
  Genbank Accession No. NM_053674
ggcccccaccatggactatacgcgcgctggtgcccggctgcaggtccttctgggacaccttggccgaccctcggcccttcagattgtagcccaccccgtatcagggccggcttcccctgccaatttctgtcctgaacaattccagtatactttggacaataatgtcctcagcctggagcagagaaaattttatgaagaaaacgggtttctcgtcattaaaaatctggtatcggatgatgatattcaacggtttcgagcagagtttgaaagaatctgcagaaaggaggtgaaaccaccagggatgactgtaatgaaagacgtggccattgcgaagcagggttatgcgccaagtgagagggtggttacgaagatccaggatttccaacaaaatgaggagctcttcagatactgtgccctgccccagattgtgaaatacgtggagtgcttcactggacccaatattatggctatgcacacaatgctgatcaacaagcctccggattctggcaagaagacatcccggcatcccttgcatcaggatctgcactttttccccttccgacccagcaacctaattgtttgtgcttggacagccatggagcacatcgacaggaacaatggctgtcttgttgtgctccctggtacccacaaaggtcccctgaagccacatgattaccccaagtgggagggaggagttaacaaaatgtaccatggcatccaagactatgacccggacagcccccgcgtccacttggtgatggaaaagggcgacacagttttcttccatcccctgctcatccatggatctggtcggaacagaactcaaggattcaggaaagcaatctcctgccactatggcagctccgactgcaaatatatcagcgtgaagggcaccagtcaagaaaacattgcgagggaagttattgagattgcggagaaacgttatggagtccaaggagccctggactttgaggacacttggaagtttcgatgccgacttgtgaaaggagaaagaataaacctttgaaagagcccttcaggtggagaggtggctcagcggttaagagcactgattgctcttccggagtcctgagttcaaatcccagcaaccacatgatggctcacaaccatctgtaatgggatctggtgccctcttctggtgtgtctgaagatagctacagtgtactcatataaataa

SEQ ID NO: 4036 - DNA, 1155 bp, Rattus norvegicus
  Genbank Accession No. NM_053698
cacgagggttggcagctgcctggcggtcctgaggagcggctagggcagcggagggaaagaaaagggaacggctcggaatttgctccagcggctgctgcaagacctcggcgccaacctcgcaccagcgagcgccccacagcccttcggctgcccctctatgtgctgctgagccggtcctggacccgacgagcccgccttcggtgttccgagccgaaatcgcaaagacggaaggactggaaatggcagaccatatgatggccatgaaccacggtcgcttccccgacggcaccaacgggctgcaccaccaccctgcccaccgcatgggcatggggcagttcccgagcccgcatcaccaccagcagcagcagccccagcacgccttcaacgccctcatgggcgagcacatacactacggcgcgggcaacatgaatgccacgagcggcatcaggcacgccatggggccggggactgtgaacggggggcaccccccgagcgctctggccccggccgccaggtttaacaactcccagttcatgggtccccctgtggccagccagggaggctccctgccggccagcatgcagctgcagaagctcaacaaccagtatttcaaccatcacccctacccccacaaccactacatgccggatttgcaccccgctgcaggccaccagatgaacgggacaaaccagcacttccgagattgcaaccccaagcacagtggaggcagcagcacccctggcggcgcgggtggcagcggcacccccggcggctccggcggcacctcgggcggcgcgggtggcagcagcgcgggcggcagtggcggtggcagcaccatgcccgcctcggtggctcacgtccccgcggcaatgctgccgcccaatgtcatagacactgatttcatcgacgaggaagtgcttatgtccttagtgatagagatgggtttggaccgcatcaaggagctgccagaactctggctgggccaaaatgagtttgattttatgacggacttcgtgtgcaaacagcagcccagcagagtcagctgttgactcggttaacctcgcggctgaaagaaatcaccctccctgcccccacccccaacttcttcggtgtgaattaaaaaaaatcaaaaacaaacaaaaaaaaaacaaaaaa

SEQ ID NO: 4037 - DNA, 2393 bp, Rattus norvegicus
  Genbank Accession No. NM_053713
atcttcgttgacttcggggtttgggtacccctctctcttcttcggactccggaggaccttctgggcccccacattaatgaggcagccacctggcgagtctgacatggctgtcagcgacgctctgctcccgtccttctccacgttcgcgtccggcccggcgggaagggagaagacactgcgtccagcaggtgccccgactaaccgttggcgagaggaactctctcacatgaagcgacttcccccacttcccggccgcccctacgacctggcggcgacggtggccacagacctggaaagtggtggagctggtgcagcttgcagcagtaacaacccggccctaccccggagggagaccgaggagttcaacgatctcctggacctagactttatcctttccaactcgctatcccaccaggaatcggtggccgccaccgtgaccacctcggcgtcagcttcatcctcgtcttccccagctagcagcggccctgccagcgcgccctccacctgcagcttcagctatccgatccgggccgggggtgacccgggcgtggctgcgggcaacacaggtggagggctcctctacagccgagaatctgcgccacctcccacggcccccttcaacctggcggacatcaatgacgtgagcccctcgggcggcttcgtggctgagctcctgcggccggagttggacccagtatacattccgccacagcagcctcagccgccaggtggcgggctgatgggcaagtttgtgctgaaggcgtctctgagcacccctggcagcgagtacaccagcccttcggtcatcagtgttagcaaaggaagcccagacggcagccaccctgtggtagtggcgccctacagcggtggcccgccgcgtatgtgccccaagattaagcaagaggccgtcccgtcctgcacggtcagccggtccctagaggcccacttgagcgctggaccccagctcagcaacggccacaggcccaacacacacgacttccccctggggcggcagctccccaccaggactacccctacactgagtcccgaggaactgctgaacagcagggactgtcaccctggcctgcctcttcccccaggattccatccccatccggggcccagctaccctcctttcctgccagaccagatgcagtcgcaagtcccctctctccattatcaagagctcatgccaccgggatcctgcctgccagaggagcccaagccaaagaggggaagaaggtcttggccccggaaaagaacagccacccacacttgtgactatgcaggctgtggcaaaacctatacgaagagttctcatctcaaggcacacctgcgaactcacacaggcgagaaaccttaccactgtgactgggacggctgtgggtggaaattcgcccgctcagatgaactgaccaggcactaccgcaaacacaccgggcaccggccctttcagtgccagaagtgcgacagggccttttccaggtcggaccaccttgccttacacatgaagaggcacttttaaattccacatcgtggacatgacccacactgccaggagagagttcagtatttttttttaacctttcacactgtcttcccacgaggggaggagcccagctggcaagcgctacaatcatggtcaagttcccagcaagtcagcttgtgaatggataatcaggagaaaggaagagtccaagggacaaaagaaaagaaaagaaaaaaatactaaaaaacaaacaaacaaaaaaaaaaaacaaaagaaaaaaatcacagaacagatggggtctgagactggatcttctatcattccaataccaaatccgacttgaacaagactggacttacaaaatgccaaggggtgactggaagtttgtggatatcagggtatacattaaatcagtgacctggggggagggaagaccagagttcccttgaattgtgcttcaatgatgcaatatacatggaaagaccaccttgtatgctctttgccttctaaaaagccattatgacgtcagaggaagaggaagcaattcaggtacagaacgtgttctaatagcctaaacgatggtgcttggtgagtcgtggttctaaaggtaccaaacgggggagccaaagttctccaactgctgcatactttgacaaggaaaatctatttttgtcttccgatctacatttatgacctaagtcaggtaaataagcctggtttatttctgtaacattttttatgcagacagtctgttatgcactgtggtttcagatgtgcaataatttgtacaatggtttattcccaagtatgcctttaagcagaacaaatgtgtttttctatatagttccttgccttaataaatatgtaatataaatttaaaaaaaaaaaaaaaaaaaaaaaaaaa

SEQ ID NO: 4038 - DNA, 2680 bp, Rattus norvegicus
  Genbank Accession No. NM_053742
gcagctgtgagggcttcccggaagatggtgctgattaaggaattccgtgtagttttgccgtgttctgttcaagagtatcaggttggacagctttactctgttgcagaagcgagtaagaatgaaactggtggtggagaaggaatcgaagtcttgaagaatgaaccttatgaaaatgatggcgagaagggacagtacacacacaaaatctaccacctgaagagcaaagtccctgcgttcgtgaggatgattgctcccgagggctccttggtgttccatgagaaagcctggaatgcttacccctactgcagaacaattgtaacgaatgagtacatgaaagatgacttcttcatcaaaatcgaaacatggcacaaacctgacttgggaacattagaaaatgttcacggtttagatccaaacacgtggaaaaccgttgaaattgtccacatagacattgcagatcgaagtcaggttgaaccagcagactacaaagctgatgaggaccctgcgttattccagtcagtcaagaccaagagaggccccctgggacctaactggaagaaggagctggcaaacacccctgactgtcctaagatgtgtgcctataagctggtgaccatcaagttcaagtggtgggggctgcagagcaaagtagagaacttcatccagaagcaagaaaaacggatatttacaaacttacatcgccagctcttttgttggattgacaagtggattgacctgacaatggaagacattaggagaatggaggacgagactcagaaagaactagaaacaatgcgtaagaagggttccgtccgaggcacgtcggctgctgatgcctagatgagcccctgtaggtcagagacattatcaaactgtctacggagtcaaggccaagtgagggggaccagtgcggcctgcgacgactaaagccaccagcgtctcagtgttgacggatgtttccagtgtgtgcctctgacggctcgggcacacttgtgcacactcgagggcacacacacacccatgcacacacactcacactgtatgtatgtctgtagctgtatgtaaagcacatatggctacaggcctagatacacacgagtgtatatatatatgtacatgtgaagatggatcagtaccttttctccaaagtactgcacctgtcttcagcagaaatactaaagaaaatattttcaatatatatacctggaacagatattaatacccatcaacatgatgccctggatggacaaacggactgccatgtggtgccctgtggtgctggctggcgtgcttcgtgaatgccaggtgtggaccagtgtgtacagcctttggttaggtttctgtttttttcaagtcaccacacacacacacacgtttagtctcaacccatcagcaacaactcctacagaaagattttttcaaatttttagatactccagtgactctggaatgtaaactctggatgtatttataactatttatttctgggtggccactatcttccagccaaatccaacaatatctgtcaagtaaggagtgaaagctctttattggtttgcccgagggttggggatatccttttttttaaaaaattgccactttttattggatttttgtattttgaatttcaagtatttttctatatcaaatctagcaaaaaacggtgatgacggtttgtgatttataataaacactgacaatattcagattctggctaagcaaacagggtgatcaggcaattaacctgagtggcactggaggctgtgcagagccattctgtggagttttgtttctgaaatggcttttctggaattacggcctggagactggatggtctgtattgctctcagttcacagggtaggagagtggtcccgcccggctgtttccagttacagtccaagctaggaggaaatgctgatgggagcaggcacagcttgagcatgacacaggcctgtccccgtcctgaggcccagctagacctgggccttgccgacagctctgcttcctcctcctgtatctcctcctcctcccccttcctcttctgtctctactttctcctttttttttaagagaaaggagcagtagctgggaaggattttcttttttttacctttccgtctgatgctattctcctctcgtcagtcctggaaccctgaccagcatcacactgttgaatccttcaggttacacactgccttttaacctccaccctgcagtcagagcacggtggtgacacccctttgttgacaggcttgaccttcatgtcccttctgccctgccctgtgtcccatgggggaaatggcagagagtcccactgcatcacactgccctgttagcctcagcaacaagccctgggttccatgtcctctaagctctagataaaggtggttattccctgggcactgctggaagctgggaaggtcaccaccagaagggtcattgccagccttgtctcctccagtgaaaccagatcacagacatccatagtttctctgagagctggggcacacaaggaaaccagagcccagtatggattcttgtgttgctctagcagctgtggagattgagggatgtggtgaatgcaaagaacccagtttacttggcagtctcctgtgtaaatcacagtaaaacaaagtgaaatcgaaacaagaataaatttgatctcaaaatgaaaaaaaa

SEQ ID NO: 4039 - DNA, 1604 bp, Rattus norvegicus
  Genbank Accession No. NM_053743
cgagcggactctctagcccttgtgggtccctgttcagcgcccggccgtgtggagacccgggagccagtccgggcctccgaggcgaagatggtggactacagcgtttgggatcacatcgaggtgtcggacgatgaggacgagacgcaccccaacatagacacggccagcctgttccgctggcggcaccaggcccgggtggaacgcatggaacagtttcagaaggagaaagaagaactggaccggggctgccgggaatgcaagcgcaaggtagccgagttccagcgcaagctgaaggaactggaagtggctgagggtggtggccaggtggagcttgagcggcttcgagcggaggcacagcagctgcgcaaggaggagcgaactgggagcagaagctggaggacatgcggcaaaaaggagaagaacatgccctggaatgtggacacactcagcaaagatggcttcagcaagagcatggtcaataccaagcctgagaaggcagaggaagactcagaggaggcaagggagcagaaacacaagaccttcgttgaaaaatacgagaaacagatcaaacatttcggcatgctccaccgctgggatgacagccagaagtacctgtcagacaatgtccacctggtgtgcgaggagacagccaactacctggttatctggtgcattgacctggaagtcgaggagaagtgtgccctgatggagcaggtggctcaccagaccatggtcatgcagttcatcctggagttggccaagagtctgaaggtcgacccccgggcctgcttccggcagtttttcaccaagatcaagactgctgaccagcagtacatggagggcttcaagtatgaactggaggcctttaaggagcgtgtgcggggccgcgccaagctgcgaatagagaaggccatgaaggagtacgaggaggaggagcgcaagaagaggctaggccctggtggcctggaccctgtggaggtctacgaatctctgcctgaggagctgcagaagtgctttgatgtgaaggatgtacagatgctgcaagacgccatcagcaagatggatcctactgatgccaagtatcacatgcagcgttgcatcgattctggcctctgggtccccaactccaagtctggtgaggccaaggagggggaggaggcgggccccggggacccattgctggaagccgtccccaaagcgggcttcgagaaagacatcagtgcgtgacccttctccagaaaaggaaacccagccaccatgtccctagctcccgacttcttcacttctgctgctcctcacgtcctggcccatggcctgccccatgtcccctctcctccggcctgtccccagcactcatcagattctctgcttcgggttgaggggctctgctgtctgcagcccccccacccccatcagcgttatgccaaagtcctgggggtctggggaggggcagcagctgccaggttggtccaccgggttggggatacacatgtccccatctgggcagggtctgtccctatgggtctatggtcactgtttctcttctgtctagctttctgtcctgcaactggcaacaatgtccaataaacagttccaggtgctgg

SEQ ID NO: 4040 - DNA, 1538 bp, Rattus norvegicus
  Genbank Accession No. NM_053744
cccggtgcaaccctggctttctttccgctggacacccgtgcccccttcgtggtccgcaaccagaagcccagcgcagccccggagcagcccctgcaccgccaccgctacccggaccacgacccaggccgccccgagatgatcgcgaccggagccctcctgcgcgtcctcttgctcctgctggctttcggccacagcacctatggggctgagtgcgacccggcctgtgaccctcagcatggattctgtgaggctgacaatgtctgcaggtgtgagcctggctgggagggccccctgtgtgagaagtgcgtaacctcccctggctgtgttaatggactctgtgaagaaccatggcagtgtgtctgcaaggaaggctgggacgggaaattctgcgaaatagatattcgggcttgcacctctaccccctgcgccaacaatgggacttgcgtggacctcgagaaaggccagtacgaatgctcctgcacccctggattctctggaaaggactgtcagcacaaggctgggccctgcgtgatcaatggttctccctgccagcacggaggcgcctgcgtggatgatgagggccgggcctcgcatgcttcctgcctgtgcccccctggcttctcgggcaacttctgtgagatcgtgaccaacagctgtacccctaacccatgcgagaacgatggcgtctgcaccgacatcgggggcgacttccgttgccgctgcccagctggattcgtcgacaagacctgcagccgtccggtgagcaactgcgccagtggcccgtgcctgaacgggggcacctgcctccagcacacccaggtgagcttcgagtgtctgtgcaagcccccgttcatgggtcccacatgcgcgaagaagcgcgggaccagccccgtgcaggtcacccacctacccagcggctacgggctcacctaccgcctgacccccggggtgcacgagctacctgtccagcagcccgagcaccacatcctgaaggtgtccatgaaagagctcaacaagagtgcccctctcctcaccgagggacaggccatctgcttcaccatcctgggcgtgctcaccagcctggttgtgctgggcaccgtggccatcgtctttctcaacaagtgcgaggcctgggtgtccaacctgcgctacaaccacatgcttcgcaagaagaagaacctgctgttgcagtacaacagcggcgaggagctggcggtcaatatcatcttcccggagaagatcgacatgaccaccttcaacaaggaggctggtgatgaggatatctaagcagcgtgtcccctccccctcccccaggcccttctacattatcggggttcctcacagctccctctatgcgctctatgcttctttgtggtggagttcgctcttgtgtggaatctagtgaacgctacgcttacatttattttctcgtgttgctgtgtgacaagctgccgctaagaacccctccctccctccctccctccctccctattaatgcatgatataatgaataataataagaatttcatctctaaatg

SEQ ID NO: 4041 - DNA, 2131 bp, Rattus norvegicus
  Genbank Accession No. NM_053747
gtgtcgcgctcgcctgagtcaccgccatggccgagagcgcagagagcggcggcccaccgggcgctcaggacagtgcggccgacagcggccccgcagagcccaagatcatgaaggtcacggtgaagacgcctaaagagaaggaagagttcgctgtgcccgagaacagctcggtccagcagttcaaagaggaaatctcaaaacgtttcaaatctcatattgaccaacttgtgttgatatttgctggaaaaattttaaaagatcaagatactttgagtcagcatgggattcatgatggacttacggttcaccttgtcatcaaaacccaaaacaggccgcaagataattcagctcagcaaacaaataccactggaaacagtgtgaccagttcaccagctcctgacagtaaccccacgtctgggcctgctgctaacagctcctttggtttaggtggacttggaggacttgcaggtcttagtagcttgggtttaaataccaccaacttctctgaactacagagccaaatgcagcggcaacttttgtctaaccctgaaatgatggtccagatcatggaaaacccctttgtgcagagcatgctctcaaaccctgacctgatgcggcagctgatcatggccaacccacagatgcagcagctgatacagagaaacccagagatcagtcacatgctcaataacccaaacataatgcgacagacattggaacttgccagaaacccagcgatgatgcaggaaatgatgagaaaccaggaacgagacttgagcaacctagaaagtatccctgggggctacaacgccttacggcgcatgtacacagatattcaggagcccatgctaaacgctgcgcaagagcagtttggtggtaatccatttgcttccttagtgagcagtccgtcctcagcagaagggactcagccttctcgaacagaaaatagggatccgctacctaacccttgggctccacagactccccagagctctccagcctctggcagcactggcagcaccactaacacagtgagcacctctgctggcaatgccaccagtaccccggcgggacagggcacctcagggcccaacttggtgcctggagcaggagctagtatgttcaacacgccagggatgcaaagcttgttgcagcaaataactgagaaccctcagctcatgcagaacatgctgtctgccccctacatgagaagcatgatgcagtcactgagccagaaccccgaccttgccgcacagatgatgctgaataaccccctatttgctgggaaccctcagcttcaagagcaaatgagacaacagctcccaaccttcctccaacaaatgcagaaccccgacacactgtcagccatgtcgaaccctagagccatgcaggcgctgctgcaaatccagcagggcttgcagacgttggccacagaagctcccggcctcatcccagggtttactcctggcttggcagcgggcaattctggaggccctgcaggaaccactgcacctagcactgcacctggtgaggatacgaacccccaagggggcgctgctgagccaggccaccagcagtttatccagcaaatgctgcaggccctcgccggggtgaaccctcagctgcagagtccagaagtcagatttcaacagcaactggaacagctcagtgcaatgggattcttgaaccgtgaagcaaacttacaagcactgatagcaacagggggcgacatcaatgcggccattgaaaggttgctgggttcccagccgtcatagcagcatttctgtatcctgaaaaaatgtaatttatttttgataacggctcttaaatctttaaaataacctgctttatttcattgggattctgtgctgttgtaaaggaaaccaataggaagtctctggaggtggagtgcagtaagatgtgcgggtttctgtgtctttggaacagtgggaatcgatgtctctggttaaggccgctgcatgcgtcaaacacttggcatttgttgtaatcttttaaacatcaccttttctaattgggtgaacacatttttgtcctgcatctgtccaactaacttgctttttaaacatagccctctggtagtaatttatgtagaataaaggcattaaaaagc

SEQ ID NO: 4042 - DNA, 1684 bp, Rattus norvegicus
  Genbank Accession No. NM_053752
gctcctactgggcctgactttgctggtgagctccctgcaagctttggtgtgctttgagtgtggcaacctcaattctatggggatttgtaactttagaacagctgtatgttacgctcatcctggtgaggtttgtgcctcagttttaacctataaagatggaaaatttgtatatggaaaccagagctgtgctgagtgctccgggaggactgttgagcatggaagtctgatagtatcaacaaactgttgctcagccacctctttctgcaatatagtacgtccctgatacttaattgtatggaaggattttagtgctctttactgagtcttgacactggagcatgccagaaagaattatctactgaccgtgtctggagaacgcactaagatttctacatcatgttttctgactacgtgtacatcatatcatatgatcttcagtgatctgtaataaattgaaggccttacaaattttgcggctgccactgcaaccatggtctccggcagcagcggccttgccgccgcccgcctgctgtcgcgcaccttcctcctgcaacagaatggaatacggcacgggtcttacacagcctctcggaaaaatatctatattgataaaaatacgaaggttatttgccagggtttcacaggcaagcagggtacctttcacagccagcaggctttggagtacggcaccaaactcgtgggaggaaccactccagggaaagggggcaagaagcacctgggcttacctgtctttaatactgtgaaggaagccaaagagaaaacaggagcgacagcttctgtcatttatgtccctcctcctttcgctgctgccgccatcaatgaagcaattgacgcagagattcccttggttgtgtgcattactgaaggtattccgcagcaggacatgttgcgggtcaagcacaagctgacacgccaggggaagacgaggctaattgggccaaactgccccggtatcatcaaccctggagaatgcaaaatcggcatcatgcctggccacattcacaagaaaggaagaataggtatcgtgtccaggtccggtactctgacttatgaagcagttcaccaaacaacccaagttggattggggcagtccttgtgtattggcattggaggtgacccttttaatgggactaattttattgattgccttgacgtcttcctgaaggatccagctacagaaggcatcgtactgattggtgaaattggtggtcacgctgaagaaaatgccgcggagtttctgaaggagcataactcaggtccaaaggccaagcctgtagtgtccttcattgctggtataactgctcctcctggcagaaggatgggccacgcaggggcgattattgctggaggaaaaggtggcgccaaagagaagatctctgctcttcagagtgcgggtgtaattgtcagcatgtcccccgcacagctgggaacctgcatgtataaggaatttgaaaagaggaagatgctttgaaggacacgacatgaattttaaggctgtggaggaaatctcacagactggagagcccgtccagactgcagcccaggcacctgaccctggtctctcagtacaggggaagtccaggcatgttttagaatgtcctaaattgagctattttcacttactgtgtaacagagacagataataaatctatcatttgatttg

SEQ ID NO: 4043 - DNA, 723 bp, Rattus norvegicus
  Genbank Accession No. NM_053756
cggagcctgggtgggaagaacaggcccctggagggcacttgaccttaagcctcttttcctccgcagagaggaagcgggagaggagcccacgtcgcctgtcacccaatatctccagccgcgcagtcccgaagagtgtaagatgttcgcctgcgccaagctcgcctgcaccccctctctgatccgagctggatccagagttgcatacagaccaatttctgcatcagtgttatctcgaccagaggctagtaggactggagagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccagaaacccttcgctgaagcagcagctgttctcatatgctatcctgggatttgccttgtctgaagctatgggtctcttttgtttgatggttgctttcttgattttgtttgccatgtaacagaaattactgcctaaaatgttggcattcatagtaattacggatgtaattctgtgtatcttgctgtgactccgaagactgtagtactggtgtcatggaaatatgtgttatttccaaagtcatttcattaaagatggaaactttaaaaaaaaaaa

SEQ ID NO: 4044 - DNA, 2508 bp, Rattus norvegicus
  Genbank Accession No. NM_053765
ctgaggaactctattttaaaaaactctcaagtaaaaaaaagcaagtcatggagaagaacgggaataaccggaagcttcgggtttgcgttgccacctgcaaccgagccgattactccaaactggcccccatcatgttcggcattaagacggagcctgcgttcttcgagctcgacgtggtggtgctgggctctcacctgatcgacgactacggaaacacataccgcatgattgagcaggacgactttgacatcaacaccaggctacacacgattgttagaggggaagacgaagcagccatggtagagtcagtgggcctagcgctagtgaagctaccggatgtcctcaaccgcctgaagcctgacatcatgattgttcacggagaccgatttgacgccctcgctctggctacatctgctgccctgatgaacatccgcatccttcacattgaaggaggagaggtcagcgggactattgatgactctatcagacacgccataacaaaactggctcactaccacgtgtgctgcaccaggagtgcagagcaacacctgatctccatgtgtgaggaccacgaccgcatccttttggctggctgcccttcctatgacaaactgctctcagccaagaataaagactatatgagcatcattcggatgtggctaggtgatgatgtaaaatgtaaagattacattgttgccctgcaacacccggtgaccaccgacattaagcattccataaagatgttcgaactgacactggatgctcttatctcatttaacaagaggaccctagttctgtttccaaatatcgatgcaggcagcaaggagatggttcgagtgatgcggaagaagggcatcgagcatcaccccaatttccgcgcagtcaagcacgtcccgtttgaccagttcattcagctggtcgcccacgctggctgcatgattgggaatagcagctgtggagtgcgtgaggttggcgcctttggaacccctgtgatcaacctgggcacgcggcagataggaagagaaacgggggagaatgttcttcatgtccgggatgctgacacccaagacaaaatattacaagcactacacctccagttcggtaaacagtacccttgctcaaagatatatggggatggaaatgctgttccaaggattttaaagtttctcaaatccatcgaccttcaagagccactacagaagaaattctgcttccctcccgtgaaggagaacatctctcaggatattgaccatatcctcgaaactctgagtgccttggctgttgatctcggggggacgaatctgagagtggcgatagttagcatgaagggtgaaatagttaagaagtacacccagttcaatcctaaaacctatgaggaaaggattagtctaatcctgcagatgtgtgtggaagcggcagcagaagccgtgaagctcaattgcagaattctgggagtaggcatctccacaggtggccgtgtgaatccccaggaaggagttgtgctgcactcgaccaagctgatacaggagtggaactctgtggacctcaggacaccactctccgacaccctgcatctccccgtgtgggtggacaacgacggcaactgcgctgccatggcggagaggaagtttggccaaggaaaaggacaggagaactttgtgacgctcatcacagggacagggatcggtgggggaatcatccaccagcacgagctgatccacggcagctccttctgtgcggcagagcttggccacctcgtggtgtctctggatggtcctgactgctcctgtggaagccatgggtgcattgaagcctacgcctctggaatggccttgcagagggaagcaaagaagctccacgacgaggacctgctcttggtggaagggatgtcagtgccaaaagacgaagctgtgggcgccctccatctcatccaagccgccaagctgggcaacgtgaaggcccagagcatcttacggacagctggaactgctttgggactcggagttgtgaatatcctccacactatgaatccttccctggtgatcctgtctggagtcctggctagtcactacatccacattgtgagggacgtcatccgccagcaagccctgtcctccgtgcaggatgtggatgtagtggtttcagacttggttgacccggccctgcttggtgcggccagcatggttctggactacacgacccgcaggatccactaggcctcctgggaatagacctggactgagacccaagagctactgagtggaaccacgctctcttagatcagtatttcttcaaaggccagtgtgggaggctgcggagccagctcagtggtcaagagcctaaactgctcttgccaaagacccaagttcagttcccagcacccatgtcaggcactcaactgcctgaaagccaagctccaggggatccagtgcctcagctgcctcaggcagctgcactcaaatgtacatagtcctctccagaatacacgtaaattaaaataaatcttgg

SEQ ID NO: 4045 - DNA, 1361 bp, Rattus norvegicus
  Genbank Accession No. NM_053768
ccattcttgaaaccgaatctgaagttaaaggctgagggaaaatggcccattaccatgacgactatggaaagaatgatgaagtggagtttgtccgaactggctatgggaaggacatggtcaaagttctccatattcagagggatggaaaataccacagcatcaaagaggtggcgacttcggtgcagttgactctgaggtccaaaaaggattacctccatggtgataattccgacatcatccccacagacaccatcaagaacacagtgcatgtcctggcgaagttcaaagggatcaaaagcatcgagaccttcgctatgaacatctgcgagcacttcctctcttcctttagccatgtcacccgagcccatgtccacgtggaagaggtcccctggaagcgttttgaaaagaatggagtcaaacacgtccatgccttcatccacaccccgacgggaactcacttctgtgacgtggagcaggtgaggaacggacctcccatcattcactctggaatcaaagacctcaaggtcttgaaaacaacccagtctggatttgaaggattcatcaaggaccagttcactactctccccgaggtgaaggaccgatgctttgccactcaagtgtactgcaagtggcgctaccagaatcgggacgtggatttcgaggctacctggggcgctgtccgggacattgtcctgaagaaatttgctgggccctatgacagaggtgaatactcaccttccgtgcagaagaccctctatgacatacaagtgctgaccctgagccagcttcctgagatagaagacatggaaatcagccttccaaacattcactactttaacatcgacatgtccaaaatggggctgatcaacaaggaagaggttttgctgcctctggacaacccctacggcaaaataaccgggacggtgaggaggaagctgccttccaggctgtgacgttatggctccagccagttgtgatgcttgggataactgtgtgctcacctgcaaaaatttcaactcaggatactgattgctctgctctgtgtgaagtaattgctcttccgtttctagtttagcaaggggcttgtagctgtgcgcacgtggagccctgcattagcagacaccgcaggctccgtggccttgggcagattcctttaaaactgtgatcggagaatcacagcgatatttctccttgctgttcttgtgccctctgcctcagactctgtctttaggatccgatcgttaaggaaatagtcgtaaagcactggctgctgccacatccgttgatctgaacatgagatcaaacactgtcatactcctagggatgtctgggttgtaccaaaaacgtaataaaaccatgtc

SEQ ID NO: 4046 - DNA, 1908 bp, Rattus norvegicus
  Genbank Accession No. NM_053769
gcgcggtgaagccagattaggatcagcgagcacttgaggatttagggccacaaaaaaccgcacaagatcgacagactatttctggagagctgcagaacgggcacgctggggtcgctggtgctggccatggtgatggaggtgggcatcctggacgccggggggctgcgcgcgctgctgcgagagcgcgccgctcagtgcctgcttctggattgtcgctccttcttcgccttcaacgccggccacatcgtgggctcagtgaacgtgcgcttcagcaccatcgtgcggcgccgcgccaagggcgccatgggcctggagcatatcgtgccgaacaccgaactgcgcggccgcctgctggccggagcctatacgcccgtagtgctgctggacgaacgcagcgccgccctggacggccgcaagcgcgacggcaccctggccctggccgcgggcgcgctctgccgagaagcgcgctccactcaagtcttcttcctccaaggaggatatgaagcgttttcggcttcctgccctgagctgtgcagcaaacagtccacccccatggggctcagcctcccgctgagtactagtgtgcctgacagtgcagaatccggatgcagctcctgtagcacccctctctacgaccaggggggcccagtggagatcctgtccttcctgtacctgggcagtgcttaccatgcttcccggaaagatatgctcgacgccttgggtatcactgctttgatcaacgtctcggccaattgtcctaaccactttgagggtcactaccagtacaagagcatccctgtggaggacaaccacaaggcagacattagctcctggttcaacgaggcgattgactttatagactccatcaaggatgctggaggaagggtgtttgtgcactgccaggccggcatctccaggtcagccaccatctgccttgcttacctcatgaggactaaccgagtgaagctggacgaggcctttgagttcgtgaagcagaggcggagtattatctcccccaacttcagcttcatgggccagctgctgcaatttgagtcccaagtactggcccctcactgttctgcagaagctgggagcccggccatggctgtccttgaccggggcacctctactacaacggtcttcaacttccctgtctccatccctgttcaccccacgaacagtgccctgaactaccttcaaagccccatcacaacctctccgagctgctgaagggccaggggaggtgtggagtttcacgtgccaccgggacgacactcctcccatgggaggagcaatgcaataactctgggagaggctcatgtgagctggtccttatttatttaacacccccccccccaaacacctcccgagttccactgagttcccaagcagtcataacaatgacttgaccgcaagacatttgctgaactcagcccgttcgggaccaatatattgtgggtacatcgagcccctctgacaaaacagggcagaagggaaaggactctgtttgagccagtttcttcccttgcctgttttttctagaaacttcgtgcttgacatacctaccagtattaaccattcccgatgacatacacgtttgagagttttaccttatttatttttgtgtgggtgggtggtctgccctcacaaatgtcattgtctactcatagaagaacgaaatacctcactttttgtgtttgcgtactgtactatcttgtaaatagacccagagcaggctttcagcactgatggacgaagccagtgttggtttgtttgtagcttttagctatcaacagttgtagtttgtttatttatgatctgaagtaatatatttcttcttctgtgaagacattttgttactgggatgactttttttatacaacagaataaattatgacgtttctattg

SEQ ID NO: 4047 - DNA, 6331 bp, Rattus norvegicus
  Genbank Accession No. NM_053770
  misc_feature (1)..(6331): n = a or c or g or t
gaattcggcacgaggaaaaatctttggagagaagagagccacagtgagcacgctagtgcacaattattgcagccacgtgtgcccgcaagctggccctgcgacaagctgttgagtgctgttgcaattagctgattggagaacggggactgcagggtgataatgctgcgtctccgctcgcgggcaccaggaaagggttttgtctcgggaaggcaagtcttccctgcacagttatctcagcagctccctagctgaagagaactgggggctctaaagggagggggtcgcactgtgcgagcacagattctgtgccaggctgttgcttatgaaccgcacgtctgggaaagcaggtgtgtgctcggacgggcactgggctggaacgcaggcggcggctctcgggttcacctgcttcctgttaacagactgttggctcacagagcatctgctcttacacgctgaaactgcggctgagaaagggttcccggcatcccacttgactgacggaggcacttggattggacttaatcttaaacctctggaggtcaagaccttttaaaaagggctaaataaacaatctacatgttaaaggccagcgactcctacttcctctgttggagcaactgtgaagtccagcctcttctaggaaaactgaagactttaataacacaccgttcaaggtgaaaatgaatacagatagcggtgggtgtgctcgcaaacgtgccgccatgtctgtcacgttaacatctgtgaagagagttcaaagttctccaaacctattggctgcagggcgtgagtctcactctccggactcagcttggagatcttacaatggtcgaaatccagagacactgaacggagatgccacatattcctctcttgcagcaaaaggttttagaagcgttcgaccaaacctgcaagacaaaaagtcaccaacccagagccatatcactatcaacggcaactctggtggcgccgtgagtccagtgagttactatcagaggccattctccccttctgcatactccctcccagcctcactcaactccagcattatcatgccacacggcaggtcgcttgattctgcggagacatattcccagcatgcccagtcgctagacggcaccatgggaagctccatcccactctacagatcctccgaggaagagaagagggtcacagtcatcaaagccccgcattacccagggatcggccctgtggatgagtctggaatccccacagccattagaacgacagttgaccggccgaaggactggtacaagacaatgtttaaacaaattcacatggtacacaagccggatgaggacacagacatgtataatactccttacacatacaatgcaggtctgtacaactcgccctacagtgctcagtcacatcctgctgcaaagacccagacctacagacctctttccaaaagccactcggacaatggcaccgatgcttttaaggaggcaccctcaccagtgcctcccccacacgttccaccacgaccaagagatcagtcttcaacagaaaagcatgactgggatcccccagacagaaaggtggacaccaggaaatttcgatcggagccaaggagtatttttgaatacgagcctgggaagtcatccatcctgcagcacgaaagacccgtctccgtctaccagtcttccatagacagaagcttggaaagacccagcagctctgcaagcatggcgggtgactttagaaaacggaggaagagtgaacctgcagtgggcccgcccaggggcttgggggatcacagttcaagcaggaccagccccggccgggcagacctcccaggatcaagttccacctttaccacgtctttcattagttcttctccttcctctccctcgagagcacaaggtggggatgatagcaaaatgtgtccgcccctttgcagttactcggggctcaatggctcgccctctagtgagttagagtgctgcggcgcttatagaaggcacttggacgtcccccaggactctcaaagggccatcactttcaagaacggctggcaaatggcccggcaaaatgcagagatctggagtagcactgaagaggcggtttcccccaaaatcaaatcacgaagctgtgacgatctcctgaatgatgactgcggcagcttcccagaccctaaaaccaagtcagaaagcatgggttctctgttatgtgacgaaggctccaaagagagcgaccccatgacgtggacttccccctacatcccggaagtgtgcgggaacagcagatctaggctcaaacataggtcagcccataacgccccaggcttcctcaaaatgtacaagaaaatgcaccgcatcaaccgcaaggatttgatgaactcggaggtcatttgctctgtgaaatccaggatccttcagtacgagaaggaacagcagcacagggggctgctccatggatggagccagtcgtccaccgaggaggtgcccagggacgtggtacccactcgcatctcggagtttgagaagctgattcagaagtcaaagtctatgcccaatctaggagatgaaatgttatctcctgtaaccctagaacccccacaaaatggtttgtgccccaagaggcgattttctattgagtctctgctggaggaggaaactcaggtccgacacccttctcagggtcagcgaagctgcaagtcgaacaccctggtacccatccacatcgaggtcaccagcgatgagcaacctagaacacatatggagttttccgacagtgaccaagatggggttgtgtctgaccacagcgataacgtccacgtcgaaaggtcgtccttttgtagtgaaagtgacttcgaccacttttcattcacatcctctgaaagtttctacggatccagccatcaccaccaccatcaccaccaccatcacggacacttcatcagttcctgcaaaggccgatgccccgcttcttacactcgatttaccacgatgttaaaacacgaaagagctaagcatgaaaatattgaccgacccagaaggcaagacatggatcctggcctatctaaactcgcgtttctagtcagccctgtgcctttccgaaggaaaaaagttttgactccccaaaaacaaactgagcaggcaaaatgcaaagcctcggtagttgaggctctggactctgcccttaaagacatttgcgaccaaataaaagctgaaaagcggagaggaagcttgccggacaacagcatcctgcacaggcttattagtgaactgctgccacagattcctaagaggaattcatctcttaatgctctaaaaaggagccccatgcaccagcctttccacccactgcctcaagatggtgctattcattgtcccctgtaccaaaatgattgtgggagaatgcctcacagtgcctctttcccagacgtggacacgaccagcagctaccacgcacaggactatggtagtgtgctgagtctccaagatcacgagtcccctagaagttactcgtctactctgactgacttgggaagaagtgtatcacgggaacgaagaggaactccagaaaaagaggtaaaattgcctgcaaaagctgtctatgatttcaaagctcagacttctaaggagctgtcatttaagaaaggagacaccgtctacatcctcaggaaaattgaccagaactggtatgagggggagcaccacggaagagtgggcattttcccaatctcatacgtagagaaactaacacccccagaaaaagcgcagcccgcgagaccaccacccccagtccagccgggagagattggagaagccatagccaagtacaacttcaatgcagacacaaatgtggaactctccctgagaaagggtgacaggattattcttctcaaaagagttgatcaaaactggtatgaaggtaaaatcccaggaaccaacagacaaggcatcttccctgtctcctacgtagaagttgtcaagaggaacacgaaaggttctgaggattaccccgaccctcctctaccccacagctactccagtgatagaatttacagcctaagctccaataagccacagcgtcctgtgttctctcacgaaaacattcaaggtggaggagaaccgtttcaggctctgtataactatactcctaggaatgaagatgagctggaactcagagaaagtgatgtcgtagatgtcatggaaaagtgtgatgacggatggttcgtgggaacttcaagaagaaccaaattctttggtacttttcctggaaactatgtcaaaaggctgtgactcacctcactcctaatttatgccacatttcagccacacatctgcattaacccacctgaaacgtcccaggaggcctgttgctgcctcgccttatggtttcccaatagcccattaccatctccatctgctgccaccaaatcaccagcagagggactgccgctgtgagccttagggaggctgggagccttagagaaaagtggcaaaacttacacccacataaatattcagtctcctgctttctgccctgaactttgaaatgcctgtatatggaatcagaatgaaaatgatcatactttcaaaaaagtgaaataattaaggaagaaagaaagagaaaagaaatagagagactcttcaggaggctgtctggcctcatggctgaatctccacctctctggaaggtgtactgtcctcaggaagcctgaagattgttttttttctgaaatgctatggttccagttctcactctcatctaggcggtatattttcctttcacgagtttgcctagcgctcgggtttacactacatgacaactatacttcggctgttgtttgcttgcacttattattccttgtttcatgcacagtgatcacaaaatccagagtgcctagggaaggttcactggttccactggttcgagtgtgatttttgttgactgcattatattttcacacggggaggggggtctttcccctgcccacttttttgtgcttattagaagtgcaaacagtgagcaactgagagctcagccacaccacaggacaaatccgtgttgtgaattcgcattgctgttttgtgtattaaggtgtaatcatcagcttcatggacaacaagctattagtgatttctttacctgttaaaacttacaggcagtgctagtgagttaggcagaaagntgacagtaataccagtaggtgagcttcactgcgtgcatgctcacacgtttgagnttgtatgaggacatataattcatatgctatgttgtacattttatggaaatataagagaatcccacattattttatagagtacttcaggagcatcctaagtgttaaggctggctttagcaaggattatgatcaatacaactatttttactacaataattatttttcttctatgagacccagaatcctgactccacttgcagacaggaatatatatgttgagcctgacttttttttctggtatatgtaaaatacttcccaggaatacattgggcacttttgggaataatggttaaatcattcaggttgtgcttcctgcccccaaaacagatctacaaaatgataccaaacctgaaagatttaacggatttacggtgcctgcattccacacaacctcacacttagctttgtatttcaaatgaatttgcataaaanctgttcactttancaccttatagtcaaaactttttatggctttcctcccatgggcaatgcttgatcttcccaacatataaactctggcatattttgttcatatgtttgttcctttttggttgtacagactatttacttgttcagaaaacatcgagatctcccaatttgttctttaccccgcccttaaaaggaatttaaactctttcagaagatcgcccttcaccacatctccacagatcacaagctaaggtgaatctggaatatancgtctgcacaaaattttgtgactcagaaaganctttgtaactacnctgaaatacatataataacaatgttccagttacagaggaatattgttggggcaggaagtgaagaaacancttcaagaaacccactttacnctccagttcacaactagctttatattagaaaaacttgggattggaaagtcagccagccagccggccacctgcagcnttgttgataaatgaatactttttcacaccatttatgaaaacaaancttcaactctgttgcctgttatatttaagaaaaattgctgtttctactcnctgtatctgattttaaaaggaaaaaaatattcacgcctggctttcaggacattgactttgaatncttacgagcaaaggncgttgtgtttttcttgcncgtgccgaattc

SEQ ID NO: 4048 - DNA, 1576 bp, Rattus norvegicus
  Genbank Accession No. NM_053785
agcaactcgaacatcttgtctgtgctggtggattattaacagaggttattggtctccatggcaaaacaattgaacgatcgcgcagaacgtaatctcatttatggggtgcaaaaaaaaaaagacattgggtcagggatataaatgcccattgccactgagggcctgctatagttcagaagtgactccacggttcaaaacgctctgacattttggtcccaaatttcttactgaaccaggtacagccactgcaacgcgctgccaaaacccctgaggagtcctgtgaagctggtggtgaggagcctttgatctctgtgctttactgtgccaccccagcatgtgtactgggggctgtgccaggtgcctggggggcaccctcattcccttggctgtgtttgccgtcctggcaaatatcctgttgttttttcctggaggaaaagtggtggatgacaacagccacctttcagatgaggtctggtacttcggaggaatactgggaagtggagtcttgatgatcttccctgcgctggtgttcttgggcctgcagaacaatgactgctgcggatgctgtggtaatgagagctgtgggaagcgatttgcgatgttcacctccacgttgtttgctgtggttggcttcttgggtgctgcatactcatttatcgtctcagccgtttccatcaacaagggtcctaaatgcttcatgaccaataacacctggggataccccttccacgatggtgattatcttaatgaccaagccttgtggagcaagtgcgaagaaccccgcgatgtggtcccttggaatctcacccttttctccattctgctggtcatcggagggatccagatggttctctgtgccatccaggtgatcaatggcctcctgggaactctctgtggagactgccagtgctgtggctgctgtgggggtgatagaccagtctaacaggctacgatgatctgctccaagtctacagcaccatgtgtgggaagacatggcccaggcccagcactgcacacatgggctgctaactcctgtccggttggatcctctctggcagagcttgggaggcacaggagatcctttactctctccaaacaacttagctcaacccaggaatttggtggaatttttttactttgcaaattaggccctattttgaattccagaacaagtttaaagcacatttttcatgatttcccataagaaaagttaaaatagaggaggtcacttgtcctaccacattgtctctttgtgtataaagatgtccatactttaggaatatttgcattgaactcaaagagataaagcattacaaggaaaaccggtttttcaggatgcataggtaaggaatgattgctatattatatataatttttatgtgaagcctgttttggctaacttgtctggactacttgtaactagttttatgagcctgtcataatttgccagggttcccacatgtatattaagttaattaaattcagaattaaaataataaatgtggggggaggaagaagagaaagaatgtatcagacctgcttgtcttttttctttttataaatgcattctttcttt

SEQ ID NO: 4049 - DNA, 881 bp, Rattus norvegicus
  Genbank Accession No. NM_053791
cctgactccgtggccaggctgctgtgagactcctcagagatgcagctgtctataactcatccatgctgttggaccctgcgtctgctactggtgtccaacctgctcctgtgggagaatgtcgccttggtgcccacgtgcttagtaaggaatgggcgctgctttgcttccttggaagaaatgcttgaaagagctgttggtttgtctgaagagataagtaaacaagctcttcaactgtttactgaatttgataatcagtatgcgcagagcaagcagctcattaacaagaacttcaaaaaatgtcatacatcttctcttgagcttccaaaacccagcagtacatctgttcagacacatcccataaccctactgaaaatagcaagcaaattattgagcgcctggaaggttcctctgaacgacctagtgaacaacctgccatccttgaaagacatacatcctaatatcctttccaaagccagagagattgaggctaagagcgctggactcctggagggtgttaagagcattctcatccagatgcaaaatggagatacagaagatgagaactaccctggctggtctggactggcatccttgcagtcagagaatgaagatgatcgcctctttgcatattataacatgatccgctgtgagggtagagaaacgcaaaaggttgaaactgctctcaagatggtaaagtgcaaaatttcaaatgaaaacaactgctaagccctttgtatcccatctgtatctgagatgctccttgatgatatattgctgtgaaacctgctttatgtttctctcttttaaatgcatgctcagtgtgattgttatcttcttttacaataaaaaactgaccccatgtatgtgaccatctgaaaaaa

SEQ ID NO: 4050 - DNA, 7140 bp, Rattus norvegicus
  Genbank Accession No. NM_053795
gtcctctgacaaggtctgcggccctgtgagctggctctacagagccgagggcggagtcctcagccaggccgagatacggtgaattaaagtcggcaatagatttctgtgaaaatgtcagttcttatatcacagagtgtgataaattatgtggaagaagagaatattcctgctctgaaagctcttcttgagaagtgcaaagatgtagatgagaggaacgagtgtggccagacgccgctgatgctggctgcggagcagggcaatgtggaaatagtgaaagaactgttaaagaatggagccaactgcaatctggaagatctggataactggactgcccttatatcggcatctaaggaggggcacatccacattgtggaggagctgctgaagagcggggccagtctggagcaccgagacatgggtggatggacagctctcatgtgggcgtgctacaaaggcaggaccgacgtggtcgagctgcttctttctcatggtgccaacccaagtgtcactggtttgtatagtgtctacccaatcatctgggcagcgggcagaggccatgccgacatagtgcatcttctactgcagaatggtgcgaaagtcaattgctccgacaagtacggaacaacccccttggtatgggctgcccgaaagggtcatttggaatgtgtgaagcacttgttggccatgggagctgatgttgatcaagaaggagccaattcgatgactgcacttatcgtggcagtgaaaggaggctacacacagtccgtgaaagagattttgaaaaggaatccaaatgtgaacctaactgacaaggatggaaacacagctctgatgatcgcatcgaaggagggacatattgagattgtgcaggacctgctggacgccggaacatacgtgaacatacctgacaggagtggggatactgtattgatcggcgctgtgagaggtggtcatgttgaaattgttcgagcacttctccaaaaatatgctgatatagacattagagggcaggacaataagaccgcgctgtattgggccgttgaaaagggaaatgcgacaatggtgagggatatcctgcagtgcaatccggacacggaaatatgcacgaaggatggtgagacaccactgataaaagccaccaagatgagaaatattgaagtggtggagctgctgctggataagggggctaaggtgtctgctgtggacaagaaaggggacactcccctgcacgttgccatccgagggaggagccggagactggccgaacttcttttacggaaccccaaagatggacggttactctacagacccaacaaagcaggcgagactccctacaacattgactgcagccaccagaaaagcattttaactcaaatatttggagccagacacttgtctcctacggaaacagatggcgacatgcttggttatgatttgtatagcagtgccctggccgatattctcagtgaacccaccatgcaaccacccatttgtgtgggcttgtatgcacagtggggaagtgggaagtctttcttactcaagaaactagaagatgagatgaagacgtttgcaggacagcagaccgagcccctcttccagttctcgtggctcatagtgttcctcaccctgctgctgtgtggcgggctcggcctagtgtttgctttcacggttgatacaaacctcgccatagccatttcattgagtttcctggctctcatatatatattcttcatcgtcatttacttcggtggacggcgggaaggagagagttggaactgggcctgggctctcagtaccagactggcaagacacattgggtacctggagctcctcttcaaactgatgtttgtgaacccacctgaactgccggagcaaactacaaaggctttacctgtgaggtttttgtttacagattacaatagactctccagtgtgggaggagaaacttccttggctgaaatgatcgcgaccctctcagatgcttgtgagagagaattcggctttttggctacccgtctttttcgagtcttcaggactgaagagtctcagggtaaaaagaaatggaaaaaaacatgctgcctcccctcttttgtcatctttctttttattgttggctgcattattgctgggatcacccttctggctatattcagagttgacccgaaacatctgacagtgaatgctatcctcatttctatcgcatctgtcgtggggttggccttcgtgctcaattgtcgaacatggtggcaagtgctggactctctcctgaattctcagagaaaacgcctccatagtgctgcctccaaattacacaagttaaaaagtgaaggattcatgaaagtcctgaagtgtgaggtggagctgatggccaggatggcaaaaaccattgacagcttcactcaaaaccagacaaggctggtggttatcattgacggcctggatgcctgcgagcaggataaagtccttcagatgctggacactgtccgagttctgttttcaaagggcccttttattgccatttttgcaagtgatccgcatattatcataaaggccatcaaccagaacctgaatagtgtgcttcgtgactcaaatataaacggacatgactacatgcgcaatatagttcacttaccagtttttcttaatagtcgtgggcttagcaatgcaaggaaattccttgtaacttcagcaacaaatggggacattacatgctcagacaccacaggaacacaggaggacactgacagaagagtttcacagaacagccttggggagatgacaaagcttgggagcaaaacggctctcaacagaagggacacttaccgcagaagacagatgcagagaaccatcacgaggcagatgtcctttgatctcacaaagctgctggtcactgaggattggttcagtgacatcagccctcagaccatgagacggctactcaatattgtttctgtgacagggcggctactaagagccaatcagattactttcaactgggacaggctagccagctggatcaacctcaccgagcagtggccgtaccggacgtcttggcttatactatatctggaagagactgaaggtctccctgatcagatgaccttaaagaccatctatgagagaatatcgaagaatatcccaacaactaaagatgttgagccgcttcttgaaattgatggagatataagaaactttgaagtcttcttgtcttcaaggactccagttctcgtggctcgagatgtaaagacctttttgccgtgcacagtaaacctggatcccaaacttcgggagatcatcgcagatgtccgagctgcaagagagcagatcaacataggaggcctggcctatcccccgctccctctgcacgaaggccctcctcggccaccttctgggtacagtcagcctgcatctgtctgctcttcagcatctttcaacgggccgttcccaggcggggttgtgtctccacagccccacagcagttactacagcggcttgtccggaccccagcaccccttctacaacaggccattctttgccccatacctttacacgccaaggtattaccctggcggttcccaacatctcatctcacgttcatcagtaaaaacgagtttgcccagagatcagaacaatggcctaccgtgtgactctgggtttaacaaacagagacaggcagccgtccctgccacaggcagctcactgttactgagttcaatgaccgtggatgtcgtatgtgagaaactgagacagatagaagggctggaccagagcatgatgcctcagtactgcacaacaatcaaaaaggcgaacataaatggccgggtattgtctcagtgtaacattgatgagctgaagaaagagatggctatgaactttggagactggcatctcttcagaagcatggtcttagaaatgagaagtgtggaaagccaggtggtccctgaagaccctcgttttctcaatgaaaactccagtgccccagttcctcatggagagtctgctcgccgctcttctcacactgagctgcccctcacggagctttccagccagactccatacaccctgaacttcagctttgaagaactgaacacgcttggccttgatgagggagcccctaggcacagtaacctgagttggcagtcacaaactcgcagaaccccaagtctctcgagtctcaattcccaggactccagtattgaaatttcaaagcttactgataaggtgcaggccgagtatagagacgcctatagagagtacattgctcagatgtcccagttagaagggggcacagggtcgtccacaataagcggcagatcttctccacatagcacatactacataggccagagctcttcagggggctccatccattctactctagaacaggaaagggggaaggagggtgagctaaagcaggaggatgggcggaagtcatttttaatgaagaggggggatgtcatagattactcctcatcaggggtgtccactaatgaggcctcacccctggaccccattactgaagaagatgagaaatccgaccagtcaggtagtaagctactcccaggcaagaaatcctcagaacggcccagtctcttccagacagacttgaagcttaaggggggtggtcttcgctaccagaaactgcccagtgatgaagatgagtcggggacagaagagtcagataacaccccactgctcaaagatgataaggacaaaaaggctgaaggcaaagcagagagagtgtgcaagtccccagagcacagtgccgagcccatcagaacgttcattaaagcaaaagagtatttgtccgatgccctccttgacaaaaaggattcctcagattcgggagtgaggtccaatgagagttctcccaaccactctctccacaatgaggcagcagacgactcccaactggaaaaggcaaacctcatagagcttgaagatgagggccacagtgggaagcgggggatgccacacagtctgagtggcttgcaagatccaattatagctcggatgtccatttgctcggaagacaagaaaagcccttccgagtgcagcctgattgctagcagccctgaagaaagctggcctgcgtgccagaaggcctacaatctaaaccgaacgcccagcactgtgactctgaacaacaacactgcacccaccaacagagccaatcagaacttcgatgagatagagggaatcagggagacgtcccaggtcattctgaggcctggccccagtcccaacccaactgctgtgcagaatgaaaacctgaagagcatggcgcacaagcgaagccagcgctccagttacacaaggctctcgaaagatgcatctgagctacatgcagcctcctcggagagcacaggctttggagaagagagagagagcattctctgatgaggaaggagaagtgaaaagagtgtgacagactttgagttgaccattcctcattactcatcatgtttatgcatcacagacacctgataggtggtcaggcactggaagcagacaggaaagcctgaaagcacagtcaccagtcattttcattgtcaccgtcatcccaggcactttaaagtctcactgccactattacacctttcctggcacacagctaggcagagcgatgagagcaggctgaagacaaaataggtcaaaagtgtatttaaagttgaaagggcttaaatcacaaggaaaaaaacttagagatctcctttataaactattcatgtaccatttgagggaagatacagtgttagatgaagcagaaaccaattttattgttagtgtttaatcttggtgcagatttataagttttagagtagcccagagactaaaagtgaatacttagcaaatggatagccagtgttctatataggaatcattgcttttcagagggcttaaagtttaagtagaaaatatatactcaagaaggcgataaaagctgatgagaaagtgagttagcagaacccaaagccgtgctgggccgcggtgactcattagcagaggaggaggggagggcagtatattcctgggatactctctccagacccagcctggcttctgacatcatccacctgtgccctcaaaaccgtcttagtctgttctgcaactcttaagtgacatacctaactcagctcatggctaaggaaaaaaaattaaagttgtcctggtgattaaactctggacctcccacatctaagtcccgagttgacaaactgcatccccagcccaaacatctgttcttccagagatctggaaagacatgggcataagagtccagtaaactcttaatgaaggtgtcgggaagtgtttcccttaaaggggttagtgacagtgacactagacaagtgacagaatttagtttgctgacattaaatcactgccttctgggccgcaatagtttagtatctgttcctaaatcagcatttgagttctgcgggggttacaaaatggaggcatggttttaagaaggaatttgaaagcatccagggaagcaagaacagagtcggagctggtgtgaccatgacacttcccattattgttagcaaagctaggagaatgaccacatacatttaagtatcatgtaggctagagcgtgcctgtcatcatcatgcattgagaccgtttgtcctttgattatagtgtgtttatgtagaccagtcctagcagtatgtcctgagccatgggcaggattgtagatggcgaggtggcaggtttagtgctcgttgagatgtccatctctgactggacctgtgtggtttacttgtagctgctccgtgaaacactgccttgctgtttgagtgtaattgagcattttcatgaagtgtatatgttgcatgatctttaacaggtatttttagacattaagaacagcatgatattactgacatatgcattagtagtatgcagtatcatgtaatgggtacttcagaggcagtttggtttctttccaggtgagtagttatagctcacagtcatgggaatcctttattcacactgtctgtgaagtcgatgctggagtgccaaatgcacacggagactaggaacaataaagacttgcatgccattctgactcatggagttttattcaatagagcaatgataattcccattctgattaaaaattaaaacacggaa

SEQ ID NO: 4051 - DNA, 1895 bp, Rattus norvegicus
  Genbank Accession No. NM_053796
gcccagcgcagtggatagcgaagctgttcccagcggagttgcggcgcccgtcgcgtcgggattgaaactgtaatgggcaccgaggggaaagccgggagcaaactgttgtttctcttcacgtctatgatcctgggctccttggtgcaaggcaagggttcggtgtacagtcctcagactgccgtccaggttcctgagaacgactctgtcaagttgccctgtatctactctggcttctcctcaccccgcgtggagtggaagttcgtccaaggcagcaccactgcgcttgtgtgctataacaaccagatcacagttccctatgcagaccgcgtcaccttctcatccagtggcatcaccttcagctctgtgacccggaaagacaatggagagtatacttgcatggtctctgaggacgggggtcagaactacggggaggtcagcatccacctcactgtgcttgtgcctccatccaagccgacagtcagtatcccctcctctgtcaccattgggaacagggcagtgctgacctgctcagaacacgacggttcccctccttctgaatattcctggttcaaggatggggtacctatgcttacagcagatgccaagaaaacccgtgccttcatcaattcttcatacaccatcgatccaaagtcaggggatttggtctttgaccctgtgtcagcctttgatagtggcgaatactactgcgaggcacagaacgggtatgggacagccatgaggtcagaggctgtacgcatggaggctgtggagctgaatgtggggggcatcgtggcagctgtcctggtaacactgattctccttggactcctgatttttggcatctggtttgcctatagccgtggatactttgaaagaacaaagaaagggactgcaccgggtaagaaggtcatttacagccagcccagtgctcgcagtgagggagaattcaaacagacctcgtcattcctggtgtgacctgctggggctcatctcatgtccacttgccttactcaggtgctacaagttccagcccctgctggctgtagctgcactggatgccttcaatgtcttctaggtcccccgggaccccttgcttttattctagctaggatatgaatttaataacatcagctacttctccctcctctttcccgccctccctcctttccttaccaccattgcgtggcctgagactagttacaaagttttcattccccattcctatgtgggattggacaagagtcctagactaggcagtaataatgactgggctgacaggagcccaaaaccactacctgcctgtaaaggcctctccataaggactttgagcctagcttcccagctttcctccccgggcggagtgccagttgctctagagtggggactggaggaagatgggctgaggcatttgatggtgacctcaggtgtctagcctctggagcctgctctttgtctcaaaatgtgccactgggattctcctggatacaagtaaactgacaccgtgtccgaacaaggtgggagagctcggttaactcccaagagacttggagtgagaaagatttaaagcgatctaaggagaaaaggctggaactggtggctgttagtcacttcatttggctggaactactgcacagacccttgtaagatttatatggatcgaggagatgtgtgtgttaatagtctcgtctctttgatggtgtgtgtgtgtgtgtgtgtgtgtgtgtgtgtgtggagagagagagagagagagagagagagagagagtgagattgagattctatattgaaattgattgttatatagaagggctttctagctctttggcaaggttgtgtttatatctgacagatgttgctggaaataaaaacttgatttgacaaaaaaaaaaaaaaaaa

SEQ ID NO: 4052 - DNA, 3695 bp, Rattus norvegicus
  Genbank Accession No. NM_053798
ctacgaagagacacggaccttgatcgtcgaggagatgctgatcttgacctcctaccgcggctcctactacgtgagcgagagtatcgccttcccctggatcgggaatgtgatctagatcgtgacctgcttcttcttcgtcggctatagcgatgacagtcataagcataatgtcccttttcaccacactcatagcatctatcattaggatcaaagggacgacgggcaggtggcctatcaaaccgagatctccgaggcatgcctgttgataattcaaccctcactcgagaaccacaaatcactttcccatccaatcctcgaactgcaggggtacactgcgggtggagcgaagcggaggaaggtgcacgatggcggccacagcctacgagcatctgaagctgcatattacacctgaaaagttttatgtggaagcttgtgatgatggagcagatgatgtactcatcattgaccgcgtgtctacagaggtcacccttgcagtcaaaaaagatgttcccccttctgctgttacaagaccaatatatgggataatgggcacaatccatctggtggcaggcaattatcttgttgtcattaccaaaaagatgaaagtaggtgaattttttaatcatgtaatctggaaagccacagattttgatgttctttcttataagaagacaatgttacacttaactgatattcagttacaagataataaaactttcctagcaatgctaaaccatgtcttgagtacggatggattttacttttcaacaacatatgacttgacccatactttgcaacggctatctaacacgagtccagaattccaagaaatgagtctcctagaaagggcagatcagcggtttgtatggaacgggcatctgctcagagaactgtctgctcagccagaggtccatcggtttgctcttcctgtgttgcatggctttattactatgcattcatgttctattaacgggaaatattttgattggattctcatctcccggaggagttgtttcagagccggtgtgcgttattatgtgagaggaattgattctgaaggccacgcagctaactttgtagaaacagaacagattgtgcactacagtgggaacagggcttcatttgtacagactcgaggatcaatacctgttttctggtcacaaagaccaaatctaaagtacaaaccagatccacagatcaacaaagtagcaaatcacatggatggtttccaaaggcattttgattcacaagtaattatttatggaaaacaagtaataattaatctggtgaaccataagggatcagagaaaccacttgagcaaacatttgcaaaaatggtgtcatccttgggaagtgggatgatcagatatattgcctttgacttccataaggagtgtaaaaatatgagatgggatcgactgagtattttattggatcaagtagcagaaatgcaggatgaattaagttattttttagtagactctgctggcaaggtggtgacaaaccaggaaggagttttccgcagcaactgtatggattgtctagacagaacgaatgtgatacagagtttattagctcggcgttcccttcaggcacagctgcagagactaggagttttgcatgtgggacaaaagcttgaagaacaagatgagtttgagaagatttacaaaaatgcctgggccgataatgctaatgcttgtgccaaacagtatgcaggaaccggtgccttgaagactgactttacaagaactggaaaaagaactcagttgggactggtaatggatggcttcaactcattattacggtactacaagaacaacttttctgatggatttagacaagattctatagacttatttcttggaaactactcagtggatgaattagactctcacagtcctttaagtgttccaagggactggaaattcctggcgttgcctatcatcatggttgttgccttttcaatgtgcatcatctgtttgcttatggctggtgacacttggacagaaacactggcatatgtcctcttctggggagttgcaagcattggaacattttttattattctttacaatggcaaagattttgttgatgctcccagacttgtacagaaagaaaagatagactgaatttgtgtttgtggaaagcggcttggcttggaagactccatgatacagaactggagtctttactgacctgctttccacatgaaccccaaggtcttcttaaagcctttatccaaaagtacctcttgtgatttgggctgggtgatgtcttagaattgatctgatattactgctttgatgatctctttactgttgggatggttatatttataatttgaagctatagtataattaaaatgtagcttaaattcagctcacagaacagaagaaatctattcactgtcaagtcagaagttcacagataagtaatatattttaaaaaatttaacttctttcattatttaaaacaaaattatttttctagctctgtttcattatagtcactgttagcaagcattttttccatgtatctttgggcttttcttaagagtttaataatatgctaattctactatgcttagagaatgtctcttaaaggtcaggcagtttgctaagctgtgatttcacagtgagggagaggagaatgggatctagagtcatttgaaattgcttgagctgctagcagcttaaatgtcatgaaaagttcagatatattttatcttttttaaatggtataaatgaaatcaaagaatgtaaagtctgtctcttatgctaaaggtccaaagtcacctctttttaagaactgctccattgtggaaaatacactagactgccagctgctgcttctcatatcttgtaggattttattattggttgctcattgagacatgcagacctcagagaaggtcttgtgctagacttgattcacacttggggtagcagttgcttttcctgcatggcactctggctttatcaccctgacaaggtttgtattcactgtcaataagtgtctgaaatttagtgcttccaggtagccatagttctccaaatcaaggaccaactttaatttatgcataaacagactgaaaaccacgcttcagagctgtgcatagttgtgagacaggttatatattaaaattgtaattatgaggtttagatattagaacagtgtataaggtagtatcactgcgctatcttagaacaattcagttaaacactatgctatatcagtgttttgctttaaaatatgtggttttttttctaatagtaccttatgttaaatatttctaaaagcgcctttaacattacctttttttcaacattatcttttataaacaataagttattgcttttagaaactctgggaaaatcctgtgtagtttaaaatcagtcattaaagctcactatagggtagtaaatagagccgcctgctctgacacgtgtaagcagtttgttccaagatgaaacatgaagccacgtctgctgtgatgtgctattcagaagctgctgggcattttacagtgagcacttcatgccaacaccacgtggaaccagtagtgtggctgctttgcaaggagtaatgtcagagggttaggctgcaagtgatcagtgtttgagagccctgcagtgatcttgtttaactcatttactgtacatccatatgcaaaaataaaatgccatattcttttg

SEQ ID NO: 4053 - DNA, 2143 bp, Rattus norvegicus
  Genbank Accession No. NM_053799
ggagtctgggggcttaaaacaaggactgggagggccagcctgcgggagggagacgttttttagcctgtcctacggaagcctgcgagggagggtggtatccactcccccaatccagtgtcctgatgcccagcgccaacgccagccgtaagggtcaggagaagccgcgggagatcgtggacgcggcggaagattatgctaaagagagatatggggtatcctctatgatacaatcacaagaaaaaccagatagagtgttggttcgagttaaggatctgacagtacaaaaagctgatgaggttgtttgggtccgtgcaagagttcatacaagcagagcaaaagggaagcagtgcttcttagtcctgaggcagcagcagtttaatgtccaggctcttgtggcggtgggagaccatgcaagcaagcagatggtgaaatttgctgccaacatcaacaaagaaagtattattgacgtagaaggcattgtgagaaaagtaaatcagaaaattggaagctgtacacagcaggatgttgagttgcacgtccagaagatttatgtgattagcttggctgagcctcgcctgcccttgcagctggatgatgccattcggcctgaggtggaaggagaagaggacgggagagctaccgttaaccaagatacaagattagacaacagaatcattgaccttaggacatcaaccagccaggccatcttccatctccagtccggcatttgccatctcttccgagaaacgttaattaacaaaggttttgtggaaatccagactcctaaaataatttcagctgccagcgaaggaggagccaatgtttttactgtgtcttattttaaaagtaatgcctacctcgctcagtctccacagctatataagcagatgtgcatttgtgctgattttgagaaggttttctgcattgggccagttttcagagctgaagactccaatacccatagacatctgactgaatttgttggtttggatattgaaatggcctttaattatcattaccatgaagttgtagaagagatcgctgacactttggtgcaaatattcaaaggacttcaagaaaggtttcagactgaaatccaaactgtaaacaaacagttcccatgtgagccgttcaaatttttggagccaactttaagactggagtattgtgaggctttggctatgcttagagaagccggagttgaaatggacgatgaggaagatctgagtacaccaaatgaaaaactgttgggtcgtttggtgaaggaaaagtatgatacagacttttatgttcttgataaatatccattggctgtaagacctttctataccatgcctgacccaagaaatcctaagcagtccaactcttacgatatgttcatgagaggagaagaaatattgtctggagcacaaagaatacatgatcctcagttgcttacagagagagctttacaccatggaattgatttggagaaaataaaagcttacattgattccttccgctttggagcccctcctcacgctggtggcggcattgggttggaaagagtgacgatgctgtttttaggattgcataatgtacgtcagacctcaatgttccctcgtgacccgaagcgactcacgccttaaagccacactttttattctctctttgattagcttatacctgaggtacttaagatatgcagtagaattaatgcattactaaagtgccacaattattttttaagtagctcaatacgaattcatttaagtcaaaacgttttagaacttcagatatgcttaaataggaaatacttgaacattttaatgagaaatttctatggttgaaattcatagtctatcactataggaaatgttaaggacaatttaaacagtttaggattatataatttttttttcttttctatattgtggtgaccaccatactaatatcctaaattttcaatatttgaacttttaactcttgacattgagaaaaaaaaattggagaaattaccaagattttaacatatataaaactggtatgtcttaaaagttactttcagaaatcatgtaaagtatctgaaaacactggctagaagcagtaacactgaaaccttgttatcaattctgaggctgaaattcaataaaaacttaaagct

SEQ ID NO: 4054 - DNA, 330 bp, Rattus norvegicus
  Genbank Accession No. NM_053800
atggtgaagctgatcgagagcaaggaagcttttcaggaggccctggccgctgcgggagacaagcttgtggtagtggacttctctgccacgtggtgtggaccttgcaaaatgatcaagcccttctttcattccctctgtgacaagtattccaatgtggtgttccttgaagtagacgtggatgactgccaggatgttgctgcagactgtgaagtcaaatgcatgccgaccttccagttctataaaaagggtcaaaaggttggggagttctctggtgctaacaaggaaaagctcgaagccactattacggagtttgcctaatcatgctctgaa

SEQ ID NO: 4055 - DNA, 2243 bp, Rattus norvegicus
  Genbank Accession No. NM_053806
atgcggcggggcgcgctcctggctagcgccctggtcgcctacgccgggtacctggcgctcggcgcgctgcttgtggcgcggctggagcggccgcacgaagcccggctgcgggcagagctggggacgctgcgggagcagctgctgcggcacagcccgtgcgtggcggctcacgccctggacgccttcgtggagcgggtgctggcggcaggacggctggggcgcgcagtgctggccaacgcatcgggacccgccaacgcttcggaccccgcgtgggactttgcctcggcgctcttcttcgccagcacgctagtcaccaccatgggctatggctacacgaccccactgacggatgcaggcaaagccttctccatcgtttttgcactcctgggcgtgcctatcaccatgctacttctgactgcctcagcccagcgcctgtcactgctgctcacccacgcacccctgtcctggctgagcctgcgctggggctggcacccgcagcgggcagcccgctggcacctggtggccctactgatggtcatagtggctatatttttcctgatcccggctgcggtcttcgcctaccttgaggaggcctggagctttctggatgctttctatttctgcttcatctctctgtccaccattggcctgggggactatgtgcctggggaagccccgggccagccttaccgatccctctacaaggtgcttgtcacagcatacctcttcctcggccttgttgccatggtgctggtgttgcagactttccgccgtgtttctgacctccatggcctcactgaactcatcttgctgccggatcccgaccctgccaggctccaccaggatgaggatgaccaggtggacattctggatgcccggacagatctgcatcagcatctctctgctgcctcccacgctaattacgcctccatccccaggtagctgtcgacctggacacacctggcctgggctttgggccccatgtgattagatcaactagaaagcccactcacactctccactgggaggtgaggagtagccgctttgctcctgtgtcctccgctcctcagggccctgacacagtcattttctcctcctatcttttctcccatttcttctcagactctgaccgtttgggctttctgactttgtgagagtggtggtttctatgcctttttgtttygttttgttcttgttcttctgtatctcactctcttgcatagtacatctggcacatccagttcttctgggctccaaccctgggctccatttcagccagtgaggtaaactgaccgactggtcccttgacagtgacaagctccagtgggcaccagaagaggcaagagtagccaggactgaggagtgaacctgatatgttcagggttatctttcctggggacaggaactaacccaagacctgctagtcaagagaaaaaatagtcccttctcctcaggtgtctatgggccatagtacctgtgggaagaggcctgcaatgggccagcatctccctcagtgacttaacaggcaaggaactgacccaggatatgagccgagatccaagtggcatgagacaagcagcttagcgtagttcctgtggtgataccatgtcttttactgggcattgatagccgtgggctctggagccagtcttcctgggcgtgccctgtgactgggccatgtttcaccaatgcatttggacggtcactctacctttcagactctgtctcctaaatggtgaccataataacgcttactctaaaaggcgaactcaaccagtagcacatgcctgtaacctgagctgaagcaggaggcttgagagttcaaaggcaggagccaggcaataaaacaatgtaagcaataaaataataataatgatgahgawrawggtggtggtgatgatgatgatgatatgttcaatggaatatagtgccaggcttaaagggacatgagagtaggctatagaaggatgtataaccctcagggctgggacttattttatttatacaatatatcacttaaagattttggcaggggaaaaaaaaaagattttggcgggctggagagatggctcagcggttaagagcacccgaacgctcttccagaggtcctgagttcaattcccagcaaccacatggtggctcacaaccatctgtaaagagatctgatgccctcttctggtgtatctgaagacagctacagtgtacttatatataataaataaataaatcttcaaaaaaaaaaa

SEQ ID NO: 4056 - DNA, 774 bp, Rattus norvegicus
  Genbank Accession No. NM_053810
atgtctggctatcctaaaagctataatcctttcgacgatgatgtggaagacgaggacacccggccggcgccgtggaaggacgcccgcgacctgcccgacggccccgacgcgcctattgacaggcagcagtacctgagacaagaggtgttacgcagggccgaggctactgctgccagcaccagcaggtccttgtccctcatgtatgaatcggagaagatcggagtcgcctcttcagaggagctggtccggcagcgaggagtcctagaacacacggagaagatggtggacaagatggatcaggacttgaagatgagccagaaacatatcaacagcatcaagagtgtgtttggaggattcatcaactacttcaaatccaaaccagtagagcctccacctgagcagaatggcagcatcgtcccccagcccagcagcagattgaaagaagccataaatacaagtaaagatcaggaaagcaagtaccaagccagccacccaaacctcagaaggctacatgatgcagaactagactctgttcctgcttctactgtgaatactgaggtttacccaaagaactcaagccttagagcttatcaccagaagattgacagcaacctagatgagctgtctgtgggattgggccgcctaaaggacatagccttaggaatgcagacggaaatcgaggagcaggatgacatccttgaccggctaacaaccaaagtggacaagttagatgtcaatataaaaagcacagaaaaaaaggtgcggcaactctag

SEQ ID NO: 4057 - DNA, 3286 bp, Rattus norvegicus
  Genbank Accession No. NM_053814
gacatgtcggcggccaaggaaaacccgtgcagaaaatttcaggccaacatcttcaacaagagcaagtgtcagaactgcttcaagccccgcgagtcgcatctgctcaacgacgaggacctgacgcaggcaaaacccatttatggtggctggctgctcctggctccagatggcaccgactttgacaacccagtacaccggtcacggaaatggcagcgacgattcttcatcctttatgagcatggcctcttgcgatatgccctggatgagatgcccaccacccttcctcagggcaccatcaacatgaaccagtgcacagatgtggtggatggggaggcccgcacagggcagaagttctccctctgcatcctaacacctgacaaggaacattttatcagggcagaaacgaaggagatcatcagtgggtggttagagatgctcatggtatatcctcgaaccaacaagcagaaccagaagaagaaacggaaagtagagccacctacgccacaggaacctgggcctgctaagatggctgtcactagcagtagtggtggcagcagtggaagcagcagcagcagcagcagcagcagcattcccagtgctgagaaggtccccaccaccaaatccacactctggcaggaagaaatgagagccaaagaccaacctgatgggaccagcctgagtccagttcagagtcccagccaaagccaacctcctgctgcttgcaccccacgggaaacagggctagacagcaaagaagatgaaaacattttaagtggggaccgtgtggatggtggtcggaaagtacgggtagaaagcggctacttctccctggagaaggccaagcaggacctgagggctgaggaacagctgcccccactactctctccacccagccccagcaccccacacagcaggaggtcccaggtaattgagaaatttgaggccttggacattgaaaaggcagagcacatggaaaccaacatgctgattctgaccactccatccagtgacactcgtcagggccgcagtgagagacgggccatccctagaaagcgggactttgccagcgaaacccccacagctcctctctcagatgcttgtcccctgtctccacaccgaagagccaagtcattggacaggaggtccacagaatcctccatgacgcctgacctgctgaatttcaagaaaggctggctaaccaagcagtatgaggatggccagtggaagaaacactggtttgtcctggcagatcagagcctgagatactacagggattccgtggctgaggaggcagctgacctagatggagaaattaacttgtccacttgctatgatgtcactgagtatccagtccagagaaactatggctttcagatacataccaaggagggtgagttcaccctgtcggccatgacatctggcatacgacggaactggatccagaccattatgaaacatgtgctcccaacatctgccccagatgtgaccagctcattgcctgagggaaagaataaaagcacatcttttgatacctgcttaaggccaagtgagaagcaagaagctgagccaggagaaccagatcctgagcagaagaaaagccgtgcacgagagcggaggcgggagggtcgctccaagacctttgactgggctgaattccgccccatccaacaggccctggctcaagaaagggccagcactgttgggtcttctgattctggtgaccctgggtgtctggaagccgagccaggtgagctggagcgtgaacgagctcgacggcgagaagaacgccgcaagcgctttgggatgctggacaccaatgatggaccaggaatggaggatacagccctacgtatggacattgaccggagcccagggctgctgggaacccctgacctcaagacacagaatgtccatgtggaaattgagcagcggtggcaccaagtggagaccacccctctcagggaggagaaacaggtgcccattgcccctctgcacctatccttagaggacagaagtgagcggctctccacacatgagctcacctctctgctagagaaggagctggagcagagccagaaagaagcttcggatcttctagagcagaatcggcttctgcaggaccagttaagggtggccctgggcagagaacagagtgcccgggagggctatgtgctgcaggctacatgtgagcgaggctttgccgccatggaggagacacatcagaagaagattgaagatctacagaggcaacaccagcgggagctagagaagctgcgggaggaaaaagaccgtctcctggctgaggagacagctgccaccatatcagccattgaagccatgaagaatgctcaccgagaggagatggaacgggagttagagaagagccagcggtctcagatcagcagcatcaattcagacatagaagccctgaggcgacagtacctggaggagctacagtcagtgcagcgagagctggaggtcctttccgagcagtactctcagaagtgcctggagaatgcacacctagcccaggcgctggaagctgagcggcaagccctgcggcagtgtcagcgtgagaaccaagagctcaatgcccacaaccaggagctgaataaccgcctggctgcggagatcacacggttgcggacactgctgactagagaaggtggtggggaatccactgggttgcctctcacacagggcaaggatgcctatgagttagaggtcttgttgcgggtcaaagagtcagaaattcagtacctgaaacaggagatcagctctctcaaggatgaactccagacagccctgcgggataagaagtatgcgagcgacaagtacaaagacatctacacagagctcagcatcgcgaaggccaaggctgactgtgacatcagcaggctgaaggagcagctgaaagcagccacagaggcactgggcgagaaatctcctgaaggcactactgtgtcaggatatgacataatgaaatctaaaagcaatcctgacttcctgaagaaagacagatcctgtgttacccggcaactcagaaacatcaggtccaagtccgtaattgagcaggtctcatgggataactgagtcgcgcccgcttccaagtcccctgtcgtagtctgaaggaaggcctgacggtgcaggagcgcttgaagctctttgaatccagggacttgaagaaagattagctgcatccattccactgacacatccttcccagctggtggcagcacaagccaagagtgggtttcatctgtgctttctcattgttgctgtcata

SEQ ID NO: 4058 - DNA, 2558 bp, Rattus norvegicus
  Genbank Accession No. NM_053818
ctcttgaggcctcttgtctgagaggcactgaacgcaggagtctgcaggtgtggtccagatctccagatcccccaacccactgccaccatggtaggaaaaggtgccaaagggatgctgaatggtgctgtgcccagcgaggccaccaagaaggaccagaacctcacacggggcaactggggcaaccagatcgagtttgtactgacgagcgtgggctatgccgtgggcctgggcaatgtgtggcgtttcccatacctctgctatcgcaacgggggaggcgccttcatgtttccctacttcatcatgctggtcttctgcggcattcctctcttcttcatggagctctccttcggccagtttgcaagccagggctgcctgggggtctggaggatcagccccatgttcaaaggcgtgggctatggtatgatggtggtgtccacgtacatcggtatctactacaacgtggtcatctgcatcgccttctactacttcttctcgtccatgacgcatgtgctgccctgggcttactgcaataatccctggaacacacctgactgtgccggtgtgctggatgcttccaatctcaccaatggctcccggcccactgccctgtctggcaacctgtctcacctgttcaactacaccttgcaaaggaccagccccagtgaggagtactggaggctgtatgtgctgaagctgtcggatgacattggagattttggagaagtgcggcttcctctcctaggctgccttggcgtctcctgggtggttgtcttcctctgcctcattcgaggagtcaagtcttcagggaaagtggtgtacttcacggccacatttccctatgtggtgctgaccattctgtttgttcgtggagtgaccctggaaggagccttcacgggtatcatgtactacctgaccccaaagtgggacaagatcctggaggccaaggtgtggggggatgcagcctctcagatcttctattccctgggctgtgcatggggtggcctcatcaccatggcatcctacaacaaattccacaacaactgctaccgggacagcgtcatcatcagcatcaccaattgtgctaccagtgtctatgctggcttcgtcatcttctctatcctaggcttcatggccaatcacctgggtgtggatgtgtctcgggtggcagaccacgggcccgggctagctttcgtggcttaccccgaggctctcacactgcttcccatctccccgctctggtccttgctgtttttcttcatgctcatcctgctgggactcggtactcagttctgcctcctggagaccctagtcactgccattgtggatgaggtggggaatgagtggattctgcagaagaagacctacgtgaccttgggtgtggctgtggctggcttcttgctgggtatccctcttaccagccaggcgggcatctactggctgctgttgatggacaactacgcagccagcttctccttggttgtcatctcctgcatcatgtgcgtgtccatcatgtatatctatgggcaccggaactacttccaggacattcagatgatgctggggttcccaccgcctctcttcttccagatctgttggcgttttgtctctcccactatcatctttttcattctcatcttcacggtgatccagtaccggccaatcacttacaaccactaccagtacccaggctgggctgtggccatcggcttcctcatggctttgtcgtctgtcatctgcatcccattgtacgcattgttccagctctgccgcacagatggggacacacttcttcagcgtttgaaaaatgccacaaagccaagcagagactggggccctgccctcctggagcaccggactgggcgctatgcccccactacaaccccctctcctgaagatgggtttgaggttcagccactgcacccggacaaggcccagatccccatcgtgggcagtaacggctccagccgcctccaggactcccggatatgagcacagttgttgcaaggggagaagccccacccaacccttgctcctaccacagagactgaggaggtggtggaccggtgtgactgcctgccccatcatgccctggccagggtggctgctgtcaccttggccaccactgctcatgtccccagtgtttacacatcctttggatgccaagacagcagctgggggtggaaaagtgatgggggtgggggggaggtgcgtgggggtggggcatggggcggcagtgtccaaagcactttggaggaggtctcaggccatgtccccagaggcttccaggcttcattatccctcatgctctgccctgagctgtttcactacgggataagaggttttgtttccacaccccacctgttcccctccagcctcatgaccagtgttcctgaccccagaacagaccctagcctcttgcccaggcaaatctgtatcttcctgctccggacaaggtgaggcgcccgggggctgtacagtgttacttgttggactgcaccactcagccctgtttatttgtgtaattatttttttaaaaaattgtattacctgtggttgcc

SEQ ID NO: 4059 - DNA, 2074 bp, Rattus norvegicus
  Genbank Accession No. NM_053821
cggcggctccctcagctcctcatctgggccatctgtccgtgtgtcgctgcctcagaccagcaggatggctgccaacaaaggcaagagccagggctccctggtccttcacaaggtcatcatggtcggcagtgggggagtcggcaagtcagccctgacgctccagttcatgtatgacgagtttgtagaagactatgagcccaccaaagccgacagttacagaaagaaggtggttctcgacggagaagaggttcagatagacatcctggacacagccggccaggaggactatgcggccatccgtgacaactacttccgaagcggagaaggctttctgctggtgttctccatcacggagcacgagtctttcaccgccacagccgagttcagggaacagatcctccgagtcaaggccgaggaggacaaaatccctctgctggtcgtgggcaacaagtctgacctggaggagcggaggcaggtgcccgtggaggaggcccgaggcaaagcggaagagtggggtgtgcagtatgtggagacatccgcaaagacccgagccaacgtggacaaggtgttctttgatctgatgagagaaatccgggcaaagaagatgtcggaaaacaaggacaagaacggcaggaaaagcggcaagagcaagaagagtttcaaagagcggtgctgcttgctgtgagcgggccgcggacagagcgagcggagaaggccacattgcagcgcgccgagcccaggtggcctccccctggctccccgtctccagcagctgtaattcactatcacttcttgaagatggacagatacctgtgcaaaccagtggctggcaggagaaagacgcacttcgtctgtgcgtctgtgcgatgcatctgctaacgttgccaggagctttgagagtctgccccctcccaccctccctgaaccgtgactgtcaccagactctagggtcaggaatctgagttgtgttgacaagaaagaggattgccacggcggcttgtccccccctgttctaggacatggtcatcttttgttggaaaatcaaaatgcttcacattagcagggcgtgctggtgcacccctgtagtcccagaactctagaaggtaaggcagggagggtagcctgagcccaaggccccaaggcctgggctacctagcaagaccctgtctctaaaaggaaaaagaactaacatcttattttcttagatttaaaaagagggtctctggcaagacccctcgttagttcttatcagtttagaagtagacagggggcggaaaacctaagctcaggtaatactgaaaaagccaaaacaatttgttttttttttttttttctgttttaaaagataaacttctgtgacttggaagcagaattagaaagatgaacttcacttggtccagataggctgaaccaagcctcctggcgtttgtagagaagtgggacgctgttcccttcatacttaaatgccagccaggtgctggctgtgggcttccctccctaacacccttacttagtagtgaggaaactttgtgtgggggagatgtagcctgtgccccagaacaagctttcttttttctgactggatcatctcaccttttctggttccctcccactccagccataggcctgttctttttcttcctttctgaaaaatgtgaccagttcaaattatgtcccaggacacgggccagcgccagctacctctgcagactctacaagcggaagaggggaaggctcagaagggagggccatctcctgtagctcccggcagttggttctggtgacactgacatgaaccaggttccagaggctcacacccactctctgttaagcctcctctcggggaaggggactctgggactgggggctgccactgagcacacacactcctcccattttccagaagtgaacatttcacttttggtgccgaatgtgaatctgggtgggaagagcgggagcccttctaatggatttttttttacagagttatggaatccaaggtctgatccctggaaacttgtgtcacttccaaagaatcatgggctttttcgaattaaaaaaaattacacttttc

SEQ ID NO: 4060 - DNA, 2180 bp, Rattus norvegicus
  Genbank Accession No. NM_053824
gggttcttccttcatatgccagctagagagccttgcctccctggagctcatagtccaggctgtgttctggggacctgaggggtgtggtcagggcacagagactctctcagagcactgggagtgggattcctgctgtaagggaagggatgtcataggtcagttgaccaatgaccagacctaaacatggctcccagccttaggcatgcggagcctaggagtcccttcaaccctggcctgtgatttttccagctcagatgacaaagacatctaggcccagtgtcttgagaatccctatagtcaaggattagagtcctcctcagtgagtcagctcccccagtcagtaccctcacaagatatcaaccgaattcggtttttttttttttttttttttaaatatgtaaggctttcaatttattacagatcacccaagaacataatgatatacatgtagtcagaaaacacgatgtagaaatcatagtgagttgtccagacatagtcagtagattattctttctggcatgctccagtgtcaagacctcaataaagagcactaaaatccttccatacaattaagtatcagcgatgtaccatattgcagaaaggggtggctgagcaacagtttgttgatactataagacttccatgctcaacagtcgtagcgttgcactcagcacagctctggtttccatatacaaattttccatctcgtaggggagcgcggctagtgccgctgccgcttccaccgcagtaactgccagatcttccaacatcacgttcagctttgtccgtcaacctgtctgacatgtcgggacccgtgccaagcagggccagagtttacacagatgttaacacacacagaccccgagagtactgggactatgaatcacatgtggtggaatggggaaatcaagatgactaccagcttgttcgaaaattaggcaggggcaaatacagtgaagtgtttgaggccatcaatatcacaaataatgaaaaagttgttgttaaaattctcaagccagtaaaaaagaagaaaattaagcgtgaaataaagattttggagaatttaagaggtgggcccaacatcatcacacttgcagacattgtgaaagaccctgtgtctcgaacccctgccttggtttttgaacatgtaaacaacacagacttcaagcaattgtaccagacgttaacagactatgacattcgattttacatgtatgaaattctgaaagccctggattattgtcacagcatggggattatgcacagagacgtgaaaccgcataatgtcatgattgatcatgagcacagaaagcttcggctaatagattggggtttagcagagttttaccatcctggccaagagtataatgtccgagttgcttcccgatatttcaaaggtccagagctacttgtagattatcagatgtacgattatagtttggatatgtggagcttgggttgtatgctggcaagtatgatcttccggaaggagccatttttccatggacatgacaattatgatcagttggtgaggatagccaaggttctgggaacggaagatttatatgactatattgacaagtacaacattgaattagatccacgtttcaacgatatcttgggcagacactcccgtaagcgatgggaacgctttgtccacagtgaaaaccagcaccttgtcagccccgaggccttggattttctggacaagctgctgcgatacgaccaccagtctcggctcactgcaagagaggccatggagcacccttacttctacactgtcgtgaaggaccaggctcgaatgagttcggctggcatggcagggggcagcacacctgtcagtagcgccaatatgatgtcagggatttcttcagtgccaaccccttcacccctgggacctctggcaggctcacccgtgattgctgctgccaactcacttgggatacccgtaccagctgccgctggcgctcagcagtaatgaccccatctgtcttctgatgcctgggcagaggtgggacgtccaccctctccttaatgcagcttgcgcctggttgggaggggtgagaacacttcagaagcaccgtgtctgaaccgttgcttgtggatttagtagttgagtcataaaaaaaattataggctgattttctttcttttttttttttttttttttaaaaaaaccg

SEQ ID NO: 4061 - DNA, 1507 bp, Rattus norvegicus
  Genbank Accession No. NM_053826
attccggagctccggctcctccggcggggctcggtatgaggctggcaaggctgctgcggggcggcacgagcgtcaggccgctctgtgccgtcccctgcgccagccgtagtctggcctcggactcggcctcgggctccgggcccgcgtcggagagcggcgttccgggccaggtggacttctatgcgcgcttctcgccgtcgccactctccatgaagcagttcctggacttcgggtcagtaaatgcttgtgaaaagacctcgttcatgtttcttcgacaagagttgcctgttagattggcaaatataatgaaagaaataagtctccttcccgataatcttctcaggaccccatccgtacagctggtacaaagttggtatatccaaagccttcaggagctgcttgactttaaggacaagagtgctgaggatgctaaaactatttatgaattcacagacacagtgataaggatcagaaaccggcacaatgatgtcatccccaccatggcccagggtgtgactgaatacaaggagagcttcggggtggatcctgtcaccagccaaaatgttcagtactttttggatcggttctacatgagtcgcatctcaattagaatgctactcaaccagcactctttattgtttggtggaaaaggaagtccatctcatcgaaaacacattggaagcataaatccaaactgtgatgtagtcgaggttattaaagatggctatgagaatgcgagacggctttgtgatttgtattacgttaactctcctgaactagaacttgaagaactaaatgcgaaatcaccaggacagccaatacaagtggtttatgttccgtcccatctctatcacatggtgtttgaactgttcaagaacgcaatgagggccaccatggagcaccatgcagacaaaggcgtttatcccccgattcaagttcacgtcacactgggggaggaggatttgactgtgaagatgagtgaccggggaggtggtgttccgctgaggaagatcgacagactcttcaactacatgtactcaactgcaccccggcctcgtgttgagacgtcccgtgcggtgcccctggctggatttggttacggattgcccatatcacgcctctatgcacagtacttccagggagacctaaagctgtattccttagagggctacgggacggatgctgtcatctatattaaggctctgtcaacggagtccatcgaaagactccctgtgtataataaagctgcctggaagcattacagaaccaaccacgaggctgacgactggtgtgtgcccagcagagagccgaaagacatgacgacgttccgaagctcgtaactgcacatgggacgcctggcaaagccaaatgtggtttttgccaaacttggaagagagatgtatttggaaccacattgtaccaaatatgtcatgtgtgatttttcacaatcagtgtttgctaaagctcctaaaggatcaattatagcaactttattcaaaaaaaaaaa

SEQ ID NO: 4062 - DNA, 2987 bp, Rattus norvegicus
  Genbank Accession No. NM_053827
gttgcccaaagaaataaatgcattgggaactcagtgtgcaggtccatgccaccaagagaacattacttctggtgatcgtcttctcccaagctccacagtttagctttgtttcagtgccggcggatcgtctccaagactcgactatgcggtccctgctgctcctggcctcgctggcctggcttcttctggcccaggcgaaggacgacgccaagctggaggacaaccttttggtcctcaccgtggccacaaaagagacagagggcttccgccgattcaagcgctcagcccagttcttcaactacaagatccagtcactgggcctgggggaggactggagcgcggccgggggaccatcggcagcaggtggaggacagaaggttcggctgctgaagaaggcactgaaaaagtatgcagacaaggaagacttggttattctcttcgttgacagctatgacgtggtgtttgcctcgggaccccgggaactcttaaagaagttccagcaggccaagagccgggtggtcttctcagcagaggagcttatctaccctgaccggaggctggaggccaagtatcccacagtccccgatggcaaacgattcttgggctctggaggcttcattggttatgctcccagcctcagcaaactggtggccgagtgggagggccaggacaatgacagcgaccagctcttttataccaagatcttcttggacccggagaagagggagcaaatcaatatcagcctggaccatcgctgccgaatcttccagaacctggatggagccttggatgaagttgtactcaagtttgaaatgggccacgtgagagcccggaatctggcctatgacaccctcccagtggtcatccacggcaacgggcccaccaagctgcaggtgaactacctgggcaactacattcctcgattctggaccttcgaaacgggctgcaccgtgtgcgacgagggcctgcgaagcctcaagggcattggggatgaagctctccctaccgtcctggtcggtgtgttcattgagcagcccacaccattcctatccttgttctttcggcggctgctgcacctacgataccctcagaaacagatgcggctcttcattcacaaccaagaacagcaccacaagcttcaggtagagcagttcctggcagagcacggcggtgagtaccagtctgtgaagctagtgggtcccgaggtacgcatggccaacgcagacgccaggaacatgggcgccgacctgtgccgccaggatcaaacatgcacctactacttcagtgtggatgctgacgtggccctgaccgagccgaacagcctacggctcctgattgagcaaaacaagaatgtcattgctccactcatgacccgtcacgggaggctctggtccaacttctggggggcactgagtgcggatgggtactacgcccgctcggaggactacgtggacatcgtgcagggccgtcgtgttggcgtctggaatgtgccttacatctcaaacatctacctgatcaagggcagtgccctgcgggccgagctgcggcacgtagacctgttccactacagcaagctggatcctgacatgagtttctgcgccaatgtccgacagcaggaggtgttcatgttcctgaccaaccggcatacctttggccacctgctgtcgctggataattaccagaccacccacctacataatgatctctgggaggtgttcagcaaccctcaggattggaaagagaagtacatccacgagaattacaccaaggccctggcagggaagctggtggagacgccttgtccggatgtctactggttccccatcttcacggaggtggcctgtgatgagctggtggaggaaatggaacactacggccaatggtctctgggtgacaataaggacaaccgtatccagggtggctatgaaaacgtgcccactattgacatccacatgaaccagatcaccttcgagcgggagtggcacaagttcctggtggagtacatcgcccccctgacagagaagctgtaccccggctactacaccaaggcccagtttgatctagccttcgtcgtccgctataagcctgatgagcagccttccttgatgcctcaccatgacgcctctactttcaccatcaacatagccctgaacagggttggggaagattatgagggtggaggttgccgatttctacgctacaactgctccgtgagagccccaaggaagggctgggccctcatgcaccccgggcggctcacacactaccacgaggggcttcccactaccaagggtacccgctacattgccgtgtccttcgtcgatccctaactgcttgcccagtgcctgcttccattcgacctatctcttcattgacaaccactgcctagcagcctctggggccaaggaacccaatccgacctctgattcctgaattcctgttgctcttgaagctgccagttggaaggattgggtgcaggccagaaatggggcaccccctccaagactggggctgcccgtggtgctcccaccagtctccggagatggtagcaatgtttatcttcctggagttcctaacctcccttcttctctgactttccctggggccagacttctgctggagagttcctggagagtcagaagctttgcctagaggacttctagaagagctagcccccgggatcctgtttcaagattcagtgccaccaagatctgggtcaaccaacttaccccaacttcacccctgcctggactgttgatacgctctcttccaggtttttatcaccggagcaaatagttgtctctattgagactataactcgaaatcctcccggaggggcaggaaagacatctgtgacaatgcttggctcgctgctgaccctgcttgagggaggggcacatgttcacactgtactaggtcaccctgccccgatgcctgtggggacagggacagagatgagagttctattaaattttgttcaaaccaaa

SEQ ID NO: 4063 - DNA, 982 bp, Rattus norvegicus
  Genbank Accession No. NM_053835
gggagctgacagcagccacgcggggaagatggctgaggacttcggcttcttctcgtcgtcggagagcggggcccccgaggccgccgaggaggacccggcggccgccttcctggcccagcaggagagcgagattgctggcatcgagaatgactcgggtttcggggcacctgccgccagccaggtggcctctgcgcagcccggactcgcgagcgggggtggttcggaggacatggggactacagtcaatggagatgtgtttcaggaggctaacgggcctgccgatggctacgctgcgattgcccaggcggacaggttgactcaggagcctgagagcatccgcaagtggagagaggagcagaagaaaaggctgcaggagttggatgctgcctcgaaggtgaccgaacaggagtggcgggagaaggccaaaaaagacctggaggagtggaaccagcgccaaagtgaacaggttgagaagaacaagatcaacaacaggatcgctgacaaagcgttctaccagcagccagatgctgataccattggctatgtggcatcggaagaggcttttgtgaaagaatccaaggaggagaccccaggcacagagtgggagaaggtggcccagctgtgtgacttcaaccctaagagcagcaagcaatgtaaagacgtgtcccgcctgcgctcggtgctcatgtccctgaagcagacgccactgtcccgctagtgcctgtcaccacgggccttggtggggcagagcagcagctgcttcagccagggtggaacttctctggcagctgccacacacgcctgttctgttcctctgagtctctgggagctgggaagcgggacccttacccctttcacccaccctgtccttcctggtcccctgttccagcccctcatgactcctgtcagtccacttgattgtgactgtccctcctgatgtatttttcttggcttaaagggtgtgttaactctttttacactt

SEQ ID NO: 4064 - DNA, 3469 bp, Rattus norvegicus
  Genbank Accession No. NM_053838
ggcgcttgtgcctgcccagtaggccagagcagcccctggttcgggggaccgtgggtcagctgctctatccccatggcactgccatccctgctactggtggtggcagccctggcaggtggggtgcgtcctccgggggcacggaacctgacgctggcggtggtgctgccagaacacaacctgagctatgcctgggcctggccacgggtgggtcctgctgtggcactggctgtggaggcgctgggccgggcactgcccgtggacctgcggtttgtcagctccgaactagacggcgcctgctctgagtacctggcaccactgcgcgctgtggatctcaagctgtaccatgaccccgaccttctgttgggccctggttgtgtgtaccctgctgcctctgtggctcgctttgcctcgcactggcaccttcccctcctgactgcgggtgcagtggcctctggctttgcagctaagaatgagcattatcgtaccctggttcgcactggcccctctgcgcccaagctgggtgagttcgtagtgacattacacgggcacttcaattggactgctcgggctgctttgctgtatctggatgctcgcacagatgaccggccccactacttcaccatcgagggggtgtttgaggccctgcagggcagcaacctcagtgtgcaacaccaggtgtatacccgagagccaggtggccctgagcaagccacccacttcatcagagccaacgggcgcattgtgtatatctgcggcccgctggagatgcttcatgagatcctgcttcaggcccagagggagaacctgaccaatggggactatgtcttcttttaccttgatgtctttggggagagtctacgagcaggccccacacgtgcgacaggccggccatggcaggacaatcgaacccaggaacaagctcaggccctcagagaggcctttcagactgtcctggtgatcacgtaccgagagcccccgaatcccgagtatcaggagttccagaaccgcctgctgatcagagcccgggaagacttcggcgtggagctggccccatccctgatgaacctcattgcgggctgcttctatgatggaatcctgctctatgcccaagtcctgaatgagacaatacaggaagggggcacccgggaagatggacttcgaattgtggagaagatgcagggacgaagataccatggtgtaactggactggttgttatggacaagaacaatgacagagagactgatttcgtcctgtgggccatgggagacttggagtctggcgactttcagcctgcagcccattactcaggagctgagaagcagatttggtggacaggccggccaattccctgggtgaagggggccccacctttggacaaccccccctgtgcctttgacttggacgacccatcctgtgataaaactccactttccactctggcaattgtggccctgggcacgggaatcactttcatcatgtttggtgtttccagcttcctaattttccgaaaactgatgctggagaaggagctggctagcatgctgtggcgcattcgctgggaagaactgcagttcggcaactcggatcgatatcacaaaggtgcaggcagtcgcctgacgctgtcgctgcggggatccagttacggctcgctcatgacagcccatgggaaataccagatctttgccaacaccggtcacttcaagggaaatgtcgttgccatcaaacatgtgaataagaagcgcattgagctgacccggcaagttctgtttgaactcaaacacatgagagatgttcagttcaaccatcttactcgattcatcggagcttgcatagaccctcccaacatctgcatcgtcaccgagtattgtcctcgggggagcttacaagatattctagaaaatgacagcatcaatttggactggatgtttcgctactcgctcattaatgaccttgtgaagggtatggcctttctccacaacagcattatttcatctcatggaagcctcaagtcctctaactgcgtggtggatagtcgatttgtgctcaaaataacggattacgggctggctagcttccgatcaactgctgaaccagatgacagtcatgccctctatgccaagaagctgtggactgctccagaacttcttagtgggaaccccctgccaaccacgggcatgcagaaggcggatgtctatagctttgccatcattctgcaggaaatagcgctccgcagtggtcctttctacttggaaggcctggacctcagtcccaaagagattgtccagaaggtgcgaaatggtcagaggccgtatttccggccaagcattgaccggacacaactgaacgaagagttagttttgctgatggagaggtgctgggcccaggacccaacagaacgtccagactttgggcaaatcaagggcttcattcgccggtttaacaaggagggtggtaccagcatattggacaacctcttgcttcgcatggaacagtatgccaataacctggaaaaactggtggaggagcgcacacaggcctacctagaggagaagcgcaaggctgaggctctgctgtaccaaattctaccccactctgtggcagagcagttaaaacggggagagacggttcaggcggaggcctttgacagtgtcactatctacttcagtgacatcgtgggcttcacagcgctgtcagctgagagcacccccatgcaggtggtgacacttcttaatgacctttatacctgctttgatgccataatcgacaactttgatgtctacaaggtggaaaccattggggatgcctacatggtggtatctggccttccgggccgaaatggtcagcgccatgcaccagaaattgctcgaatggctctagcattactagatgcagtttcttccttccgcattcgccatcgaccccacgaccagctaaggttacgcataggcgtccatactgggccagtctgtgctggggttgttggcctgaagatgccccggtactgtctttttggagacacagtaaacactgcttctcgaatggagtctaatggtcaagctctaaagatccatgtctcctcgaccaccaaggatgccctggatgagctaggatgcttccagctagaactccgtggggatgtggagatgaagggaaaaggaaaaatgcgaacttattggctcttaggagagcgaaaaggacctcctggactcctgtaaatcccaagcagacaatttcttgctgttggtacttggatgggcaatggtcactgtgtctccacttgacagaaacagacgtcatatgagatggaaaatatgcatatacacaatccccctgccttatctggaagtcatataagccctctgccgctcagccttgtacatatgcctgcccctccctatcttggtcctcttcctgccttctgtaaatacctgtatctagaccagaatattttgtccaagtataaaacaa

SEQ ID NO: 4065 - DNA, 1467 bp, Rattus norvegicus
  Genbank Accession No. NM_053842
ccgtggttctaccggcggttagttctctcttctgtgttgtcctccctcctcgttcccgatcgccgccagccggctacacgggcggcggcgcggttcctgtgggaagcgcagcacaagtcgagcggtaacgcgaagcgtcgagcccaacgcggcggaggctgtgcagccaacatggcggcggcggcggcggcgggcccggagatggtccgcgggcaggtgttcgacgtggggccgcgctacactaatctctcgtacatcggagaaggcgcctacggcatggtttgttctgcttatgataatctcaacaaagttcgagttgctatcaagaaaatcagtccttttgagcaccagacctactgtcagagaaccctgagagagataaaaatcctactgcgcttcagacatgagaacatcatcggcatcaatgacatcatccgggcaccaaccattgagcagatgaaagatgtatatatagtacaggacctcatggagacagatctttacaagctcttgaagacacagcacctcagcaatgatcatatctgctattttctttatcagatcctgagaggattaaagtatatacattcagctaatgttctgcaccgtgacctcaagccttccaacctcctgctgaacaccacttgtgatctcaagatctgtgactttggccttgcccgtgttgcagatccagaccatgatcatacagggttcttgacagagtatgtagccacgcgttggtacagagctccagaaattatgttgaattccaagggttataccaagtccattgatatttggtctgtgggctgcatcctggcagagatgctatccaacaggcctatcttcccaggaaagcattaccttgaccagctgaatcacatcctgggtattcttggatctccatcacaggaagatctgaattgtataataaatttaaaagctagaaactatttgctttctctcccgcacaaaaataaggtgccgtggaacaggttgttcccaaacgctgactccaaagctctggatttactggataaaatgttgacatttaaccctcacaagaggattgaagttgaacaggctctggcccacccgtacctggagcagtattatgacccaagtgatgagcccattgctgaagcaccattcaagtttgacatggagctggacgacttacctaaggagaagctcaaagaactcatttttgaagagactgctcgattccagccaggatacagatcttaaattggtcaggacaagggctcagaggactggacgcgttcagatgtcggtgtccccccagttcttgaccctggtcctgtctccagcccgtctcagcttacccactcttgactcctttgagccgttccgaggggcagtctggtcgtagtggcttttatactttcacggaattcttcagtccagagagttctcctgcaccaggccctgcacagttgcactcag

SEQ ID NO: 4066 - DNA, 1318 bp, Rattus norvegicus
  Genbank Accession No. NM_053843
acctcatcagactctgacccagttcttgaatgactttggagacccagatgtttcagaatgcacattctggaagccaatggctactcccaccactgacaatgttgctgctgtttgcttttgcagacaggcagacggcaaatcttccgaaggctgtggtgaaacgtgatcccccatggatccaggtgctcaaggaaggcactgtgacgctgacgtgcgaagggacccacaatcctggaaactcttctacccagtggttccacaaccagagctccacctggggccaggtccaagccagctacacgtttaaggccacagtcaatgacagtggagaataccggtgccgaatggcgcacaccagcctcagcgaccccgtacatctggaagtgatttctgactggctgctgctccagacccctcaactggtgtttgaggaaggggaaaccatcacattaaggtgccatagctggaagaacaaacagctgactaaggtcttgttgttccagaatggaaaacctgtgaggtattattatcaaagcagcaatttttcaatccccaaagccaaccacagtcacagtgggaactactactgcaaagcatatctaggaaggacaatgcatgtgtccaagcctgtcaccatcactgtccaaggttcagcaacggcatccaccagctctctagtgtggttccatgccgctttctgcctagtgatgtgcctcctgtttgcagtggacaccggcctgtatttctgtgtacggagaaatcttcaaacctcgggggaggactggaggaaatccctgtcagtcggaaagtacaaggctccacaggacaaatgacatcccatcgtatggctaaacagcggcagcttcttttcagccacaccgccgcttcatctacagccttcctttgaaagcaacttaccaccaggctggatatttggtcctgcaatcacaactgctaggaggctgaggcaggagggtcaccaaaggctgcccgggttttagagaagagagagtgcaagtctatcctggataacccaataagaccctgggtttagatggcttatcaggaaagagcacccattgctaagctcacagacaagaccacagattgatccctaaggacacagggcaaagggagagaacaaattcctgaaagttgtcctctgacctccacacgtccaccatggcagatgcacacaataaacaaattaaaatgtaatatatatattttaaacaagaggtggggaaaggctgggggttggtggcacagtttttatccaggacacatgatgctctggattttgacctcctataataaa

SEQ ID NO: 4067 - DNA, 1420 bp, Rattus norvegicus
  Genbank Accession No. NM_053845
gtgggacttcagatcctgcaactgcctctggccatggcgggacctgagtggcagtccctggagcagtgcctggaaaagcatctgccgcctgacgatttgagccaggtgaagcgaattctctacggcaagcaaactaggaatcttgatctgcccagaaaagctttagaagctgcctcagaaagaaacttcgaactgaagggatacgccttcggggcagccaaggaacagcagagatgtccccagatcgtgcgcgtggggctcgttcagaacagaatcccgctccccacttccgcccctgtggcagaacaggtctctgccctccacaaacgcatagaggaaatagctgaggtggcagcaatgtgcggagtcaacatcatctgtttccaggaagcctggaatatgcccttcgctttttgtacacgagagaaacttccttggacagaatttgctgagtcagcagaggacgggctcaccaccaggttctgtcagaagctggcaaagaagcacaacatggtggtgatatctccaatcttggagcgtgacagagatcacgggggagttctatggaacacagctgtggtgatctccaactcgggactggtcatgggaaagaccagaaagaatcacatccccagagtgggcgacttcaatgagtccacttactacatggagggaaacctcggccaccccgtgttccagacccagtttggcaggattgccgtgaacatctgctatgggcggcaccaccccctcaactggctcatgtacagcgtcaacggagctgaaatcatcttcaacccttcagccaccattggagaactcagtgagtccatgtggccgatcgaagccagaaacgcagccatcgctaatcactgcttcacctgtgccctcaaccgtgtgggtcaggaacactaccccaatgagtttacttctggagatggaaagaaagctcaccatgacctcggctacttctacggttcgagctacgtggcagctcctgacggtagccggacccccggcctctcacgcaatcaggacgggctgctggtcactgagctcaacctcaacctatgccagcagattaatgatttctggactttcaagatgacgggccgacttgagatgtatgcccgggagcttgccgaagctgtcaaacccaactacagtcccaacattgtgaaggaagacctggttctagcccctagctcgggttaggttcgggggcagtggttaagttctaaacatgtgtgcgagagagttttcaatacccaggcaggaggagggtagactgggcaagcgtgtgtgtgataactgttgataagggatatgagatttttcttctggggatttggaaatgttttggggttcaaaaggtgatccgacagcattgaaacttcaataaacataactggatcgtaaa

SEQ ID NO: 4068 - DNA, 2398 bp, Rattus norvegicus
  Genbank Accession No. NM_053849
atggcgaaggctgtgtgatgctcatagggagaagaagatgttgatgtattgattgatgaccagctcccggtataggctgaaggctcaggctgcggggtggggccggtgtggcggggcgccaccgtctcgccctgattcgtgcggggattggacggctgcggcttccttgcctctaaccaatcaccgggctgaacttcctggaggttttggtgcgctccagcgtcgcttgggaggtcggcgagtgcttcgctgtggtgggtgtctgcaggcctccctcggcaccttaccatgaagctccggaaagcttggctgttggtcctgctcttggcgctgacacagctgctggctgctgcgagcgccgaagatgcgcacgaagatgcttcagattcagaaaatcccattgaggatgacgacgaggaggaggaagatgaagaagatgaagatgacttggaagttaaggaagaaaatggtgtttgggtcctaaacgatgaaaacttcgataactttgtggctgacaaagatacagtgctcctggagttctatgcaccgtggtgtggacactgcaagcaatttgctccagaatatgagaaaattgccagtactttgaaggataatgatcctcccattgctgttgcaaagattgacgcgacctcagcatccatgttggccagcaaattcgatgtgagtggctaccccaccatcaagatcctgaagaagggacaggctgttgactatgacggctccaggacccaggaagaaattgttgccaaagtcagagaagtttcccagcctgattggacacctccacctgaagtcactcttacattgactaaagagaactttgacgatgttgtaaataatgcagacatcattttggtggagttctatgccccatggtgcggacactgcaagaaacttgcccctgagtatgagaaggctgccaaggagctcagcaagcgctctcccccaattcccttagccaaagttgatgccaccgaacagacagacctggctaagaggtttgatgtctctggctaccccactttgaaaatattccgcaaaggaaggccttttgactacaatggtccacgagagaaatatggaattgttgactacatggttgagcagtctggacctccttccaaggagattctgaccctgaagcaggtccaggagtttctgaaggatggagatgatgtagtcatccttggagtctttcagggagtcggtgacccaggctacttgcagtatcaggatgctgctaacaccctgagagaagattacaaatttcaccacactttcagcactgaaatagctaagttcctgaaagtctccctggggaaactggtgctgatgcagcctgagaagttccagtccaagtatgagcccaggatgcatgtgatggatgttcagggctccacagaggcatcagccattaaggactatgtggtgaaacatgacttgcccctagtgggccacaggaagacttctaacgatgctaagcggtacagcaagcgccccctggtggttgtatactacagcgtggacttcagctttgattacagaactgctactcagttttggcgtaacaaagtcctagaggtggccaaggacttccctgagtacacattcgccattgctgatgaagaagactatgccacagaggtgaaggacctgggactgagtgagagtggagaggacgtcaatgcagccatcctagatgagagtgggaagaagtttgccatggagccagaggagtttgattcagatgctctccgagaatttgtcatggctttcaaaaaaggaaaactaaagccagttatcaaatcacagccagttcccaagaacaacaagggaccagtcagggtggtagtggggaagacctttgatgccattgtgatggaccccaaaaaggacgtcctcattgaattctatgcaccgtggtgtgggcactgcaagcagctggagcctgtctacaccagcctaggcaagaagtacaagggccagaaggacttggtcatcgccaagatggatgctactgccaatgacatcaccaacgaccgatacaaggtggagggcttccccaccatctattttgcccccagtggggacaaaaagaacccaattaagtttgagggtggcaacagagatctggagcatttgagcaagtttatcgatgaacatgccacaaagaggagcaggaccaaggaagagctttaaggcctggctgtgtgcagaaggtggagggatcagacactgtagtggacagctttggccaccaagcaagcaagccgtcattgaatggcaggatcttgaccctttttttgttatattttattaatgccacctcatgctctgatactgatagcatgatgacttgatagtttagatcagattt

SEQ ID NO: 4069 - DNA, 1082 bp, Rattus norvegicus
  Genbank Accession No. NM_053850
ggtcaacagctaagtgaagccatatccatagagagtttgtgccagtgccccaagatcctgaacctctgtctgtcttcggacactgactgaagagaccgagatggatgccgagccaaagaggaaatttggagtggtagtggttggtgttggcagagctggctcggtgaggctgagggacttgaaggatccacgctctgcagcattcctgaacctgattggatttgtgtccagacgagagcttgggagccttgatgaagtacggcagatttctttggaagatgctctccgaagccaagagattgatgtcgcctatatttgcagtgagagttccagccatgaagactatatacggcagtttctgcaggctggcaagcatgtcctcgtggaataccccatgacactgtcatttgcggcggcccaggagctgtgggagctggccgcacagaaagggagagtcctgcatgaggagcacgtggaactcttgatggaggaattcgaattcctgagaagagaagtgttggggaaagagctactgaaagggtctcttcgcttcacagctagcccactggaagaagagagatttggcttccctgcgttcagcggcatttctcgcctgacctggctggtctccctcttcggggagctttctcttatttctgccaccttggaagagcgaaaagaggatcagtatatgaaaatgaccgtgcagctggagacccagaacaagggtctgctgtcatggattgaagagaaagggcctggcttaaaaagaaacagatatgtaaacttccagttcacttctgggtccctggaggaagtgccaagtgtaggggtcaataagaacattttcctgaaagatcaggatatatttgttcagaagctcttagaccaggtctctgcagaggacctggctgctgagaagaagcgcatcatgcattgcctggggctggccagcgacatccagaagctttgccaccagaagaagtgaagaggaagcttcagagacttctgaagggggccagggtttggtcctatcaaccattcacctttagctcttacaattaaacatgtcagataaacac

SEQ ID NO: 4070 - DNA, 843 bp, Rattus norvegicus
  Genbank Accession No. NM_053857
gggccgaggtgccgcggggttgctggagggtcgtgggcggcgtgcaggagacatgtcggcgggcagcagttgcagccagactcccagccgggctatccccactcgccgcgtagccctcggcgacggcgtgcagctcccgcccggggactacagcaccacccccggcggcacgctcttcagcaccaccccgggaggaaccagaatcatctatgaccggaaattcctgatggagtgtcggaactcgcctgtggccaaaacacccccaaaggacctgccaaccattccaggggtcactagccctaccagcgatgagcctcccatgcaggccagccagagccatctgcacagcagcccggaagataagcgggcaggtggtgaagagtcacagtttgagatggacatttaagggaccagccataggacgcagtgatgcttctgggcccctggggcccttgggaggagagccacagcagtcaggccttgtacccggcagacactgggtgtggatcggccacccagtcctgctcctcactcagggcacctgctctgccttccattttgtgaataccagcacatacctccttgtgcctctgttgatactgagctgctactccagggtaatgactctcacctacaccctccctgcatcaagcgccagcgagtggacacagaggagtctgtcggaatgatctggcaattctagccccaacctctggagcacacccaccttaccttaggttggggtacctgggaaagccaccctttacttctttccctgagaggaaataaaagccacatttaccctaggcccacagccgggccctgtctgaaaaaaaaaaaaaa
